United States Patent 10,975,383 (ISOLATED POLYNUCLEOTIDES, POLYPEPTIDES AND METHODS OF USING SAME FOR INCREASING ABIOTIC STRESS TOLERANCE, BIOMASS AND YIELD OF PLANTS) - sequence listing, part 4

SEQ ID NO: 4659 - DNA, 1709 bp, Leymus cinereus x Leymus triticoides
ctcttcctcgcagaaggggcagcaagtaatccggtcgaattgataggcgagacgaggagcagcgatggccgccgctcgagcccgatggcggtccctcgcgctgcccctggcgctgttcctcgcgatcggctcgtcgcccggcctcgacgcggcgcccaagccccccgtccccaaggccatctccgacctgagggacgcgatcgtgaacgggctgggcttccagtcggacgagctcaaggtgtccgggttcgacgtgagggacgcgctggtggggcacgcggtggcgtacgagttcgacatggaggtcgggaggaaggtcgtgccggtgcggctgctcgaggacgtcaaccgatgggacttcgtcgacctgcccatcttccggtcccaggcagacgccgacgacacggcgctcgccgagatcggacgggggagcttcgacccgacactgccgcccttccagctcgccgggcccatggagctctggatccaggacggcgacgacgtcaggctcgctttgccgcatgatgtggaagctggaaccctgaagaaagttgttcttgctgatggtgcggtggtaacagtgaaaggtgctagggcggtgagcctccgtttgccccttgaactaccacttcctctcaaccgcaccacatacaagggccgcctgtctagcttgctttccattgctcgagccctacgtggtgcagctcggtctaatcagaaacccctgctctccctccggatcgagggtccaacctccttatcctcaacaccttccatgtctccgaatgacaagctcaagctcaaaaggttggccccaggtcaagtggagctctcctcgcgtgcaatccctgctgtcacagacgatgaggatgaatcacctagccctggattgtggcctcttttgtcattgaatgcatcagatggcagcctgcaggggcttgaagaactattggcgaaggttctcggtaagaaggccggtgagaagggcacgttcaagttgttgaacgcacgggcctcggcacaaacatatgtcaaaatgggattcacggtggagaagcggattgctgacggggaggtgaactggtctaacttgcctgagtggaaaacaaagcccaagaagttgagagcgcactatgaagttcttgctcgtgtggagcgtggccaggcgatcccggaaaggatcgcccaggtgcagcctttccaggtcgacgaggccatgtccgagagcatgctcaccggaaacgtgtcgagatcgaagatggaggtggtaaaccccccaccggtttatttcactttgtgagacctggaggggatggaagcttttatttccagagctctacttgggatggtcgaccattgttgctggatgtggcaaaaagtactgatttctgcgttaacatggaacttgtatgttatactggctagctttgtaaattacgggcgcgaacgaggagaccttacagtgaagtgcagcaataagcaaattgtatgtacacagtacacacctcagagcaaagcacaagtgcttagcgcatctccaagagatggtctaaagtggttctccaacagatagtctgagcatctccagtaggtgcccaaaaggcaagatcactttttgggctaaaatagtgctccaatgggtgccctatatgtaaaaaaatcttactccaaatttgcaacaccagcaaaatagggcaccaagtgttgta

SEQ ID NO: 4660 - DNA, 1547 bp, Avena sativa
gaacagttttcagtctcaaaataaatcgagttaaattccgttgcttctctccccatcttcctcgcggaaggagcagcaaatatttggtcgaattgataggggagacgaggaggagcagcgatggccgccggtcgagcccgatggcgattcctcgcgctgcccctggcgctgctcctcgcgatcggctcgtcgcgcggcctggacccggcgcccaagccccccgttcccaaggccatctccgacctgagggacgcgatcgtgaaggggctggggttccagtcggaggagctcaaggtgtccgggttcgacgtgagggacgcgctggtggggcaggcggtggcgtacgagttcgacatggaggtcgggaagaaggttgtgccggtgcgactgctcgaggacgtcagccgatgggacttcgtcgacctgcccatcttccgaacccaggccgacgctgacgacacggcgctcgccgagatcggacggggcgctagagggagtttcgagccgacacttcctcccttccagctcgccgggcccatggagctctggatccaggacggcgacgacgtcaggctcgctttgccgcatgacgtggaagctggaaccctgaagaaagttgttctcgctgatggtgcggtcgtaacagtgaaaggcgctagggcagtgagcctccgtttgcctcttgagttgccacttcctctcaaccgtaccacttacaagggtcgcctgtcaagcttgctttccatcgctcgagccctacgtggtgcagctcggtcgaatcagaaacccctcctctccctgcgaattgagggtccaacatcgttatcctcaactccttccatgtctcccaatgacaagctgaagctcaaaaggttggccccaggtcaagtggagctctcctcgcgtggaatccctgctgtcactgatgacgaggatgaaccacataacgctggattgtggcctctcttgtcattgaatgcatcagagggtagcctgcagggacttgaggatttgttggcgtcagttctcggaaagaaggctggtgagaagggcacgttcaagttgttgaatgcacgggcagcggcacaaacctatgtcaaaatgggcttcacggttgagaagagtgtagctgatggggaggtaaactggtctaatttgcccgagtggaaaacaaaaccgaagaagctgagggcgcactatgaagttcttgcccgtgtggagcgtgggcaggccatccctgaaaggatcgcccaggtgcagcctttccaggtcgaggaggccatgtccgagagcatgctcaccggaaatgtgtcgagatcgaagatggaggtggtcaatccgccaccagtttatttcaccctgtgagacctggaagctcttctttcagagctctacttcaggacggtttgactgttgtagcgggagatggcaaaatggactacaagcggcagaagcttctgtcttgttacggactttctgcgttaacatgaaacttgttgtattttatcctggcttgctttgtaaattaccaacgcgaatgatgagcc

SEQ ID NO: 4661 - DNA, 1376 bp, Avena sativa
gaacagttttcagtctcaaaataaatcgagttaaattccgttgcttctctccccatcttcctcgcggaaggagcagcaaatatttggtcgaattgataggggagacgaggaggagcagcgatggccgccggtcgagcccgatggcgattcctcgcgctgcccctggcgctgctcctcgcgatcggctcgtcgcgcggcctggacccggcgcccaagccccccgttcccaaggccatctccgacctgagggacgcgatcgtgaaggggctggggttccagtcggaggagctcaaggtgtccgggttcgacgtgagggacgcgctggtggggcaggcggtggcgtacgagttcgacatggaggtcgggaagaaggtcgtgccggtgcgactgctcgaggacgtcagccgatgggacttcgtcgacctgcccatcttccgaacccaggcagacgctgacgacacggcgctcgcggagatcggacggggcggtagagggagtttcgagccgacacttcctcccttccagctcgccgggcccatggagctctggatccaggacggcgacgacgtcaggctcgctttgccgcatgacgtggaagctggaaccctgaagaaagttgttctcgctgatggtgcggtcgtaacagtgaaaggcgcaagggcagtgagcctccgtttgccccttgagctgccacttcctctcaaccgtaccacttacaagggtcgcctgtcaagcttgctttccatcgctcgagccctacgtggtgcagctcggtcgaatcagaaacccctcctctccctgcgaattgagggtccaacatcgttatcctcaactccttccatgtctcccaatgacaagctgaagctcaaaaggttggccccaggtcaagtggagctctcctcacgtgcaatccctgctgtcaccgatgacgaggatgaaccacagaacgctggattttggcctctcctgtcattgaatgcatcagatggcagcctgcaggggcttgaggatctgttggcgtcagttctcggaaagaaggcgggtgagaagggcacgttcaagttgttgaacgcacgggccgcggcgcaaacctatgtcaaaatgggcttcacggtagagaagagtgtagctgatggggaggtaaactggtctaatttgcccgagtggaaaacaaaaccgaagaagctgagggcgcactatgaagttcttgcccgtgtggagcgtgggcaggccatccctgaaaggatcgcccaggtgcagcctttccaggtcgaggaggccatgtccgagagcatgctcacaggaaatgtgtcgagatcgaagatggaggcggtcaatccgccaccaatttatttcactctgtgagacctggaggt

SEQ ID NO: 4662 - DNA, 1450 bp, Avena sativa
gaggaggagcagcgatggccgccgctcgagcccgatggcgattcctcgcgctgcccctggcgctgctcctcgcgatcggctcgtcgcgcggcctggacccggcgcccaagccccccgttcccaaggccatctccgacctgagggacgcgatcgtgaaggggctggggttccagtcggaggagctcaaggtgtccgggttcgatgtgagggacgcgctggtggggcaggcggtggcgtacgagttcgacatggaggtcgggaagaaggttgtgccggtgcgactgctcgaggacgtcagccgatgggacttcgtcgacctgcccatcttccgaacccaggcagacgctgacgacacggcgctcgcggagatcggacggggcggtagagggagtttcgagccgacacttcctcccttccagctcgccgggcccatggagctctggatccaggacggcgacgacgtcaggctcgctttgccgcatgacgtggaagctggaaccctgaagaaagttgttctcgctgatggtgcggtcgtaacagtgaaaggcgcaagggcagtgagcctccgtttgcctcttgagttgccacttcctctcaaccgtaccacttacaagggtcgcctgtcaagcttgctttccatcgctcgagccctacgtggtgcagctcggtcgaatcagaaacccctcctctccctgcgaattgagggtccaacatcgttatcctcaactccttccatgtctcccaatgacaagctgaagctcaaaaggttggccccaggtcaagtggagctctcctcacgtgcaatccctgctgtcaccgatgacgaggatgaaccacagaacgctggattttggcctctcctgtcattgaatgcatcagatggcagcctgcaggggcttgaggatctgttggcgtcagttctcggaaagaaggcgggtgagaagggcacgttcaagttgttgaacgcacgggccgcggcgcaaacctatgtcaaaatgggcttcacggtagagaagagtgtagctgatggggaggtaaactggtctaatttgcccgagtggaaaacaaagccgaagaagctgagggcgcactacgaagttcttgcccgtgtggagcgcgggcaggccatccccgaaaggatcgcccaggtgcagcctttctatgccgaggaggccacgtccgagagcatgctcaccggaaatgtgtcgagatcgaagatggaggtggtcaatccgccaccagtttatttcactctgtgagacctggagggtctggaagctcttctttcagagctctacctcaggacggtttgactgttgtagcgggagatggcaaaatggactacaagcggcagaagcttctgtcttgttacagactttctgcgttaacatgaaacttgttgtattttatcctggctagctttgtaaattaccaacgcgaatgatgagcc

SEQ ID NO: 4663 - DNA, 1529 bp, Avena sativa
ctcgcgaaaggagcagcaaatatttggtcgaattgataggagagacgaggaggagcagcgatggccgccgctcgagcccgatggcgattcctcgcgctgcccctggcgctgctcctcgcgatcggctcgtcgcgcggcctggacccggcgcccaagccccccgttcccaaggccatctccgacctgagggacgcgatcgtgaaggggctggggttccagtcggaggagctcaaggtgtccgggttcgatgtgagggacgcgctggtggggcaggcggtggcgtacgagttcgacatggaggtcgggaagaaggtcgtgccggtgcgactgctcgaggacgtcagccgatgggacttcgtcgacctgcccatcttccgaacccaggcagacgctgacgacacggcgctcgcggagatcggacggggcggtagagggagtttcgagccgacacttcctcccttccagctcgccgggcccatggagctctggatccaggacggcgacgacgtcaggctcgctttgccgcatgacgtggaagctggaaccctgaagaaagttgttctcgctgatggtgcggtcgtaacagtgaaaggcgcaagggcagtgagcctccgtttgcctcttgagctgccacttcctctcaaccgtaccacttacaagggtcgcctgtcaagcttgctttccatcgctcgagccctacgtggtgcagctcggtcgaatcagaaacccctcctctccctgcgaattgagggtccaacctcgttatcctcaactccttccatgtctcccaatgacaagctgaagctcaaaaggttggccccaggtcaagtggagctctcctcacgtgcaatccctgctgtcaccgatgacgaagatgaaccacataacgctggattttggcctctcctgtcattgaatgcatcagacggcagcctgcaagggcttgaggatctgttggcgtcagttctcggaaagaaggcgggtgagaagggcacgttcaagttgttgaacgcacgggccgcggcgcaaacctatgtcaaaatgggcttcacggtagagaagagtgtagctgatggggaggtaaactggtctaatttgcccgagtggaaaacaaagccgaagaagctgagggcgcactatgaagttcttgcccgtgtggagcgcgggcaggccatccccgaacggatcgcccaggtgcagcctttctacgccgaggaggccacgtccgagagcatgctcaccggaaatgtgtcgagatcgaagatggaggtgatcaatccgccaccagtttatttcactctgtgagacctggagggtctggaagctcttctttcagagctctacttcaggatggtttgactgttgtagcgggagatggcaaaatggactacaagcggcagaagcttctgtcttgttacggactttctgcgttaacatgaaacttgttgtattttatcctggctagctttgtaaattaccaacgcgaatgatgagcctttttttttgagtatagcgaatgatgagccctt

SEQ ID NO: 4664 - DNA, 1586 bp, Avena sativa
ctcgcgaaaggagcagcaaatatttggtcgaattgataggagagacgaggaggaggagcgatggccgccgctcgagcccgatggcgattcctcgcgctgcccctggcgctgctcctcgcgatcggctcgtcgcgcggcctggacccggcgcccaagccccccgtccccaaggccatctccgacctgagggacgcgatcgtgaaggggctggggttccagtcggaggagctcaaggtgtccgggttcgatgtgagggacgcgctggtggggcaggcggtggcgtacgagttcgacatggaggtcgggaagaaggtcgtgccggtgcgactgctcgaggacgtcagccgatgggacttcgtcgatctgcccatcttccgaacccaggccgacgctgacgacacggcgctcgcggagatcggacggggcggtagagggagtttcgagccgacacttcctcccttccagctcgctgggcccatggagctctggatgcaggacggcgacgacgtcaggctcgctttgccgcatgacgtggaagctggaaccctgaagaaagttgttctcgctgatggtgcggtcgtaacagtgaaaggcgcaagggcagtgagcctccgtttgcctcttgagctgccacttcctctcaaccgtaccacttacaagggtcgcctgtcaagcttgctttccatcgctcgagccctacgtggtgcagctcggtcgaatcagaaacccctcctctccctgcgaattgagggtccaacctcgttatcctcaactccttccatgtctcccaatgacaagctgaagctcaaaaggttggccccaggtcaagtggagctctcctcacgtgcaatccctgctgtcaccgatgacgaagatgaaccacataacgctggattttggcctctcctgtcattgaatgcatcagacggcagcctgcaagggcttgaggatctgttggcgtcagttctcggaaagaaggcgggtgagaagggcacgttcaagttgttgaacgcacgggccgcggcgcaaacctatgtcaaaatgggcttcacggtagagaagagtgtagctgatggggaggtaaactggtctaatttgcccgagtggaaaacaaagccgaagaagctgagggcacactatgaagttcttgcccgtgtggagcgcgggcaggccatccccgaaaggatcgcccaggtgcagcctttctatgccgaggaggccacgtccgagagcatgctcaccggaaatgtgtcgagatcgaagatggaggtggtcaatccgccaccagtttatttcactctgtgagacctggagggtctggaagctcttctttcagagctctacttcaggatggtttgactgttgtagcgggagatggcaaaatggactacaagcggcagaagcttctgtcttgttacggactttctgcgttaacatgaaacttgttgtattttatcctggctagctttgtaaattaccaacgcgaatgatgagcctttttttttgagtatagcgaatgatgagcccttgttcttacagataaagtacataaataagcaaactgtatataaatccttctccagaat

SEQ ID NO: 4665 - DNA, 1656 bp, Brachypodium distachyon
acgtagcgtaacggttcgacgcatccaccttctccagaaagatcaaagatccatcttacgaagttctcttctcctcttccccgcggaaggagcagcaaataatccggttgaaattgagcagcaatggccgccgctcaagcacgatggcgattccttgcgatgcccctggcgctgttcctcgcgatcggctcgtcgaacgcggcgcccaagccccccgtccccaaagccatctccgatcttagggaggcgattgtgaaggggctggggatccagtcggaggagctcagggtgtctgggttcgacgtgcgggacgcgctggtggggcaggcggtggcgtacgagttcgacatggaggtcgggaggaaggccatgccggtgcgtctgctggaggacgtcaaccgatgggacttcgtcgacctgcccatcttccgatcccaggccgacgcagacgacacggcgctcgccgagttcggacggggcgctaggggaagtttcgagcccacactgccgcccttccagctcgccgggcctatggagctgtggatccaggatggcgacgacgtcagactcgctttgccgcatgatgtggacgctggaaccttgaagaaagttgttctcgctgatggtgcagtggtaactgtgaaaggtgctagggcagtgagcctccgtttgccccttgaactaccacttcctctcaatcgtaccacttacaagggccggctttctagcttgctttccattgctcgagccctacgtggtgcagctcggtccaatcagaagcccttgctctccctccggattgagggcccaacctccttatcttcaactccttccatgtctcccaataacaagcttaagctcaaaaggttggccccaggtcaagtggagctctcttcccgtgcaatccctgctgtcaccgaggacgaggatgaatcacatagtacaggattgtggcctctgttgtcactgaatggatcagatagcagtctacaggggcttgaggagctattggcgtcggttctcggtaagaaggcaggcgagaaaggcacgtttaaattgttgaacgcacgggcctcggcacaaacgtatgttaaaatggggttcacagtggagaagagtattgctgatggagaggtcaactggtctgatttccctgagtggaaaacaaagcccaagaagctgagggcgcactatgaagttcttgctcgtgttgagcgcggccaagcgattcctgaaaggattgcccaggtgcagcctttccaggtcgacgaggccatgtccgagagcatgctaaatggaaacgtctcgagatcaaaggtggaggtggttaatccgccaccggtttacttcactctctaagacttggaaaggggctggaagctctttttccgagctctgattgggatggttgattatttggctggagatggtaaaaatgactacaagcagcatatacttctttcttgtatactgctactgactgcgttaacatggaatctgttgtgtgctatactggctggctttgtagtttatccatgtgaataatgagcacttacatatgaaaatgcagcaataagcaagtgtatatatatagtactcggtactttttttttcaaagctggagtgcttagaactccagtagcttttgcaaaacat

SEQ ID NO: 4666 - DNA, 1669 bp, Brachypodium distachyon
acgtagcgtaacggttcgacgcatccaccttctccagaaagatcaaagatccatcttacgaagttctcttctcctcttccccgcggaaggagcagcaaataatccggttgaaattgagcagcaatggccgccgctcaagcacgatggcgattccttgcgatgcccctggcgctgttcctcgcgatcggctcgtcgaacgcggcgcccaagccccccgtccccaaagccatctccgatcttagggaggcgattgtgaaggggctggggatccagtcggaggagctcagggtgtctgggttcgacgtgcgggacgcgctggtggggcaggcggtggcgtacgagttcgacatggaggtcgggaggaaggccatgccggtgcgtctgctggaggacgtcaaccgatgggacttcgtcgacctgcccatcttccgatcccaggccgacgcagacgacacggcgctcgccgagttcggacggggcgctaggggaagtttcgagcccacactgccgcccttccagctcgccgggcctatggagctgtggatccaggatggcgacgacgtcagactcgctttgccgcatgatgtggacgctggaaccttgaagaaagttgttctcgctgatggtgcagtggtaactgtgaaaggtgctagggcagtgagcctccgtttgccccttgaactaccacttcctctcaatcgtaccacttacaagggccggctttctagcttgctttccattgctcgagccctacgtggtgcagctcggtccaatcagaagcccttgctctccctccggattgagggcccaacctccttatcttcaactccttccatgtctcccaataacaagcttaagctcaaaaggttggccccaggtcaagtggagctctcttcccgtgcaatccctgctgtcaccgaggacgaggatgaatcacatagtacaggattgtggcctctgttgtcactgaatggatcagatagcagtctacaggggcttgaggagctattggcgtcggttctcggtaagaaggcaggcgagaaaggcacgtttaaattgttgaacgcacgggcctcggcacaaacgtatgttaaaatggggttcacagtggagaagagtattgctgatggagaggtcaactggtctgatttccctgagtggaaaacaaagcccaagaagctgagggcgcactatgaagttcttgctcgtgttgagcgcggccaagcgattcctgaaaggattgcccaggtgcagcctttccaggtcgacgaggccatgtccgagagcatgctaaatggaaacgtctcgagatcaaaggtggaggtggttaatccgccaccggtttacttcactctctaagacttggaaaggggctggaagctctttttccgagctctgattgggatggttgattatttggctggagatggtaaaaatgactacaagcagcatatacttctttcttgtatactgctactgactgcgttaacatggaatctgttgtgtgctatactggctggctttgtagtttatccatgtgaataatgagcacttacatatgaaaatgcagcaataagcaagtgtatatatatagtactcggtactttttttttcaaagctggagtgcttagaactccagtagcttttgcaaaacatactgaattctgaa

SEQ ID NO: 4667 - DNA, 1588 bp, Oryza sativa
caatctctccgcttccgccgcggtgttcttcctcctctcgcaggagaaaatttcgctggttgaatcggagggaggcagcaatggccgctcgagctcggtggcgaatcctcgcgctgccgctcgctcttctcctagcggtcgggtcgtcgcctggcctcgtgaggcaggcgtcgtcgtcggcggcggccaagcctcccgtccccaaggccatctcggacctgagggaggcgatcgtgaaggggctggggttccagtcggaggagctcaaggtgtccgggttcgacgtgcgcgacgcgctcgtggggcaggcggtggcgtacgagttcgacatcgaggtcgggaggaaggtggtgccggtgcgcctgctcgaggacgtcaaccgatgggacttcgtcgacctgcccatcttccggtcccaggccgacgccgacgacacggcgctcgccgagatccggcgtggcaagagcgggaagcgagccttcgacccgaccctgccaccgttccagctcgccgggcccatggagctctggatccaggacggcgacgacgttaggctcgccttgccgcatgatgtggaagcagggacgctgaagaaagtagtgctatcagatggtgccgtggtaacagtgaagggtgccaaggctgtgagcctccggttgccacttgaattaccgctccctctcaaccgcaccacttacaagggccggttgtcaagcttgatatccattgcgcaaacgctacggggcgccgcccggtcgaaccagaagccgctgctctccctccgcatcgaaggtccgacgtcgttgtcctcgactccttccatgtctcccaatgacaggcttaagctcaaacggttggccccaggccaagtggagctctcctcgcgtgcaatccctgctgttacagacgatgatggtgatggatcacacgcagctggattgtggccccttctgtcactgaatgggtcagatggcagcctgcaggggtttgaggagttgctggcctcggttcttggaaagaaggcaggtgagaaggggacgttcaagctgttgaaggcgcgagcttctgcccaaacgtacgtcaagatggggtttgcggtggagaagaggattgctgacggagaggtgaactggtccaacttcccggagtggaagacgaagcccaagaagttgagggcgcactacgaggttcttgctcgtgtggagggtggccaggcgatccctgaaaggatcgcgcaggtgcagccttttgaggccgacgaggccatgtcagagagcgtgctcaccgggaatgtgtcgatgtcgaagacggaggtggttcatccgccgccggtttacttcactctttgagagcagttgaagctccggttttaagtgagctgatcacggtagatgacaagcggcgaaagtttcttggcggcgagtattattaactgcattagcatgaaaaattgttgtacggggtatgttatactggccagctttgtaaattaccaaactgaataatgaatgaacgaaccattacaggaaaaggattcatccataggcaattgtatatctttttgaaaccaagagtgccaacttttcag

SEQ ID NO: 4668 - DNA, 1887 bp, Panicum virgatum
cggggaacaacttgcggccgctagcgtgaccgagcagccagcacccagcaggtgccgctgcacatggtacggtgacccgccgccacccaacgccgtccacgcaatcttttgctagctcctcattggtcggctacacgtgttccttgtcatcgacccacgaaggaggcacggccaaagaaccagttttcccgatttccaaaaaaaaagaaacaagtccagcctctggagaattccaccctaaaaaaagggcgtagcaaatccaactcctcctgcctctcctctcgccggaaggagcaggagaagggaaatccgggctgcatcgatcggagtggagggctcagcagccatggccgctcgagctcgatggcgactcctcgcgctgccactcgccctgttcctcgtggccggctcggcgcgcggcctcgcgaagccggaggacacggcggcgcccaagccccccgtgccgaaggccatctcggacctaagggatgcgatcgtgaaggggctggggttccaggcggaggggctcaaggtgtccgggttcgacgtgcgggacgcgctggtggggcacgcggtgtcgtacgagttcggcatcgaggtcggcaggaaggtcctgcccgtgcgcctgctcgaggacgtcaaccgctgggacttcgtcgacctccccatcttccgctcccaggccgacgccgacgacacggcgctcgccgagatctggagggcggggaaagggagcatcgtcgagcccaccctgccgcccttccagctcgccgggcccatggagctctggatccaggacggcgacgatgtcaggctcgccttgccgcatgacgtggacgctggaacactgaagaaagttgttctgtctgatggtgcagtggtaacagtgaagggcgccagggctgtgagcctccggttgccacttgaactaccacttccactcaaccgtacgacttataagggccgcctctcgagcctactatctattgcacaagccctacgtggtgcagcccggtctaaccagaagcccctgctctctcttcgcattgagggcccaacctctttatcctcgactccttccatgtctccgaaagacaagctcaagctcaaacgattggccccgggtcaagtggagctctcctcacgggcaggggcaatccctgctgccactgaagacggggatgaatcaccgaacaccgaattgtggcctctcttgtcactgaacggatcagatggtagcctacagggatttgaggagcttttggcctcggtccttggaaaaaaggcaggcgagaaggggacattcaagctgctgaaggcgcgggcctccgcgcaaacttacgtcaaaatggcgttcgcagtggagaagaagctcgctgaaggagaggtgaattggtccaactttccggagtggaagacgaaacccaagaagctgagagcacactatgaggtccttgctcgagtggagggcggccaggcgatccccgagaggattgcgcaggtgcagcctttccaggctgacgaggccacggccgagagtgtactcaccggcaatgtcacgaggtcgaagatggagattatccatccgccgccggtttacttcactctatgaaaggcggaggagcttgaggttgttttctctctttagagctacacgccgttgagaaaaagcttcacaagcgccaagaagtttgtggcctattgttactgactgtttcaggaatactgatcggctttgtataaatatatgtatatcaactcgaataacgagcgagacaaaagaaaagtttggaacacaagtagttagcaattgtgcatgtttggagacgcaacagaccaacagcgcgaagttgtttagtgcctctcttgttgcgcataacttgcgag

SEQ ID NO: 4669 - DNA, 1914 bp, Sorghum bicolor
tttttatatagccccgtagcaaatccaattcgtctccccctcgccggaggagaacagaaacgataatacggttaatccatagcgaagaagggcagcaccaccagtagcagcagccatgcccgctcgcgctcgatggcgactcctcgcgctgccgctcgcgctcttcctcgtggcggggtcggcgcatggcctcgtgaagccggaggccgccgcgacgcccaagccccccgtccccaaggccatctcggacctgagggacgcgatcgtgaaagggctggggttccaggccgaggggctgaaggtgtccggattcgacgtgcgggacgcgctggtggggcacgcggtggcgtacgagttcgacatcgaggtcggcaggaaggtcctgccggtgcgcctgctggaggacgtcagccggtgggacttcgtcgacctccccatcttccgttcccaggccgacgccgacgacacggcgctcgccgagatcaggcggggcgggaggggcagcgtcgtcgaacctaccctgccgcccttccagctcgccgggcccatggagctctggatccagaacggcgacgacgtcaggcttgccttgccgcatgatgtggacgctggtaccttgaagaaggttgttctgtctgatggtgcagtcgtaacagtgaagggtgccagggctgtgagcctccggttgccacttgaactgccacttcctctcaaccgtactacttacaagggtcgcctctcgagcctactatccattgcacaagccctgcgtggtgcagcccggtctaatcagaaacccctgctttctcttcgcattgagggcccaacctccttgtcctcaactccttccatgtctcccaaggacaagctcaagctcaaacggttggccccaggccaagtggagctctcctcacgggcggggccaatccctgctatcgctgaagatgacgatgaaccacatagctctggattgtggcctcttttgtctctgaatggatcagatggcagtctgcaggggtttgaggagctattggcctcagtacttggaaagaaagcaggcgagaagggtaccttcaagctactgaaggcacgggcctcggctcaaacctatgtcaagatggcattcatggtggagaagaagcttgttgaaggggaggtgaactggtcaaatattccggaatggaagacgaagcccaagaggctgagagcacactatgaagtccttgctcgagtggaggagggtcaggcgatccctgagaggatcgcgcaggtgcagcctttccaggccgacgaggccatgtccgagagtgtgctcaccggcaacgtcacaaggtcgaagatggaaatcgtccatccaccgcctgtttatttcactctctgatggaagagctggagcctggaggctgttttgatgttttctcttcagagctactacacgttgggtggtggttagtttacggtgcctcgtaggtaacaaagtcatacaagcggcaagagtttgttgcctatacactgactgcttcgacataaatattggcattttatgtgtactgacagactgccaagccttgtatattatcgactggaataatgagcaatacagaaaaaaatgttttcagtacacttttggatgggaaagagccgagttcttagtactgaaaaactggctaaccttgtccttgtatatcaactggaacttgttggtttaattgttctgacagtgatgcaatgtcgtgaagatttttgtagaatcataccgagatgtcttgtgcggttgtgattttcttagaatcactagggctcatttggatcatctcgggctcgggctcgggctcgggctcagttggtctaatgctctaatgtaagatgagccaaaatttacagctaattttagactacttgtttggattttta

SEQ ID NO: 4670 - DNA, 1676 bp, Setaria italica
cctaaaaaaagccgtagcaaatccaactcctctcggcctcacgccggaagaaacatcagcagggaaggggggaattcgggctgaatcgatcggagtgaagggcaagttttcagcagccatggccgctcgagctcgatggcgactcctcgcgttgccgctggcgctgttcctcgtggccggctcggcgcgcggcctcgtgaagccggaggccgcggccgcgcccaagccccccgtcccgaaggccatctcggacctgagggacgcgatcgtgaaggggctggggttccaggcggaggggctcaaggtgtccgggttcgacgtgcgggatgcgctggtggggcacgcggtatcgtacgagtttgacatcgaggtcggcaggaaggtcctgccggtgcgcctgctcgaggacgtcaaacgctgggacttcgtcgacctccccatcttccgctcccaggcagacgccgacgacacggcgcttgccgagatctggcgggcagggaaagggagcgtcgtcgagcccaccctgccgccattccagctcgccgggcccatggagctctggatccaggacggcgacgatgtcaggctcgcattaccgcatgatgtggatgcgggaaccttgaagaaagttgttctgtctgatggtgcagtggtaacagtgaagggtgccagggctgtgagcctccggttgccacttgaactaccgcttcctctcaaccggaccacttacaagggccgcccctctagcttactgtccattgcacaagccctacgtggtgcagcccggtctaatcagaagcccctgctctctcttcgcatcgagggcccaacctccttatcctctactccttccaagtctccgaacgacaagctcaagctcaaaaggttggccccaggccaagtggagctctcctcacgggcagggacaatccctgctgtcactgaagacgaggatgaaccacacaataccgcattgtggcctctcttgtcactgaacggatcagatggtagcctgcagggatttgaggagcttttggcctcggtccttggaaagaaagcaggcgagaatgggacattcaagctggtgaaggcgcgagcctccgcgcaaacctatgtcaagatggcattcgcggtggagaagaagcttgttaagggagagacggactggtccaacttcccggagtggaagacgaagcccaagaatctgagagcgcactatgaggtccttgctcgagtggagggcagccaggcgatccccgagaggatcgcgcaggtgcagcctttccaggccgacgaggccatgtcggaaagtgtgctcactggcaacgtcacgaggtcgaagatggagattgtccatccgccgccggtttacttcactctatgaaagccggaagagctggagactgttttatctcttcagagctgcacgccgtcgagaaaagctttacaagcggcaagaagtttattgcctattgctgctgactgttaacatgagaagtgtcgttgtatgttacaggaatactggctagctttgtaaaaatatcaatcaactccaataacgagccagacaaaaggagaatcttgtacgagtagttagcaattgtacatttttgaacgcaacagttcgtgattctttagtttgtagtgcctctcagaacttgagagttcgttctgtg

SEQ ID NO: 4671 - DNA, 1679 bp, Setaria italica
cctaaaaaaagccgtagcaaatccaactcctctcggcctcacgccggaagaaacatcagcagggaaggggggaattcgggctgaatcgatcggagtgaagggcaagttttcagcagccatggccgctcgagctcgatggcgactcctcgcgttgccgctggcgctgttcctcgtggccggctcggcgcgcggcctcgtgaagccggaggccgcggccgcgcccaagccccccgtcccgaaggccatctcggacctgagggacgcgatcgtgaaggggctggggttccaggcggaggggctcaaggtgtccgggttcgacgtgcgggatgcgctggtggggcacgcggtatcgtacgagtttgacatcgaggtcggcaggaaggtcctgccggtgcgcctgctcgaggacgtcaaacgctgggacttcgtcgacctccccatcttccgctcccaggcagacgccgacgacacggcgcttgccgagatctggcgggcagggaaagggagcgtcgtcgagcccaccctgccgccattccagctcgccgggcccatggagctctggatccaggacggcgacgatgtcaggctcgcattaccgcatgatgtggatgcgggaaccttgaagaaagttgttctgtctgatggtgcagtggtaacagtgaagggtgccagggctgtgagcctccggttgccacttgaactaccgcttcctctcaaccggaccacttacaagggccgcccctctagcttactgtccattgcacaagccctacgtggtgcagcccggtctaatcagaagcccctgctctctcttcgcatcgagggcccaacctccttatcctctactccttccaagtctccgaacgacaagctcaagctcaaaaggttggccccaggccaagtggagctctcctcacgggcagggacaatccctgctgtcactgaagacgaggatgaaccacacaataccgcattgtggcctctcttgtcactgaacggatcagatggtagcctgcagggatttgaggagcttttggcctcggtccttggaaagaaagcaggcgagaatgggacattcaagctggtgaaggcgcgagcctccgcgcaaacctatgtcaagatggcattcgcggtggagaagaagcttgttaagggagagacggactggtccaacttcccggagtggaagacgaagcccaagaatctgagagcgcactatgaggtccttgctcgagtggagggcagccaggcgatccccgagaggatcgcgcaggtgcagcctttccaggccgacgaggccatgtcggaaagtgtgctcactggcaacgtcacgaggtcgaagatggagattgtccatccgccgccggtttacttcactctatgaaagccggaagagctggagactgttttatctcttcagagctgcacgccgtcgagaaaagctttacaagcggcaagaagtttattgcctattgctgctgactgttaacatgagaagtgtcgttgtatgttacaggaatactggctagctttgtaaaaatatcaatcaactccaataacgagccagacaaaaggagaatcttgtacgagtagttagcaattgtacatttttgaacgcaacagttcgtgattctttagtttgtagtgcctctcagaacttgagagttcgttctgtgcat

SEQ ID NO: 4672 - DNA, 1720 bp, Zea mays
gtcaggcactcaggctcacagacgcgaaggaacaccgcccaaccagaaaccgtttccaaaatgcaaaactcgactccacgcgtcgcccttcttctccggagagatcgttttaatagccccgtaccaaatccaattcgtctctcctcaccggagaacagaaacgatacggttaatagatagcgaagaagggcagcaccaccagtagcagcagccatgcccgctcgcgctcgatggcgactcctcgcgctgccgctcgcgctcttactcgttgccgggtcggcgcatggcctcgtgaagccggaggcagccgcggcgcccaagccccccgtccccaaggccatatcggacctgagggacgcgatcgtgaaggggctgggattccaggccgaggggctcaaggtgtccgggttcgacgtgcgagacgcgctcgtggggcacgcggtggcgtacgagttcgacatcgaggtcggcaggaaggtcctaccggtgcgcctgctggaggacgtcagccggtgggacttcgtcgacctccccatcttccgttcccaggccgacgctgacgatacggcgctcgccgagatccggcggaccgggacggggagcatcgttgagcctaccctgccgcccttccagctcgccgggcccatggagctctggatccagaacggcgacgacgtcaggcttgccttgccgcatgatgtggacgctggtaccttgaagaaggttgttctttctgatggtgcagtcgtaacagtgaagggtgctagagctgtgagcctccggttgccgcttgaattaccacttcctctcaaccgtaccacttacaagggtcgcctctcaagcctgatatccatcgcacaagccctgcgtggtgcagcccggtctaatcagaaacccctgctctctcttcgcgttgagggtccagtttccttgtcctcgactccttccatgtctcccaaggacaagctcaagctcaaacggttggccccaggccaagtggagctctcctcacaggcgggggcaatccctgctatcaccgaagacgaggatgaaccacataaccctggattgtggcctcttttgtctctgaatggttcagatggcagcctgcaggggtttgaggagctattggcctcagtacttggaaagaaggcaggcgagaagggtaccttcaagctactgaaggcacgggcctcggctcaaacctatgtcaagatggcattcacggtggagaagaagcttgctgaaggggatgtgaactggtcaaatattccagaatggaagacgaagcccaagaggatgagagcgcactatgaagtccttgctcgagtggaggagggtcaggcgatccctgagaggatagcgcaggtacagcctttccaggccaacgaggccatgtcggagagtgtgctcaccggcaacgtcacgaggtcgaagatggaaatcgtccatccaccgccggtttacttcactctctgagtgagggaagaactggatgctgtttgatgttctcttcagagctactacacgttgggtggtgggtagtttacgctggctcgtaggcaacaaagttgtacaagcggcaagagtttgttgcctatacactgactgcgttgacatgaatattgacgttctatgtgtactgaaaggctggcaagcctttaatattatcaattggaataatgaggaataagaaaattctgtacatctttagagggcc

SEQ ID NO: 4673 - DNA, 1907 bp, Panicum virgatum
acaaggctcgagggatcgttattagccgcgtcgaaaattttcgagcctaaaaaaagggcgtagcaaatgcaactcctctccctctcgtctcgccggaagaaacagcagcaggagaagggaaatcagggttgaatcgatcggagtggagggcagcttcccagcagccatggccgctcgagctcgagggcggctcctcgcgctgtttctcgttgccggctcggcgcgcggcctcgcgaagccggaggccgcggcggcgcccaagccccccgtgccgaaggccatctcggacctaagggacgcgatcgtcaaggggctggggttccaggcggaggggctcaaggtgtccgggttcgacgtgcgggacgcgctggtggggcacgcggtgtcgtacgagttcgacatcgaggtcggcaggaaggtcctgccggtgcgcctgctcgaggacgtcaaccgctgggacttcgtcgacctccccatcttccgctcccaggccgacgccgacgacacggcgctcgccgagatctggagggcggggaaagggagcatcgtcgagcccaccctgccgcccttccagctcgccgggcccatggagctctggatccaggacggcgacgatgtcaggctcgccttgccgcatgacgtggacgcgggaacactgaagaaagttgttctgtctgacggtgcggtggtaacagtgaagggtgccagggctgtgagcctccggttgccacttgaactaccacttccgctcaaccgtacgacttacaagggccgcctctcgagcctactatctattgcacaagccctacgtggtgcagcccggtctaaccagaagcccctgctctctcttcgtattgagggcccaacctctttatcctcgactccttccatgtctccgaaagacaagctgaagctcaaacgattggccccgggccaagtggagctctcttcacgggcaggggcaatccctgcagccactgaagacggggatgaatcacccaacactgaattgtggcctctcttgtcactgaacggatcagatggtagcctacagggatttgaggagctgttggcctcggtccttggaaagaaagcaggcgagaaggggacattcaagctgctgaaggcgcgagcctcggcgcaaacttatgtcaaaatggcgttcgcagtggagaagaagctcgctgagggagaggtgaattggtccaactttccggagtggaagacgaagcccaagaagctgagagcacactatgaggtccttgctcgagtggagggtggccaggcgatccccgagaggatcgcgcaggtgcagcctttccaggctgacgaggccacggccgagagtgtactcaccggcaatgtcacgaggtcgaagatggagattatccatccgccgccggtttacttcactctatgaaaggcagaggagcttgaggttgttttctctcttcagagctacacgccgttgagaaaaagcttcacaggcgacaagaagtttgtggcctattgttactgactgtttcaggaatactggtaagctttgtataaatatcaactcgaataacgagcgagacgaaagaaaagtttggaatacaagtagttagcatttgtgcatgtttggagaagcaacagaccagcaacgcgaagttgtatagtgcctctcttgttgtgcataccttgcgattgcgagcttgttctgtccactgtcgccccaatttgtcggatggtgctattgaagcgatgttggcctttttttcatttttatattaaaaaaaacaaaatttcaaaaatatatgccgaatagggaaattttcaaaaatgggtgtgggcgacagggtgcctgtcgcccatccagttggcggcaggacctaaatataaaaaaaatttacatttaggtcctggcg

SEQ ID NO: 4674 - DNA, 1312 bp, Avena sativa
gcgatcgtgaaggggctggggttccagtcggaggagctcatggtgtccgggtttgatgtgagggatgcgctggtggggcaggcggtggcgtacgagttcgacatggaggtcgggaagaaggtcgtgccggtgcgactgctcgaggacgtcagccgatgggacttcgtcgacctgcccatcttccgaacccaggccgacgctgacgacacggcgctcgcagagatcggacggggcgctagagggagtttcgagccgacacttcctcccttccagctcgccgggcccatggagctctggatccaggacggcgacgacgtcaggctcgctttgccgcatgacgtggaagctggaaccctgaagaaagttgttctcgctgatggtgcggtcgtaacagtgaaaggcgcaagggcagtgagcctccgtttgcctcttgagttgccacttcctctcaaccgtaccacttacaagggtcgcctgtcaagcttgctttccatcgctcgagccctacgtggtgcagctcggtcgaatcagaaacccctcctctccctgcgaattgagggtccaacatcgttatcctcaactccttccatgtctcccaatgacaagctgaagctcaaaaggttggccccgggtcaagtagagctctcctcacgtgcaatccctgctgtcaccgatgacgaggatgaaccacagaacgctggattttggcctctcctgtcattgaatgcatcagacggcagcctgcaggggcttgaggatctgttggcgtcagttctcggaaagaaggcgggtgagaagggcacgttcaagttgttgaacgcacgggccgcggcgcaaacctatgtcaaaatgggcttcacggtagagaagagtgtagctgatggggaggtaaactggtctaatttgcccgagtggaaaacaaagccgaagaagctgagggcgcactatgaagttcttgcccgtgtggagcgtgggcaggccatccctgaaaggatcgcccaggtgcagcctttctatgccgaggaggccacgtccgagagcatgctcaccggaaatgtgtcgagatcaaagatggaggtggtcaatccaccaccagtttatttcactctgtgagacctggagggtctggaagctcttctttcagagctctacttcaggacggtttgactgttgtagcgggagatggcaaaatggactacaagcggcagaagcttctgtcttgttacggactttctgcgttaacatgaaacttgttgtattttatcctggcttgctttgtaaattaccaacgcgaatgatgagcccttgttat

SEQ ID NO: 4675 - DNA, 1378 bp, Echinochloa colona
ggccgcggcggcgcccaaggcccccgtgccgaaggccatctcggacctgagggacgcgatcgtcaaggggctggggttccaggcggaggggctcaaggtgtccgggatcgacgtgcgggacgcgctggtggggcacgcggtgtcgtacgagttcgacatcgaggtcggcaggaaggtcctgccggtgcgcctgctcgaggacgtcaagcgctgggacttcgtcgacctccccatcttccgctcccaggccgacgccgacgacacggcgctcgccgagatctggcgggcagggaaggggagcgtcgtcgagcccaacctgccgcccttccagctcgccgggcccatggagctctggatccaggacggcgacgatgtcaggcttgccttgccgcatgatgtggatgcgggaaccctgaagaaagttgttctctctgatggtgcagtggtaacagtgaagggtgccagggctgtgagccttcggttgccacttgaactacctctgcctctcaatcgtaccacttacaagggccgcctctcgagcctactatccattgcacaagctttacgtggtgcagcccggtctaatcagaagcccctgctatctcttcgaatcgagggcccggcctccttatcctcgactccttccaagtctcccaatgacaagctcaagctcaaacggttggccccaggccaagtggagctctcctcacgggcaggaacaatccctgctgttgctgaagacgatgatgaaccacacaacaccggattgtggcctctcttgtcactgaatggatcagatggtagcctgcagggatttgaggagctgttggcctcggtcctcggaaagaaagcaggcgagaaggggacattcaagctgctgaaggcgcgagcctcagcccaaacctatgtcaagatggcattcgcagtggagaagaaacttgctgagggagaggcgaactggtccaacttccctgagtggaagacgaagcccaagaagctgagagcacactatgaggtccttgctcgagtggagggtggccaggcgatccccgagagaatagcgcaggtgcagcctttccaggccgacgaggccatgtcggagagtgcgctcaccggtaacgtcacgaggtcgaagatggagattgtccatcctccgccggtttacttcgctctatgaaagcctgaagagctggaggctgtttttatcctatcccttcagagccatacgccgatgagaaaagccttatacaagagccaagaagctttattgcctattgctactgactgttaacatgaaaaatgtcgttgtatgttaaaggaatgccgaatgctggtagatttgtatatcaactcgaataatgagccagacaaaagaaaa

SEQ ID NO: 4676 - DNA, 1338 bp, Secale cereale
gagcgtcaaggtgccgggtttgacgtgagggacgcgctggtggggcgacgcggtggcgtacgagttcgacatggaggtcgggaggaaggtcgtgccggtgcggctgctcgaggacgtcaaccggtgggacttcgtcgacctgcccatcttccggtcccaggccgacgccgacgacacggcgctcgccgagatcggacgcgggagcttcgaccccacactgccgcccttccagctcgccgggcccatggagctctggatccaggacggcgacgacgtcaggctcgctttgccgcatgatgtggaagctggaaccctgaagaaagttgttcttgctgatggtgcggtggtaacagtgaaaggtgctagggcggtgagcctccgtttgcccctcgaactaccacttcctctcaaccgcaccacatacaagggccgcctgtctagcttgctttccattgctcgagccctacgcggtgcagctcggtctaatcagaaacccctgatgtccctccggatcgagggtccaacctccttatcctcaaccccttccatgtctccgaatgacaagctcaagctcaaaaggttggctccaggtcaagtggagctctcctcgcgtgcgatccctgctgtcacagacgatgaggatgaatcacctagccccggattgtggccctttttgtcattgaatgcatcagatgggagcctgcaggggcttgaagaactactggcgaagtttttgggtaagaaggcgggtgagaagggcacgttcaagttggtgaatgcacgggcctcagcacaaacatatgtcaaaatgggattcacggtggagaagcggattgctgatggagaggtgaattggtctaacttgcctgagtggaaaacaaagcccaagaagttgagagcgcactatgaagttcttgctcgcgtggagcgtggccaggcgatcccggaaaggatcgcccaggtgcagcctttccaggtcgacgaggccatgtccgagagcatgctcaccggaaacgtgtcgaggtcgaagatggaggtggtaaaccccccgccagtatttttcactttgtgagactgggaggggctggaagctttttatttccaaagctctacttgggatgaatgtggcaaaaagtactgatttctgagttagcatggaacttcttgtgtgttatactggctagctttgtaaattacgggcgcgaacaatgaggccttatagtgaagtgcagcaataagcaaattgtatgtacacagtacacatctcaaagcaaagcaaagcaaaagcgctcagagcatgggatggccgttttggctctgggcaaccccaaaaaagtc

SEQ ID NO: 4677 - DNA, 1633 bp, Secale cereale
gactcgcgagtcaacctctcctctctgcctctctcgtggggatctcgcgcgctcctcccgggatcaggcgccggcggccggagggataaagatacggacatggaggcggtcgcggcggccggtggcgccgggctgaccgggtggcaggcggcggcgctgtcgggcgcggcgggctgggtgtgggcggcctcctactacgacctcacgcgccgggcgcgcgcgctggcgcagccctgggtcacccgccgcgtccacgccgagacgccctccatcctcaccttccagaggctgcagcacaggttgctggacaacttcttctcggtgctgtcatgcgttgtctctgtccctttctacacgggattcctccccctcctcttctggagtggacatggcaagctggccaggcaaatgaccctgctgctggccttctgcgattaccttggcaacgctgtcaaggatttagtgtcggctcctcgcccgtgttcccctcccgtgaggagagtcacagccaccgaagatgagaaggaaaatgccatggaatatgggctgccttcatcgcacgctctcaacaccgtttgtttgatggggtacatgttgcattatgtcctcacatatggaccgtgtgatggtttcacgattgccacgggtctttctctagctctcatgctcgttacgttaattggcattgcgagggtatacttgggcatgcacagcttgaccgatgttatcgctgggatctcttttggcatcgtgatccttgcattctggttggttgtccatgatcatgttgatgcctttgtcgtctctggccaaaatgttacattcttctgggcaagcctttctctagtgctctgctttgcatatccaaggccagagttcccaactcctagctttgaattccacacagcattcaacggggtcgctttcggaattgtctatggcgtccagcagacctacactcgtttccacggccccgacgcgcccctcattctcagccatgaactacccctcctcgggtacgccgggagggtcctggtgggcatcccaaccatcttggccgtgaagtcgtgcagcaaggcactgtcgaaatggctcctgccggtcatgtgcagcaccctggggatcccgatcgtctcgtcctgctacgtgcccgcgctgaagccatccgacattggcggtggctcgggcaacaaggatgaggccaagcaggccggcgggtacctccagcgggtcttctccctcttccctcagaaggcgtatgacgtggacacgggcatccggtttgtgcagtacgccgggctcgcgtggtcggtggtggacctggtgccggtgatcttcacgcatctgaacctgtgaggccgatcgaattagcgaatataaggttagcatcatttcgtttatttcttgggaggacggctgatgatccatcctcctgtcctccatctctctcaggcaggcaggctgtagatccattggcctgggcctcatttttgtgttgtatgtttgtctagcacgtcctctagtggggtgttttctttgtgtacagttgtccaaagtagcaacgaggaaagtatacacgtgatggccttgtttttgtttgattgatgggaacggctactgactgtcatgtgcg

SEQ ID NO: 4678 - DNA, 1914 bp, Hordeum vulgare
ccgcgtggtggtgccagactcctctccggtccggtccagagcgggggaggccggcagaccgccacgacccgaaccaccccctcccgtcgccgtccccggccccggccacctgcccgcgccctccaccgctcctcctacaagaactcccctcgcctgcctgcgctgccagcctgcgccgtgcgagtcaacctctcctctcctctccatccctcctggggatctcgcgcgctccttccggaatcaggcgccggcggttgacatggacgtggaggcggtcgctgcggccggtggcgccgggctgaccgggtggcaggcggcggcgctgtcgggcgcggcgggctgggtgtgggcggcctcccactacgacctcacgcgccgggcgcgcgcgctggcgcagccctgggtcacccgccgcgtccacgccgagacgcccgacatcatcaccttccagaggctgcagcacaggttgctggacaacttcttctcggtgctgtcatgcgttgtctctgtccctttctacacgggattcctcccgctcctcttctggagtggacatggcaagttggctaggcaaatgaccctgctgctggcattctgcgattacctgggcaacgctgtcaaggatctagtgtcagctcctcggccgtgctcccctcctgtgaggagagtcacagctaccgaagatgagaaggaaaatgccatggaatatggactgccttcgtcacacgccctcaataccgtttgtttgatgggatatatgttgcactatgtcctcacatatggaccatgtaatggttttatgattgccacgggtctttctctagctttcttgctcgttacgttaattggcattgcgagggtatacctaggcatgcacagcttgaccgatgttatcgctgggatctcttttggcatcgtgatccttgcattctggttggttgtccatgatcatgttgatgcctttgtcgtctctggccaaaacgttacattcttctgggcaagccttgccctagtgctctgctttgcatatccaaagccagagttcccaactcctagctttgaattccacacagcattcaacggggtcgctttcggaattgtctatggcgtccagcagacatacacccgtttccacggccccgacgcgcccctcattctgagccatcaactacctctcctcgcgtacgccgggagggtcctggtgggcatcccgaccatcctagccgtgaagtcctgcagcaaggcgctctcgaaatggctcctgccggtcatgtgcagtaccctggggatcccgatcgtctcgtcctgctacgtgcccactctgaagccgtcaaacagcagctcgggcaacaagccggacgatgcaaagctggccggcgggtacctccagagggtgttctccctcttcccgcagaaggcatacgacgtggacacgggcatcaggttcgtgcagtacgccgggctcgcgtggtcggtggtcgacctggtgccggtgatcttcacgcacctcaacctgtgaagccgatcgaattagcggatcaaggttagcggcattttgttcatttcttgggaggacggctgatgatccctcctccatgtgtagcaggcaggctgtggatccattgacctcggcctcatttttgtgttgtatgtttgtctgtctagcacgtcctctacgggggtgttttctcttttgtacagttgtccagagtagcaacgagggaagtgtacacgtgttgacctgtatttttgcttgatgatgggtacagttactgactgactgccatgtgcgccattagtgcttagaactgaatcctgactccagatataactgcagcaaatacagagtatgcttccttatcgcgaaaatgccttttggagctcggcctccttatcgtcttttcattcttatat

SEQ ID NO: 4679 - DNA, 1767 bp, Brachypodium distachyon
tttcggtccagcacggggggcggccggcaaaccgcgagaaaccaagccaccctcctcctcccgtccccgtccgtcctcggccccggcccgccggccgccgccaccagcgccttctacccttcctacaagaaacccccgcgcggctgcgtttgccgcgagtcctttctctatctcttctctcgtggggatctcgtgtggtcaaggacgagagctccgggaactaggcggccggatcagggggagatatggaggccgctgcggctgccggtgctgccgggctgaccaggtggcaggcggcggcgctgtcggcggtggcggggtgggtgtgggccgcctcgtacttcgacctcacgcggcgagcgcgcgcgctgacgcagccgtgggtcacccgccgtgtgcacgccgagacaccgtcgatcctcaggttccagaggacgcagcacaggttgctagacaatttcttctccgtgctgtcatgcgttgtctctgtccctttctacacgggattcctccctctcctcttctggagtggacacggcaagctggccagacaaatgaccctcctgatggctttctgtgattaccttggcaacgctgtgaaggacttagtgtcagctcctcggccatgctctcctcctgtcagaagagtcacagccactgaagatgagaaggaaaatgccatggaatatggattaccttcatctcacgctctcaataccgtttgtttgatgggatatatactccactatgtcctgacatatggaccgtgtagtgcttttatggtcgctacatgtttatctctagctctcttgcttgttatgctaattggcattgcgaggatatacttgggcatgcacagcttgaccgacgtcatcgctgggatctgttttggcactgtgatccttgcgttctggttggttgttgatgatcatgtagacgcctttgttgtctctgggcaaaatgttacattcttctgggcaagcctttctctattgatgtgctttgcatatccaaagccagaatttccaactcctagctttgaataccacacggcattcaatggcgttgctttcggaattgtctatggcatccagcaaacctacttccatttccacaacccaaatgtccccctcattttcagccagcagctacctcttcttgcatacatcgggagggtcctggtagggatcccaaccatcctggccgtgaaatcctgcagcaaagcgctctcgaaatggcttctaccggtcatgtgcaacaccttgggcattcccatcgtctcgtcctgctatgtcccggcactgaaggtgaccaacagcaactcgagcaaatccgacgccaagcaggccggttacctccagagagtcttctccctcttcccgcagaaggcgtacgacgtggacactggcataaggttcgtgcagtatgccgggctcgcgtggtcggtggtcgacttggtgccggccatattcactcatctgaatctgtagcggaacccctacaatttttttgtgtgtttcgttcttcagagggtaaatgggtaatccgtccctactcgcagggcattgtcttgtgaggctgtaaatccattgatctcgaccttcttttttgtattgtatgtatgtttttggcttagcacgtcctccatagaggtgtttttttttctcaaagttgaggatagcattgaccttatttttgtttgtttgatgagtacagtgttcgcactttaaggtttaaactgaagagcaaaaactgaatcctgaaaca

SEQ ID NO: 4680 - DNA, 1785 bp, Brachypodium distachyon
cgcgtggtggtttcggtccagcacggggggcggccggcaaaccgcgagaaaccaagccaccctcctcctcccgtccccgtccgtcctcggccccggcccgccggccgccgccaccagcgccttctacccttcctacaagaaacccccgcgcggctgcgtttgccgcgagtcctttctctatctcttctctcgtggggatctcgtgtggtcaaggacgagagctccgggaactaggcggccggatcagggggagatatggaggccgctgcggctgccggtgctgccgggctgaccaggtggcaggcggcggcgctgtcggcggtggcggggtgggtgtgggccgcctcgtacttcgacctcacgcggcgagcgcgcgcgctgacgcagccgtgggtcacccgccgtgtgcacgccgagacaccgtcgatcctcaggttccagaggacgcagcacaggttgctagacaatttcttctccgtgctgtcatgcgttgtctctgtccctttctacacgggattcctccctctcctcttctggagtggacacggcaagctggccagacaaatgaccctcctgatggctttctgtgattaccttggcaacgctgtgaaggacttagtgtcagctcctcggccatgctctcctcctgtcagaagagtcacagccactgaagatgagaaggaaaatgccatggaatatggattaccttcatctcacgctctcaataccgtttgtttgatgggatatatactccactatgtcctgacatatggaccgtgtagtgcttttatggtcgctacatgtttatctctagctctcttgcttgttatgctaattggcattgcgaggatatacttgggcatgcacagcttgaccgacgtcatcgctgggatctgttttggcactgtgatccttgcgttctggttggttgttgatgatcatgtagacgcctttgttgtctctgggcaaaatgttacattcttctgggcaagcctttctctattgatgtgctttgcatatccaaagccagaatttccaactcctagctttgaataccacacggcattcaatggcgttgctttcggaattgtctatggcatccagcaaacctacttccatttccacaacccaaatgtccccctcattttcagccagcagctacctcttcttgcatacatcgggagggtcctggtagggatcccaaccatcctggccgtgaaatcctgcagcaaagcgctctcgaaatggcttctaccggtcatgtgcaacaccttgggcattcccatcgtctcgtcctgctatgtcccggcactgaaggtgaccaacagcaactcgagcaaatccgacgccaagcaggccggttacctccagagagtcttctccctcttcccgcagaaggcgtacgacgtggacactggcataaggttcgtgcagtatgccgggctcgcgtggtcggtggtcgacttggtgccggccatattcactcatctgaatctgtagcggaacccctacaatttttttgtgtgtttcgttcttcagagggtaaatgggtaatccgtccctactcgcagggcattgtcttgtgaggctgtaaatccattgatctcgaccttcttttttgtattgtatgtatgtttttggcttagcacgtcctccatagaggtgtttttttttctcaaagttgaggatagcattgaccttatttttgtttgtttgatgagtacagtgttcgcactttaaggtttaaactgaagagcaaaaactgaatcctgaaacatattccat

SEQ ID NO: 4681 - DNA, 1906 bp, Setaria italica
ggagaagaagaaaacgaggaggccccaaagaccccgcgtggtcgtccggtccagggcggggggcggccggcaacgacgaaaccagccaacgccaccacctcctcctcctcctccctcctccccccgtcgccgtcccgtccagttccgcgatccacacgaccccgtccgcctcggcctgcgcccgccagccctcctctcgctacaagaatccgcccgccagctcgcgctgcgctccagcgagtccctccctgcggtgcggagatcctgcgtgaggagtccgtccaagaaccaggcggcggttgcggggagatcgattggatatggaggcggcggtcgcgggtgcgggcggcgcggggctgaccaggtggcaggcggcggcgctgtcggcggtggccgggtgggtctgggcggcctcgttctacgacctcacgcgccgggcgcgcgcgctggtccagccatgggtcacgcgccgtgtgcacgccgagacgccggcaatcctcaggtttcagaggttgcaacacaagttgctggacaatttcttctctgtgctgtcatgcgttgtctctgttcccttctacacgggattcctccctctcctcttctggagtggacacaacaagctggctaggcagatgaccctcctcatggctttatgtgattacctcgggaactctgtcaaggacatgatatcagctcctcgtccatgctctcctcctgttagaagagtaacagccactgaagatgagaaggaaaatgccatggaatatgggcttccatcatcgcatgctctcaatactgtttgtttgatgggatatctattacattatgtcctcacatatggagatgctggcaatgttatgattgctgctggtttatctttagctttcttgtttgttatgctaattggcattgcaaggatatatttgggtatgcacagcttgatcgatgttattgctggaatttgttttggcattgtcatcctagcattctggttggttgtccatgaccatgttgatgcctttgttgtgtctgggcaaaacgttgcatccttctgggcaggcctttctctattgatgtgctttgcatacccgaagccagaattcccgactcctagctttgaataccatacagcattcaacggagtcgctttcggaattgtctacggcatccagcaaacctacttccatttccacacccctgacgcccccctcatcttcagctcgcgactgcccctgcttgcattcgcagggcgtgtcctcgtcgggatcccgaccatcctggttgtgaagttctgcagcaaggcgctgtccaagtggctgctgcctgtcatgtgcagcaccctgggcatccccattgtatcatcttgctatgttcctgccctgaaagtcgacaacagcagcaagaacaagcctgatgcgaagcagggtgccgggtacctccagagggtgttttccctcttccctcagaaggcctacgacgtggacacaggcatcaggttcgtgcaatacgccagcctcgcgtggtccgtggtcgacctggtgccagccatattcacccatctaaatttgtagccagctactcaataattcagggtgcaagtttaatttttactctttctggagctcccaatgcaggggctcctactcgtaagacatggatcatcttatgaggctgtaaatccaatgatctctccctcgttttttgtattgtatgattgcctaggtgttcgcaccacgtggtgatgtttctgtagaggtgtcaaggaagtagtaagcactaagcaggaagtattgatgtgttactatcactattattccatgacagaagtggccactatggtgccacgcctaacctgcacgggattctgattcttaatcgcaaagaaatgcctttacttgccttgcat

SEQ ID NO: 4682 - DNA, 1851 bp, Setaria italica
gtccggtccagggcggggggcggccggcaacgacgaaaccagccaacgccaccacctcctcctcctcctccctcctccccccgtcgccgtcccgtccagttccgcgatccacacgaccccgtccgcctcggcctgcgcccgccagccctcctctcgctacaagaatccgcccgccagctcgcgctgcgctccagcgagtccctccctgcggtgcggagatcctgcgtgaggagtccgtccaagaaccaggcggcggttgcggggagatcgattggatatggaggcggcggtcgcgggtgcgggcggcgcggggctgaccaggtggcaggcggcggcgctgtcggcggtggccgggtgggtctgggcggcctcgttctacgacctcacgcgccgggcgcgcgcgctggtccagccatgggtcacgcgccgtgtgcacgccgagacgccggcaatcctcaggtttcagaggttgcaacacaagttgctggacaatttcttctctgtgctgtcatgcgttgtctctgttcccttctacacgggattcctccctctcctcttctggagtggacacaacaagctggctaggcagatgaccctcctcatggctttatgtgattacctcgggaactctgtcaaggacatgatatcagctcctcgtccatgctctcctcctgttagaagagtaacagccactgaagatgagaaggaaaatgccatggaatatgggcttccatcatcgcatgctctcaatactgtttgtttgatgggatatctattacattatgtcctcacatatggagatgctggcaatgttatgattgctgctggtttatctttagctttcttgtttgttatgctaattggcattgcaaggatatatttgggtatgcacagcttgatcgatgttattgctggaatttgttttggcattgtcatcctagcattctggttggttgtccatgaccatgttgatgcctttgttgtgtctgggcaaaacgttgcatccttctgggcaggcctttctctattgatgtgctttgcatacccgaagccagaattcccgactcctagctttgaataccatacagcattcaacggagtcgctttcggaattgtctacggcatccagcaaacctacttccatttccacacccctgacgcccccctcatcttcagctcgcgactgcccctgcttgcattcgcagggcgtgtcctcgtcgggatcccgaccatcctggttgtgaagttctgcagcaaggcgctgtccaagtggctgctgcctgtcatgtgcagcaccctgggcatccccattgtatcatcttgctatgttcctgccctgaaagtcgacaacagcagcaagaacaagcctgatgcgaagcagggtgccgggtacctccagagggtgttttccctcttccctcagaaggcctacgacgtggacacaggcatcaggttcgtgcaatacgccagcctcgcgtggtccgtggtcgacctggtgccagccatattcacccatctaaatttgtagccagctactcaataattcagggtgcaagtttaatttttactctttctggagctcccaatgcaggggctcctactcgtaagacatggatcatcttatgaggctgtaaatccaatgatctctccctcgttttttgtattgtatgattgcctaggtgttcgcaccacgtggtgatgtttctgtagaggtgtcaaggaagtagtaagcactaagcaggaagtattgatgtgttactatcactattattccatgacagaagtggccactatggtgccacgcctaacctgcacgggattctgattcttaatcgcaaagaaatgccttta

SEQ ID NO: 4683 - DNA, 1740 bp, Echinochloa colona
cctcctccttccccccgtcgccgtcccgtccagttcccgcgatccagacgaccccgtccgcctcggcctgcgcccgcctttcccgcccgcctccaccgctacaagagtccgcccacgggctttcgtcgcggagatcctgtgcccgtctgcccgagagccgagtccatccgggaaccaggcggcgcggcgtctgcggggagatcggattggacatggaggcggcggcggccgtgggtgccgggtggcgcgggcctgaccaggtggcaggcggcggcgtctgcggggagatcgattggacatggaggcggcggcggccgtgggtgcgggtggcgcgggcctgaccaggtggcaggcggcggcgctggccgcggtggccgggtgggtctgggcggcctcgttctacgacctcacccgccgggcgcgcgcgctggtccagccgtgggtcacgcgccgggtgcacgccgagacgccggccatcctcaggttccagaggttgcaacacaagcttctggacaatttcttctctgtgctgtcatgcgttgtttctgttcccttctacacgggattcctcccgctcctcttctggagtggacacggcaagctggctaggcagatgaccctcctcatggctttctgtgattacctcggcaactctgtcaaggacatggtatctgctcctcggccatgctctcctcctgtaagaagggtgacagctacagaagatgagaaagaaaatgccatggaatatgggcttccatcatcgcatgccctaaatactgtttgtttgatgggatatctattacattatgtcctcacgtatggagaacatggcggtgttatgattgctgcgggcttatctctagctttcttgcttgttatgctagttggcattgcaaggatatatttgggcatgcacagtttgaccgatgttattgctggaatcagttttggcattgtcatccttgcattctggttggctgtccatgaccatgtcgatgcctttgttgtgtctggacaaaatgttgcatccttctgggcaggcctttctctattgatgtgctttgcatacccgaagccagaattccctactcctagctttgaataccacacagcattcaatggagttgcttttggaattgtcttcggcatccagcaaacctactttcatttccacacacctgatgcccccctcatcttcagcccacaactgcccctgctcacattcgccgggcgtgtcctcgttgggatcccaaccatcctggtcgtgaagttctgcagcaaggcgctgtccaagtggctgctgcctgtcatgtgcagcaccctaggcatccccattgtatcgtcttgctatgttcctaccctgaaagttgacaacagcaagagcaagcccgacgcgaagcatggtgctgggtacctccagagggtgttctccctctttccccagaaggcgtacgatgtggacacaggcatcaggttcgtccagtacgccagcctctcgtggtccgtggtcgacctggtgccagctatattcactcatttaaatttgtagccagctactcaataattcagggtgcagtttcatttttactaattctgttgctcctaaggggggtgttcctactcgtaagacatggatcatcttatgaggctgtaaatccaacgatctgtcccttgttttttgttttgtattgtatgtttgcctaggtgctttcaccacgggtgatgcttctgtagagatgt

SEQ ID NO: 4684 - DNA, 1763 bp, Secale cereale
gactggtggtgcgagactccggtccggagcgggggcggccggcagaccgaccgccaagaaaccaaaccacctcccgtctccgtcctcggccaccaccaccgccacctgcccgcgccctccaccgctcctcctacaagagcccccgcgcccctgccagcagcaaccctgcgccgcgcgagtcaacctctcctctctgcctctctcgtggggatctcgcgcgctcctcccgggatcaggcgccggcggccggagggataaagatacggacatggaggcggtcgcggcggccggtggcgccgggctgaccgggtggcaggcggcggcgctgtcgggcgcggcgggctgggtgtgggcggcctcctactacgacctcacgcgccgggcgcgcgcgctggcgcagccctgggtcacccgccgcgtccacgccgagacgccctccatcctcaccttccagaggctgcagcacaggttgctggacaacttcttctcggtgctgtcatgcgttgtctctgtccctttctacacgggattcctccccctcctcttctggagtggacatggcaagctggccaggcaaatgaccctgctgctggccttctgcgattaccttggcaacgctgtcaaggatttagtgtcggctcctcgcccgtgttcccctcccgtgaggagagtcacagccaccgaagatgagaaggaaaatgccatggaatatgggctgccttcatcgcacgctctcaacaccgtttgtttgatgggatacatgttgcattatgtactcacatatgcaccatgtgatggtttcacgattgccacgggcctttctctagctttcatgcttgttacgttaatcggcattgcgagggtatacttgggcatgcacagcttgaccgatgttatcgctgggatctcttttggcatcgtgatccttgcattctggttggttgtccatgatcatgttgatgcttttgtcgtctctggccaaaacgttacattcttctgggcaagcctttctctggtgctctgctttgcatatccaaggccagagttcccaactcctagctttgaattccacacagcattcaacggtgtcgctttcggaattgtctacggcgtccagcagacctacacccgtttccatggccctgacgcccctctcattatgagccatgaactacccctcctcgggtacgccgggagggtcctggtgggcatcccgaccatcctggccgtgaagtcctgcagcaaggcggtctcgaaatggctcctgccggtcatgtgcagcaccctggggatcccgatcgtctcgtcctgctacgtgcccgcgctgaagccatctgacattggcggtgacccgggcaacaggacgaggccaagcaggccggcgggtacctccagcgggtcttctccctcttcccgcaaaaggcgtacgacgtggacacgggcatccggttcgtgcagtacgccgggctagcgtggtcggtggtggacctggtgccggtgatcttcacgcatctgaacctgtgaggccgatcgaattagcgaatctaaggttagcggcatttcgtttatttctttggaggacttctgatgatccctcctcctgtcctccatctctctcaggcaggcaggctgtagatccattgacctgggcctcatttttgtgttgtatgtttgtctagcacgtcctctagtggggtgttttctttgtgtacagttgtccaaagtagcaatgaggaaagtatacacgtgatggccttgttttt

SEQ ID NO: 4685 - DNA, 1890 bp, Panicum virgatum
aagagagaaaacgaggaggccccgagaacccgcgtggtcgtcccggtccagagcggggggcggccggcatcgacgaaacgagccaacgccaccacctcctcccctccttcccccgtcgccgtcccgtccagttccgcgatccacacgaccccgtccgcctcggcctgcgcccgcccgcccgccctcctctcgctacaagaatccgccctcccgcgccgcggccccagcgagtccctccctgcggtgcggagatcctgcgcccgagagcgagagaggaaccgagccgggggagattggatatggaggccgcggccgtgggtgtgggtgcgggcggcgcggggctgaccaggtggcaggcggcggcgctgtcggcggtggccgggtgggtctgggcggcctcgttctacgacctcacgcgccgggcgcgcgcgctggtccagccgtgggtcacgcgccgggtgcacgccgagacgacggccatcctcaggttccagaggttgcagcacaaattgctggacaatttcttctctgtgctgtcctgcgttgtctctgttcccttctacacgggattcctccctctcctcttctggagtggacacggcaagctggctagacagatgaccctcctcatggctttctgtgattacctcggcaactctgtcaaggatatagtgtcagctcctcggccatgctcccctcctgtaagaagagtaacagctacagaagatgagaaggaaaatgccatggaatatgggctgccatcatcgcatgctctcaatactgtttgtctcatgggatatctgttacattatgtccttgcatatggagaacatggcagtgttatgattgctgcgggtttatctctagctgtcttgcttgttatgctagttggcattgcaaggatatatctgggtatgcacagcttgaccgatgttattgctggtattggttttggctttgtcatccttgcattctggttggctgtccatgaccacgttgacgccttcgttgtgtctggacaaaacgttgcatccttctgggcaggcctctctctattgatgtgctttgcatacccgaagccagaattcccaactcctagctttgaataccatgcagcattcaacggagtcgcttttggaattgtttatggcatccagcaaacctacttccatttccacacccctgatgcccccctcatcttcagcccccaattgcccctgctcgcatttgcagggcgtgtccttgttgggataccgaccatcttggtcgtgaagttctgcagcaaggcgctttccaaatggctgctgcccgtcatgtgcagcaccctgggcattcccaatgtatcgtcttgctatgttcctgccctgaaagctgactacagcaagagcaagcccgacgtgaagcaaggtgtcggatacctccagagggtgttctccctcttcccccagaagtcatatgacgtggacacaggcataaggttcgtccagtatgccagcctcgcgtggtccgtggtcgacctggtaccagccatattcacccatctgaatctgtagcccaggtactcaataatccagggtgcagtttcatttttagtccttctggagctcccaatggggtgttcctactcgtaagacatggatcatcttatgaggctgtaaatccaatgatctctcccttgtcattttgtatgctatgcttgcttaggtgtttttgccacggggtgatgtttctgtagaggttgagtagtagtatgcaggaagtatttatgtgttgctgtcactattattgttccatgacagaagtggccactatagtgccacgtctaaccctgctggctgctgtgaattctgattcttgaccgcaaagaaatgccttcccttgccttgcata

SEQ ID NO: 4686 - DNA, 1592 bp, Pennisetum glaucum
ggtccagcgagtcccttcccttcctgcaggctgcggtgcggagatagatcctgtgcccgggagcgtgaggggtccgtccggggaccaggcggcggtcgcggggagatcgactgggtgggtatggaggcggcggcggtcgtgggtgcgggcggcgccggtctgaccaggtggcaggcggcggcgctgtcggcggtggccgggtgggtctgggcggcctcgttctacgacctcacgcgccgggcgcgcgcgctcgtccagccgtgggtcacgcgccgtgtgcacgccgagacgccggcaatcctcacgctccagaggttccaacacaactttctggacaatttcttctctgtcctgtcatgcgttgtctctgttcccttctacacgggattcctccctctcctcttctggagtggtcacaacaagctggctaggcagatgaccctccttatggctttatgtgattacctcgggaactctgtcaaggatatgatatctgctccccgtccatgctctcctcctgttagaagagtgacagcaactgaggatgagaaggaaaacgctatggaatatgggcttccatcatcacatgctctcaatactgtttgtttgatgggatatctattacattatgtcctcacatatggagatgctggcaatgttatgattgttgcgggtttatctctaggtgtcttgtttgttatgctaattggcactgcaaggatatatttgggtatgcacagcttgatcgatgttattgctggaattggttttggcgttgtcatcctagcattctggttggttgtccatgaccatgttgatgcctttgttgtgtctgggcaaaacgttgcatccttctgggcaggcctttctctattggtgtgctttgcatacccaaagccagaattcccaactcctagctttgaataccatacagcattcaacggagtcgctttcggaattgtctacggcatccagcaaacctacttccatttccacacccctgacgcccccctcatcttcagcccgcaactgcccttgctcgcattcgcagggcgcgtcctcgtcgggatcccgaccatcctggctgtgaagttctgcagcaaggcgctgtccaagtggctgctgcctgtcatgtgcagcaccctgggcatccccattgtgtcgtcttgctatgttcctgccctgaaagttgacaacagcagcaagagcaaggctaatgcgaagcagggtgctgggtacctccagagggttttctccctcttcccccagaaggcgtatgacgtggacaccggcatcaggttcgtgcagtacgccagcctcgcgtggtccgtggtcgacctggtgccagccatattcacccatctaaatttgtagccggctactcaataactcagggtgcaagtttcattttgactcttttgggagctcccaatgcaggtgttcctactcgtaagacgggaatcatcttatgaggctgtaaatccaatgatctctctcccccctctttttttttggtattgtatgatgattgcctaggtgttttcaccacgtggtgatgtttctgtagaggtgtcgagtaagtagtaagctgg

SEQ ID NO: 4687 - DNA, 2031 bp, Panicum virgatum
aagaaggaaacgaggaagcccccgagaccccgcgtgtggacgtgtggtcgttgggtccagaggaccagagcggggggcggccggcaacgacgaaacgagccaacgccaccacctcctcctcctcccccgtcgccctcccgtccagttccgcgatccacacgaccccgtccgcctcggcctgcgcccgcccgcccgcccgcctctcgctacaagaatccgcccgcccgcgccgcggtcccagcgagtccctccctgcggtgcggagatcctgcgcccgaggacgagagcggaaccgagccggcggcgttcgcgggggagatcggatatggaggccgcggccgtgggtgcgggcggcgcggggctgaccaggtggcaagcggcggcgctgtcggcggtgggcgggtgggtctgggcggcctcgttctacgacctcacgcgccgggcgcgcgcgctggtccagccgtgggtcacgcgccgagtgcacgccgagacgacggccatcctcaggttccagaggttgcagcacaagttgctggacaatttcttctctgtgctatcctgcgttgtctctgttcccttctacacgggattcctccctctcctcttctggagtggacacggcaagctggctaggcagatgaccctcctcatggctttctgtgattacctcggcaactctgtcaaggatatagtgtcagctcctcgtccatgctctcctcctgtaagaagagtaacagctacagaagatgagaaggaaaacgccatggaatatgggctgccatcatcacatgctctcaatactgtttgtctgatgggatatctattacattatgtcctcgcatatggagaacatggcagtgttatggttgctgcgggtttatctctagctgtcttgcttgttatgctagttggcattgcaaggatatatttgggtatgcacagcttgactgatgttattgctgggattggttttggctttgtcatcctttcattctggttggctgtccatgaccatgttgacgccttcgttgtgtctggacaaaacgttgcatccttctgggcaggcctctctctattgatgtgctttgcatacccgaagccagaattcccaactcctagctttgaataccatacagcattcaacggagtcgcttttggaattgtctacggcatccagcaaacctacttccatttccacacccctgacgcccccctcgtcttcagcccgcaattgcccctgctcgcattcgccgggcgcgtccttgtcgggataccgaccatcctggtcatgaagttctgcagcaaggcactgtccaaatggctgctgcccgtcatgtgcagcaccctgggcatccccattgtatcatcttgctatgttcctgccctgaaagttgacaacagcaagagcaagcctgacgtgaagcaaggtgtcgggtacctccagagggtgttctccctcttcccccagaaggcatacgacgtggacacaggcatcaggttcgtccagtacgccagcctcgcgtggtccgtggtcgacctggtgccggccatattcacccatctgaatttgtagcccaggtactcaataacctaccagggtgcagtttcgtttttagtctttctcgagctcccaatggggtgttcctgctcgtaaggcatggatcatcttatgaggctgtaaatccaatgatctctccctcgtcattttgtattctatgattgcctaggtgttttcgccatggggtgatgtttctgtagaggttgagtagtagtaagcaggaagtattaatgtgtcgctatcactattattgttccatgacaagtggccactatagtgccacgtctaacactgcagcgaattctgattcttgaccgcaaagaatgcctttccttgccttgcatactatggtgttgggtggactatccatgcttgctacttgtatgccatctcaccgtgtgttcaagttttgccctctgaaaacgttgccaacttctcaactcctataacggaattggacatgacagaacggt

SEQ ID NO: 4688 - DNA, 1372 bp, Festuca arundinacea
ggcacgaggcctcctacttcgacctcacgcgccggacgcgcgcgctggcgcagccctgggtcacccgccgcgtccacgccgagacgccctccatcctcaggttccagaggatgcagcacaagttgctagacaatttgttctctgtgctgtcatgcgttgtctctgtccctttctacacaggattcctccccctcctcttctggagtggacacggcaagttggctaggcagatgaccctcctcatggctttctctgattaccttggcaacgttgtgaaggatgtagtgtcagctcctcggccatgctctcctcccgtgagaagagtgacaaccacccaagacgagaaggaacacgccatggaatatggactgccttcgtcgcacgctctcatgaccgtttgtttgatgggatatatgctgcattatgtcctcacatatggagggtgtgacggtttcatgattgccattggtctctctgtagctctaatgcaagtcattttaatcggcattgcgagggtgtacttgggcatgcacagcttgacagatgttatcgctgggatctgtcttggcattgtgatccttgcattctggttggttgtcgatgaccatgttgatgccttcgttgtctctgggcagaacgttacattcttctgggcaagcctttctttattgctctgctttgcatatccggtgccagaattcccaactcctagctttgaattccacaccgcattcaccggggttgcattcggcattgtctatggcgtccaacaaacctacctccgtttccacggccccgatgcccccctcatcttgagcgagcaacttcccctactcacatacgtcgggagggttcttgttgggatcacaaccatcctgatcgtgaaatcctgcagcaaggcgctctcaaaatggctcctgccagtcatgtgcagcaccctgggcattccgatcgtctcgtcctgctacgtcccgacgctgaaggcacctaacagcaactcgggcaagtctgaccccaagcaggccggttacctccagaaggttttcttgctcttcccgcggaaggcgtacgacgtggacacgggcatcaggtttgtgcagtacgccggccttgcgtggtcggtggtcgacttggtgccggtgatattcacctacttgaatttgtagccggattaacattcgaggttagcatttgatttattgcctcggaggcgtccaaccggtgattcctcttacttgtatggcgtcctgtgaggctgtaaatccattgacctcaccctcaattttgtgttgtgtggctagcacatcctccatccagggtggtgtttctgtacagagttctcaaagtagcaatgaagaaagtattgacagct

SEQ ID NO: 4689 - DNA, 1873 bp, Zea mays
cgaaaaaaggtccccggccgagaccgagagccgcggtccagagcggggggcggccggcaaggacgaaacggcccaacgccaccacctccaccacctcgtcctcgatcgacacctcccccgtcgccgtcccgtgactccccgtccagccgtccaggcccagctgcccccgcgacccagacgaccacgtccgcctcggcctgcgcctccccgctacaagagtccgtccgcccgccagcgctgcggtgccagcgagcccctccctcctccactctctgcggcgcggagatcccgtcctttctctgtgcccccggtaccgcgaggagccactgccaggcgccggcgtttttggaactgggcatggaggcggcggcggcgtcggcggcggcggtcgggggttcgggcgctggactgaccaggtggcaggcggcggcgcttgcggcgctggccggctgggtgtgggcggcctccttctacgacctcacgcgccgggcgcgcgcgctcgtccagccgtgggtcacgcgccgggtgcacgccgagacgccggccatcctcaggttccagaagttggagcacaagttgctggacaatttcttctctgtgctgtcatgcgttgtctccgtgcccttctacacgggattcctccctctcctgttctggagtggacacggcaggctggctaggcagatgaccctcctcatggctttctgtgactacctcggcaactctgtcaaggatatggtgtcagcccctcggccatgctctccacccattagaagagtgacggctacagaagatgagaaggaaaatgccatggaatatgggctaccgtcatcgcatgctctcaacactgtttgtttgacgggatatttgttacattatgtcctcacatacggagaacatggcagtcttacagttgctgcgggtttatctctagctctcttacttgttatgctagttggcattgcgaggatatatctgggtatgcacagcttgaccgacgttgtcgctggaattggtttcggcatcgtcatcctcgcattctggctggctgttcatgaccatgtcgacgcctttgttgtctccgggcaaaacgttgcaaccttctgggcaggccttgctctactgatgtgctttgcgtatcccaagccagaattccctaccccgagctttgaattccacacagcattcaacggggtcgctttcggaatcgtgtacggcatccagcaaacctacttccacttccacgcccccgacgcgccgatcgtcttcagcgccgagctgcccttcctcgcgttcgcggggcgcgtcctcgtcgggatcccgaccatcctggccgtgaaatcgtgcagcaaggcgctctccaggtggctgctgcccgtgatgtgcagcaccctgggcatccccatcgtgtcgtcctgctacgtccccgccctgaaaatcgacggcggcagcagcaagagcaggcaggccgccggcgggcacctccagcgccttctctctcacttcccccagaaggcgtacgacgtggacaccggcatcaggttcgtccagtacgccagcctcgcgtggtccgtggttgacttggtgccggccatcttcgcccatttggatttgtagccagctacttaaaatttcagtttcgtttttttttctggaggtctcaataaggccctcctactcgtaagacatgtgtcatcttatgaggctgtaaatccgatgatctggccctttcttctttttttgtattgtattgtgtgtatgaatggacgaatggttccctagctgttttcatcagggtgttcagtaagtagaaatcagtggtacatttcttattctttaaattagatatggttattgtcttatatactaggtt

SEQ ID NO: 4690 - DNA, 2234 bp, Zea mays
gcgagcgcaacaacgaaaccgaaactaccacggatcaagaagaaagaaagtccccgagacccagagccgcggtccagagcgggcggcggccggcaacaacgaaacgggccaacgccaccacctccacctcgtcctcctcggcacctcccccgtcgcgtccagcgttccaggtccagctccccccgcgatcccgacgaccccgtccgcctcggcctgcgcctccccgctacaagggtccgcccgcgggcgccgcggtaccagcgagcccctcctcctccacactctgcggcgcggagatcctgtccctgtgccccggaccgagaggagccagacgccggcgtctggaattcggacatggaagcggcggcggcggtcgtaggcttcggcgctggcgcgggcctgaccaggtggcaggcggcggcgctgtcggcggtggccggctgggtgtgggcggcctccttctacgacctcacgcgccgggcgcgcgcgctcgtccagccgtgggtcacgcgccgggtgcacgccgagacggcggccattctcaggttccagaggctggagcacaagttgctggacaatatcttctctgtgctgtcatgcgttgtctccgtgcccttctacacgggattcctccctctcctcttctggagtggacacggcaggctggctaggcagatgaccctcctcatggctttctgtgactacctcggcaactctgtcaaggatatagtgtcagcccctcggccgtgctctcctcctgtaagacgagtgacggctacagaagacgagaaggaaaatgccatggaatatgggcttccatcatcgcatgctctcaataccgtttgtttgacgggatatttactacactacatcctcacgtttggagaacatggtagtgttacagttgctgcgggtttatctctagctttcttgcttgtcatgctagttggcatcgcgaggatatatctgggtatgcacagcttgaccgacgttgttgctggaattggttttggcatcgtcatccttgcgttctggttggctgttcatgaccgtgtcgatgccttcgttgtctccggggaaaatgttgcgaccttctgggcaggcctttctctgttgctgtgctttgcgtacccgaagccggagttccctactcctagcttcgaataccacacagcattcaacggggttgctttcggaatcgtgtacggcatccagcaaacatacttccacttccacacccctgacgccccggtcgtcttcagcgccgagctgcccctgctcacgttcgccgggcgcgtcctcgtcgggatcccgaccatcctggccgtgaaattctgcagcaaggcgctgtccaagtggctgctgcccgtggtgtgcagcaccctgggcatccccaccgtgtcgtcctgctacgtcccggccctgagagccgacagcggcagcggcagcggcaagaacaggcagggccccgggcacctgcagcggctgctgttctcccacttcccccggaaggcgtacgacgtggacacgggcatcaggttcgtccagtacgccagcctcgcgtggtccgtggttgacttggtgccggccatgttcgcccatctgaatctgtagccagctgcgtagaatttctgcttctcttttcgatgagctcccaatgcggccccctcctgctcgtaagacatggatcagcttacgaggctgtaaatccgattgtctggctggctggcttctccttctcgtatcgtatgtacctagctgttctcaccaggggtgttgtttctgtgcaagtttgtgtgtgtagtaagtagcaaccagtagtattgattgatgatgggtagctatgagacattcttgacgtcaaagggatgccttttcttgccttgtgtgtcctagcaccaacgtcgggtagatgatggatcatggatgcgagcgctcttcgcctcttgcatgcacagggtggcagaatatacgtcgtcataatggtggtattgggtgtgagaaaacgatgtgtgacgatgcattcttgaccatcgcttttcgacgccgaagccagtagcccggcattagctggtggcggcgacgtcgacggcgacacgagaatagcgcccaagcccaacgaatccctgttgtcccgtgcggctgttgcccgcctgttgttccgtgggcacgcagacagccacggcattcgagaagctgtatcctgcttttttttttcttttcaaaaaggcaac

SEQ ID NO: 4691 - DNA, 1046 bp, Pseudoroegneria spicata
catccggcgaaacacgccaagcacgcgcaccgaatccatcgcccgagcaagcagacaccacctgccagactgccgcccaccctctcccaggagctcagaggcgccaagaaccgtacgggagcagccaaagcaagcggcacctcaccggatcgatggcgatggccggcggagccccaccggcgccgctgccggtggtggggcaccagttctgcgcgccctacgtggtgccgctgacggtgaccaagaaggccctcagcctctccgacggcgacttcgccatcacggacgccaacggcgcggtcgtgctcaaggtcaagggcgccatcttcagcatccggagccgccgcaccatcctcgacggcgccggcctgcccctcctcaccatgcaagaaaaggtgttcagcatgcaccacagatgggaggtgttcagaggggacagcacgaacgcaggcgacctgctcttcaccgtgaagacaacttcgctgatccaactcaagacggagatggacgtcttcttggccgggaacaccgcgcagcaggtctgcgacttcaagatcaagggcacctacttcgacaggtcctgcgtcttctaccttggcgactccaacaccatggtagctcaaatgagccgtaagctgactgtttcgaacgtgctgcttgggagggacacgttcagtgtcaccgtgttcccgcacgtcgactacgtgttcatcgcgagcctcgttgtgatcctggatgaggttcacagggacaagcgcgacgataattgatgagtgagctagatagactcccggatcctgagcgtcctcggagttctacagatgtcgtgtcatctcaagctgctgtgttgttgtcactagtgttatctgatcaagggttgcatctcttgtagtattatggtagcatggtgaagcatgctgaattgtgatgttgtgcaataagaatgtgtatgcaccttctgtttgatccctggcctgccattgtatttactgcagcgattgatagtttgtttgagatgaaatgttgacctatataagttaaatgta

SEQ ID NO: 4692 - DNA, 1038 bp, Secale cereale
tcgccacacaagctccaccgtcccctgtttttccctcccctgtcccatccgacaaaacacggcaagcacgcgcaccgaatccatcgccccagcaagcagacaccatctgccgacctgcgagactgccgcccaccgtctccgaggagcgtcagaagcgccaagaagaaccgcacgcacgggagcggccggagcaggcggcaccggaagaaccggatcgatggcgatggccccgccggcgccgctgccggtggtggggcagcagttctgcgcgccctacgtggtgccgctgacggtgaccaagaaggccctcagcctctcggacggcgacttcgccatcacggacgccaacggcgccgtggtgctcaaggtcaagggcgccatcttcagcatccgcagccgccgcaccatcctcgacggcgccgggatgcccctcctcaccatgcaggaaaaggtgttcagcatgcaccaccgatgggaggtgttcagaggggacagcaccaacgcacgcgacctgctcttcagcgtcaagacaacctcgctgatccagctcaagacggagatggacgtcttcctggccgggaacaccgcgcagcaggtctgcgacttcaagatcaagggcagctacttcgaccggtcctgcgtcttctacctcggcgactccaacaacatggtagctcaaatgagccgtaagctgacggtttccaatgtgctgctggggagggacacgttcagcgtcaccgtgttcccgcacgtcgactatgtgttcatcgcgagccttgttgtgatcctggacgaggttcacagggacaagcgcgacgattgatgagtgagttatgtatagtacactcctggatcatgagcgtccctggagttctactagactactactgtggtgtcatcccaagctgttgtgttgtcacttgtcactggtgttatctgcatttcttgtagcattatggttgcacggtgagccatgctgaattgtgatgttgtggaataatgtttatgcaccttacatttgaaccactggaaaaaaaa

SEQ ID NO: 4693 - DNA, 1163 bp, Secale cereale
aagctccaccgtccccctgtttccccactcctccccctgtcccattcggcacaaaacacgccaagcacgcgcaccgaatcgaccgcccgagcaagcagagcacgagcagacaccaccacctgcccggactgccgcccgccgtcccccaggagctcagtcagaggcgccaagaagaaccgcacgcacggaagcggccggagcaggcggcaccggaagaaccgggtcgatggcgatggccccgccggcgccgctgccggtggtggggcagcagttctgcgcgccctacgtggtgccgctgacggtgaccaagaaggccctcagcctctcggacggcgacttcgccatcacggacgccaacggcgccgtggtgctcaaggtcaagggcgccatcttcagcatccgcagccgccgcaccatcctcgacggcgccgggatgcccctcctcaccatgcaggaaaaggtgttcagcatgcaccaccgatgggaggtgttcagaggggacagcaccaacgcacgcgacctgctcttcagcgtcaagacaacttcgctgatccagctcaagacggagatggacgtcttcctggccgggaacaccgcgcagcaggtctgcgacttcaagatcaagggcagctacttcgaccggtcctgcgtcttctacctcggcgactccaacaacatggtggctcaaatgagccgtaagctgacggtctccaatgtgctgctggggagggacacgttcagcgtcaccgtgttcccgcacgtcgactacgtgttcatcgccagccttgttgtgatcctcgacgaggttcacagggacaagcgcgacgattgatgagtgagttatgtatagtacactcctggatcctgagcgtccctggagttctactagactactactgtggtgtcatcccaagctgttgtgttgtcacttgtcactggtgttatctgcatttcttatagcattatggttgcacggtgagccatgctgaattgtgatgttgtggaataatgtttatgcaccttacatttgaaccactaggaaaaaaaatgcgcgctatagcgttgagtaattcgcctcgacttaaatattagtcggtagtaaaacattctacgttaatacgcacgtactaatagttatttattttaggacggttacgtaaacg

SEQ ID NO: 4694 - DNA, 1059 bp, Secale cereale
gactgccatgttttgccctcccctgtcccattcggcaacaaaacacgccaagcacgcgcaccgaatcaaccgccggagcaagcagagcagacaccagtcaccaccacctgccagaccgccgcccgccgtctcccaggagctcagtcagaggcgccaagaagaaccgcacgcacgggagcggccggagcaggcggcaccggaagaaccggatcgatggcgatggccccgccggcgccgctgccggtggtggggcagcagttctgcgcgccctacgtggtgccgctgacggtgaccaagaaggccctcagcctctcggacggcgacttcgccatcacggacgccaacggcgccgtcgtgctcaaggtcaagggcgccatcttcagcatccgcagccgccgcaccatcctcgacggcgccgggatgcccctcctcaccatgcaagaaaaggtgttcagcatgcaccaccgatgggaggtgttcagaggggacagcaccaacgcacgcgacctgctcttcagcgtcaagacaacctcgctgatccagctcaagacggagatggacgtcttcctggccgggaacaccgcgcagcaggtctgcgacttcaagatcaagggcagctacttcgaccggtcctgcgtcttctacctcggcgactccaacaacatggtggctcaaatgagccgtaagctgacggtctccaatgtgctgctggggagggacacgttcagcgtcaccgtgttcccgcacgtcgactacgtgttcatcgccagccttgttgtgatcctcgacgaggttcacagggacaagcgcgacgattgatgagtgagttatgtatagtacactcctggatcatgagcgtccctggagttctactagactactactgtggtgtcatcccaagctgttgtgttgtcacttgtcactggtgttatctgcatttcttgtagcattatggttgcacggtgagccatgctgaattgtgatgttgtggaataatgtttatgcaccttacattttgaaccactggaaaaaaaatagcgcgctatagcgttgagaatt

SEQ ID NO: 4695 - DNA, 987 bp, Secale cereale
cccctgtcccatccgacaaaacacgccaagcacgcgcaccgaatcaaccgcccgagcaagcacagcacgagcagacaccaccacctgcccggaccgccgcccgccgtctcccaggagctcagtcagaggcgccaagaagaaccgcacgcacgggagcggccggagcaggcggcaccggaagagccggatcgatggcgatggccccgccggcgccgctgccggtggtggggcagcagttctgcgcgccgtacgtggtgccgctgacggtgaccaagaaggccctcagcctctcggacggcgacttcgccatcacggacgccaacggcgccgtggtgctcaaggtcaagggcgccatcttcagcatccgcagccgccgcaccatcctcgatggcgccgggatgcccctcctcaccatgcaagaaaaggtgttcagcatgcaccaccgatgggaggtgttcagaggggacagcaccaacgcacgcgacctgctcttcagcgtcaagacaacctcgctgatccagctcaagacggagatggacgtcttcctggccgggaacaccgcgcaggcaggtctgcgacttcaagatcaagggcagctacttcgaccggtcctgcgtcttctacctcggcgactccaacaacatggtagctcaaatgagccgtaagctgacggtttccaatgtgctgctggggagggacacgttcagcgtcaccgtgttcccgcacgtcgactatgtgttcatcgcgagccttgttgtgatcctcgacgaggttcacagggacaagcgcgacgattgatgaatgagttatgtatagtacactcctggatcatgagcgtccctggagttctactagactactactgtggtgccatcccaagctgatgtgttgtcgcttgtcactggtgttatctgcatttcttgtagcattatggtagcatggtgagccatgctgaattgtgatgttgtggaataatgtttatgcacc

SEQ ID NO: 4696 - DNA, 1128 bp, Brachypodium distachyon
gcggctcacggaacaacagaaagctccaccatctcctgtttcttcttccctgtcccatcccaagcaacacgcaaaggccgagcaaacgcagggcaaacacagccccaccagtgaccagaccagagctcgaaagcgtgcgaaagagcgagcaagcaaattaagcgagaagtaacccggattcctttcgatcgatggcggcggcggcggcggccagcggagccccaccggcgccgctgccggtggtggggcagcagttctgcgcgccgtacgtggtgcctctgacggtgaccaagaaggccatcagcctctccgacggcgacttcgccatcaccgacgccaacggcgccgtcgtgctcaaggtcaagggcgccatcttcagcatccggaaccgccgcgtgctcctcgacgctgccggccagcccctactctccatgcaagagaaggtattcagtatgcacaacagatgggaagtgttcagaggggacagcacaaatgcaagcgatctgctcttcactgtgaagaaatcctcaatgatacaactcaagacagagatggatgtcttcttggccggaaacaccgcacagcaggtctgcgatttcaagatcaagggcagctacttcgacaggtcctgcgccttctatttgggcaactccagtaccatggtagctcaaatgaaccgtaagttcactgtttcaaatgtactgcttgggaaggacacatttggtgtcaccgtgttcccacatgtcgactacgtgttcatcgcgactcttgttgtgatcttggatgaggttcacagggacaaaaacgattgatgaacacagtcgcctcctgagcttccttcggatcccgctgcggtcatgtcatctcaaattgttattgttcgtactcttatccggatcgagggctgcatgcactgtatatgctgctgctagacagattgagtgttgaacatgctgacttgtgatgttgcaataatgattattaccgtgtcgtctgatcaacggtttggattggaattgcttactgcgataagtatggttgtttctttaagattctgtcagggtatgcgtactgttgtgtgaccctatcgcagttggtgccgagtctgaaatatgcatctcgtgtgca

SEQ ID NO: 4697 - DNA, 1158 bp, Brachypodium distachyon
cggctcacggaacaacagaaagctccaccatctcctgtttcttcttccctgtcccatcccaagcaacacgcaaaggccgagcaaacgcagggcaaacacagccccaccagtgaccagaccagagctcgaaagcgtgcgaaagagcgagcaagcaaattaagcgagaagtaacccggattcctttcgatcgatggcggcggcggcggcggccagcggagccccaccggcgccgctgccggtggtggggcagcagttctgcgcgccgtacgtggtgcctctgacggtgaccaagaaggccatcagcctctccgacggcgacttcgccatcaccgacgccaacggcgccgtcgtgctcaaggtcaagggcgccatcttcagcatccggaaccgccgcgtgctcctcgacgctgccggccagcccctactctccatgcaagagaaggtattcagtatgcacaacagatgggaagtgttcagaggggacagcacaaatgcaagcgatctgctcttcactgtgaagaaatcctcaatgatacaactcaagacagagatggatgtcttcttggccggaaacaccgcacagcaggtctgcgatttcaagatcaagggcagctacttcgacaggtcctgcgccttctatttgggcaactccagtaccatggtagctcaaatgaaccgtaagttcactgtttcaaatgtactgcttgggaaggacacatttggtgtcaccgtgttcccacatgtcgactacgtgttcatcgcgactcttgttgtgatcttggatgaggttcacagggacaaaaacgattgatgaacacagtcgcctcctgagcttccttcggatcccgctgcggtcatgtcatctcaaattgttattgttcgtactcttatccggatcgagggctgcatgcactgtatatgctgctgctagacagattgagtgttgaacatgctgacttgtgatgttgcaataatgattattaccgtgtcgtctgatcaacggtttggattggaattgcttactgcgataagtatggttgtttctttaagattctgtcagggtatgcgtactgttgtgtgaccctatcgcagttggtgccgagtctgaaatatgcatctcgtgtgcagagtccgggagtaacaaagattacattgtct

SEQ ID NO: 4698 - DNA, 820 bp, Avena sativa
ctaggccggccgatcgatggcgttcccggcggccagcggagccccaccggcgccgctgccggtggtggggcaccagttctgcgctccgtacgtggtgccgctcacggtgaccaagaaagccctcagcatctccgacggcgacttcaccatcaccgacgccaacggcgccgtcgtgctcaaggtcaaggggtccatcttcagcctgcggcaccgccgcgtcctcctcgacgccgccggccagcccctcctctccatgcaagagaaggtattcagtatgcacaacagatgggaagtgttcagaggggacagctcaaacgcaagcgatctgctctttagtgtgaaaaagtcttcgatgatccaattcaagacggagatggacgtattcttggctgggaacaccgcgcagcaggtctgcgatttcaagatcaagggcaactacttcgacaggtcctgcgccttctaccttggcaactccaccacaatggtagctcaaatgaaccgtaagttcactatttcgaatgtgctgctcgacagggacacgtttgtcgttaccgtgtttcctcatgtcgactatgtgttcatcgcgactcttgttgtgatcctggatgaggttcacagggagaaatacgatcagtgagcgagatggactcttgtgtcttgctttgagttctgcaactgtcgtgtcgtctcaagttgttgctgttgtatgtttctgatcgagggttgcatgtattgtacagtattagccagctcggtaaactgtcaatccgtgctgaattgtgatgttgcgcaataatgtttatgcacttcccgtttgatc

SEQ ID NO: 4699 - DNA, 933 bp, Festuca arundinacea
accatcttctgtttctcccctgtcccggaacaacacgccaaagcaagcgcacacaccacaagggctcaaagtttactagcccgatcgatggcgtttccggcggcgagcggagcagccccaccggcgccgctgccggtggtggggcatcagttctgcgtgccgtacgtggtaccgctgaccgtgaccaagaaggccctcagcatctccgacggagacttcgccatcactgacgccaacggcgccctcgtgctcaaggtcaagggatccatcttcagcatgcgccaccgccgcgtcctcctcgacgccgccggccagcccctcctctccatgcaagagaaggtattcagtatgcaccacagatgggaagtgttcagaggggacagctcaagcgcaagcgatctgctcttcagcgtgaagaaatcttcgttgatccaattcaagacagagatggatgtcttcttggctggaaacaccgcgcagcaggtgtgcgatttcaagatcaagggcaactacttcgacaggtcctgcgccttctatcttggcgactccaccacaatggtagcccaaatgaaccgtaagttcactgtttcgaatgtgctgctcgacagggacacgtttgtggttaccgtgtttccgcatgtcgactacgtgttcatcgcgactcttgttgtgatcctggatgaggttcacagggagaaatacgatggatgagcgagattgtacactaagcttcctttgagtgctggcagtgctgtgtcatctcaagttgctgttgtatgtacctgacctgatcgagggttgcatgtattgtattagccagctcggtgagctgtctgaaccatgctgaattgtgatggtctgcaataatgggagatttgataatgatctctccagaacgcatgactttgatcataaaaaaaaaaaaaaaaaaaa

SEQ ID NO: 4700 - DNA, 1663 bp, Lolium multiflorum
ctgtttctcgcctttcccgtcccgaagaacacgccaagcaggagcaccgaatcaatccaccgaggaagcaaggtctgaaatgctaccagccccagcgattccgttgccggacagcgaggccccaccagcgccgctgccggtggcggggcatcagttctgcgcgccgtacgtcgtgccgctcacggtgaccaagaaagccctcagcctctccgacggcgacttcgcaatcaccgacgccaacggcgccgtcgtgctcaaggtcaagggaaccatcttcagcatgcagaaccgccgcgtcctcctcgatgccgctggcctgcccctcctctgcatgcaagagaaggtattcagtatgcaccaccggtgggaagtgttcagaggggacagcacaaacacaggcgatctgctctttagtgtgaagaaatcttcgatgatccaattcaagacagagatggatgtcttcttggctggaaacaccgcacaacaggtctgtgatttcaagatcaagggcagctaccttgataggtcatgcgccttctatcttggcaactctgctgcaatggtagctcaaatgaaccgtaagatgactgtttctagtgtgctgctcgacaaggacacatttgctgttactgtgttcccgcatgtcgactacgtgtttatcgccgctcttgttgtgatcctagacgacgttcacagggacaaaaacgattgatgaagtttcgccgctatcatgttgatgttgtttgtcactaattgtttttcgagaaccccatgcgtgccgttatattaagctttcaagagtttatgttatagaaaacggaacaaaccaccgaaaataaaacaccacttgagtcggcacaggtacatggagagggctaagatctctttcaaacttccacttctacacgctacccatgacagccactcaatgtcgatgatctctaggagcgagtgggccgggatcagattgccatcgaaaacgcgcgagttccgttggagcaatagggatctcatgatcagcaaagcgcaggaattgaaagccttgcgtgctgatggagccttcctgccgaattgtcacgactattgtcacaccgtagtgtcaggtggtgccacctagggtgtgtggtatacagtggcacttgagttgtgcgtgtaacctgggcgttggccagctggtgtgagtcgctgcgtgttataagcagctaatcctgtaacagacaaaccaagttggaaagaatagaagaaaacggagaaatctgtctccttctatctcctatctctgttcttcctcttcatcgcgagttcctcgcaaatccccaattcctcacgctggcaatcacaccagccaaggggactattacacttggtatcagattcgggacgagctccagggcacgctgctgtgcgtgatttcgttttcccctttcgattttgagttgtaattccggggtcgcattaaatcctcgcgctggtcgcttgatcgtgaggcgggacaccacggcaccagccaagccgtcgttgcagacccagtacgtcctcgacgcgatgggggaggcggtggaagagacgagcgccacgctcgctaggcttgaatcaagcctcgatctcctgcacggggtggtcgccggagttgacacagcacagcagcagatgcgagcgcagc

SEQ ID NO: 4701 - DNA, 847 bp, Secale cereale
gactcattcgacaaaacacggcaagcacgcgcaccgaatccatcgccccagcaagcagacaccatctgccgacctgcgagactgccgcccaccttctccgaggagctcagaagcgccgagaagaaccgcacgggggagcggccggcaccggaagaaccggatcgatggcgatggccccgccggcgccgctgccggtggtggggcagcagttctgcgcgccgtacgtggtgccgctgacggtgaccaagaaggccctcagcctctcggacggcgacttcgccatcacggacgccaacggcgccgtggtgctcaaggtcaagggcgccatcttcagcatccgcagccgccgcaccatcctcgacggcgccgggatgcccctcctcaccatgcaggaaaaggtgttcagcatgcaccaccgatgggaggtgttcagaggggacagcaccaacgcacgcgacctgctcttcagcgtcaagacaacttcgctgatccagctcaagacggagatggacgtcttcctggccgggaacaccgcgcagcaggtctgcgacttcaagatcaagggcagctacttcgaccggtcctgcgtcttctacctcggcgactccaacaacatggtggctcaaatgagccgtaagctgacggtttccaatgtgctgctggggaggacacgttcagcgtcaccgtgttcccgcacgtcgactacgtgttcatcgccagccttgtgtgatcctcgacgaggttcacagggtacaagcgcgacgattgatgagtgagttacgtatagtacactcctggatcatgagcgtccctggagttctactagactactactgtggtgtcatcc

SEQ ID NO: 4702 - DNA, 1048 bp, Avena sativa
ccaccatcttgagttcctcccgtgtcccgtccggaacaacacgccaagcacgcgcacagaatcaatcgaccgaccgagcaagcagagcacagaccaggccatccccttcccccgtaagagctcagctcaaaggcttcttactaggccggccgatcgatggcgttcccggcggccagcggagccccagccccaccggcgccgctgccggtggtggggcaccagttctgcgccccgtacgtggtgccgctgacggtgaccaagaaggccctcagcatctccgacggcgacttcgccatcaccgacgccaacggcggcctcgtgctcaaggtcaagggctccatcttcagcctgcggcaccgcgcgtcctcctcgacgccgccggccagcccctcctctccatgcaagagaaggtattcagtatgcacaatagatgggaagtgttcagaggggacagcgcaaacgcaagcgatctgctctttaccgtgaaaaaatcttcgatgatccaattcaagacagagatggacgtgttcttggctgggaacaccgcgcagcaggtctgcgatttcaagatcaagggcaactacttcgacaggtcctgcgccttctaccttggcaactccaccacaatggtagctcaaatgaaccgtaaggtcactatttcgaacgtgctgctcgacagggacacgtttgtcgttaccgtgtttcctcatgtcgactatgtgttcatcgcgactcttgttgtgatcctggatgaggttcacagggagaaatacgatcagtgagcgagatggactctcgtgtcctgagcttccgatccttcgagttctgccactgtcgtgtcatctcaagttgctgttgttgtatgttcctgatcgagggttgcatctattgtacagtattagccagctcggtgaactgtcaatccgtgctgaattgtgatgttgcgcaataataatgtttatgcacttcccgtttgatcgcgggcctgcgaattgtttaccatagccactgattatttgctgggatgacgtgttaaactatgttagga

SEQ ID NO: 4703 - DNA, 842 bp, Festuca arundinacea
aagcaagcgcgcacaccacaagagcccaaagtataccagcccgatcgatggcgtttccggcggcgagcggagcagccccaccggcgccgctgccggtggtggggcatcagttctgcgcgccgtacgtggtgccgctgaccgtgaccaagaaggccctcagcatctccgacggagacttcgccatcactgacgccaacggcgccctcgtgctcaaggtcaagggatccatcttcagcatgcggcaccgccgcgtcctcctcgacgccgccggccagcccatcctgtccatgcaagagaaggtattcagtatgcacaacagatgggaagtgttcagaggggacagctcaagcgcaagcgatctgctcttcagcgtgaagaaatcttcgttgatccaattcaagacagagatggatgtcttcttggctggaaacaccgcacagcaggtgtgcgacttcaagatcaagggcaactacttcgacaggtcctgcgccttctatcttggcgactccaccacaatggtagcccaaatgaaccgtaagttcactatttcgaatgtgctgctcgacagggacacatttgtggttaccgtgtttccgcatgtcgactacgtgttcatcgcgactcttgttgtgatcctggatgaggttcacagggagaaatacgatggatgagcaagatgtacactaagcttcctttgagctctggcagtgtcgcgtcatctcaagctgctattgtatgtaccagacctgatcaagggttgcatgtattgtattagccagctcggtgagctgtctgaaccatgcggaattgtggtggtctgcaataatcggagatttgataat

SEQ ID NO: 4704 - DNA, 969 bp, Lolium multiflorum
ctgggaactcgcggccagccgtgatcggcatataggaagctacacaagaaaaggctccaccatcttcttgtgtttctcccctgtcccgtccggaacaacacgccaagcaagcgcacacaccacaagagctcaaagtataccagcccgatcgatggcgtttccggcggcgagcggagcagccccaccggcgccgctgccggtggtggggcatcagttctgcgcgccgtacgtggtgccgctgaccgtgaccaagaaggccctcagcatctccgacggagacttcgccatcactgacgccaacggcgccctcgtgctcaaggtcaagggatccatcttcagcatgcgccaccgccgcgtcctcctcgacgccgccggccagcccatcctgtccatgcaagagaaggtattcagtatgcacaacagatgggaagtgttcagaggggacagctcaagcgcaagcgatctgctcttcagcgtgaagaaatcttcgttgatccaattcaagacagagatggatgtcttcctggctgggaacaccgcacagcaggtgtgcgacttcaagatcaagggcaactacttcgacaggtcctgcgccttttatcttggcgactccaccacaatggtagcccaaatgaaccgtaaattcactatttcgaatgtgctgctcgacagggacacatttgtggttactgtgtttccgcatgtcgactacgtgttcatcgcgactcttgttgtgatcctggatgaggttcacagggagaaatacgatggatgagcgagattgtacactaagcttcctttgagctctggcagtgtcgtgtcatctaaagttgctgttgtatgtacctgacctgatcgagggttgcatgtattgcattagccagctggctatctgaaccatgctgaattgtgatggtctgcaataatgggagatttgataataacatctccagaacgcatgactttgat

SEQ ID NO: 4705 - DNA, 983 bp, Avena sativa
acgcggccagcggcacaaacaacggcatatacgaagctatatactcctacagaagaagctccaagctccaccatcttgagttcctcccgtgtcccgtccggaacaacacgccaagcacgcgcaccgaatcaatcgaccgaccgagcaagcagagcacagaccaggccatcccctccccccgtaagagctcagctcaaaggcttcttactaggccggccgatcgatggcgttcccggcggccagcggagccccagctccaccggcgccgctgccggtggtggggcaccagttctgcgccccgtacgtggtgccgctgacggtgaccaagaaggccctcagcatctccgacggcgacttcgccatcaccgacgccaacggcggcctcgtgctcaaggtcaagggctccatcttcagcctgcggcaccgccgcgtcctcctcgacgccgccggccagcccctcctctccatgcaagagaaggtattcagtatgcacaatagatgggaagtgttcagaggggacagcgcaaacgcaagcgatctgctctttaccgtgaaaaaatcttcgatgatccaattcaagacagagatggacgtattcttggctgggaacaccgcgcagcaggtctgcgatttcaagatcaagggcaactacttcgacaggtcctgcgccttctacctcggcaactccaccacaatggtagctcaaatgaaccgtaagttcactatttcgaacgtgctgctcgacagggacacgttcatcgttaccgtgtttcctcatgtcgactatgtgttcatcgcgactcttgttgtgatcctggatgaggttcacagggagaaattcgatcagtgagcgagatggactctcgtgccccgagcttcctttgtgttcatctcaagttgctgttgtatgttcctgatcgagggttgcatgtattgtacagtattagccagctcggtaaactgtcaatctgtgctgaattgtg

SEQ ID NO: 4706 - DNA, 982 bp, Avena sativa
cctacggaagaagctccaagctccaccatcttgagttcctcccgtgtcccgtccacaacaacacgccaagcacgcgcaccgaatcaatcgaccgaccgagcaagcagagcacataccatcccctccaccgcgtaagagctcaaaggcttcttactaggccggccgaccgatggcgttcccggcggccagcggagccccagccccaccggcgccgctgccggtggtggggcatcagttctgcgccccgtacgtggtgccgctgacggtgaccaagaaggccctcagcatctccgacggcgacttcgccatcaccgacgccaacggcggcctcgtgctcaaggtcaaggggtccatcttcagcctgcggcaccgccgcgtcctcctcgacgccgccggccagcccctcctctccatgcaagagaaggtattcagtatgcacaatagatgggaagtgttcagaggggacagcgcaaacgcaagcgatctgctctttaccgtgaaaaaatcttcgatgatccaattcaagacagagatggacgtgttcttggctgggaacaccgcgcagcaggtctgcgatttcaagatcaagggcaactacttcgacaggtcctgcgccttctacctcggcaactccaccacaatggtagctcaaatgaaccgtaagttcactatttcgaacgtgctgctcgacagggacacgtttatcgttaccgtgtttcctcatgtcgactatgtgttcatcgcgactctcgttgtgatcctggatgaggttcacagggagaaattcgatcagtgagcgagatggaatctcgtgtcctgagcttcctttgagttctgccactgtcgtgtcatctcaagttgctgttgttgtatgttcctgatcgagggttggatgtattgtacagtattagccagctcggtgaactgtcaatccgtgctgaattgtgatgttgcgcaataataatgtttatgcacttcccgt

SEQ ID NO: 4707 - DNA, 986 bp, Avena sativa
cgaagctatatactcctacagaagaagctccaagctccaccatcttgagttcctcccgtgtcccgtccagaacaacacgccaagcacgcgcaccgaatcaatcgaccgaccgagcaagcagagcacagaccaggccatcccctccccccgtaagagctcagctcaaaggcttcttactaggccggccgatcgatggcgttcccggcggccagcggagccccagctccaccggcgccgctgccggtggtggggcaccagttctgcgccccgtacgtggtgccgctgacggtgaccaagaaggccctcagcatctccgacggcgacttcgccatcaccgacgccaacggcggcctcgtgctcaaggtcaagggctccatcttcagcctgcggcaccgccgcgtcctcctcgacgccgccggccagcccctcctctccatgcaagagaaggtattcagtatgcacaatagatgggaagtgttcagaggggacagcgcaaacgcaagcgatctgctctttaccgtgaaaaaatcttcgatgatccaattcaagacagagatggacgtgttcttggctgggaacaccgcgcagcaggtctgcgatttcaagatcaagggcaactacttcgacaggtcctgcgccttctacctcggcaactccaccacaatggtagctcaaatgaaccgtaagttcactatttcgaacgtgctgctcgacagggacacgttcatcgttaccgtgtttcctcatgtcgactatgtgttcatcgcgactcttgttgtgatcctggatgaggttcacagggagaaattcgatcagtgagcgagatggactctcgtgccccgagcttcctttgtgttcatctcaagttgctgttgtatgttcctgatcgagggttgcatgtattgtacagtattagccagctcggtaaactgtcaatctgtgctgaattgtgatgttgcgcaataatgtttatgcacttcccgttt

SEQ ID NO: 4708 - DNA, 1024 bp, Avena sativa
tacgaagctatacaacccctacggaagaagctccaagctccaccatcttgagttcctcccgtgtcccgtccacaacaacacgccaagcacgcgcaccgaatcaatcgaccgaccgagcaagcagagcacataccatcccctccaccgcgtaagagctcaaaggcttcttactaggccggccgaccgatggcgttcccggcggccagcggagccccagccccaccggcgccgctgccggtggtggggcatcagttctgcgccccgtacgtggtgccgctgacggtgaccaagaaggccctcagcatctccgacggcgacttcgccatcaccgacgccaacggcggcctcgtgctcaaggtcaaggggtccatcttcagcctgcggcaccgccgcgtcctcctcgacgccgccggccagcccctcctctccatgcaagagaaggtattcagtatgcacaatagatgggaagtgttcagaggggacagcgcaaacgcaagcgatctgctctttaccgtgaaaaaatcttcgatgatccaattcaagacagagatggacgtgttcttggctgggaacaccgcgcagcaggtctgcgatttcaagatcaagggcaactacttcgacaggtcctgcgccttctacctcggcaactccaccacaatggtagctcaaatgaaccgtaagttcactatttcgaacgtgctgctcgacagggacacgtttatcgttaccgtgtttcctcatgtcgactatgtgttcatcgcgactctcgttgtgatcctggatgaggttcacagggagaaattcgatcagtgagcgagatggaatctcgtgtcctgagcttcctttgagttctgccactgtcgtgtcatctcaagttgctgttgttgtatgttcctgatcgagggttggatgtattgtacagtattagccagctcggtgaactgtcaatccgtgctgaattgtgatgttgcgcaataataatgtttatgcacttcccgtctgattgcgggcctgcgattgttta

SEQ ID NO: 4709 - DNA, 636 bp, Secale cereale
gccactcgagcactcgatccgattcgatctttctacgcgtctcgagctccccgttcttcgatctcaatcaatggcgccgtccatctccattgccgtcgcgccgccggcctcgggctggaagagcggcaggaaggccggggcggcgccggcgcccgcggagggcgaggcggaggcggtgctgctgcgtcgccggaacgccgagctggagcgggaggtggcgctgctgcgggcgagctggaggccgcgcggctgcgcgccgaggccgcggaggaggccgaggagcggctgtgcgcgcagctcggcgaggccgagtgcgaggccctcgagctcgcgcgcgcgtaccagggccacgtccaggagctcgcgcgggagctcgccgccgcgcgcagcagctagcggagcgcctaggcccgccggaggcggagaggcaggccgagctcgtcggtgattctttgacgatcgaccaagagacgtgacacgctctcgagtctcgacactcgcagtgcggcggcagtatagattccttagacaaatgtactaaaacgaaacgagattaattagtttcttgcccgagcaagattgcagtggttgttgtaacttgtacgcctacagttgaatagaactccagcaacattt

SEQ ID NO: 4710 - DNA, 631 bp, Secale cereale
tagcagccactcgagcactcgatccgattcgatctttctacgcgtctcgagctccccgttcttcgatctcaatcaatggcgccgtccatctccattaccgtcgcgccgccggcctcgggctggaagagcggcaggaagaccggagcggcgccggcgcctgcggagggcgaggcggaggcggtgctgctgcggcgccggaacgccgagctggagcgggagtggcgctgctgcgggcggagctggaggccgcgcggctgcgcgccgaggccgcggaggaggccgaggagcggctgtgcgcgcagctcggcgaggccgagtgcgaggccctcgagctcgcgcgcgcgtaccagggccacgtccaggagctcgcgcgggagctcgccgccgcccgcagcagatagcggagcgcctaggcccgccggaggcggagaggcaggccgagctcgtcggtgatactttgacgatcgaccaagagacgtgacacgctctcgacactcgcagtgcggcggcagtatagattccttagacaaatgtaaaacgaaacgagattaattagtttcttgcccgagcaagattgcagtggttgttgtaacttgtacgcctacagttgaatagaactccagcaacattt

SEQ ID NO: 4711 - DNA, 883 bp, Hordeum vulgare
tcccggccctcacccccgcccataaattaacccgagcaccagttgccacatctcaaagcaaccccagcacactgcagccaatcataacagccactcaagcactcgattcgtttcggtcctctctctctttcgagctctccgtgctccgatctcggtccatggcgccgtccatctccattgccgtccctacgccggcctcgggctggaagagcggcaggaaggccgcggagggcgaggcggaggcggcgctgctgcggcgccggaacgccgagctggagcgcgaggtggcgctgctgcgggcggagctggaggccgcgcggctgcgcgccgaggccgcggaggaggccgaggagcggctgtgcgtgcagctcggcgaggccgagtgcgaggccctcgagctcgcgcgcgcgtaccagggcgaggtccaggagctcgcgcgggagctcgccgccgcacgcagcagatagcggagcacctacagcctagaggcaggcagagcgcgtcggcctcgacgaaggcggtgcagcggcagtatagattccttagacaaaatgtaaagcgaggttaattaattactctgtgcttctagagattctaatagaggactactccttccgttcctaaatactaccttcgtccggaaatacttgtcctaaagatgaatatatctagacttattttaattatagatacatccattatatgcatttttaggacaagcatttccgaacggaggaagtataattcttttaagagatttcacgtctcatacggggcaaaataagtgaatctctagtctaaagtatgtctatatacatctgtatgtagtttaccagtgaaacctctacaaaaacttatactccctccgtctgaaaataattgt

SEQ ID NO: 4712 - DNA, 1257 bp, Triticum aestivum
tcactctctccctctcccactccggcgcgcgctcagctgaatctcgccgcaggagcaatggcgtcggtgcatctgtgcggcccgaaggtggcgtcggcggcgatggcgaagccggcgctggcggacgggctccgcatccccacttcgtcgtcggcgcgtcccgtgccgacggggcgcaggctccggggcctcgtcgtcagggccgccacggtcgtgtcgcccaagtatacttctgtgaaaccattgggagatagggtactagtgaagaccaagactactgaggataaaactgctggagggatattgcttccaacaacagctcagtcaagaccacaagcaggggaggttgttgcagttggagaggggagaagcttaggcagcaacatcgttgagatcagtgttccggttggtgccaaagttatttactctaaatacgctggcaccgagctggaattcaatgataccacccacctcattatgaaagaagatgacatcattggtattcttgacactgatgacgtgaaagatctgaagccactgagtgaccgtattctcattaaggttgcagagtctgaagaggaaactgctggcggtttgctattgacacaggcgtcgaaagagaagccttccgttggaacagtggtcgctgttggccccgggccattgggcgatgatggcagcaggacaccattgtcaatcactcctggaagcagcgtgctgtactccaagtatgcaggaagcgagttcaagggttcggaaggcgagtacattgttctcaggtcatccgacgtgatagcggtgctgtcatcataagcttgccctgccctacgtgaactaggaattttgatatttagtccaaaaccttgtttggttattgctctttgcttgtgattggtgaactgtgaattgcttcttcgctctatcgtggaaatgctgcttgatagttttaataagatgacggcttagacttcagaagtggctgtgctctgcttctaagcgtcttggtttggtgggcgtctaaacgttgacagatcggcagggtcagcgtttctcacgaagattggccgactgaaaataacccgccatgtgaagaacgcttggtagctgtagtaaaaaagcatgctgacattgcacttggctcggttggtgaaccactatgctggataatactactcgtctgccagagttggtgtatcggtacagaagatttgtctctaggaggatatagtcatacaaaaatgctatttgtgcgttgtt

SEQ ID NO: 4713 - DNA, 946 bp, Secale cereale
aggagccatggcgtcggtgcatctgtgcggcccgaaggtggcgtcggcggcgatggcgaagccggcgctggcggacgggctccgcgtccccgcttcgtcgtcggcgcgtcccgtgccgacggggcggaggctccggggcctcgtcgccagggccgccacggtcgtgtcccccaagtatacttctgtgaaaccattgggagatagggtactagtgaagaccaagactactgaggataaaactgctggagggatattgcttccaacaacagctcagtcaagaccacaagcaggggaggttgttgcagttggagaggggagaagcttaggcagcaacatcgtcgaaatcagtgttccggttggtgccaaagttatttactcgaaatacgctggcaccgagttggaattcaatgataccacccacctcattatgaaagaagatgacatcattggtattctcgacactgatgacgtgaaagatctgaaaccactgagtgaccgtattctcattaaggttgcagagtctgaagaggaaactgctggcggtttgctattgacacaggcatcgaaagagaagccttctgttggaacagtggtcgctgttggccctggggggttgggtgatgatggcagcagtacgccattgtcgatcactcctggaagcagcgtgctgtactccaagtatgcaggaagcgagttcaagggttcggaaggcgagtacatcgttctcaggtcatccgacgtgatagccgtgctgtcatcataaaaagcttgtcctgtcctgctcatgtgaactaggaattttgatatttagtccaaaacattgtttggttactctcgcttcggatcatattggtgaattgcttcttttgctctactaccctgttatggtggaaaatgctgcctggtagtttaataagatgacggcttagattttcagaaaaaaaaa

SEQ ID NO: 4714 - DNA, 1032 bp, Secale cereale
cagccccggtctcctcggtttctcctcctccccgaaccctcgctccatcactctctctcactcccactccggcgcgccgtcagctgaatctcgccgtaggagccatggcgtcggtgcatctgtgcggcccgaaggtggcgtccgcggcgatggcgaagccggcgctggcggacgggctccgcgtccccgcttcgtcgtcggcgcgtcccgtgccgacggggcggaggctccggggcctcgtcgccagggccgccacggtcgtgtcccccaagtatacttctgtgaaaccattgggagatagggtactagtgaagaccaagactactgaggataaaactgctggagggatattgcttccgacaacagctcagtcaagaccacaagcaggggaggttgttgcagttggagagggaagaagcttaggcagcaacatcgtcgagatcagtgttccggttggtgccaaagttatttactctaaatacgctggcaccgagttggaattcaatgataccacccacctcattatgaaagaagatgacatcattggtattcttgacactgatgacgtgaaagatctgaagccactgagtgaccgtattctcattaaggttgcagcgtctgaagaggaaactgctggcggtttgctattgacacaggcatcgaaagagaagccttctgttggaacagtggtcgctgttggccctggggggttgggtgatgatggcagcaggacgccattgtcgatcactcctggaagcagcgtgctgtactccaagtatgcaggaagcgagttcaagggttcggaaggcgagtacattgttctcaggtcatccgacgtgatagccgtgctgtcatcataagaagcttgtcctgtcctgctcatgtgaactaggaattttgatatttagtccaaaacattgtttggttactctcgcttgggatcaaattggtgaattgcttcttttgctctactaccctgttatggtggaaaatgctgcctggtagtttaataagatgacggcttagattttc

SEQ ID NO: 4715 - DNA, 1183 bp, Secale cereale
cttggtttctcctcctccccgaaccctcgctccatcactctctctctctcactccggcgcgccgtcagctgaatcctgccgtaggagccatggcgtcagtgcatctgtgcggcccgaaggtggcgtccgcggcgatggcgaagccggcgctggcggacgggctccgcgtccccgcttcgtcgtcggcgcgtcccgtgccgacggggcggaggctccggggcctcgtcgccagggccgccacggtcgtgtcccccaagtatacttctgtgaaaccattgggagatagggtactagtgaagaccaagactactgaggataaaactgctggagggatattgcttccgacaacagctcagtcaagaccacaagcaggggaggttgttgcagttggagagggaagaagcttaggcaccagcatcgtcgagatcagtgttccggttggtgccaaagttatttactctaaatacgctggcaccgagttggaattcaatgataccacccacctcattatgaaagaagatgacatcattggtattcttgacactgatgacgtgaaagatctgaagccactgagtgaccgtattctcattaaggttgcagagtctgaagaggaaactgctggcggtttgctattgacacaggcatcgaaagagaagccttctgttggaacagtggtcgctgttggccctggggggttgggtgatgatggcagcaggacgccattgtcgatcactcctggaagcagcgtgctgtactccaagtatgcgggaagcgagttcaagggttccgaaggcgagtacatcgttctcaggtcatccgacgtgatagccgtgctgtcatcataaaaagcttgtcctggcctgctcatgtgaactaggaattttgatatttagtccaaaacattgtttggttactctcgcttgggatcaaattggtgaattgcttctttgctctactaccctgttatggtggaaaatgctgcctggtagtttaataagatgacggcttagattttcagaaacgactgtgctttgttttgaagcgtcttgtttgctgcgtgcttaaacgttgacggatcgttagggtcagcgtttctcaggaatattgactgactgaaaacaacctgctcatgtcaagaacactcggtagtttacagtagtccacaagcatgcatacagtgcaa

SEQ ID NO: 4716 - DNA, 1020 bp, Echinochloa colona
accacagtgagcgcttgcagttgcagataacagctcaacacctccttatcctaagcccaatccccgtctctccgtgccttctccattccctcgccctcgactcgaagcagccatggcgtcggtgcacctgactgggccgcgggtggcggtggccgcgaagccggccgcgctgggcgggctccgcctgccgacgccgtcgattgccgtgccgacggggcggagggcccgggggctcgttgtgagggccgccacggtcgtgtcgcccaagtacacttccataaaaccattaggagacagagtacttgtgaaggtcaagacctccgaggctaaaactgatggagggattttacttccagtatcagttcagacaagaccacaaggaggggaagttgttgctgttggagagggtagaagttttggaagtaacagcattgaaataagtgttccgattggtgctcaagttgtctactcaaaatacgcgggcacagaattggaattcaacgatgaggcccatctcattttgaaagaggatgacatcatcggtattctcgatggtgatgatgtgaaagatctgaagccactgaatgatcgtattctgattaaggttgctgaagctgaagaacaaactcctggtggcttgctattgactcaggcatctaaagagaagccttctgttggaacagtggtagccgttggccccgggccattgggcgaggacggcagcaggacatctctgtcgatcactcctggaagcaacgtgatgtacaccaagtatgccggaagcgagttcaagggcgtggagggcgagtacatcgtgctcagggcatccgacgtgatggctgttctttgctcctaatctgaagcagatactaccgcacgtgcaagatagaaattttgatggttaggccggaccttatctttcatttgatcttgtttggaattggcgtaagcttttgaactgcaatttggtgcaaatgctacggaaaataagatgagttgcttagacttgagatagaaaat

SEQ ID NO: 4717 - DNA, 882 bp, Setaria italica
tctcaccccccgccctcggagcagcagccatggcgtcgttgcacctgactgggccgcgggtggcggtggccgcgaagccggccgcgctgggcgggctccgcctgccgacgccgtcgattgccgtgccgacggggcggagggcccgggggctcgtggtgagggccgccaccgtcgtgtcacccaagtatacttccataaaaccattaggagacagagtacttgtgaaggtcaagaccaccgaggctaaaactgatggagggattttacttccagtatcagttcagtcaagaccaacaggaggggaagttgttgctgttggagaggggagaagttttggaagtaacagcatcgagatcagcgttccggttggtgcacaagttgtctactcgaaatacgccggcacggaattggaattcaatgacgccgaccatctcattttgaaagaagatgacatcattggtattctcgacagtgatgatgtgaaagatctgaagccgctgaatgatcgtattctgattaaggttgctgaagctgaagaacaaactgctggtggtttgctattgacgcaggcgaataaagagaaaccttctgttggaacagtggtagctgttggccccgggccgttgggcgaggacggcacaaggaaggccctgtcgatcactcctggaagcaacgtgatgtacagcaagtacgccggaagcgagttcaagggtcaggacggcgagtacatcgtgctcagggcatccgacgtgatggctgttctttcctaatcctaagcagatgccacccgtgcaaaatagaaattttgatggttaggccgtacgctgtctttcatttgctcttgtttggaattggtggaagcttttgaactgtaatttggtg

SEQ ID NO: 4718 - DNA, 1290 bp, Setaria italica
gcagcactaccacagtgagcgcttgcagataacaagttaacagctccttatcctaagcccaacccccgtctccgtgcctttctcaccccccgccctcggagcagcagccatggcgtcgttgcacctgactgggccgcgggtggcggtggccgcgaagccggccgcgctgggcgggctccgcctgccgacgccgtcgattgccgtgccgacggggcggagggcccgggggctcgtggtgagggccgccaccgtcgtgtcacccaagtatacttccataaaaccattaggagacagagtacttgtgaaggtcaagaccaccgaggctaaaactgatggagggattttacttccagtatcagttcagtcaagaccaacaggaggggaagttgttgctgttggagaggggagaagttttggaagtaacagcatcgagatcagcgttccggttggtgcacaagttgtctactcgaaatacgccggcacggaattggaattcaatgacgccgaccatctcattttgaaagaagatgacatcattggtattctcgacagtgatgatgtgaaagatctgaagccgctgaatgatcgtattctgattaaggttgctgaagctgaagaacaaactgctggtggtttgctattgacgcaggcgaataaagagaaaccttctgttggaacagtggtagctgttggccccgggccgttgggcgaggacggcacaaggaaggccctgtcgatcactcctggaagcaacgtgatgtacagcaagtacgccggaagcgagttcaagggtcaggacggcgagtacatcgtgctcagggcatccgacgtgatggctgttctttcctaatcctaagcagatgccacccgtgcaaaatagaaattttgatggttaggccgtacgctgtctttcatttgctcttgtttggaattggtggaagcttttgaactgtaatttggtgcaaaacgctacgaaaaaaataagatgagttgcttagacttgagataggagtatgctgctgctgtgtgctgcttggcaggtacgtgagctgaccaggttgccagttggtagggttcgggtctgttgtttaggtgctcttcctggtggtcagcgttttccacaaagattggccagcgacaacaacatgaacgctttcatttcgcaaggacacattggagtttgtggtcaacagggcgtgctcgcgagcactggttgggttggtgaagactggaggcagtggttgatgataactgataagagagttggtgagagaggcactttgttacaag

SEQ ID NO: 4719 - DNA, 1039 bp, Pennisetum glaucum
actagcacagtgagcccttcccggctcccgctgcagataacagcttccttatcctgagccaaacccccgtctccgtgcctcttctcaattcaactctcgccctcgaagcatagcagccatggcgtcggtgcacctgacagggccgcgggtggcggtggccgcgaagcccgccgcgctgggcgggctccggctgccgacgccgtcgattgccgtgccgacggggcggagggcccgggggctcgtggtgagggccgccaccgtcgtgtcacccaagtatacttccgtaaaaccattaggagacagagtacttgtgaaggtcaagaccactgaggctaaaactgatggagggattttacttccagtatcagttcagtcaagaccaacaggaggggaagttgttgctgttggagaggggagaagttttgggagtaacagcgtcgagatcagcattccggttggtgcacaagttgtctactcgaaatatgccggcacagaattggaattcaatgacgcagaccatctcattttgaaagaagatgatatcatcggtattctcgacagtgatgatgtgaaagatctgaagccgctgaatgatcgtgttctgattaaggttgctgaagctgaagaacaaactcctggtggtttgctattgacgcaggcaaataaagagaaaccttctgtcggaacagtggtagctgttggccccgggccgttgggtgaggacggcaccaggaagcccctgtcgatcactcctggaagcaacgtgatgtacagcaggtatgccggaagcgagttcaagggtcaggatggcgagtacatcgtgctcaaggcatccgacgtaatggctgttctttcctaagcagatagcacccgtgcaaagaaattttgatggttaagccggaccttgttgtccaatgtgctctttgtttggaatttagtggaagcttttgaactgtaatttggtgcaaacgctacggaagaaataagatgagttacttagacttgaatataggcttgagctgtgtgctgcttgggcgcc

SEQ ID NO: 4720 - DNA, 2927 bp, Secale cereale
aagatgctgctgcacgggctggtggagcggctgacggggaagaacaagcaggcgtggaaggagggcaagatccggggcacggcggtgctggtcaagagcgacgtcctcgacctcaacgacttcaacgcctccctcctcgacggcgtccacaagatcctcggcagggacgacggcgtcctcttccacctcctcagcgccaccgcccccgacccccagaatccgaggcggggcaaggtggggaaggcggcgcacctggaggagatggtggtgacgatgaagtcgacggcggcgggggagtcggtcttcaaggtcaccttcgactgggacgactcgcagggcatccccggcgccgtcatagtccgcaacacctaccgctccgagtacctgctcaagacactcaccctccacggcgtccccggcaagggcaccgtcgtcttcgtcgcaaactcctggatctaccccaacgtcgaccgcgtcttcttcgccaacgacacctatctacccagcaaaatgcctgcacttttggtgcaataccggcaagatgaactcaacaatctccgaggcgacggcacaaccggaaagtacgaggagtgggaccgtgtgtaccgctatgactactacaacgacctcggtgagccagacagcggccatccgcgcccggttctcggcggcacccaagaactcccctatccccgtcgttgcagaactggccgacccccaacaaaaacggaccctagatcagagagcagaattcctcggtacaagattaaggaggccctggagatctatgtcccgcgtgatgagcgctttggccacctcaagttgtccgacttccttggctactctctcaaggccatcaccgaggccattcttccgataattaggacctatgtcgataccacacccaaggagtttgattcatttcaagacatctataatctctatgatggtctgttgaaagtgccagataacccacacctaaaggagctcaagaataaaatcccccttcagtttattaaaagtcttttaccggttgctggcgatgacctcctgaacctgccccttccacatgttatcaaatcagatccgtatgcttggaggtcagatgaggagtttgcacgtgagatgcttgcaggcgtgaacccggtttgcatcaaacgtctgacggagttccctgtaaaaagtaccctggatcccagtgtgtacggggaccaatcaagcactatcactgaagatcaaattcagcagaaccttgaagaaggcctcacagtgaaacaggcaatggagaggaacaggctcttcattctcgatcaccacgacaacttcatgccattccttgaacgcatcaacaagttgaagggcaacttcatctacgcttccaggaccctgctgttcctcaaggccgatggcacgctgaagcccttggccatcgagctgagcgtgccgcaccccaacgggatacagcacggcgcggagagcacggtgtatcttccggctgatattgactctggtgttcaaggccagatctggcagcttgccaaggcttacgcctcggtcgatgactccgcatggcatcagcttatcagccactggctgaacacacacgcggtgatcgagccgttcgtgattgcgacgaaccggcaactcagtgtggtgcacccggtgcacaagctgctgagcccacactaccgcgacacgttgaacatcaatgccctggcgcggaccactctcatcaacgcgggtggcgtctttgagatgaccgtcttcccgggggaatacgcgcttatgatgtcttccgtggtctacaaggactggaagctcaccgagcagggcctccccgacgatctcgtcaagaggggcatggctgtgccggacgcgtcgagtccgtacggcgtccggctgctgatcaaggactacccgtacgcggtggacgggctggtgatctggtgggcgatcgagcggtgggtgaacgagtacctggccatctactacccgaacgacggcgtgctacgggcagacaaggagctggcggagtggtggagggaggtgcgcgaggtcgggcacggcgacctcaaggacgcggagtggtggccgagaatggtgaccgtgcaggagctggccaagacgtgcaccaccatcatctgggtggcgtcggcgctgcacgcggctgtcaacttcgggcagtacccgtacgcggggtacctcccgaaccggccgacggtgagccggcggaagatgccggaggagggtgacgaggagtacaaacagctggagaagggcgggaaggaggcggacaaggtgttcatccacaccatcacgagccagttccagaccatcctgggcatcacgttgatcgagatcctgtcgaagcactcgtcggacgaggtgtacctggggcagcgggacacgccggagtggacgtcggacggcaaggccctggaggcgttcaggaggttcggcacccggctgagggagatcgagaagcggatcatggacatgaacaaggacccggcgctcaagaaccggaacgggccggtgaagatgccgtacatgctgctgtaccccaacacgtcggacgccggcggcgagaaagggctcgggctcaccgccatgggcatccccaacagcgtctccatctgagcgtgatctttcttcggtagatcggttggatcgtgtctcgcagggtgtattgtgttcctttaatccttttcattcgctcttgggtgattgcggtaattagttgtcagggattagtggatgatgggaaatgatgatcgtagatgatgttgataagggtgggacaatgaggcatgaatatataaccagtgtgcatttaaacttttaaaaaaaaaaaaaaaaaaaaaaaaaaagaaaaaaaaaaaaactaaaaaaaaactgaagactgaccgaaggcacgaacgagggag

SEQ ID NO: 4721 - DNA, 2949 bp, Secale cereale
cccaacgcggcggcaactcccgtctgacatcgctgccgctgagttggtggctgtggtaaattatcggcgaggcctataaatcccggggtagcggaccgcggactaggccagcccactctacgctccttttgcgaactgcatcagcaaggagactagccggccaccggtttgcgttcctcgtgctctgccccaagaaccagagaagagaaagagagatgctgctgcaggggctggtggagcggctgacggggaagaacaagcaggcgtggaaggagggcaagatccagggcacggcggtgctggtcaagagcgacgtcctcgacctcaacgatttcaacgcctccctcctcgacggcgtccacaagatcctcggcagggacgacggcgtcctctttcacctcctcagcgccaccgcccccgaccccagaatccgaggcggggcaaggtggggaaggcggcgcacctggaggagatggtggtgacgatgaagtcgacggcggcgggggagtcggtcttcaaggtcaccttcgactgggacgactcgcagggcatccccgggcgccgtcatcgtccgcaacacctaccgctccgagtacctgctcaagacgctcaccctccacggcgtccccggcaagggcaccgtcgtcttcgtcgccaactcctggatctaccccaacgtcgaccgcgtcttcttcgccaacgacacctatctgcccagcaaaatgcctgcacttttgatgcaataccggcaagatgaactcaacaatctccgaggcgacggcacaaccggaaagtacgaggagtgggaccgtgtgtaccgctatgactactacaacgacctcggtgagccagacaagggccatccgcgcccggttctcggcggcacccaagaactcccctatccacgccgttgcaggactggccgacccccaacaagaacagaccctagatcagagagcagaattcctcagtacaagatacaggaagccctgaacatctatgtcccgcgtgatgaacgctttgggcacctcaagttgtctgacttccttggctactctctcaaggccatcaccgaggccattcttccgataattcggacctatgttgacactacacccaaggagtttgattcgtttcaagacatctatgatctctatgatggtcttctgaaagtgcccgataacaaacacctaaaggagctcaaggataaaatcccacttccgtttattaaaagtcttttaccggttgctggcgacgacctcctgaacctcgccccttccacatgttatcaaatcagaaccgcatgcttggaggacagatgaggagtttgcgcgggagatgctcgcaggcgtgaacccggtttgcatcaaacgtctgacggagttccctgtaaaaagcaccctggatcctagtgtgtacggggaccagtcaagcactatcactgaagatcaaattcagcagaacctggaagaaggcctcacagtgaaacaggcaatggagaggaacaggctcttcattctcgatcaccacgacaacttcatgccattccttgaacgcatcaacaagttgaagggcaacttcatctacgcttcaaggaccctgctgttcctcaaggccgatggcacgctgaagcccttggccatcgagctgagcctgccgcacccccacgggatacagcacggcgcggagagcacggtgtaccttccggctgatattgagtctggtgttcaaggccagatctggcagcttgccaaggcttacgcctcggtcgacgactctgcgtggcatcagcttatcagccactggctgaatacacacgcggtgatcgagcccttcgtgatcgcgacgaaccggcaactcagtgtggtgcacccggtgcacaagctgctgagcccgcactaccgcgacacgttgaacatcaatgccctggcgcggaccactctcatcaacgccggtggcgtctttgagatgaccgtcttcccgggggaatacgcgcttgagatgtctgctgtcgtctacaagaactggaagctcaccgagcagggcctccccgacgatctcgtcaagaggggcatggctgtgccggacgcgtcgagcccgtacggcgtccggctgctgatcaaggactacccatacgcggtggacgggctggtgatctggtgggcgatcgagcggtgggtgaacgagtacctggccatctactacccgaacgacggcgtgctccgggcggacaaggagctggaggagtggtggagggaggtgcgggaggtcgggcacggcgacctcaaggacgcggagtggtggccgaggatggtgacggtgcaggagcttgccaagacgtgcaccaccatcatctgggtggcgtcggcgctgcacgcggcggtcaacttcgggcagtacccgtacgcggggtacctcccgaaccggccgacggtgagccgtcggaagatgccggtgccgggcgacgaggagtacaagcagctggagaagggcggggaggaggcggacaaggtgttcatccacaccatcaccagccagttccagaccatcctgggcatcacgctgatcgagatcctgtcgaagcactcgtcggatgaggtgtatctcgggcagcgtgacacgccggagtggacgtcggacggcagggctctggaggcgttcaggaggttcggcgcccggctgatggagatcgagaagcggatcatggacatgaacaaggacccggcgctcaagaaccggaacgggccggtgaagatgccgtacatgctgctgtaccccaacacgtcggaccccggcggggagagagggctcgggctcaccgccatgggcatccccaacagcgtctccatctgagcgtgatctttcttcagtagataggttggttcatgtctcgcagggtgtatcttgttacttttcattggcttctgggtggttgcggtaattagtttg

SEQ ID NO: 4722 - DNA, 3300 bp, Hordeum vulgare
agtaggcagtaaacaaaattgttaccgctactataataaagtgcaccggaaggcaccacctcgccctccctccggcgatctctctccatctctgacatcgctgcggctgggttggtggccgcggtaaattggtagtatcggcgaggcgccctataaatcccgccgcagcggccctgcatctaggccaccctaccaccaccactgccctccttgtgccaagtgcatcagcaaggggacaggcacccaccggttgtgttcctcgtgctctgctctgccctgcctccgctgcagaaccagagagcagaggagaggagagatgctgctgcacgggctggtggaccggctgacggggaagaacaaggaggcgtggaaggagggcaagatccggggcacggcggtgctggtcaagagcgacgtgctcgacctcggcgacttccacgcctccctcctcgacggcgtccacaagatcctcggcaaggacgacggcgtctccttccgcctcgtcagcgccaccgcccctgacccacagaatgggagccggggcaaggtggggaagccggcgcacctggaggagatggtggtgacgatgaagtcgacggcggcgggggagtcggtgttcaaggtcaccttcgagtgggacgagtcgcagggcgtccccggcgccgtcatcgtccgcaacacctaccgctccgagtacctgctcaagacgctcaccctccacggcgtccccggcaagggcaccgtcgtcttcgtcgccaactcctggatctaccccaacgtcgaccgcctcttcttcgccaacgacacctatctgcccagcaaaatgcctgcacttttggtgcaataccggcaagatgaactcaacaatctccgaggcgacgacacgaccggagagtacaaggaggctgaccgcgtgtaccgctatgactactacaatgacctcggtgagccagacaacgacaatccccgcccagttctcggcggcacccaagaactcccctatccccgtcgttgcagaactggccgaccaccaacagaaacggaccctagatcggagagcagaattcctaagtacaagattaaggaggccctgaacatctatgtcccccgcgatgagcgctttgggcacctcaagttgtctgacttccttgggtactctctcaaggccatcacggaggccattcttccgataatcaggacctatgttgacagtacacccaaggagtttgattcgtttcaagacatctataatctctatgatggtcttctgaaagtgccagataaccaacacctaaaggagctcaagaataaaatcccccttcagtttattaaaagtcttttaccagttgctggcgatgacctcctaaacttgccccttccacatgttatcaaatcagataagtatgcttggaggtcagatgaggagtttgcacgggagatgctcgcaggcgtgaacccggtttgcatcagacgtctgacggagttccctgtaaaaagtaccctggatcccagtgtgtacggggaccagtcaagcactatcactgaagatcaaattcagctgaacctggaagatggcctcacagtgagacaggcaatggacaagaagaggctcttcattctagatcaccacgataacttcatgccattccttgaccgcatcaacaagctggaaggcaactacatctatgcttcaaggaccttgctgttcctgaaggccgatggcacgctgaagcccttggccatcgagctgagccagccgcaccccgatgggatccagcatggcgcaaagagcacggtgtaccttccagctgacattaactctggcgttgatggccagatctggcagcttgccaaggcttacgcctccgtcgacgactctgcgtggcatcagcttatcagccactggctgaacacacatgcggtgatcgaaccgttcgtgattgcgacgaaccggcaactcagtgtggtgcacccggtgcacaagctgctgagcccgcactaccgcgacacgttgaacatcaatgccctggcgcggaccaccctcatcaacgccggtggcgtgttcgagctgaccgtcttccctgggcaatacgcgcttgagatgtctgctgttgtctacaagaactggaagctcactgagcagggcctccctgacgatctcgtcaagaggggcatggctgtgccggacgaatcgagcccatacggcatccgtctgctgataaaggactacccatacgcggtggacggactggtgatctggtgggcgatcgagcggtgggtgaacgagtacctggccatctactacccaaatgacggcgtgctccgggccgacaaggagctggaggagtggtggaaggaggtgcgcgaggtcgggcacggcgacctcaaggacgccgactggtggcccaagatggtgaccgtccaggagctggccaagacgtgcaccaccatcatctgggtggcgtcggcgctgcacgcggcggtcaactttgggcagtacccgtacgcggggtacctcccgaaccggccgacggtgagccgtcgcccaatgccgaaggagggcgacgaagagtacgagcagctgaaggagggcggggaggcggccgacatggtgttcatccacaccatcaccagccagttccagaccatcctcggcatcacgctcatcgagatcctgtccaagcactcctccgacgaggtgtacctggggcagcgcgacacgccggagtggacgtcggacgccaaggcgctcgaggcgttcaagaggttcggcagccggctggtggagatcgagaagcggatcctcgacatgaacaaggacccggcgctcaagaaccggaacgggcccgtgaagatgccctacatgctgctgtaccccaacacgtcggacgccaacggggagaaggcgctggggctcaccgccatgggcatccccaacagcgtctccatctgagctgagcatggtctttgtttccttctttcggtagtcgtccgtccgctggtcatggatcggttcgtgtctcgcaaggtgtattgtgttacttttcattggcttctgggtggttgcggtaattagttgccagggattagtggatgatggaaaatgatgattgtgtcgtagatgatgttgatagggtgaggacaatgaggcatgaataagcactcgtgtgcgcattcttttcatctccagaaatttcccttctctctattatctccattttctttacggttttgctaattttcatccgattgaaaacagttcggtacaagtgcaagagatatagaaaatgttcatgtttc

SEQ ID NO: 4723 - DNA, 2865 bp, Secale cereale
cgaaggagacagccagccggccggccacccggttgcgttcctcgtgctctgcccaagaaccagagaagagagaacagagaggagaggggagatgctgctgcaggggctggtggagcggctgacggggaagaacaagcaggcgtggaaggagggcaagatccagggcacggcggtgctggtcaagagcgacgtcctcgacctcaacgatttcaacgcctccctcctcgacggcgtccacaagatcctcggcagggacgacggcgtcctctttcacctcctcagcgccaccgcccccgacccccagaatccgaggcggggcaaggtggggaaggcggcgcacctggaggagatggtggtgacgatgaagtcgacggcggcgggggagtcggtcttcaaggtcaccttcgactgggacgactcgcagggcatccccggcgccgtcatagtccgcaacacctaccgctccgagtacctgctcaagacactcaccctccacggcgtccccggcaagggcaccgtcgtcttcgtcgcaaactcctggatctaccccaacgtcgaccgcgtcttcttcgccaatgacacctatctacccagcaaaatgcctgcacttttggtgcaataccggcaagatgaactcaacaatctccgaggcgacggcacaaccggaaagtacgaggagtgggaccgtgtgtaccgctatgactactacaacgacctcggtgagccagacagcggccatccgcgcccggttctcggcggcacccaagaactcccctatccccgtcgttgcagaactggccgacccccaacaaaaacggaccctagatcagagagcagaattcctcggtacaagattaaggaggccctggagatctatgtcccgcgtgatgagcgctttggccacctcaagttgtccgacttccttggctactctctcaaggccatcaccgaggccattcttccgataattaggacctatgtcgataccacacccaaggagtttgattcatttcaagacatctataatctctatgatggtctgttgaaagtgccagataacccacacctaaaggagctcaagaataaaatcccccttcagtttattaaaagtcttttaccggtgctggcgatgacctcctgaacctgccccttcacatgttatcaaatcagatccgtatgcttggaggtcagatgaggagtttgcacgtgagatgcttgcaggcgtgaacccggtttgcatcaaacgtctgacggagttccctgtaaaaagtaccctggatcccagtgtgtacgggaccaatcaagcactatcactgaagatcaaattcagcagaaccttgaagaaggcctcacagtgaaacaggccagtggagaggaacaggctcttcattctcgatcaccacgacaacttcatgccattccttgaacgcatcaacaagttgaagggcaacttcatctacgcttcaaggaccctgctgttcctcaaggccgatggcaccctgaagcccttggccatcgagctgagcttgccgcaccctcacgggatacagcacggcgcggagagcacggtgtaccttccggctgatattgagtctggtgttcaaggccagatctggcagcttgccaaggcttacgcctcggtcgacgactctgcgtggcatcagcttatcagccactggctcaatacacacgcggtgatcgagcccttcgtgatcgcgacgaaccggcaactcagtgtggtgcacccggtgcacaagctgctgagcccgcactaccgcgacacattgaacatcaatgccctggcgcggaccactctcatcaacgccggtggcgtctttgagatgaccgtcttcccgggggaatacgcgcttgagatgtctgctgtcgtctacaagaactggaagctcaccgagcagggcctccccgacgatctcgtcaagaggggcatggctgtgccggacgcgtcgagcccgtacggcgtccggctgctgatcaaggactacccatacgcggtggacgggctggtgatctggtgggcgatcgagcggtgggtgaacgagtacctggccatctactacccgaacgacggcgtgctgcgggcggacaaggagctggaggagtggtggagggaggtgcgcgaggtcgggcacggcgacctcaaggacgcggagtggtggccgaggatggtgacggtgcaggagctggccaagacgtgcaccaccatcatctgggtggcgtcggcgctgcacgcggcggtcaacttcgggcagtacccgtacgcggggtacctcccgaaccggccgacggtgagccgtcgccgcatgccggtgccgggcgacgaggagtacaggcagctggagaagggcggggaggaggcggacaaggtgttcatccacaccatcacgagccagttccagaccatcctgggcatcacgctgatcgagatcctgtcgaagcactcgtcggacgaggtgtacctagggcagcgcgacacgccggagtggacgtcgacggcaaggccctggaggcgttcaagagtttcggcacccggctgagggagatcgagaagcggatcgtggacatgaacaaggacccggcgctcaagaaccggaacgggccggtgaagatgccgtacatgctgctgtaccccaacacgtcggaccccggcggggagagagggctcgggctcaccgccatgggcatccccaacagcgtctccatctgagcgtgatctttcttcagtagataggttggttcatgtctcgcagggtgtatcttgttacttttcattggcttctgggtggttgcggtaattagtttgtcaggcatgttgatagggagaggacaacgaggcatgaataagca

SEQ ID NO: 4724 - DNA, 2472 bp, Secale cereale
agaatccgaggcggggcaaggtggggaagccggcgcacctggaggagatggtggtgacgatgaagtcgacggcggcgggggagtcggtcttcaaggtcaccttcgactgggacgactcgcagggcgtccccggcgccgtcgtagtccgcaacacctaccgctccgagtacctgctcaagacgctcaccctccacggcgtccccggcaagggcaccgtcgtcttcgtcgccaactcctggatctaccccaacgtcgaccgtgtcttcttcgccaacgacacctatctgcccagcaaaatgcctgcactttgatgcaataccggcaagatgaactcaacaatctccgaggcgacggcacaaccggaaagtacgaggagtgggaccgtgtgtaccgctatgactactacaacgacctcggtgagccagacaagggccatccgcgcccggttctcggcggcacccaagaactccccctatccacgtcgttgcaggactggccgacccccaacaagaacagaccctagatcagagagcagaattcctcagtacaagatacaggaggccctgaacatctatgtcccgcgtgatgaacgctttgggcacctcaagttgtctgacttccttggctactctctcaaggccatcaccgaggccattcttccgataattcggacctatgttgacactacacccaaggagtttgattcgtttcaagacatctatgatctctatgatggtcttctgaaagtcgcccgataacaaacacctaaaggagctcaaggataaaatcccacttccgtttattaaaagtcttttaccggttgctggcgacgacctcctgaacctgccccttccacatgttatcaaatcagaaccgcatgcttggaggacagatgaggagtttgcgcgggagatgctcgcaggcgtgaaccccgtttgcatcaaatgtctgacggagttccctgtgaaaagtaccctggatcctagtgtgtacggggaccagtcaagcactatcactgaagatcaaattcagcagaacctggaagaaggcctcacagtgaaacaggcaatggagaggaacaggctcttcattctcgatcaccacgacaacttcatgccattccttgaacgcatcaacaagttgaagggcaacttcatctacgcttcaaggaccctgctgttcctcaaggccgatggcacgctgaagcccttggccatcgagctgagcctgccgcacccccacgggatacagcacggcgcggagagcacggtgtaccttccggctgatattgagtctggtgttcaaggccagatctggcagcttgccaaggcttacgcctcggtcgacgactccgcatggcatcagctaatcagccactggctgaatacacacgcggtgatcgagcccttcgtgatcgcgacgaaccggcaactcagtgtggtgcacccggtgcacaagctgctgagcccgcactaccgcgaacacattgaacatcaatgccctggcgcggaccactctcatcaacgccggtggcgtctttgagatgaccgtcttcccgggggaatacgcgcttcagatgtcggccgtcgtgtacaagaactggaaactcaccgagcagggcctccccgacgatctcgtcaagaggggcatggctgtgccggacgcgtcgagcccgtacggcgtccggctgctgatcaaggactacccatacgcggtggacgggctggtgatctggtgggcgatcgagcggtgggtgaacgagtacctggccatctactacccgaacgacggcgtgctccgggcggacaaggagctggaggagtggtggagggaggtgcgggaggtcgggcacggcgacctcaaggacgcggagtggtggccgaggatggtgacggtgcaggagcttgccaagacgtgcaccaccatcatctgggtggcgtcggcgctgcacgcggcggtcaacttcgggcagtacccgtacgcggggtacctcccgaaccggccgacggtgagccgtcggaagatgccggtgccgggcgacgaggagtatgcgcagctggagaagggcgggaggaggcggacaaggtgttcatccacaccatcacgagccagttccagaccatcctgggcatcacgctgatcgagatcctgtcgaagcactcgtcggacgaggtgtacctagggcagcgcgacacgccggagtggacgtcggacggcaaggccctggaggcgttcaggaggttcggcacccggctggtggagattgagaagcggatcatggacatgaacaaggacccggcgctcaagaaccggaacgggccggtgaagatgccgtacatgctgctgtaccccaacacgtcggacgccggcggggagagagggctcgggctcaccgccatgggcatccccaacagcgtctccatctgagcgtgatctttcttcagtagataggttggttcatgtctcgcaggg

SEQ ID NO: 4725 - DNA, 2939 bp, Brachypodium distachyon
cctcgccttttgccacactagcatagacacctgccagttccgtctcccccctggtccctttttcctgagcggagctcgtgcgaggagagagggatcatcggagatgctgctgcacgggttatgggacaaggtgacggggaagaacaaggaggcgtggaaggaagggaggatccggggcacggcggtgctggtgaagaaggacgtgctggacctgggcgacttccacgcctccctcctcgacggcgtccataagatcctcggctgcgaagacggcgtcgccttccacctcgtcagcgccaccgccgccgaccccaacaatggagaaagggggaaggtggggaaggcggcccacctggaggagctagtggtgacgatgaagtcgacggcggcgggtgagtcggttttccgggtggcgttcgagtgggacgactcccaggggatccccggcgccgtcatcgtccggaacaccaaccgctccgagttcctcctcaagacgctcaccctcgagggcgtccccggccggggcaccgtcgtcttcgtcgccaactcctggatctaccccgccgccggcgaccgcgtcttcttcgccaacgatacctatctgcccagcaaaatgcctgtacttttggtacaataccgacaagatgaactcagaaatctccgtggcgacagtaaagctggaccatatgaggagcatgaccgtgtgtaccgctatgactactacaatgacctcggggaaccagacaagggtgaggaccatgtacggccgatgctcggtggcagccaagaacacccttacccccgtcgtggtagaaccggccgacggccgacaaaaacagatccgaaatcagagagcaggcttcctctgttgaacctgaagaaggcgctgaacatttacgtcccacgcgatgagcgctttgggcatctcaagttgtctgacttccttgggtactctctcaaggccataacggaggctgttgttccgattataaggacctatgtcgatacgacaccgaaggagtttgattcctttcaagacatcatgaatctctacgatggtcttctagaagtgccacatagcccagctctagcagagatcaagaagaaaattccctttgattttattaaaagtattttaccagtcgctggtgacgattttctcaacttgccctttccacatgttgtcaagtcagataggtctgcttggaggacagatgaggagtttgcacgagaaatgctcgcaggagttaatccggtttgcatcagacgtctgacggagttccctgcaagaagtaccctggatcacagtgtgtatggggaccataccagcaaaatcactgaagatcatattcagcataaccttgaagatggcctctcaattaaaaaggcgttagagagcaacaggctcttcattctagatcaccatgataactttatgccgttccttgaccgcatcaacaaattggaaggcaactttatctatgcttccaggaccctgctgttcctgaaggccgatggcacgctgaagcccttggccattgagctgagcctgccgcaccctgacgggcagcaacatggtgcagagagcaaggtgtacactccagctgttgaaggtgttgaaagccaaatctggcagcttgccaaggcctatgcgtgcgtcaatgattccgcttggcaccagctgatcagccactggttgaacacacatgcagtgatcgagccgtttgtgatcgcgacgaaccgacagctcagcgtagttcaccccgtgcataagctgctgagtccgcactaccgcgacacaatgaacatcaacgccctggcgcggcagaccctcatcaatgccggtggcatctttgagctgactgtgttccctgggaagtacgcgctggagatgtcttctgtcgtgtacaaggactggaagctcactgaacagggcctccccgccgatctcgtaaagagaggtgtcgctgtgccagacccgtcgagcccatacaatgtccggctgctgatcaaggactacccgtacgccgtggatggactggtgatctggtgggctatcgagacatgggtgaaggagtacctcaccatctactaccccaacgatggtgtgctccggagcgacgaggagctgcagaagtggtggaaggaggtgcgtgaggtcgggcacggtgatctcaaggacgcagactggtggcccaagatggataccgtccaggagctggccaagatgtgcaccaccatcatctgggtggcgtcagcgctgcatgcagcggtcaacttcgggcagtacccatacgccgggtacctccccaaccggcctaccgtgagccggcggccgatgccggagcccggcatgaaggagtatgcacagctggagcgcggcgggaaggaggccgacaaggtgttcatccacaccatcaccagccagttccagaccatccttggcatcacgctcatcgagatcctgtcaaagcactcctctgacgaggtgtacctcgggcaacgtgacacaccggagtggacgtcggacgccaaggcgctggaggcgttcaagaggttcggcagccggcttatcgagatcgagaagcggatcacggagatgaacggcaacccgtcgctcaagaaccggaacgggccggtgaagatgccttacatgctgctgtaccccaacacgtcggacgtcaccggcgagaaaggcgtggggctcacggccatgggcatccccaacagcatctccatttgatcgcgtagtgtctgcgtcgtcggtctgtgtctcgcacagtgcattgtgtttctttcattgattgtcgtgtcgttgcggtaattaattgttcagggattaggggggtgatgatgagagtgaggaacgaataagttagtcttctctgtatttttcatctccggaaataaaagagtggtatagtttgcatttcctgaaa

SEQ ID NO: 4726 - DNA, 2940 bp, Brachypodium distachyon
ccctcgccttttgccacactagcatagacacctgccagttccgtctcccccctggtccctttttcctgagcggagctcgtgcgaggagagagggatcatcggagatgctgctgcacgggttatgggacaaggtgacggggaagaacaaggaggcgtggaaggaagggaggatccggggcacggcggtgctggtgaagaaggacgtgctggacctgggcgacttccacgcctccctcctcgacggcgtccataagatcctcggctgcgaagacggcgtcgccttccacctcgtcagcgccaccgccgccgaccccaacaatggagaaagggggaaggtggggaaggcggcccacctggaggagctagtggtgacgatgaagtcgacggcggcgggtgagtcggttttccgggtggcgttcgagtgggacgactcccaggggatccccggcgccgtcatcgtccggaacaccaaccgctccgagttcctcctcaagacgctcaccctcgagggcgtccccggccggggcaccgtcgtcttcgtcgccaactcctggatctaccccgccgccggcgaccgcgtcttcttcgccaacgatacctatctgcccagcaaaatgcctgtacttttggtacaataccgacaagatgaactcagaaatctccgtggcgacagtaaagctggaccatatgaggagcatgaccgtgtgtaccgctatgactactacaatgacctcggggaaccagacaagggtgaggaccatgtacggccgatgctcggtggcagccaagaacacccttacccccgtcgtggtagaaccggccgacggccgacaaaaacagatccgaaatcagagagcaggcttcctctgttgaacctgaagaaggcgctgaacatttacgtcccacgcgatgagcgctttgggcatctcaagttgtctgacttccttgggtactctctcaaggccataacggaggctgttgttccgattataaggacctatgtcgatacgacaccgaaggagtttgattcctttcaagacatcatgaatctctacgatggtcttctagaagtgccacatagcccagctctagcagagatcaagaagaaaattccctttgattttattaaaagtattttaccagtcgctggtgacgattttctcaacttgccctttccacatgttgtcaagtcagataggtctgcttggaggacagatgaggagtttgcacgagaaatgctcgcaggagttaatccggtttgcatcagacgtctgacggagttccctgcaagaagtaccctggatcacagtgtgtatggggaccataccagcaaaatcactgaagatcatattcagcataaccttgaagatggcctctcaattaaaaaggcgttagagagcaacaggctcttcattctagatcaccatgataactttatgccgttccttgaccgcatcaacaaattggaaggcaactttatctatgcttccaggaccctgctgttcctgaaggccgatggcacgctgaagcccttggccattgagctgagcctgccgcaccctgacgggcagcaacatggtgcagagagcaaggtgtacactccagctgttgaaggtgttgaaagccaaatctggcagcttgccaaggcctatgcgtgcgtcaatgattccgcttggcaccagctgatcagccactggttgaacacacatgcagtgatcgagccgtttgtgatcgcgacgaaccgacagctcagcgtagttcaccccgtgcataagctgctgagtccgcactaccgcgacacaatgaacatcaacgccctggcgcggcagaccctcatcaatgccggtggcatctttgagctgactgtgttccctgggaagtacgcgctggagatgtcttctgtcgtgtacaaggactggaagctcactgaacagggcctccccgccgatctcgtaaagagaggtgtcgctgtgccagacccgtcgagcccatacaatgtccggctgctgatcaaggactacccgtacgccgtggatggactggtgatctggtgggctatcgagacatgggtgaaggagtacctcaccatctactaccccaacgatggtgtgctccggagcgacgaggagctgcagaagtggtggaaggaggtgcgtgaggtcgggcacggtgatctcaaggacgcagactggtggcccaagatggataccgtccaggagctggccaagatgtgcaccaccatcatctgggtggcgtcagcgctgcatgcagcggtcaacttcgggcagtacccatacgccgggtacctccccaaccggcctaccgtgagccggcggccgatgccggagcccggcatgaaggagtatgcacagctggagcgcggcgggaaggaggccgacaaggtgttcatccacaccatcaccagccagttccagaccatccttggcatcacgctcatcgagatcctgtcaaagcactcctctgacgaggtgtacctcgggcaacgtgacacaccggagtggacgtcggacgccaaggcgctggaggcgttcaagaggttcggcagccggcttatcgagatcgagaagcggatcacggagatgaacggcaacccgtcgctcaagaaccggaacgggccggtgaagatgccttacatgctgctgtaccccaacacgtcggacgtcaccggcgagaaaggcgtggggctcacggccatgggcatccccaacagcatctccatttgatcgcgtagtgtctgcgtcgtcggtctgtgtctcgcacagtgcattgtgtttctttcattgattgtcgtgtcgttgcggtaattaattgttcagggattaggggggtgatgatgagagtgaggaacgaataagttagtcttctctgtatttttcatctccggaaataaaagagtggtatagtttgcatttcctgaaa

SEQ ID NO: 4727 - DNA, 2777 bp, Avena sativa
gtcatggtgaagccggaagtgctcgacatccgcgacttccacgcctccttcctcgacggcgtccacaacatcctcggcaagaaggacggcgtctccttccgcctcgtcagcgcaaccgcgccggaccccatcaacagggagcggggcaaggtgggcagcgcggcgcacctggaggagatggtggtgaccctcaagtccagggcggagggggagtccatcttcaaggtcaccttcgactgggacgcctcgcagggcatcccgggcgccgtcgtcgtcaccaacacctacaagtccgagttcctcctcaagacgctcaccctccacggcgtaccggggaagggcaccgtcgtcttcgtcgccaactcgtggatctaccgcggcgccgaccgcgtcttcttcgcaaacgatacctacctgcccagcaaaatgcctgcacttttggtgcaataccggcaagaggaactcaacaatctccgaggcgacagtacagtcggagagtatcaggagcatgaccgtgtgtaccgctatgactactacaatgaccttggtgagccagacaggggcgagaaatatgcacggccaatccttggtggcagccaagaactcccctacccccgccgtggcagaactggccgccccccaacaaaaaatgacccaaaatcagagagcaggattcctgtgtatttagtgacgaaagccctgggaatatatgtcccacgtgatgagcgctttgggcacctcaagttgtctgacttccttgggtactctctcaaggccatcactgaggctattcttccgatgataaggacctacatcgacacgacaccgacggaattcgattcgtttcaggacatctataatctctatgatggtcttttgcaagtgccccatagcccccagctagcggagatgaagaagaaaatcccctttgaatttattaaaagtattttaccagttgctggtgatgactttctaaacttgccccttccacaagttattaaatcagataaatttgcttggaggacagatgaagagtttacgcgggagatgcttgcaggcgtgaaccctgtttgcatcagacgtgtgacggagttccctataaaaagtaccctggatcacagtgtatatggggaccagaatagcacaatcactgaagatcaaattcagccttacctggaagaaggcctcaccgtggaacaggcacgggagagcaacaggctcttcattctagaccaccacgataacttcatgccattccttgagcgcatcaacaagttggagggcaactacatctacgcttccagaaccctgctgttcctgaagtctgatggcacgctgaagcccttggccatcgagctgagcctgccacaccctgacgggattcagcacggcgcgaagagcacagtgtaccctccagcatcaatggctgatggtgttgatggccagatatggcagcttgccaaggcttacgcctgcgtcaatgactctgcttggcatcagctgatcagccactggttgaacacacatgcggtgattgagccattcgtgattgcgacgaaccggcagctgagcgtggtgcatccagtgcataaactgctgagcccacactaccgcgacacgatgaacatcaacgccctggcacggacgacgctcatcaacgctgggggtgtctttgaactgactgtcttcccagggaagtacgcgctcgagatgtcttcagtcgtgtacaaggactggaaactcaccgagcagggcctccccgacgatctcgttaagaggggcatggctgtgcgagacccgtcgagcccatacggcgtccgtctgctgatcaaggactacccgtacgccgtggacgggctggtgatctggtgggcgatccagcggtgggtgaaggagtacctggaaatctactaccctaacgacggcgtgctccgagccgacgaggagctcagggaatggtggaaagaggtgcgtgaggtcgggcacggtgacctcaaggacaaggactggtggcccaagatggacaccgtggaggagctggccaagacctgcaccaccatcatctgggtggcgtcggcgctgcacgcggcggtcaacttcgggcagtacccatacgcggggtacctcccgaaccggccgaccgtgagccggaagccaatgccggtggagggctcggacgagtacaaggcgctggtggaaggcggggaggcggccgacaaggtgttcatccacaccatcaccagccagttccagaccatcctgggcatcacgctcatcgagatcctgtccaagcatgcctccgacgaggtgtacctcgggcagcgcgacacgccggagtggacgtcggacgccaaggccctggatgcgttcaagaggttcggcgaccggctgatggacatcgagaagcggatcctgacgatgaacaaggacccggcgctcaagaaccggaacgggcccgtgaacatgccgtacatgctgctctacccaaacacgtcggatgtcaacggcgagaaaggcctggggctcaccggcatgggcatccccaacagcgtctccatctgagcctctagtaagccgccgtcgtcgatttgtgtccccgcgcagtgcattgtgttcctttcattggtttttgtggtagtcgtggtaattgattgtcagggattagtggatgatggagacgagtctggtagatggtactgatagggaaacgactgtgaagcgtcagttagcaatccgctgtacattttgtatctcgagaaataaaagagttaattgca

SEQ ID NO: 4728 - DNA, 2727 bp, Avena sativa
gcgacttccacgcctccttcctcgacggcgtccacaacatcctcggcaagaaggacggcgtctccttccacctcgtcagcgcaaccgcgccggaccccaacaacagggagcggggcaaggtggggagcgcggcgcacctggaggagatggtggtgaccctcaagtccagggcggagggggagtccatcttcaaggtcaccttcgactgggacgcctcgcagggcatcccgggcgcggtcatcgtcaggaacacctacaagtccgagttcctcctcaagacgctaaccctccacggcgtaccggggaagggcaccgtcgtcttcgtcgccaactcgtggatctaccgcggcgccgaccgcgtcttcttcgcaaacgatacctacctgcccagcaaaatgcctgcacttttggtgcaataccggcaagaggaactcaacaatctccgaggcgacagtacagtcggagagtatcaggagcatgaccgtgtgtaccgctatgactactacaatgaccttggtgagccagacaggggcgagaaatatgcacggccaatccttggtggcagccaagaactcccctacccccgccgtggcagaactggccgccccccaacaaaaaatgacccaaaatcagagagcaggattcctgtgtatttagtgacgaaagccctgggaatatatgtcccacgtgatgagcgctttgggcacctcaagttgtctgacttccttgggtactctctcaaggccatcactgaggctattcttccgatgataaggacctacatcgacacgacaccgacggaattcgattcgtttcaggacatctataatctctatgatggtcttttacaagtgccccatagcccccagctagcggagatgaagaagaaaatcccctttgaatttattaaaagtattttaccagttgctggtgatgactttctaaacttgccccttccacaagttattaaatcagataaatttgcttggaggacggatgaggagtttacacgggagatgcttgcaggcgtgaatcctgtttgcatcagacgtgtgacggagttccctataaaaagtaccctggatcacagtatatatggggaccagaatagcaaaatcactgaagatcaaattcagccttacctggaagaaggcctcaccgtggaacaggcacgggagagcaacaggctcttcattctagaccaccacgataacttcatgccattccttgagcgcatcaacaagttggagggcgactacatctacgcttccagaaccctgctgttcctgaagtctgatggcacgctgaagcccttggccatcgagctgagcgtgccacaccctgacggggttcagcacggcgcgaagagcacagtgtaccctccagcatcaatgactgatggtgttgatggccagatatggcagcttgccaaagcttacgcctgcgtcaatgactctgcttggcatcagctgatcagccactggctgaacacacatgccgtgatcgagccgttcgtgattgcgacgaaccggcagctgagcgtggtgcatccagtgcataaactgctgagcccacactaccgcgacacgatgaacatcaacgccctggcacggacgacgctcatcaatgctggcggtgtctttgagctgactgtcttcccagggaagtacgcgctcgagatgtcttcagtcgtgtacaaggactggaaactcaccgagcagggcctccctgacgatctcgtaaagaggggcatggctgtgcgagacccgtcgagcccatacggtgttcgtctgctaatcaaggactacccgtacgccgtggacggactggtgatctggtgggcgatcgagcggtgggtgaaggagtacctggaaatctactaccccaacaacggcgtgctccgggctgacaaggagctggaggagtggtggaaagaggtgcgcgaggtcgggcacggcgacctcaaggacaaggactggtggcccaagatggagaccgtggaggagctggccaagacgtgcaccaccatcatctgggtggcgtcggcgctgcacgcggcggtcaacttcgggcagtacccgtacgcggggtacctcccgaaccggccgaccgtgagccggaagcctatgccggtggagggctcggatgagtacaaggcgctggtggaaggcggggaggctgccgacaaggtgttcatccacaccatcaccagccagttccagaccatcctgggcatcacgctcatcgagatcctgtcgaagcacgcctccgacgaggtgtacctcgggcagcgcgacacgccggagtggacgtcggacaccagggccctggatgcgttcaagaggttcggcgaccggctgatggacatcgagaagcggatcctgacgatgaacaaggacccggcgctgaagaaccggaacgggcccgtgaacatgccgtacatgctgctgtaccccaacacgtcggacgtcaacggcgagaaaggcctggggctcaccggcatgggcatccccaacagcgtctccatctgagcctatagtaagccgccgtcgtcgatttgtgtccccgcgcagtgcattgtgttcctttcattggtttttgtggtaattgattgtcagggattagtggatgatggagacgagtctggtagatggtactgatagggaaacgactgtgtagcgtcagttagcaatccgctgtacattttgtatctcgagaaataaaaga

SEQ ID NO: 4729 - DNA, 1091 bp, Triticum aestivum
gcttccggactccacgcgaaccttgatctcctctccttcctcccctcgggcggcgcaactccccgatcgatcctccccgcccgcgaccaatatgagaagaggctacagctacagtccatccccgccaccaagaggctacaggggaagggcccgtagcccaagtccccgtgatcgttatgatggtcggggtagagatctcccaaccagccttttggtcaggaaccttcgtcgtgactgcaggccagatgaccttcgccgaccatttgcacagtttggtcgtcttaaagacgtatatattccaagggattactatactcaggagccgcggggatttgggtttgtgcaatactttgatcccaacgatgcggcagacgctaaatactacatggatggacaggtcattcttggtagagaagttgcagttgtttttgcacaggagaacagaaagaagcctgctgagatgagaaccagagaaagtagcagaggtcggtcttacgatcggaggcactctccttccccaaggcggcggccatcttaccgcggccgaagctactcaaggtctccatcacctcggcccgcaaggcggaggttcagagacgagtctccctcgcgctcccgctcgcccagtggatcgaggagcgcgagtccattggatgggaagtatggcaggtcctcacgaagagagaggtcgatttcggttagcggatgaagcagcagtagctctgctggggtttctagaactgtagtggacttgctcgtgggaatctaagtttgctatcgcttttgcgaaccgcgttatccgtggatttatagagaagattgccgtcatgtatcagcaatagtatgtcaaactatgtctgcgactctctgtacttttgcactagattattcagcgcataaaataaagatgactctgcattgcatattcgtcactggcatacacagggctggggtaaatgctactccctccatagaaatataagagcgctcttatatctcttttacagagagagtagttgacagcagagcaaggaactgtcccagctgaaatgctgtcatcttattttcagcttctgaattttaagctcaat

SEQ ID NO: 4730 - DNA, 916 bp, Secale cereale
gaagcttccggactccacacgaaccttgatctcgtctccttcttcccctcgggcggcgccactccgatcgatcctccccgtcggcgaccaatatgagaaggggctacagctacagtccatccccaccaccaagaggctacaggggaagggcccgaagcccaagtccccgtgatcgttatgatggtcggggtagagatctcccaaccagtcttttggtcaggaaccttcgccgtgactgcaggccagatgaccttcgccgaccatttacacagtttggtcgtcttaaagacgtatatattccaagggattactatactcaggagccgcgtggatttgggtttgtgcagtactttgatcccgacgatgcggcagacgcaaaatactacatggatggacaggtcattcttgggagagaagttgcagttgtttttgcacaggagaacagaaagaagcctgctgagatgagaaccagagaaagtagcagaggtcggtcttacgatcggcggcactctccttccccaagggggcggccatcttatcgcggccgaagctactcaaggtctccatcacctcggcccgcaaggcggaggttcagagacgagtccccctcgcgctcccgctcgcctgtggacagtggatcgaggagcgcgagtccattggatgggaagtacggcaggtcctcacgaagagagaggtcgatttcggttagcggatgaagcagcagtagctctgctcgggtttctagaactgtagtggacttgctcgtgggaatttaagtttgctatcgcttttgtgaaccgcgctatctgtggatttatagagaagattgccatcatgtatcagcaagagtatgtcgaattgtgtctgcgactctctgtacttttgcactagattattcagcgcataaataaagatg

SEQ ID NO: 4731 - DNA, 962 bp, Secale cereale
cgcgacatcggctcagtcgataaaggcagcgccactcccccgtcgcgtcgggaagattccggactccacacgaaccttgatctcctctccttcttcccctcgggcggcgccactccgatcgatcctccccgtcggcgaccaatatgagaaggggctacagctacagtccatccccaccaccaagaggctacaggggaagggcccgaagcccaagtccccgtgatcgttatgatggtcggggtagagatctcccaaccagtcttttggtcaggaaccttcgccgtgactgcaggccagatgaccttcgccgaccatttacacagtttggtcgtcttaaagacgtatatattccaagggattactatactcaggagccgcgtggatttgggtttgtgcagtactttgatcccgacgatgcggcagacgcaaaatactacatggatggacaggtcattcttggtagagaagttgcagttgtttttgcacaggagaacagaaagaagcctgctgagatgagaaccagagaaagtagcagaggtcggtcttacgatcggcggcactctccttccccaagggggcggccatcttaccgcggccgaagctactcaaggtctccatcacctcggcccgcaaggcggaggttcagagacgagtccccctcacgctcccgctcgcctgtgcacagcggatcgaggagcgcgagtccattggatgggaagtacggcaggtcctcacgaagagagaggtcgatttcggttagcggatgaagcaccagtagcttgctctgctcgggtttctagaactgtagtggactctcgtgggaatctaagtttgctatcgcttttgtgaaccgcgctatctgtggatttatagagaagattgccgtcatgtaccagtaccagcaagtgtcaaactgtgtcgcgactctctgtccttttgcactagattattcaacgcataaa

SEQ ID NO: 4732 - DNA, 904 bp, Secale cereale
ggactccacacgaaccttgatctcctctccttcttcccctcgggcggcgccactccgatcgatcctccccgtcggcgaccaatatgagaaggggctacagctacagtccatccccaccaccaagaggctacaggggaagggcccgaagcccaagtccccgtgatcgttatgatggtcggggtagagatctcccaaccagtcttttggtcaggaaccttcgccgtgactgcaggccagatgaccttcgccggccatttacacagtttggtcgtcttaaagacgtatatattccaagggattactatactcaggagccgcgtggatttgggtttgtgcagtactttgatcccgacgatgcggcagatgcaaaatactacatggatggacaggtcattcttggcagagaagttgcagttgtttttgcacaggagaacagaaagaagcctgctgagatgagaaccagagaaagtagcagaggtcggtcttacgatcggcggcactctccttccccaagggggcggccatcttaccgtggccgaagctactcaaggtctccatcacctcggcccgcaaggcggaggttcagagatgagtccccctcacgctcccgctctcctgtgcacagcggatcgaggagcgcgagtccattggatgggaagtacggcaggtcctcacggagagagaggtccatttcggttagtggatgaagctcgggtttttagaactgtagttgacttgctcgtgggaatctaagtttgctatcgcttttgtgaaccgcgctatctgtggatttatagagaagattgccgtcatgtaccggtaccagcaagagtacgtcgaactgtgtcgcgactctctgtccttttgcactagattattcagcgcataaataaagatgactctg

SEQ ID NO: 4733 - DNA, 974 bp, Triticum aestivum
cgcgacatcgactcagtcgataaaggctccccgtcgcgtcgggaagcttccggactccacacgaaccttgatctcctctcctctccttcctcccctcgggcggcgccactccgatcgatcctccccgtccgcgaccaatatgagaagaggctacagctacagtccatccccgccaccaagaggctacaggggaagggcccgtagtccaagtccccgtgatcgttatgatggtcggggtagagatctcccaaccagtcttttggtcaggaaccttcgtcgtgactgcaggccagatgacctacgcaggccatttgcacagtttggtcgtcttaaggacgtatatattccaagggattactatactcaggagccgcgaggatttgggtttgtgcagtactttgatcccgacgatgcggcagacgcaaaatactacatggatggacaggtcattcttggtagagaagttgcagttgtttttgcacaggagaacagaaagaagcctgctgagatgagaaccagagaaagtagcagaggtcggtcttacgatcggcggcactctccttccccgagggggcggccatcttaccgtggccgaagctactcaaggtctccatcacctcggcccgcaaggcggaggttcagagacgagtcccccacgcgctcccgctcgcctgtggacagcggatcgaggagcgcgagtccattggatgggaagtacggcaggtcttcacgaagagagaggtcgatttcggttagcggatgaagcagcggtagctctgctcgggtttctagaactctagtggagttgcttgtgggaatctaagtttgctatcgcttttgtgaaccgcgctatctgtggatttatagagagaagattgccgtcgtgtacccgcaaagagtgtgtcaaattgtgtctgcgactctgtacttttgcactagattattcagcgcataaataaagatgactctgcatt

SEQ ID NO: 4734 - DNA, 955 bp, Secale cereale
cgcgacatcggctcagtcgataaaggcagcgccactcgggaagcttccggactccacacgaaccttgatctcctctccttcctcccctcgggcggcgccactccgatcgatcctccccttccgcgaccaatatgagaaggggctacagctacagtccatccccaccaccaagaggctacaggggaagggcccgaagcccaagtccccgtgatcgttatgatggtcggggtagagatctcccaaccagtcttttggtcaggaaccttcgccgtgactgcaggccagatgaccttcgccgaccatttacacagtttggtcgtcttaaagacgtatatattccaagggattactatactcaggagccgcgtggatttgggtttgtgcagtactttgatcccgacgatgcggcagacgcaaaatactacatggatggacaggtcattcttggtagagaagttgcagttgtttttgcacaggagaacagaaagaagcctgctgagatgagaaccagagaaagtagcagaggtcggtcttacgatcggcggcactctccttccccaagggggcggccatcttatcgcggccgaagctactcaaggtctccatcacctcggcccgcaaggcggaggttcagagatgagtccccctcacgttccggctctcctgtgcacagcggatcgaggagcgcgagtccattggatgggaagtacggcaggtcctcacggagagagaggtccatttcggttagtggatgaagctcgggtttctagaactgtagttgacttgctcgtgggaatctaagtttgctatcgcttttgtgaaccgcgctatctgtggatttatagagaagattgccgtcatgtaccagtaccagcaagagtatgtcgaactgtgtcgcgactatctatccttttgcactagattattaacgcataaataagatgactctgactaa

SEQ ID NO: 4735 - DNA, 833 bp, Secale cereale
atgagaaggggctacagctacagtccatccccaccaccaagaggctacaggggaagggctcgaagcccaagtccccgtgatcgttatgatggtcgtggtagagatctcccaaccagtcttttggtcaggaaccttcgccgtgactgcaggccagatgaccttcgccggccatttacacagtttggtcgtcttaaagacgtatatattccaagggattactatactcaggagccgcgtggatttgggtttgtgcagtactttgatcccgatgatgcggcagacgcaaaatactacatggatggacaggtcattcttgggagagaagttgcagttgtttttgcacaggagaacagaaagaagcctgctgagatgagaaccagagaaagtagcagaggtcggtcctatgatcggcggcactctccttccccaagggggcggccatcttaccgcggccgaagctactcaaggtctccatcacctcggcccgcaaggcggaggttcagagacgagtccccctcacgctcccgctcgcctgtgcacagcggatcgaggagcgtgagtccattggatgggaagtacggcaggtcctcacgaagagagaggtcgatttcggttagcggatgaagcaccagtagcttgctctgctcgggtttctagaactgtagtggactctcgtgggaatctaagtttgctatcgcttttgtgaaccgcgctatctgtggatttatagagaagattgccgtcatgtaccagtaccagcaagtgtcaaactgtgtcgcgactctctgtccctttgcactagattattcaacgcataaataaagatgactctg

SEQ ID NO: 4736 - DNA, 880 bp, Leymus cinereus x Leymus triticoides
cctccgatcgacgatcctcgtcgtccgcgacccatatgagaagaggctacagcaacagtccacccccgccaccaagaggctacaggggaagggcacgtagcccaagtccccgtgatcgttatgatggccggggtagagatctcccaaccagtcttttggtcaggaaccttcggcgtgactgcaggccagatgaccttcgccggccatttgcacagttcggtcgtcttaaagatgtatatattccaagggattactatactcaggagccacggggatttgggtttgtccagtactttgatcccgacgatgctgcagacgcaaaatactacatggatggacaggtcattcttggcagagaagttgcagttgtttttgcacaggagaacagaaagaagcctgctgagatgagaaccagagaaagtagcagaggtcggtcttatgatcggcggcactctccttccccaagggggcggccatcttaccgtggccgaagctactcaaggtctccatcgcctcggcctgcaaggcgcaggttcagagacgagtccccctcgcgctcccgctcgcctgtggacagcggatcgaggagcgcgagtccattggatgggaagtacggcaggtcctcacgaagagagaggtcgatttcggttagcagatgaagaagcagcagtagctctgctgggggttttagaactgtagtggactagctcgtggtaatctggtttgctatcgcttttgtgaaccgcgctatctgtggatttatatagagaagaagattgccgtcatgtatcgtctgtgactgtgtactttcgcacttgattattcagcgtataaataaagatgactgcatattcgtcgcgggcatgcacggtttaaggca

SEQ ID NO: 4737 - DNA, 881 bp, Secale cereale
gatctcctctccttcttcccctccggcggcgccactccgatcgatcctccccgtccggcgaccaatatgagaaggggcgtacagctacagtccatccccacccacccaagaggctacagggaaggggcccgaagcccaagtccccgtcgatcgttatgatggccggggtagagatctccaaccagtcttttggtcaggaaccttcgccgtgactgcaggccagatgaccttcgccggccatttacacagtttggtcgtcttaaagacgtatatattccaagggattactatactcaggagccgcgtggatttgggtttgtgcagtactttgatcccgacgatgcggcagatgcaaaatactacatggatggacaggtcattcttggtagagaagttgcagttgtttttgcacaggagaacagaaagaagcctgctgagatgagaaccagagaaagtagcagaggtcggtcttacgatcggcggcactctccttccccaagggggcggccatcttaccgcggccgaagctactcaaggtctccatcacctcggcccgcaaggcggaggttcagagatgagtccccctcacgctcccgctcgcctgtgcacagcggatcgaggagcgcgagtccattggatgggaagtacggcaggtcctcacgaagagagaggtcgatttcggttagcggatgaagcagcagtagcttgctctgctcgggtttcagaacactgtagtggacttgctcgtgggaatctaagtttgctatcacttttgtgaaccgcgctatccgtggatttatagagaagattgccgtcatgtaccagtaccagcaagggtgtcaaactgtgtcgcgactctctgtccctttgcactagattat

SEQ ID NO: 4738 - DNA, 895 bp, Pseudoroegneria spicata
cacgaaccttgatctcctctcctccccccctcgggcggcgcccctccgatcgatcctccccgtccgcgaccaatatgacaagaggctacagctacagtccatccctgccaccaagaggctacaggggaagggctcgtagcccaagtccccgtgatcgttatgatggtcggcgtagagatctcccaaccagtcttttggtcaggaaccttcgtcgtgactgcaggccagatgaccttcgccggccatttgcacagtttggtcgtcttaaagacgtatacattccaagggattactatactcaggagccgcggggatttgggtttgtgcagtactttgatcccgacgatgcggcagacgcaaaatactacatggatggacaggtcattcttggtagagaagttgcagttgtttttgcacaggagaacagaaagaagcccactgagatgagaaccagagaaagtagcagaggtcgatcttacgatcggcggcgctcgccttccccaagggggcggccatcttaccgcggccgaagctactcaaggtctccatcacctcggcctgcaaggcggaggttcagagacgagtccccctcgcgctcccgctcgcctgtggacagcggatcgaggagcgcgagtccattggatgggaagtacggcaggtcctcacgaagagagaggtcgatttcggttagcggatgaagcagcagtagctctgctcgggtttctagaactgtagtggacttgctcgtgggaatctaagtttgctatcgcttttgtgaaccgcgctttctgtggatttatagagagaatccgtcatgtatcagcaagattatgtcaaactgtgtctgcgacaatgtacttttgcactagattattcagcgcataaataaaaaaaa

SEQ ID NO: 4739 - DNA, 929 bp, Avena sativa
gggaaacttctggagtctagacgaaaccctagcgttccttgatctgctcccctcccgagtcgagcggcgcccccctctgttcgatccgaatcgttcgcggccaatatggcaagaggctacagttacagtccatccccgccaccaagaggctacaggggaagggcacgcagcccaagtccccgtggtcgttatggtgctcgaggtggagatattccgaccagtcttttggtcaggaaccttcgtcgagattgcaggccagatgaccttcgtaggccttttggacagtttggtcgtctgaaagatgtatatattccaagagattaccatactcaggagccgcgaggatttgggtttgtccagtactttgatcccgcggatgctgctgatgcaaaatactatatggatgggcaggttgttcttggcagagaaatagcagttgtatttgcccaggagaacagaaagaagcccgctgagatgagaaccagagaaggtagcagaggtcggtcgtatgaccggcgatactctccttctccgaggggccggccgtcttaccgtggccggagctactcaaggtctccgtcgcctcggtacgccaggcgcaggttcagggaggagtcctactcccgctcacctgctgagagcagatcgaggagcccgacgccatcggatgggcggcattacaacaggtctgcacgaagggagaggtcggtttctgttagcggatgaagtagtggtagctctgttgggcgtttagaagtgcagtggagaggactatagctcgtggtaatctggttgctatcactttgtgaactgtgtcgtctgtggatttatttagatcgctgtgatgtactgtactagcgaaagtatgaataaactgtaaaactgggggttgtgtcagtgtgcgcttagaccatgtactatgttgagcc

SEQ ID NO: 4740 - DNA, 863 bp, Avena sativa
cctcccctcccgagtcgagcggcgcccccctctgttcgaaccgatttgttcgcggccaatatggcaagaggctacagttacagtccatccccgccaccaagaggctacaggggaagggcacgcagcccaagtccccgtggtcgttatggtgctcgaggtggagatattccgaccagtcttttggtcaggaaccttcgtcgagattgcaggccagatgaccttcgtaggccatttggacagtttggtcgtctgaaagatgtatatattccaagagattaccatactcaggagccgcgaggatttgggtttgtccagtactttgatcccgcggatgctgctgatgcaaaatactatatggatgggcaggttgttcttggcagagaaatagcagttgtatttgcccaggagaacagaaagaagcctgctgagatgagaaccagagaaggtagcagaggtcggtcgtatgatcggcggtactctccttctccgaggggccgtccgtcttaccgtggccggagctactcaaggtctccgtcgcctcggtacgccaggcgcaggttcagggaggagtcctactcccgctcacctgctgagagcagatcgaggagcccgacgccatcggatgggcggcattacaacaggtctacgcgaagggaaaggtcggtttctgtcagcggatgaagtagtggtagctctgttgggcgtttagaagtgcagtggagaggactatagctcgtggtaatctggttgctatcactttgtgaactgtgtcgtctgtggatttatttagatcgctgtgatgtactgtactagcgaaagtatgaataaactgtaaaactgggggttgtgtcagtgtgcgctta

SEQ ID NO: 4741 - DNA, 831 bp, Avena sativa
cgaaaccctagcgttccttgatctgctcccctcccgagtcgagcggcgcccccctctgttcgatccaaatcgttcgcggccaatatggcaagaggctacagttacagtccatccccgccaccaagaggctacaggggaagggcacgcagcccaagtccccgtggtcgttatggtgctcgaggtggagatattctgaccagtcttttggtcaggaaccttcgtcgagattgcaggccagatgaccttcgtaggccttttggacagtttggtcgtctgaaagatgtatatattccaagagattaccatactcaggagccgcgaggatttgggtttgtccagtactttgatcccgcggatgctgctgatgcaaaatactatatggatgggcaggttgttcttggcagagaaatagcagttgtatttgcccaggagaacagaaagaagcccgctgagatgagaaccagagaaggtagcagaggtcggtcgtatgaccggcgatactctccttctccgaggggccggccgtcttaccgtggccggagctactcaaggtctccgtcgcctcggtacgccaggcgcaggttcagggaggagtcctactcccgctcacctgttgagagcagatcgaggagcccgacgccatcggatgggcggcattacaacaggtctgcacgaagggaaaggtcggtttctgtcagcggataaagtagtggtagctctgttgggcgtttagaagtgcagtggagaggactacagctcgtgtaatctggttgctatcactttgtgaaccgtatcgtctgtgaatttatttggatcgctgtgatgttctcc

SEQ ID NO: 4742 - DNA, 850 bp, Secale cereale
aagcttccggactccacacgaaccttgatctcctctccttcctcccctcgggcggcgccactccgatcgaccctccccttacgcgaccaatatgagaaggggctacagctacagtccatccccaccaccaagaggctacaggggaagggcccgaagcccaagtccccgtgattgttatgatggtcggggtagagatctcccaaccagtcttttggtcaggaaccttcgccgtgactgcaggccagatgaccttcgccggccatttacacagtttggtcgtcttaaagacgtatatattccaagggattactatactcaggagccgcgtggatttgggtttgtgcagtactttgatcccgacgatgcggcagacgcaaaatactacatggatggacaggtcattcttggtagagaagttgcagttgtttttgcacaggagaacagaaagaagcctgctgagatgagaaccagagaaagtagcagaggtcggtcttacgatcggcggcactctccttccccaagggggcggccatcttaccgcggccgaagctactccaggtctccatcacctcggcccgcaaggcggaggttcagagatgagtccccctacgctcccgctcgcctgtgcacagcggatcgaggagcgcgagtccattggatgggaagtacggcaggtcctcacgaagagagaggtcgatttcggtagcggatgaagcagcagtagcttgctctgctggttcagacactgtagtggacttgctcggtggaatcgtaagttgcttatctacttttggcgtaccgcgctatccgtgtactttagtacgtagaagtacgttcggtcccgtacgta

SEQ ID NO: 4743 - DNA, 1032 bp, Lolium multiflorum
cggccattacggccgggggggctctagacgaaacagtagtcccttgattgatctctctctctctctcccgtgacgagcggcgcgcgccccctctgttccatacgaatcctccgcgaccaatatggcaaggggctacagttacagtccatccccgccaccaagaggctacaggggaaggggaagggcacgcagcccaagtccacgtggtgatcgttatggtgcccaaggtagagatatcccgaccagtcttttggtcaggaaccttcgccgggactgcaggccagatgatcttcgtaggccatttgggcaatttggtcgtctgaaagatgtgtatattccaagggattaccatactcaggagccgagaggatttgggtttgtccagtacttcgatcctgccgatgctgctgatgcaaaatactatatggatggacaggttgttcttggcagagaaatagcagttgtgtttgcccaggagaacaggaagaagcctggtgagatgagaaccagagaaagtagcagaggccatagcagaggccggtcttacgatcggcggtactctccttctccgagggcccggccatcttaccgaggccgtagctactcaaggtctccctctcctcggtactcaaggcgcaggttcagagaggagtcttactcacgttcacccgctgacagcagatcaaggagcccaacgccttctgatgggcgttacagaaggtctgcgcgaagagagaggtccgtctctgttagcgaatgaagtagcagtagctctgtttggcgttcagaactgcggtggagacgactagtgcctcgtggtaaacctagttgctaccacgttatgaacctcttatcgactgtggatctatatagaggtcgtctactagcagaagtttgaattttgaataaaatgtggggtgtgtggcagtgtgcgcttatgctctgtactgtacgtgaggttcagtgtgtaaagatgattacctagcgtttcctcttgctgagcctgtttgcgattacatggagaaagtgttg

SEQ ID NO: 4744 - DNA, 896 bp, Brachypodium distachyon
aggaaatccccaccggtctggtcgggaagcttctggactccagactagaggcgacgccactgatctcctcctcccatcgagcggcgctctctgttcgatcccaaatcgttcgcgatcaacatgggaagaggctacagctacagtccatccccaccaccaagaagctacagaggaagggcacgcagcccaagtccccgtgttcgttatgtgggccgaggtagagatctcccaaccagtcttctggtcaggaaccttcgtcgggactgcaggccagaagaccttcgtcggccatttggacaatttggccgccttaaagatgtatatattccaagggattactatactcgggagccgcgaggatttggctttgtccagtactttgatcctgaagatgctgctgatgcaaaatactatatggatgggcaagttgtccttggcagggaaatagctgttgtttttgcgcaggagaaccgtaagcatccttctgagatgagaaccagagaaagtagcagaggtcgatcttatgaccggcggcgctctctttctccaaggggccggtcgcctttccgtggccgaagctactcaaggtctccatcgcctcggtacgaacggcgcagattcagagaggactcctactcccgctcgcctgtggatggcaggtcgaggagcgggagtccattgcatgagcattacagcaggtctgcgcaaagagagaggtccatttctgccagtggatgaagtagtgtcgtcccaaagtttagaacagcagtgaagctgagtattgtagttgctatgcctttgagaactttgttatctgtggatctttgttatctgtggatctatgagtcttatgtatcgctatgatgtacttgtaaaagtttgttgagctacggtgc

SEQ ID NO: 4745 - DNA, 909 bp, Brachypodium distachyon
gaaaaggaaatccccaccggtctggtcgggaagcttctggactccagactagaggcgacgccactgatctcctcctcccatcgagcggcgctctctgttcgatcccaaatcgttcgcgatcaacatgggaagaggctacagctacagtccatccccaccaccaagaagctacagaggaagggcacgcagcccaagtccccgtgttcgttatgtgggccgaggtagagatctcccaaccagtcttctggtcaggaaccttcgtcgggactgcaggccagaagaccttcgtcggccatttggacaatttggccgccttaaagatgtatatattccaagggattactatactcgggagccgcgaggatttggctttgtccagtactttgatcctgaagatgctgctgatgcaaaatactatatggatgggcaagttgtccttggcagggaaatagctgttgtttttgcgcaggagaaccgtaagcatccttctgagatgagaaccagagaaagtagcagaggtcgatcttatgaccggcggcgctctctttctccaaggggccggtcgcctttccgtggccgaagctactcaaggtctccatcgcctcggtacgaacggcgcagattcagagaggactcctactcccgctcgcctgtggatggcaggtcgaggagcgggagtccattgcatgagcattacagcaggtctgcgcaaagagagaggtccatttctgccagtggatgaagtagtgtcgtcccaaagtttagaacagcagtgaagctgagtattgtagttgctatgcctttgagaactttgttatctgtggatctttgttatctgtggatctatgagtcttatgtatcgctatgatgtacttgtaaaagtttgttgagctacggtgcattgtgctt

SEQ ID NO: 4746 - DNA, 1583 bp, Secale cereale
cgccactcccacgctccactccgacccccgtcgcgttccatttcaaatacgccacctttcatcccctgcatttccaccaaagcctacatgtctccgaccaccgccgcgtcccccgcgccggcgccggcaacagacgtgctcccgaagccttcgccaggcgcgaagcgcagcctgatggggtccctcattgacgccacggcgctgctccgggcggcctccttcaaggaggactcgtacgtggccgcggcgctcccggcctcggacctccgcgcgctcgccgacctcagggcgctcctcgccacccacccggaccaaatctccatctggggcgtgccgctcaacccgcccagcgacgcccccgccgacgagcgcaccgacgtggtgctcctcaagttcctccgcgccagggacttccgcgtccgcgacgcgcacgccatgctgctccgctgcgccgcctggcgggccgagttccgcgccgacgccgtgctggacgaagacctcggcttcaaggacctggagggcatcgtcgcctacatgcacggctgggaccgcgagggccaccccgtctgctacaacgcctacggcgtgttcaaggaccgggacatgtacgaccgggtgttcggcgacggcgaccgcctcagccggttcctccggtggcgcgtccagatcatggagcgcggcgtgcgtgcgctccagctccgccccggcggcgtcaacgccatcatacaggtcaccgacctcaaagacatgccgaagcgagagctccgcgccgcgtccaaccagatactctccctcttccaggacaactaccccgagatggtagcccgcaaggtgttcgtgaacgtgccgtggtacttctccgtgctgttctcgatgatctcgcccttcctcacggagcgcaccaagagcaagttcgtcatcgcgcgcgagggcaacgtcgcagagacgctcttcaagttcatccggccggagctggtgccggtgcagtacggcgggctgagccgcgcgagcgagctggagaacgggccgcccaagccggcgtccgagttcaccatcaagggcggcgagaaggtcttcctagagatcgacggcatcgaggccggtgcaacaataacgtgggacctggtcgtcggcggctgggagctcgagtacggcgcggagtacgtgccggcggcggagggcggctacacgctgtgcgtggagaggaccaggaaggtgccggccgccgccgacgagcccgtgcacaacgccttcacggccaaggagcccggcaagatggtgctctccatcgacaactccggctcacggaagcggaaggtcgccgcctaccgctacttcgtgcgcaagccgtcggcctaggctaccctgctgctcgactgctgtggccggcggcttgccggccggcttgtgctttgctttgctgggcgtcagctcgtctcggagaggagattaatttagggtctatttaattagtgctataatatgatatgcatgtattatgccatatgtagaatatattgtatgtgccgtgagatcctacttgtcatcatcgttataaaaagctaatgagtttaagttttttt

SEQ ID NO: 4747 - DNA, 2019 bp, Brachypodium distachyon
tatgaaagtcagattaatgatagcctatgcaacaatagttgtttcattattcagcgagacagcttgagctccttgcccgcgggatccaccgccgccgctgctttagccgagaagagagacggagccacggagggggaagaaagcagcaagcagcgagacacaacagcccccaccgcatcgatcgatcccctttcgttcttaaaaccccccgagaagagaggcgtgagcagccaacggcggccagccaccagcaaggcagcaagcagcggagcacagcccccacgccagcatcataacgccaccccacgccagcatcataccccccacgctccactgcccacttccgtttcaaataccagcaggccacactcctttttcccctctcccgcattcccacgaacatctaccagggatgtctccgaccaccaccccgtccccggccgcagcgccgaagccttcctcaggaggagccaagcgcggcctgatgggttccctcatcgacgccaccgcgctcctccggacggcctccttcaaggaggactcgtacgtggccgctgcgctgccggcctccgacctccgcgcgctggccgacctcagggcgctgctcgccacccacccggaccaaatctccatctggggcgtgccgctcaacaacacgcccggcgacgccgacgccccggccgacgagcgcgccgacgtcgtgctcctcaagttcctccgcgccagggacttccgcgtccgcgacgcgcacgccatggtgctccgctgcgccgcctggcgcgccgagttccgcgccgacgccgtgctcggcgaggacctcgggttcaaggacctcgagggcgtcgtggcgtacatgcacggctgggaccgcgaaggccaccccgtctgctacaacgcctacggcgtcttcaaggacagggacatgtacgaccgcgtcttcggcgacggcgaccgcctcgccaggttcctccgctggcgcgtccagatcatggagcgcggcgtgcgcgcgctccagctccgccctggcggcgtcaacgccatcattcaggtcaccgacctcaaggacatgcccaagcgcgagctccgtgccgcctccaaccagatactctccctcttccaggacaattaccccgagatggtggcccgcaaggtgttcgtgaacgtgccgtggtacttctccgtgctcttctccatgatctccccgttcctgacggagcgcaccaagagcaagttcgtcatcgcgcgtgagggcaacgtcgcggagacgctattcaagttcatccggccggagcttgtgccggtgcagtacggcgggctcagtcgcgccagcgacctcgagaacggcccgcccaaaccggcgtccgagttcaccatcaagggcggcgagaaggtcttcctagagatcgacggcattgaggccggtgcaacaataacgtgggacctggttgtcggtggctgggacctggagtacggcgcggagtacgtgccggcggcggacggaggctacacgctgtgcgtggagaggacgaagaaggtcccggccagcgccgacgagcccgtgcacaatgccttcacggccaaggaggccggcaagatggtgctctccatcgacaactcgggctcccggaagaggaaggtcgctgcctaccgctacttcgtgcgcaagccgtcggtgtaggctccgatacggtggccggcggcttgccggtagtgcgttgctttgcttgcctttggcttttggctttccctagtcttgaggggagagtttaatttaggtctacttaattagtgctataatatgacatggatgtattatgccatatgtagaatatataatgtctgagctgtgagatcctacttgtcattcgttataaagctaatgagttgagtttttttggggtcaattttacatttgtcgattggcgtttgcagatttactaatgctttggattcctctagtatatatgtttgtttgtttaaaagatgcttgttttgtaggaccatttagaggtgactttt

SEQ ID NO: 4748 - DNA, 2035 bp, Brachypodium distachyon
gtaaagcattgtgcagtatgaaagtcagattaatgatagcctatgcaacaatagttgtttcattattcagcgagacagcttgagctccttgcccgcgggatccaccgccgccgctgctttagccgagaagagagacggagccacggagggggaagaaagcagcaagcagcgagacacaacagcccccaccgcatcgatcgatcccctttcgttcttaaaaccccccgagaagagaggcgtgagcagccaacggcggccagccaccagcaaggcagcaagcagcggagcacagcccccacgccagcatcataacgccaccccacgccagcatcataccccccacgctccactgcccacttccgtttcaaataccagcaggccacactcctttttcccctctcccgcattcccacgaacatctaccagggatgtctccgaccaccaccccgtccccggccgcagcgccgaagccttcctcaggaggagccaagcgcggcctgatgggttccctcatcgacgccaccgcgctcctccggacggcctccttcaaggaggactcgtacgtggccgctgcgctgccggcctccgacctccgcgcgctggccgacctcagggcgctgctcgccacccacccggaccaaatctccatctggggcgtgccgctcaacaacacgcccggcgacgccgacgccccggccgacgagcgcgccgacgtcgtgctcctcaagttcctccgcgccagggacttccgcgtccgcgacgcgcacgccatggtgctccgctgcgccgcctggcgcgccgagttccgcgccgacgccgtgctcggcgaggacctcgggttcaaggacctcgagggcgtcgtggcgtacatgcacggctgggaccgcgaaggccaccccgtctgctacaacgcctacggcgtcttcaaggacagggacatgtacgaccgcgtcttcggcgacggcgaccgcctcgccaggttcctccgctggcgcgtccagatcatggagcgcggcgtgcgcgcgctccagctccgccctggcggcgtcaacgccatcattcaggtcaccgacctcaaggacatgcccaagcgcgagctccgtgccgcctccaaccagatactctccctcttccaggacaattaccccgagatggtggcccgcaaggtgttcgtgaacgtgccgtggtacttctccgtgctcttctccatgatctccccgttcctgacggagcgcaccaagagcaagttcgtcatcgcgcgtgagggcaacgtcgcggagacgctattcaagttcatccggccggagcttgtgccggtgcagtacggcgggctcagtcgcgccagcgacctcgagaacggcccgcccaaaccggcgtccgagttcaccatcaagggcggcgagaaggtcttcctagagatcgacggcattgaggccggtgcaacaataacgtgggacctggttgtcggtggctgggacctggagtacggcgcggagtacgtgccggcggcggacggaggctacacgctgtgcgtggagaggacgaagaaggtcccggccagcgccgacgagcccgtgcacaatgccttcacggccaaggaggccggcaagatggtgctctccatcgacaactcgggctcccggaagaggaaggtcgctgcctaccgctacttcgtgcgcaagccgtcggtgtaggctccgatacggtggccggcggcttgccggtagtgcgttgctttgcttgcctttggcttttggctttccctagtcttgaggggagagtttaatttaggtctacttaattagtgctataatatgacatggatgtattatgccatatgtagaatatataatgtctgagctgtgagatcctacttgtcattcgttataaagctaatgagttgagtttttttggggtcaattttacatttgtcgattggcgtttgcagatttactaatgctttggattcctctagtatatatgtttgtttgtttaaaagatgcttgttttgtaggaccatttagaggtgactttt

SEQ ID NO: 4749 - DNA, 1844 bp, Setaria italica
ggggccggccgcgcgcagcatccagtgagccagcgcgcagctcctactcctccggccccaaccccacgcgcggcgcggccatcataacgctcgcctcacgcctccgctcgctccactccaaaatcctcctcctcctcccatttcaaaacctcctcctcctccaccattcccgcagaggccctgcttgtcaccttcccaatcctccctcccctccccctcccccacacctagcaggagtcaggagtcaagagaggccatgtctcccaccaccaccccgtcccccgcgcccgccgcggcgccggcgccctcctccaagggcgccaagcgcagcctcatgtcctcgctcatggacgccaccgcgctgctccgctccgcctccttcaaggaggactcgtacgtcgccgccgcgctcccgccctccgagctccgcgcgctcgccgacctcaaggcgctgctcgccacgcacccagacccaatctccatctggggcgtcccgctcaacccccagtcccctcctccggccgccgcagccgacggcactgccgccactcctgccgccgacgagcgcgcggacgtggtgctcctcaagttcctccgcgcgcgcgacttccgcgtccgcgacgcgcacgccatgctcctccgctgcgcggcgtggcgcgccgagttcggcgccgacgcggtgctggacgaggacctgggcttcaaggacctggagggggtggtcgcctacatgcacggctgggaccgcgacggccaccccgtctgctacaacgcctacggcgtcttcaaggaccgcggcatgtacgagcgcgtcttcggcgacggcgaccgcctcgcgcgcttcctccgctggcgcgtacaggtcatggagcgcggcgtcagggcgctcagcctcaggccggggggcgtcaacgccattatacaggtcaccgacctcaaggacatgcccaagcgcgagctcagggccgccagcaaccagatcctctcgctcttccaggacaactacccggagatggtggcgcgcaaggtgttcatcaacgtgccgtggtacttctccgtgctcttctccatgatctcgcccttcctcacggagcgcaccaagagcaagttcgtcatcgcgcgcgagggcaacgtcgcagagacgctatacaagttcatccggccggagctggtgccggtgcagtacggcgggctgagccgcgccggcgacctcgagaacggcccgcccaagccggcgtccgagttcaccatcaagggcggcgagaaggtgttcctggagatcgacggcatcgaggccggtgcgacaataacgtgggacctggtggtcggcggctgggacctggagtacggcgcggagtacgtgccggcggcggaggagagctacacgctgtgcgtggagaagacgaggatggtgctggccaccgccgaggagcccgtgcacaacgccttcacggcgagggaggccggcaagatggtgctgtccatcgacaactccggctcccggaagcggaaggtcgccgcgtaccggtacttcgtgcggaagccatcggcgtagttgcgctctgccttctagcgcggtggccggcggctctccggccggcggtggcgacgggagcctgacatgggacggacggcgaactgcttgcttgcttgggcttgttgtggtcttgttggaggggagagaagttcagttagggctgtttaattactactagtgctataatgacatgcatgtattatgccatatgtagaatataatgtaagagctgttggacttttgtcatcaccgccgttataaaagctaatgagttcagtttttttgggtaattccatcttggtttaca

SEQ ID NO: 4750 - DNA, 2125 bp, Setaria italica
ccctcccggtcatatttttctcgcgcgctcttaaaatcggcggcgcgggagagcggggggccggccgcgcgcagcatccagtgagccagcgcgcagctcctactcctccggccccaaccccacgcgcggcgcggccatcataacgctcgcctcacgcctccgctcgctccactccaaaatcctcctcctcctcccatttcaaaacctcctcctcctccaccattcccgcagaggccctgcttgtcaccttcccaatcctccctcccctccccctcccccacacctagcaggagtcaggagtcaagagaggccatgtctcccaccaccaccccgtcccccgcgcccgccgcggcgccggcgccctcctccaagggcgccaagcgcagcctcatgtcctcgctcatggacgccaccgcgctgctccgctccgcctccttcaaggaggactcgtacgtcgccgccgcgctcccgccctccgagctccgcgcgctcgccgacctcaaggcgctgctcgccacgcacccagacccaatctccatctggggcgtcccgctcaacccccagtcccctcctccggccgccgcagccgacggcactgccgccactcctgccgccgacgagcgcgcggacgtggtgctcctcaagttcctccgcgcgcgcgacttccgcgtccgcgacgcgcacgccatgctcctccgctgcgcggcgtggcgcgccgagttcggcgccgacgcggtgctggacgaggacctgggcttcaaggacctggagggggtggtcgcctacatgcacggctgggaccgcgacggccaccccgtctgctacaacgcctacggcgtcttcaaggaccgcggcatgtacgagcgcgtcttcggcgacggcgaccgcctcgcgcgcttcctccgctggcgcgtacaggtcatggagcgcggcgtcagggcgctcagcctcaggccggggggcgtcaacgccattatacaggtcaccgacctcaaggacatgcccaagcgcgagctcagggccgccagcaaccagatcctctcgctcttccaggacaactacccggagatggtggcgcgcaaggtgttcatcaacgtgccgtggtacttctccgtgctcttctccatgatctcgcccttcctcacggagcgcaccaagagcaagttcgtcatcgcgcgcgagggcaacgtcgcagagacgctatacaagttcatccggccggagctggtgccggtgcagtacggcgggctgagccgcgccggcgacctcgagaacggcccgcccaagccggcgtccgagttcaccatcaagggcggcgagaaggtgttcctggagatcgacggcatcgaggccggtgcgacaataacgtgggacctggtggtcggcggctgggacctggagtacggcgcggagtacgtgccggcggcggaggagagctacacgctgtgcgtggagaagacgaggatggtgctggccaccgccgaggagcccgtgcacaacgccttcacggcgagggaggccggcaagatggtgctgtccatcgacaactccggctcccggaagcggaaggtcgccgcgtaccggtacttcgtgcggaagccatcggcgtagttgcgctctgccttctagcgcggtggccggcggctctccggccggcggtggcgacgggagcctgacatgggacggacggcgaactgcttgcttgcttgggcttgttgtggtcttgttggaggggagagaagttcagttagggctgtttaattactactagtgctataatgacatgcatgtattatgccatatgtagaatataatgtaagagctgttggacttttgtcatcaccgccgttataaaagctaatgagttcagtttttttgggtaattccatcttggtttacagttgcagaatgctttggattcctcgagcgagcttggactttggagtgtactactatggttgtttccgagtaccattttgtcgcgtggccaccaattaaaatactcaattttagccttctaaagcattctctgaattctactgatacaattttacgttatttcaaaactttttatttacaccttttgaactgttctgaattctgatatacagtttttactgatatt

SEQ ID NO: 4751 - DNA, 2104 bp, Sorghum bicolor
ccactggtcatgcttttcatcgtccgctcttaaaatcggcggcgcgggagagcgggcggccgcgccagcaggcagcagccggtgatcctgagccaccagcaggcaggcaggcaggcaggtccctcttcctccttcccgggcccccgcccaaccccacgcgagcgaggcgcggccatcataacgccccccttcacgctcttccgctccactccaaatcctctcctcccatttcaaaacctctcctcctctcctcgccgcagctcccaccatttccgcagacgccttgtcctcccctccccaccccgccgcacgtccgcaccgcaagccccacgccaccgccatgtctcccaccaccaccccgtcgcccgcgcccgtggcagccccggcctccaagggcgccaagcgcagcctcatgtcctcgctcatggacgccaccgcgctgctccgctcctcctccttcaaggaggactcgtacgtcgccgccgcgctgccgtcgtccgagctccgcgcgctcgccgacctcaaggcgctgctcgccacccacccggaccccatttccatctggggcgtcccgctgaacccacactctcctcccgccgcggcggacgacgctgcccctgccccaaccccggcaccggtggacgagcgcgccgacgtggtgctcctcaagttcctccgcgcgcgggacttccgcgtccgcgacgcgcacgccatgctgctccgctgcgccgcctggcgcgccgagttcggcgccgacgccgtgctggacgaggacctgggcttcaaggacctcgagggcgtcgtcgcctacatgcacggctgggaccgcgacggccaccccgtctgctacaacgcctacggcgtcttcaaagacagggacatgtacgagcgcgtcttcggcgacggcgaccgcctctcgcgcttcctccgctggcgcgtccaggtcatggagcgcggcgtgcgcgcgctcaccctcaggcccggcggcgtcaacgccatcatacaggtcaccgacctcaaggacatgcccaagcgggagctcagagccgccagcaaccagatcctctccctcttccaggacaattacccggagatggtggcgcgcaaggtgttcatcaacgtgccgtggtacttctccgtgctcttctccatgatctcgccattcctcaccgagcgcaccaagagcaagttcgtcatcgcgcgcgagggcaacgtcgccgagacactctacaagttcatccggccggagctggtgccggtgcagtacggcgggctgagccgcgccggcgacctcgagaacggaccaccaaagccggcgtccgagttcaccatcaagggtggcgagaaggtcttcctggagatcgacggtatcgaggccggtgcaacaataacctgggatctggtcgtcgggggctgggacctcgagtacggcgccgagtatgtgccggcagccgaggacagctacacgctctgcgtggagaagacgaggatggtctcggccaccgccgacgagcccgtgcacaacgccttcacggcgagggaagccggcaagatggtgttgtccatagacaactctggttcccggaagcggaaggttgccgcctaccggtacttcgtgcgcaagccgtcggtgtaggcctgctgctgcctttgtggtgctcgtggcggccggcaccttgccggccggtggccgcgaggggaggttgacgtggaacagacggtgaagggggctttgcatgctttgcttggccttgttgtggggacttggtcacttggagaggttaagttaggctatttaattattagtgctataacgaaatgcatgtattatgccatatgtagaatataatgtaagagctgttgaacttttgtcatcaccaccgttataaagctaatgatgagttaagttttttggataactcgcctcctctttctttttcttttttttttctttttttgctttggattcctagagggattttggaggatacaatggctgtttccgcttaccagtttgttgggtgcccaccgattaaaatgctttcttttggagttttgcactgttgtgaattctttgagtatatatacggttttactgatattt

SEQ ID NO: 4752 - DNA, 1825 bp, Zea mays
gtgatcctgaggcagcagcaggctcacaggctggtcctctcgtctcgtgtctcgtctcgtctcgtcttcctcctcccccgccccctggcaccaacccggcccaaccccactcgagcgaggcgcggcgcggccatcataacgtccccccttcacgttcttccgctccactccaaatcctcctcccatttgaaaacctcctcttttctcctctcctcgccgcagctcccaccattcccgcagacggacgcttttccccttcccagcttcccctgaccactccgcagcaggcccgcaagccccgacgccagcggcatgtcccccgccaccaccccgttgcccgcccccgtggcagccccagcgtccaagggcgggaaacgcagcctcatgtcgtcactcatggacgccaccgcgctgctccgctcctcctccttcaaggaggactcgtacgtggcggcggcgctcccggcgtccgagctccgcgcgctcgccgacctcaaggcgctggtggccacccacccggaccccatctccatctggggcgtcccgctgaatccccactcccctcctcccggcgcggcgaacgacgacgccgacgagcgcgccgacgtggtgctcctcaagttcctccgcgcgcgggacttccgcgcgcgcgacgcgcacgcgatgctgctccgctgcgccgcgtggcgcgccgagttcggcgcggacgcggtggtggacgaggagctgggcttcaaggagctggagggcgtggtggcgtacatgcacgggtgggaccgggacgggcaccccgtgtgctacaacgcgtacggcgtgttcaaggacagggccatgtacgagcgcgccttcggcgacggcgaccgcctggcgcgcttcctccggtggcgcgtccaggtgatggagcgcggcgtgcgcgcgctcacgctcaggccccgcggcgtcaacgccatcatacaggtgaccgacctgagggacatgccgaagcgggagctcagagccgccagcaaccagatcctctccctcttccaggacaactacccggagatggtggcgcgcaaggtgttcatcaacgtgccgtggtacttctccgtgctcttctccatggtctcgcccttcctcacggagcgcaccaagagcaagttcgtcatcgctcgcgagggcaacgtcgccgagacgctgtacaagttcatccggccggagctggtgccggtgcagtacggcgggctgagccgcgccggcgagctcgagaacggaccgccgaagccggcgtccgagttcaccatcaagggtggcgagaaggtgttcctggagatcgacggtatcgaggccggcgcaacgataacgtgggacctcgtcgtcgggggctgggacctggagtacggcgccgagtacgtgccggcggccgacggcagctacaccctctgcgtggagaaggcgaggacggtcccggccacaaccgccgacgccgacgccgggccgctgcacaacgccttcacggctcgggaggccggcaggatggtgctgtccatagacaactccggttcccggaagcggaaggtcgccgcctaccgctacttcgtgcgcaagccgtcggcgtagcgtaggccttgctgtgctcgtggcggccgccggcgtcttgccggccggccgcgccaggggggaggcaaacgtggaaccaccggtgaagtgcctgcatgcatgctttgcttgggcttatatttgtcggacttggagaggagaggttaagctaggctattttattattagtgctatatataacgacatgcatgtattatgccatgtgtagagtataatgtaagagatg

SEQ ID NO: 4753 - DNA, 1727 bp, Saccharum officinarum
cctcctgccatttcaaaacctcttcctcttctcctctcctcgcctcagctggcaccatttccgcagacgccttgtccccttcccggcttcccctacccaccgcgccgcacgtccgcaagccccacgcgccaccgccatgtctcccaccaccaccccgtcgcccgcgcccgtggcagccccggcctccaagggcgccaagcgcagcctcatgtcctcgctcatggacgccaccgcgctgctccgctcctcctccttcaaggaggactcgtacgtcgccgccgcgctcccgtcgtccgagctccgcgcgctcgccgacctcaaggcgctgctcgccacccacccggaccccatttccatctggggcgtcccgctgaacgcccactctcctcccgccgcggcggacgacgctgcccctgccccaaccccggccccggttgacgagcgcgccgacgtggtgctcctcaagttcctccgcgcgcgggacttccgcgtccgcgacgcgcacgccatgctgctccgctgcgccgcctggcgcgccgagttcggcgccgacgccgtgctggacgaggacctgggcttcaaggacctcgagggcgtcgtcgcctacatgcacggctgggaccgcgacggccaccccgtctgctacaacgcctacggcgtcttcaaagacagggacatgtacgagcgcgtcttcggcgacggcgaccgcctcgcgcgcttcctccgctggcgcgtccaggtcatggagcgcggcgtgcgcgcgctcaccctaagccggggggcgtcaacgccatcatacaggtcaccgacctcaaggacatgcccaagcgggagctcagagccgccagcaaccagatcctctgcctcttccaggacaattacccggagatggtggcgcgcaaggtgttcatcaacgtgccgtggtacttctccgtgctcttctccatgatctcgcccttcctcacggagcgcaccaagagcaagttcgttatcgcgcgcgagggcaacgtcgccgagacactctacaagttcatccggccggagctggtgccggttgcatacggcgggctgcggcagtacggcgggctgagccgcgccggcgacctcgagaacggaccaccaaagccggcgtccgagttcaccatcaagggtggcgagaaggtcttcctggagattgacggtatcgaggccggtgcaacaataacgtgggatctggtcgtcgggggctgggacctcgagtacggcgctgagtatgtgccggcggccgaggacagctacacgctgtgtgtggagaagacgaggatggtctcggccaccgccgaggagcccgtgcacaataccttcacagcgagggaagccggcaagatggtgttgtccatagacaattctggttcccggaagcggaaggttgccgcctaccggtacttcgtgcgcaagccgtcggtgtaggcctactgccttgtggtgctcgtggcggccggcaccttgccggccggtggccgcgaggggaggtgtgccggcaggtggccgcgaggggaggttaacgtggaacagacggtggcatgctgcttgggcttgttgtgggacttggaggggagaggttaagttaggctatttaattattagtactataacgacatgcatgtattatgccatatgtagaatataatgtaagagctgttgaacttttgtcatcaccactgttataaagctaatgatgagttaag

SEQ ID NO: 4754 - DNA, 2127 bp, Secale cereale
tgcgtgccgcgggggagtctcgtccgcgtagatctggacgggcgccgctagggttgcttccccgccgccgcattcacccccctcctaaaccctagagcccgcccgcccgcccgagccaagaagccggtgcccccctgctccccgtcccgcgctctcggagaacggctccagcgacggcggccagcctcccccagggccgcctgccggcacaccccccctcgccgccagatcgacggcggtgcagtcttttcttgctcgttcctctcgggcctcggcagatcgacgccggcggcgactcctctcgccctgtcctcccgagcccggcttaaatggctgcaaggaaggataatgcagtccttattgcttgccaagctcccaatggccgtgtcacacgagctcaagctgctaccaaccgcggaaggtttggagcgccaaatcctgcaccggtacctgtgagaactgaacgaaaaccagcgacgaaaggaaaggcaaaacgcggagcttcggatgagaacacttgtgcaagtgctgtaacttcagctccagctcctaaaaggcgagcagccctcaaggatgtgacaaacataagctgcgcaaactcgttcagaaattgcactactgcgactaagctacagtcaaggcccacccaaaaggttgggcgaaatccaagcaaaaacaagcagtgtgcaaagaaggctcctaagccacctcttcctgctgttagtggaacttcatttgttgtgaatgattctcatattgtggaagaagctaagaaggcagaacttttgccaccaaaagaggagcccattgctctgcttgataataaggggccgttgtcgttatggaatgttgcacggaacagggagagtggtgttcatgagccattctttcagggaagaaacacaggagataaatctgaaactgctgactcaaacactggggactatgttggcttaaacgttatagacattgacaaagataatggcaatccacaaatgtgtgcttcctatgctgcagaaatatatagaaacctaatggctgcagagcttgtaaggagacctaaatcaaattacatggagactttgcaaagggatatcacgaagggcatgcgaggaatcctgattgattggcttgttgaggtttccgaggaatataaacttgtgccagacacactgtacctcactgtatatcttattgatcaatttctttctcggaaatatattgaaagacagaaactacaacttcttggaataacaagcatgctgattgcctcaaaatatgaagagatctgtgcgcctcgtgttgaagaattttgtttcataactgataacacatatacaaaaaatcaggtgctgaaaatggagtgcgaagtgcttaatgatctggggtttcatctttctgttcccacaattaaaacatttctgaggagattccttagagcagcacatgcttctcagaaagctccttgtgcaactttgggctatctaggcaattatcttgcggagttgactttgaccgattacaatttcctgaaatttcacccttcagtggtggcagcctcggcagtgttccttgcaaaatggacacttgaccaatcagacctgccatggaactgtactctcgagcattacacctcatacaaaagttccgatattcaaggatgcgtacgcgatctatgggagctgcagcagggcaacaccagtggaagtccccccctcaatgctatacgcgagaagtaccggcaagaaaagtttgaatgtgtagccgacatgctgtcgccggcgatgcctgtgtcgctcttccatagacaagctaacggcaccagccccctgctgatcaacaactcctagcagcgcagcgtcagcgccctgctgatcaacaacttgatttttccccgaagatcttgtagcatccccttcccaccatccttctccccctccgacctggttgtgctgttattccccctgacctttttcgagtcgtgcagtcgtaggcgatggctgacataaatgtcgatcgagtttgtgtgtaggctgctgatggatgcctagggcgggctggtaattgtatgatgatgatgatgatgctgtctgtctgtctgtatgataactgagtgagtgccgcttg

SEQ ID NO: 4755 - DNA, 2200 bp, Hordeum vulgare
ccagggccgcctgccggcacatcctccctcgccgccagatcgacggcggtactgtcttttcttgctcgttcctctcgggcctcggcagatcgacgccggcggcgactcctatcgccccgcccggcttaaatggctgcaagaaaggaaaatgcagtccttattgcttgccaagctcccaatggccgtgtcacacgagctcaagctgctacaaatcgtggaaggtttggagcgtctctccctgcacaggtacctgtaagaactgaacgaaaaccggcgacgaaaggaaaggcgaaacggggagcttcggatgacaacacttgtgcaagtgctctaatttcagctccacctcctaaaaggcgagcagcgctcaaggatgtgacaaacataagctgcgcaaactcctccagaaattcaactgctgtgactaaacatcaggcaaggcccacccaaaaggcagggcgaaatccgagtaaaaacaaacagtgcatgaagaaggtccctaagccacctcttcctgctgttagtggaacttcatttgttgtgaatgattctcataatgttgaagaggctcagaaggcagagcttctgccaccaaaagaggaacccactgctctgctcgaaaacaaggggtcattctccttatggaatattgcacggaacagggagagtggtgttcatgagccattctttcagggaagaaacacaagagataaatctgaaactgctgactcaaacactggggactatgttggcttaaatgttatagacattgacaaagataatggcaatccacaaatgtgtgcttcctatgttgcagaaatatacagaaacctgatggccgcagagcttataaggaggcctaaatcaaattacatggagactttgcaaagggatatcacaaagggcatgcgaggaatcctcattgattggcttgttgaggtttctgaggaatataaacttgtgccagacacactgtacctcactgtatatcttattgatcaatttctttctcggaaatatattgaaagacagaaactacaacttcttggaataactagcatgctgattgcctcaaaatatgaagagatctgtgcgcctcgtgttgaagaattttgtttcataactgataacacatatacaaaaaatcaggtgctgagaatggagtgcgaagtgcttaatgatctggggtttcatctttctgttcccacaatcaaaacgtttctcaggagattccttagagcagcacatgcttctcagaaagctccttgtgcaactttgggctatcttggcaattatctcgcggagctgactttgaccgattacagtttcctgaaatttcatccttcagtggtggcagcctcggcggtgttcctggcaaaatggacacttgaccaatcagacctgccatggaactgtactctcgagcattacacctcatacaaaagttccaatatcgaaagatgcgtacgcgatctatgggagctgcagcagggcaacaccagcgggagtccccccctcaatgctatacgcgagaagtaccggcatgaaaagtttgaatgtgtagccaacatgctgtcgccggccatgcctgtgtcgctcttccgtaggcaagctaacgacaccacccccttgctgatcaacgactcctagcagcacagcatcagtcccctgctgatcaacagcttgatttttttcgaagatcttgtagcatccccttcctccccccgatctgtctgtgttgtgttttgctctcctcctgagctgagctgttgttttttcccgacctttttcgagtcgtgcagtcgtaggcgatggctcgcataaatgttgatttgagttggcgtgtaggctgctgatggatgtgcctatggctggtaattgtatgatgatgatcctgtctgtctgtatgataactgagtgagtgccgcttgatttaacgtaggtttgggcgcctttcctagagtctagtgtgtgctgtgcaattgcagtgctcttgacattagaagagcacctgagtccaggatggttgatttgatgtaacatgttgttacaagaagatacattgttgttgcttggtttgtaaatgaacataaatgtagcctgactgtctacatcatgatgaacacagctggggtttgtttgtttgttgttttcttttctttatgaaatgaaatgaaactaagcaagtgaagagccatca

SEQ ID NO: 4756 - DNA, 2500 bp, Triticum aestivum
ctccccttcaaaacttcaaaacccgaaaggtggtcgccgcctccgcctccgccgcctcacccggatcccgccggcgctggggagagctttcctcttcggcacagatctgaacgcgaaccgctagggttcccgccgctgcattctcccctcttataccctagagcctgtccgtccttcccgagcgcagggcccctcccgcgcctcgctgctccacatctcgctcttgccgaagcactccagcgacggcggcctgcctcctccaggaccggctgtcgacacatcctatctcgccgccggatcgacggcaatccagtctttcttgctcgctcctctcgggcctcggcagatcgacgcgggcggcgaccctctcgcccgtccctcccgaccccggcgagttctttgtcctcacattcccctagatgctctccttccttgcacaccatggccgccaaatgtgggctttcttgttttaaagaaaagaatttgagctttctttttcaacaactggtggtgcccccattcttttgcaagaactcatgaatctgatggtataggcttaaatggcttcaagaaaggatattccagtccttattgcttgccaaggtcccagtggccgtgtcacacgagctcaagttgctaataatagtagaagatgtggagtggctcaccccgcactggtacctgtgagaactgaacaaaaaccgacagtgaaagggaagacgaaacggggagctttggatgagaatacttgtgtaagtgctgtagcttcagctccacaccctaaaaggagagcagtgctcaaggacgtgacaaacataagctgtgcaaactcatatagaaattgcactgctgtgactaagctacagtcgaggcccacccaaaaggtaggacgaaatccgagcaaaaacaagcagcgttcaaagaaggtccctaagccacctcttcctgctgttagtggaacttcatttgtgaatgattgtcacaacgttgaagaagctcagaaggaagagctttcaccaccaaaggaggagcccactgctttgcttgaaaacaaagggtcgttgttgcagaatactgaacggaacagggagagtggttttcatgaggcattctttcagggaagaatcacaagagataaatttgaaactgctaactcaaacactggggactatgctggtttaaacattatagatattgacaaagataatggcaatccacaaatgtgtgtttcctatgctgcagagatatacacaaacctaatggctgcagagcttataagaaggcctaaatcaaattacatggagactttgcaaagggatattacaaaaggcatgcgaggaatcctcattgattggcttgttgaggtttctgaagagtataaacttgtgccagacacgctgtacctaactgtataccttatcgatcaatttctttcttggaaatatattgaaagacagaaattgcaacttcttggaataactagcatgttgattgcctcaaaatatgaagagatctgtgcaccacgtgttgaagaattttgtttcataactgataatacatatacaaaagaccaggtgctgaaaatggagtgccaagtgcttaatggtctgggatataatctttctgttcccacaactaaaacatttctcaggagatttcttagagcagcgcaggcttctcacaaagctccttctgtaactctgggttatctggcgaattatctcgcggagttgactttgaccaattacaatttcctgaggtttctcccttcagtggtggcagcctcggcagtctttcttgccagatggacacttgaccaatcagatctcccatggaactgtactctggagcattacacctcatacaaaagttctgatattcaaatatgtgtatgcgctctatgggaacttcagggcaacaccagccgatgcccccttaatgccatacgtgaaaagtatcagcacaaaaagtttgaatgtgtagccaacatgttgtcgccggagctggctcagtcgctctttagtagacaagctaacgacaccaatcccctgctgatcaatgactcttagcagcatcaatctcctgacaaccgtgtggccgacaactcgatttttggaagatcctgtagcttccttccccctctgatctaggtgtgttgtgttctccgccgagctgttgtttgtccgacctttctcgagccatgcagtagtaagtgatggctcccataaatattgctggaacgtgattaagttggtgtgtaggctgctgatgccttgggttgataattgtatgatgatcctatctgtataatatctgccggctgcttgatttaacgtagatttgcgttgaattgactgttttccagagtgtaatgtagtgtaatgctcttaagattataagagcgcttgaatccaggatgatgtaacctgctacaggcacatattacttggtttgtaaatgtagcctatgttacgccgaacagaagagttttcttttcttt

SEQ ID NO: 4757 - DNA, 2346 bp, Lolium multiflorum
agcctgcgctgcgcagcgtcgtccccttctcctcttctacgctgccccaaatcatcccgcctgctcggttcaaacctcaaaccccaaaggtggtcgccgcctccgccgcagccgcctcatccggatcccgccggcgctggggaggcctttcctcttcgccgcagatctggacggggaacgctagggtttccgccgctcgcattctcccttcttaaaccctacaacctctcggaccggagggcctcccggacgccggcgactccccgccccacatctcgctctcggcgaaccactccagcgacggcggcctgcctctcccggggaccggctgccgccccatcctccctcgccgccagatcgacggcaatcccgtctttcttgctccttcctctccggcctcggcagatcgacgcgggtggcgaccctctcgcccggccctcccgagcccggttgtcatggctgcaagaaaggataatccagtccttattgcttgccaagcacccagtggccgtgtcacccgagctcaagctgctaataaccgtggaaggtttggagtggctcaccctgcaccagtacctgtgagaaaaccgccggcaaaaacaaatgcgaaaaggggagctttggatgagaatgcttgtgcaagtgctgtaacatcagctccacagcctaaaaggcgagcagtgctcagggatgtgacaaacataagctgtgcaaactcatacaaaaattgcactgctgcgactaagctgcagtcaaagccaccccaaaaggtggcacgaatgccgagcaagaacaagcagtgtgcaaagaaggctcctaaaccaccccttcctgctgttagtgaagcttcatttgttaatgattctgaggaagctcagaagggagagctttttgcaccaaaagaggagcccactgctttgctcgaaattaaggggtcattgtcattacaaaatattgaatggaacaggttgagtgggtttcatgaggcattctttcagggaaggaacacaagggataaatctgaaactgcggactcaaagaatgggaactatgctggtttaaatattatagatattgacaaagataatggaaatccacaaatgtgtgcttcctacgttgcagagatatacgcaaacttaatggcctcagagcttataagaagacctaaatcaaattacatggagactttgcaaaaggacattacaaaggggatgcgagggattctgattgattggcttgttgaggtttccgaagaatataagctcgtgccagacacgctgtacctcactgtatatcttattgatatatttctctcccggaaatatattgagagacaaaaacttcaacttcttgggataactagcatgctcattgcctcgaaatatgaagagatctgtgcacctcgtgttgaagaattttgtttcataactgataatacatatacaaaagctgaggtgctgaaaatggagtgccaagtccttaatgatctaggatttcatctttctgttcctacaacaaaaacatttctcaggagattccttagagcagcacaggcttctcacaaagctccttctgtaactttgggttatctggccaattatcttgcggagttgactttgaccgattacagtttcctgagatttctcccttcagtggtggcagcttctgcagtctttcttgcaagatggacacttgaccaatcagaccttccatggaactatactctggagcattacacctcatacaaaagttctgatattcaaatgtgcgtatgcgctctacgggaactgcagggcaacaccagtggatgccccctcaatgctatacgtgaaaagtataggcacgaaaagtttgaaggtgtagccaacatgctgtcgccggaactgagtcagtcgctctttagtatacaagctaacgacatcaatcccctgctgattgacaactattagcagcatcaatctcctgacaattgtgtcgcccatatttcgaagttcttgtggcaccgctcccatcccattcaatccccttgatctggttgtgttgtgttgtccccccgagctggtgttgtttttctgacctttttcgagtcgtgcagtagtacgtgatgactcgcataaatattgtttggcttgtaggcttctgatgccttgtatgatggccctatctgtataataacccagtgctgcttgatttaacgtagattgtgtcggaatgattatttttcagagtgtagtgcaatgctcttaagattgaaagagcactagaatccaggatgatgtaacctgttatgaatccaggatgatgtaacctgcttcatgcaattcatacttggtttgtaaatgtagt

SEQ ID NO: 4758 - DNA, 1748 bp, Festuca arundinacea
atggagtttcctcagtgggcgtccttcctgggagtcgtgctcgccacggtgctctttctcaaggccgtcctccaacgccgaagcagccgcaagtacaacctcccgccgggtcccaaggcgtggccgatcatcggcaacctgaacctcatcggcacgctcccacatcgctccatccacgcgctctccaaacagtacggcccgctcttgcagctccagtttggctcctttccctgcgtcgtcggctcctccgtcgagatggctaagttcttcctcaagacccacgacgtgatgttcaccgaccggcccaagttcgccgccggcaagcacaccacctacaactacagcgatatcacctggtccccctacggcgcctactggaggcaggcccgcaagatgtgcctcacggagctcttcagcgccaggcggctccagtcgtacgagtacatccgcagcgaggaggtactcgccctcctccgcgacctgcatcgcggcgccaccgtcggcgccggccgcgccctggtgctcaaggactacctgtccacggtgagcctgaacgtgatcacgcgcatggtgatgggcaagaaatacctggagaaggaggtgagggacgggagcggcgcggtgatcacgacgccggacgagttcaagtggatgatcgacgagctgttccttctcaacggcgtgctgaacatcggtgactccatcccgtggctcgactggatggacctgcagggttacattaagaggatgaagaagctcagcaagatgtttgaccggttcctggagcacgtcgtcgacgagcacagcgagcgacgccgccacgaggcggagagcttcgttgccaaggacatggttgacgtgcttctgcagttcgcgagcaaccccgatctcgaggtcaagctcaacagggagggcgtcaaggctttcactcaggatcttatcgctggcggcacagaaagctcggcggtgacggtggagtgggcactctcggagctcctgaagaagcccgaggtgttcgccagggcgaccgaggagctggaccgcgtcgtcggaagaggccgttgggtcaccgagaaggacatgccgagcctcccctacgtggacgccatcgtgaaggagacgatgcggctgcacccagtggcgccgatgctggtgccccgcctctcccgcgaggtcacgaccatcggcggctatgacatccccgccggcacccgggtgctcgtcagtgtgtggaccatcggccgggacccagagctatgggacgcgcctgaagagttcatgccagagaggttcctcggcagcaggctcgacgtcaaggggcaggactacgagctactgccgttcggatcgggacgcaggatgtgccctgggtacagtcctggactaaaagtcatccaggtgagcctggccaacctactgcacggcttcgagtggaagctccccgacggcgtggagctgagcatggaggagatcttcggcctctccacgccgcgcaagttcccgctggaggccgtcgtggagcccaagctcccggctcatctctacgaatgaatgcggttgcgtgctagtgactcaaatacttattagttcatttttactacttttgtttctgcatttttttgccgtattactccggtcatgtgtcgtggtggtcttgtgtggcgtacagtcgagtggaataaacgggatattgtatactctgtaactctataagaagatggtgctaattcaggatcattttcgactat

SEQ ID NO: 4759 - DNA, 1585 bp, Avena sativa
atcacctgcttggcaaggcagctgaatcttcgatcccattaatggagcttcctcagtgggcgtccttcctgagcatcgtggtagccacagtgctcttcctcaaggccgtcctcggccgccgtaggagccgcaagtacaacctcccgccgggtccaaaggcatggccgatcatcggcaacctgaacctcatcggcacgctcccgcaccgctccatccacgcgctggccaagcagtacggcccgctcgtgcagctccagttcggctccttccccgtcgtcgtcggctcctccgtcgagatggccaagttcttcctcaagacccacgatgttgtcttcaccgaccggcccaagaccgccgccggcaagcacaccacctacaactactgcgacatcacctggtccccctacggcgcctactggcggcaggcccgcaagatgtgcctcaccgagctcttcagcgccaagcggctcgagtcgtacgagtacatccgcagggaggaggtcctcgccctcctccgcgacctgcatcgcggcgcggccactgccggcgccggccgcgccctcgtgctcaaagactacctgtccacggtgagcttaaacgtgatcacgcgcatggtgatgggaaagaagtatctggagaaggaggtgagggacgagaccggagcggtgatcacgacgccagacgagttcaagtggatgatcgacgagcttttcctcctcaacggcgtgctaaacatcggcgactctatcccgtggctcgactggctggacctgcaggggtacatcaaaaggatgaagaagctgagcaagatgttcgaccggttcctggagcacgtcgtggaagagcacagcgagcggcgccgctgcaacggggagagcttcgtggccaaggacatggtcgacgtgctgctgcagttcgccagtgatcccaatctagaggtcaagctcaacagggagggcgtcaaggctttcactcaggatctcattgctgggggcacagaaagctcggcggtgacggtggaatgggctctctcggagctgctgaagaagcctgaggtgttcgccaaggcgaccaaagagctggacagtgtaatcggccgaggccgctgggtcacggagaaggacatcccgagcctaccatacatagaggccatcgtcaaggagacaatgaggctgcacccggttgcgccgatgctggtgccccgactctcccgtgaggacacatccatcggcggctacgacatccccgccggcacacgcgtgctagtcagcgtgtggtccatcggccgcgacccggagctgtgggacgcgccggaagagttcatgccagagcggtttctgggcagcaggctcgatgttaaggggcaggactacgagctgctgccattcggatcgggacgaaggatgtgccctgggtatagtctaggactgaaggtgatccaggtgagcctagccaacctgttgcacggcttcacgtggaggctccctaacggcgtggagctgagcatggaggagatctttgggttatccacgccacgaaagttcccgctggaggccgtcgtggagcccaagctcccggctcacct

SEQ ID NO: 4760 - DNA, 1906 bp, Brachypodium distachyon
cagctcaagcctcaacacaatacgtcactcaaccacagtactacttagcccacttgcatcacgaactgagcgtcatcaatggagctcccccaatgggcgtccttccttggcgtggtgctggccacggtggtcttcctcaaggccgtcctccggcgccgcggcggcagcccaaaacgcacgtacaacctcccgccgggcccgaagccgtggcccatcatcggcaacctgaacctgatcggcacgctcccgcaccgctccatccacgcgctgtccaagcagtacggcccgctgatgcagctccagttcgggtccttccccgtcgtggtgggctcctccgtggacatggccaagttcttcctcaagacccacgacgtggtcttcacggaccggcccaagaccgccgccggcaagcacaccacctacgactacagcgacatcacctggtccccctacggcgcctactggcgccaggcccggaagatctgcctcaccgagctcttcagcgccaagcggctcgagtcctacgagtacatccgcggcgaggaagtgctggcgctcctccgcgacctccacggggcgtccgggcgcgtcgtggtgctcaaggacttcttgtccacggtgagcctgaacgtgatcacacgcatggtgatggggaagaagtacctggagaaggaggtgaaggacgaggccggggccgtgatcacgacgcccgacgagttcaagtggatgctcgacgagctcttcctgctcaacggcgtgctcaacatcggcgactccatcccgtggctcgactggatggacctccaggggtacattaagaggatgaagaagctgagcaagatgttcgaccggttcctggagcatgtggtcgacgagcacagcgagcgctgccgccgcgagggcgagggattcgtggccaaggacatggtcgacgtgctgctgcaggtcgccagcgatcctgatcttgaggtcaagctcaacagggagggcgtcaaggctttcacccaggacatgatcgccggcggcacggagagctcggcggtgaccgtagaatgggccttgtcagagctcctaaaaaagcccgaggtattcgccaaggcgaccgaggagctggaccgcgtggtgggccgaggccggtgggtgacggagaaggacatggcgagcctcccgtacgtggaagccatcgtgaaggagacgatgcggctccacccggtggcgcctctgctggttccccgcctctcccgcgaggacacgtccatcggcggccacgacatccccgccggcacccgggtcctcgtcagcgtgtggtccatcggccgggacccggcgctgtgggacaagcccgaggagttcgcgccggagcggttcctggggagcaggatcgacgtcaaggggcaggactacgagctgctgccgttcgggtccggccgcaggatgtgcccagggtacagcctcgggctcaaggtgatccaggtgagcctggcgaacctcctgcacggcttcgcctggaggctccccgacggcgtcaccaaggaggaactgagcatggaggagatctttgggctgtccacgccccgcaagtccccgctggaggccgtcgtggagcccaagctcccggcccagctctacgcccaggctgcttgatttgctcgatcggcccaaggttgtgtgtcgagttattttgcgtgtgtccttatatcgtccgtcggtctgtggcaggataaagtggaataataatgaggaatatactagtatggagtatgtaagtcagtaagtgtatgcttgctatttatggccgttcttgagtattgtatgatggcacgctcgccgtgtacaccagtgttccaaatcacaaagttgctcacgcgtgcatgaggtgcccgtgttcatgctctctctttttgaa

SEQ ID NO: 4761 - DNA, 1908 bp, Brachypodium distachyon
atcagctcaagcctcaacacaatacgtcactcaaccacagtactacttagcccacttgcatcacgaactgagcgtcatcaatggagctcccccaatgggcgtccttccttggcgtggtgctggccacggtggtcttcctcaaggccgtcctccggcgccgcggcggcagcccaaaacgcacgtacaacctcccgccgggcccgaagccgtggcccatcatcggcaacctgaacctgatcggcacgctcccgcaccgctccatccacgcgctgtccaagcagtacggcccgctgatgcagctccagttcgggtccttccccgtcgtggtgggctcctccgtggacatggccaagttcttcctcaagacccacgacgtggtcttcacggaccggcccaagaccgccgccggcaagcacaccacctacgactacagcgacatcacctggtccccctacggcgcctactggcgccaggcccggaagatctgcctcaccgagctcttcagcgccaagcggctcgagtcctacgagtacatccgcggcgaggaagtgctggcgctcctccgcgacctccacggggcgtccgggcgcgtcgtggtgctcaaggacttcttgtccacggtgagcctgaacgtgatcacacgcatggtgatggggaagaagtacctggagaaggaggtgaaggacgaggccggggccgtgatcacgacgcccgacgagttcaagtggatgctcgacgagctcttcctgctcaacggcgtgctcaacatcggcgactccatcccgtggctcgactggatggacctccaggggtacattaagaggatgaagaagctgagcaagatgttcgaccggttcctggagcatgtggtcgacgagcacagcgagcgctgccgccgcgagggcgagggattcgtggccaaggacatggtcgacgtgctgctgcaggtcgccagcgatcctgatcttgaggtcaagctcaacagggagggcgtcaaggctttcacccaggacatgatcgccggcggcacggagagctcggcggtgaccgtagaatgggccttgtcagagctcctaaaaaagcccgaggtattcgccaaggcgaccgaggagctggaccgcgtggtgggccgaggccggtgggtgacggagaaggacatggcgagcctcccgtacgtggaagccatcgtgaaggagacgatgcggctccacccggtggcgcctctgctggttccccgcctctcccgcgaggacacgtccatcggcggccacgacatccccgccggcacccgggtcctcgtcagcgtgtggtccatcggccgggacccggcgctgtgggacaagcccgaggagttcgcgccggagcggttcctggggagcaggatcgacgtcaaggggcaggactacgagctgctgccgttcgggtccggccgcaggatgtgcccagggtacagcctcgggctcaaggtgatccaggtgagcctggcgaacctcctgcacggcttcgcctggaggctccccgacggcgtcaccaaggaggaactgagcatggaggagatctttgggctgtccacgccccgcaagtccccgctggaggccgtcgtggagcccaagctcccggcccagctctacgcccaggctgcttgatttgctcgatcggcccaaggttgtgtgtcgagttattttgcgtgtgtccttatatcgtccgtcggtctgtggcaggataaagtggaataataatgaggaatatactagtatggagtatgtaagtcagtaagtgtatgcttgctatttatggccgttcttgagtattgtatgatggcacgctcgccgtgtacaccagtgttccaaatcacaaagttgctcacgcgtgcatgaggtgcccgtgttcatgctctctctttttgaa

SEQ ID NO: 4762 - DNA, 1923 bp, Zea mays
atttccctgccctttcccaccccaccaagtgccacagcagcttccacaggcgcgcggttcatccctgcgctcctatataagaaggtacggtgaagcaacttccggcaccacctcaccagctctgcacactctctactcgacaatcctctctagctcggccgtaccaatggagcttccaacatgggcgtccttcctcggcgtggtgctcgccaccgtgatgcttctgaaggccatcctcggccgccgcagccgccgcgtgtacaacctcccgccgggtcccaagccgtggccgatcatcggcaacctcgatcttgtgggcgcgctcccgcaccgctccatccacgagttgtccaggaagtacggcccgctgatgcagctccggttcgggtcgttccccgtggtggtcggctcgtcggtggacatggccaagttcttcctcaagacccacgacgtggtgttcacggaccggccaaagacggccgccggcaagtacaccacctacaactaccgcgacatcacctggtccccctacggcgcgtactggcggcaggcgcgcaagatgtgcctcaccgagctcttcagcgccaagcggctcgagtcgtacgagtacatccgcgccgccgaggtgcgcgtgctgctgcgcgacctgcactccgcgtccggctccggccgcgccgtcatgctcaaggactacctgtccacggtgagcctgaacgtgatcacgcgcatggtgctcggcaagaagtacctggacagggaggaggcggccgccggggccgtgaccacccccgaggagttcaagtggatgctcgacgagctgttcctgctcaacggcgtgctcaacatcggcgactccatcccctggctcgactggatggacctgcaggggtacatcaagaggatgaagaagctcagcaagatgttcgaccggttcctggagcacgtcgtcgaggagcaccaccagcggcggctgagcgagggcaagggcttcgtcgccaaggacatggtcgacgtgctgctgcagatcgccgacgaccctacacttgaggttgagctggacagggaaagcgtcaaggcttttactcaggacctcatcgccggtggcacggagagctcggcggtcacagtggagtgggccatctcggagctcctgaagaagcccgaggtgatcgctaaggcgacggaggagctggaccgcgtcatcggccgcggccgctgggtgacagagaaggacatccccagcctcccctacgtggacgcaatcgtcaaggagacgatgcgcctgcacccggtggcacccatgctggttccccgcctgtcgcgcgaggacacggccgtggccggctacgacatcccggccggcacgcgcgtgctcgtcagcgtctggtccatcgggcgcgaccccgcgctgtgggacgcgccggaggagttcatgccggagcggttccttggcagcaggctggacgtgaaggggcaggactacgagctgctgccgttcgggtccgggcggcggatgtgccctgggtacagcctcggcctcaaggtcatccaggtgagcctcgctaacctgctgcacggcttcgcgtggagcctccccgacggcgtgaccatggaggagctcagcatggaggagatctttggcctgtccacgccgcgcaagttcccgctcgaggccgtcgttcagcccaagctgccggcgcacctctacgccgagccttgatcgatgtgtgagtggttgtgcagcgcagtcaccatttttggcgttgctgtccactgttcagtgcgcgtgtgctagcttgcgtcatgcgctgcgttgtgacactatagttatagtggaataatggtgtaatcaattttatattatactatacgtttatacaacctagataaaatactcctacttttctcagatcgagcatatct

SEQ ID NO: 4763 - DNA, 1862 bp, Sorghum bicolor
gaaggcacgttccggcaccacctcaccagctcaactccacaatcgtctctgcctcgactgtaccaatggagcttccaacatgggcgtccttcctcggtgtggtgctcgccactgtgatgcttctgaaggccatcctcggccgccgcagccgccgcgtgtacaacctcccgcccggccccaagccgtggccgatcatcggcaacctcaacctgatgggcgcgctcccgcaccgctccatccacgagctgtccaggaagtacggcccgctgatgcagctccagttcgggtcgttccccgtggtggtcggctcgtcggtggacatggccaagttcttcctcaagacccacgacgtggtgttcacggaccgcccaaagaccgccgccggcaagtacaccacctacaactaccgcgacatcacctggtccccctacggcgcctactggcggcaggcgcgcaagatgtgcctcaccgagctcttcagcgccaagcggctcgagtcgtacgagtacatccgcgccgccgaggtgcgcgcgctgctgcgggacctgcactcggcgtccggctccggccgcgccgtcatgctcaaggactacctgtccacggtgagcctgaacgtgatcacgcgcatggtgctcggcaagaagtacctggacaaggaggaggcggccgccgggtcggtgaccaccccagaggagttcaagtggatgctggacgagctgttcctgctcaacggcgtgctcaacatcggcgattccatcccgtggctcgactggatggacctgcaggggtacatcaagcggatgaagaagctcggcaagatgttcgatcggttcctggagcacgtcgtggaggagcacaaccagcggcggctgcgcgagggcaagggcttcgtcgccaaggacatggtcgacgtgctgctgcagatcgccgacgaccctacgcttgaggttgagctcaaccgggaaagcgtcaaagcttttactcaggacctcatcgccggtggcacagagagctcggcggtcacggtggagtgggccatctcggagctcctcaagaagcccgaggtgatcgccaaggccacggaggagctggaccgcgtcatcggccgcggccgctgggtgacagagaaggacatgcccagcctcccctacgtcgacgccgtcgtcaaggagaccatgcgtctgcacccggtggcgccgctgctggtgccccgcctgtcacgcgaggacacgaccgtggccggctacgatatccccgccggcacgcgcgtgctcgtcagcgtgtggtccatcggccgcgaccccgcgctgtgggacgcgccggaggaattcatgccggagcggttcctcggcagcaagctcgacgtgaaggggcaggactacgagctgctgccgttcgggtccggccggcggatgtgccccgggtacagcctcggcctcaaggtcatccaggtgagcctcgctaacctgctgcacggcttcgcgtggagcctccccgacggcgtgaccaaggaggagctcagcatggaggagatcttcggcctgtccacgccgcgcaagttcccgctcgaggccgtcgtcgagcctaagctgccggcgcacctctacgccgagccatgattgatgcgtgcgtgattctgcagcatatagtggcctcttttgcgttgatgtctcgtgtgtgcgtccacttgctgctcctgttgttgctattagtacttctgtaatagagtaagtaggtattgctcctagcttgcgtcgtgcgctgcgttgtgagttgtgacactacagtggaataatggtgtaaccaaccttatatttatttataccagtatacttttacccaacaaagataagtattcctgc

SEQ ID NO: 4764 - DNA, 2045 bp, Setaria italica
cacgcgctccaccgcttcacccgcctataagaagtccgtaagcgccccggcacagcaccaactcgccaggtctactcctcacttaaccagccatttccagtcttcaccgccatcagccgtcttgagtcagcaccgcagcagcctatctagctcaattatacgtaccaatcatggagcttccaccatgggcgtctttcctcggtgtggtgctcgccaccgtgatgcttctcaaggccatcgtcggccgccaccgccgccgccgcgcgtacaacctcccgccgggccccaagccgtggccgatcatcggcaacctggacctggtgggcgcgctcccgcaccgctccatccacgagctgtccaggaagtacggcccgctgatgcagctccagttcgggtcgttccccgtggtggtcggctcgtcggtggacatggccaagttcttcctcaagacccacgacgtggtgttcactgaccggcccaagaccgccgccggcaagtacaccacctacaactaccgcgacatcacctggtccccctacggcgcctactggcggcaggcgcgcaagatgtgcctcaccgagctcttcagcgccaagcgcctcgagtcgtacgagtacatccgcgccgccgaggtgcgcgcgctgctgcgcgacctgcacgccgtctccggctccggctgcgccgtcatgctcaaggactacctgtccacggtgagcctgaacgtgatcacccgcatggtgctcggcaagaagtacctggacaaggaggtggctgccggtgggtcttccgtgaccacccccgaggagttcaagtggatgctcgacgagctgttcctgctcaacggcgtgctcaacatcggagactccatcccgtggctcgactggatggacctgcaggggtacatcaagaggatgaagaagctcggcaagatgttcgaccggttcctggagcacgtcgtggaggagcacaaccagcggcggttgcgcgaggggaagagcttcgtcgccaaggacatggtcgacgtgctgctgcagatcgccgacgaccctaccctggaggtcgagctgaacagggagagcgtcaaggctttcactcaggacctcatcgccggcggaacagagagctctgcggtcaccgtcgagtgggccatctcagagctcctcaagaagcccgaggtcttcgccaaggcaacagaggagctggaccgtgtgatcggccgcggccgctgggtcacggagaaggacattccccagctcccgtacgtggacgccatcgtcaaggagacgatgcggctgcacccggtggcgcccatgctggtgccccgcttgtcccgcgaggacacgaccgtggccggctacgacatccccgccggcacgcgcgtgctcgtcagcgtgtggtccatcggccgagaccccacgctgtgggacgctccggaggagttcatgccggagcgattcctcggcagcaagcttgacgtgaaggggcaagattacgagttgctgccgttcggatccggccggcggatgtgccccgggtacagcctcggcctgaaggtcatccaggtgagcctcgccaacctgctgcacggcttctcgtggagcctccccgatggcctcaccaaggaggagctgagcatggaggagatcttcggcctgtccacgccgcgcaagttcccgcttgaggccgtcgtcgagcccaagctgccagcacacctctacgccgaggcttgatcgatgcgtgtgtcttcagtacacaggcgtggttcttgcgttgctgcccagtgtccacttgctgcttgctttttttttttgttgctgttactctactagtatgtaagttcttctcaaggtttgagtggtgtatggcgttatgactatagctagcgaaataacttccctaagcaagtgtagccagagtccacaactacatattgcagtcatatccaaggttcgtaagtctctttggccgctattttgcaaacttgataataacttcttcgtagataaagctattttctaccacggatatctatccatgattgaaaa

SEQ ID NO: 4765 - DNA, 2100 bp, Setaria italica
aaaaactcgccaggtctactcctcacttaaccagccatttccagtcttcaccgccatcagccgtcttgagtcagcaccgcagcagcctatctagctcaattatacgtaccaatcatggagcttccaccatgggcgtctttcctcggtgtggtgctcgccaccgtgatgcttctcaaggccatcgtcggccgccaccgccgccgccgcgcgtacaacctcccgccgggccccaagccgtggccgatcatcggcaacctggacctggtgggcgcgctcccgcaccgctccatccacgagctgtccaggaagtacggcccgctgatgcagctccagttcgggtcgttccccgtggtggtcggctcgtcggtggacatggccaagttcttcctcaagacccacgacgtggtgttcactgaccggcccaagaccgccgccggcaagtacaccacctacaactaccgcgacatcacctggtccccctacggcgcctactggcggcaggcgcgcaagatgtgcctcaccgagctcttcagcgccaagcgcctcgagtcgtacgagtacatccgcgccgccgaggtgcgcgcgctgctgcgcgacctgcacgccgtctccggctccggctgcgccgtcatgctcaaggactacctgtccacggtgagcctgaacgtgatcacccgcatggtgctcggcaagaagtacctggacaaggaggtggctgccggtgggtcttccgtgaccacccccgaggagttcaagtggatgctcgacgagctgttcctgctcaacggcgtgctcaacatcggagactccatcccgtggctcgactggatggacctgcaggggtacatcaagaggatgaagaagctcggcaagatgttcgaccggttcctggagcacgtcgtggaggagcacaaccagcggcggttgcgcgaggggaagagcttcgtcgccaaggacatggtcgacgtgctgctgcagatcgccgacgaccctaccctggaggtcgagctgaacagggagagcgtcaaggctttcactcaggacctcatcgccggcggaacagagagctctgcggtcaccgtcgagtgggccatctcagagctcctcaagaagcccgaggtcttcgccaaggcaacagaggagctggaccgtgtgatcggccgcggccgctgggtcacggagaaggacattccccagctcccgtacgtggacgccatcgtcaaggagacgatgcggctgcacccggtggcgcccatgctggtgccccgcttgtcccgcgaggacacgaccgtggccggctacgacatccccgccggcacgcgcgtgctcgtcagcgtgtggtccatcggccgagaccccacgctgtgggacgctccggaggagttcatgccggagcgattcctcggcagcaagcttgacgtgaaggggcaagattacgagttgctgccgttcggatccggccggcggatgtgccccgggtacagcctcggcctgaaggtcatccaggtgagcctcgccaacctgctgcacggcttctcgtggagcctccccgatggcctcaccaaggaggagctgagcatggaggagatcttcggcctgtccacgccgcgcaagttcccgcttgaggccgtcgtcgagcccaagctgccagcacacctctacgccgaggcttgatcgatgcgtgtgtcttcagtacacaggcgtggttcttgcgttgctgcccagtgtccacttgctgcttgctttttttttttgttgctgttactctactagtatgtaagttcttctcaaggtttgagtggtgtatggcgttatgactatagctagcgaaataacttccctaagcaagtgtagccagagtccacaactacatattgcagtcatatccaaggttcgtaagtctctttggccgctattttgcaaacttgataataacttcttcgtagataaagctattttctaccacggatatctatccatgattgaaaattattgtatgctgcaatcttgacacaatccctcgtagcaacatctatctattatcttaatacaatagtgttaaaagaagtcaccacgtttatcgagagggtctagaaattc

SEQ ID NO: 4766 - DNA, 2209 bp, Setaria italica
ccacccacacttccagtctaccatcaccaccacagcctcctgtgcctgcaccaccgcagcgtcccaatggagcttccaccatgggcgtctttcctcggcgtggtgctcgccaccgtgatgcttctcaaggccatcgtcggccgccgccgccgccgccgcgcgtacaacctcccgccggggcccaagccgtggccgatcatcggcaacctggacctgatgggcgcgcttccgcaccgctccatccacgagctgtccaggaagtacggcccgctgatgcagctccagttcgggtcgttccccgtggtggtcggctcgtcggtggacatggccaagttcttcctcaagacccacgacgtggtgttcactgaccggcccaagaccgccgccggcaagtacaccacctacaactaccgcgacatcacctggtccccctacggcgcctactggcggcaggcgcgcaagatgtgcctcaccgagctcttcagcgccaagcgcctcgagtcgtacgagtacatccgcgccgccgaggtgcgcgcgctgctgcgcgacctgcacgccgtctccggctccggccgcgccgtcatgctcaaggactacctgtccacggtgagcctgaacgtgatcacccgcatggtgctcggcaagaagtacctggacaaggaggtggctgccggtgggtcttccgtgaccacccccgaggagttcaagtggatgctcgacgagctgttcctgctcaacggcgtgctcaacatcggcgactcgatcccgtggctcgactggatggacctgcagggttacatcaagaggatgaagaagctcggcaagatgttcgaccggttcctggagcacgtcgtggaggagcacaaccagcggcggttgcgcgaggggaagagcttcgtcgccaaggacatggtcgacgtgctgctgcagatcgccgacgaccctaccctggaggtcgagctgaacagggagagcgtcaaggctttcactcaggacctcatcgccggcggaacggaaagctcggcagtcaccgtcgagtgggccatctcagagctcctcaagaaacccgaggtcttcgccaaggccacggaggagctggaccgtgtgatcggccgcggccgctgggtcacggagaaggacattccccagctcccgtacgtggacgccatcgtcaaggagacgatgcggctgcacccggtggcgcccatgctggtgcctcgcctgtcccgcgaggacacgaccgtggccggctacgacatccccgccggcacgcgcgtgctcgtcagcgtgtggtccatcggccgcgacccgacgctgtgggacacgccggaacaattcatgccggagcgattcctcggcagcaagctcgacgtgaaggggcaagattacgagctgctgccgttcggatccggccggcggatgtgccccgggtacagccttggcttgaaggtcatccaggtgagccttgccaacctgctgcacggttttgcgtggagcctccccgatggcctcaccaaggaggagctgaacatggaggagatcttcggcctgtccacgccgcggaagttcccgctcgaggccgtcgtcgagcccaagctgccagcacacctctacgccgaggcttgatcgatgcgtttgtcttcagtagaggcgtggttcttgcgttcctgcccagtgtccacttgctgcttgcttttttgttgctgttgctctactttgtaagttcttttcaaggtttgcgtgatgtatggccttatgactatagcggaaatgcggaataacttccctaagcaagtgtcgccagagtacacaactacacactgcagtcatctccgaggttcgtaagtctctttggccgctattttgcaaccttgataataacttctccatagataaagctattttctaccacggatatctatccatgattgaaaataattttaggctgcaatcttgacacgatccgtcgtagcaacatttcctagacttgataagctgtaaaacataaatcagctaaatcctaccgggaccaaacaataaaaccgctagcaccgacccaaacgtcacaccaccaccatcatatacctaaacctcaaaaaagcttggaaatcaggacatgtttctcagagcagggagcatatatatggagtagtgtctgtattggataatgaacgattgaaacaattgtatttgatatatcacgaatgac

SEQ ID NO: 4767 - DNA, 4484 bp, Setaria italica
atgcagtggctgctgaaaacgacacggattagggtgttcccccggcgaatgatgaacaaacagaaaactgctagtgtccctgtaccgtgcccgggccccggggtgacttttcaccgcgagagcacttcagtgccacccacacttccagtctaccatcaccaccacagcctcctgtgcctgcaccaccgcagcgtcccaatggagcttccaccatgggcgtctttcctcggcgtggtgctcgccaccgtgatgcttctcaaggccatcgtcggccgccgccgccgccgccgcgcgtacaacctcccgccggggcccaagccgtggccgatcatcggcaacctggacctgatgggcgcgcttccgcaccgctccatccacgagctgtccaggaagtacggcccgctgatgcagctccagttcgggtcgttccccgtggtggtcggctcgtcggtggacatggccaagttcttcctcaagacccacgacgtggtgttcactgaccggcccaagaccgccgccggcaagtacaccacctacaactaccgcgacatcacctggtccccctacggcgcctactggcggcaggcgcgcaagatgtgcctcaccgagctcttcagcgccaagcgcctcgagtcgtacgagtacatccgcgccgccgaggtgcgcgcgctgctgcgcgacctgcacgccgtctccggctccggccgcgccgtcatgctcaaggactacctgtccacggtgagcctgaacgtgatcacccgcatggtgctcggcaagaagtacctggacaaggaggtggctgccggtgggtcttccgtgaccacccccgaggagttcaagtggatgctcgacgagctgttcctgctcaacggcgtgctcaacatcggcgactcgatcccgtggctcgactggatggacctgcagggttacatcaagaggatgaagaagctcggcaagatgttcgaccggttcctggagcacgtcgtggaggagcacaaccagcggcggttgcgcgaggggaagagcttcgtcgccaaggacatggtcgacgtgctgctgcagatcgccgacgaccctaccctggaggtcgagctgaacagggagagcgtcaaggctttcactcaggacctcatcgccggcggaacggaaagctcggcagtcaccgtcgagtgggccatctcagagctcctcaagaaacccgaggtcttcgccaaggccacggaggagctggaccgtgtgatcggccgcggccgctgggtcacggagaaggacattccccagctcccgtacgtggacgccatcgtcaaggagacgatgcggctgcacccggtggcgcccatgctggtgcctcgcctgtcccgcgaggacacgaccgtggccggctacgacatccccgccggcacgcgcgtgctcgtcagcgtgtggtccatcggccgcgacccgacgctgtgggacacgccggaacaattcatgccggagcgattcctcggcagcaagctcgacgtgaaggggcaagattacgagctgctgccgttcggatccggccggcggatgtgccccgggtacagccttggcttgaaggtcatccaggtgagccttgccaacctgctgcacggttttgcgtggagcctccccgatggcctcaccaaggaggagctgaacatggaggagatcttcggcctgtccacgccgcggaagttcccgctcgaggccgtcgtcgagcccaagctgccagcacacctctacgccgaggcttgatcgatgcgtttgtcttcagtagaggcgtggttcttgcgttcctgcccagtgtccacttgctgcttgcttttttgttgctgttgctctactttgtaagttcttttcaaggtttgcgtgatgtatggccttatgactatagcggaaatgcggaataacttccctaagcaagtgtcgccagagtacacaactacacactgcagtcatctccgaggttcgtaagtctctttggccgctattttgcaaccttgataataacttctccatagataaagctattttctaccacggatatctatccatgattgaaaataattttaggctgcaatcttgacacgatccgtcgtagcaacatttcctagacttgataagctgtaaaacataaatcagctaaatcctaccgggaccaaacaataaaaccgctagcaccgacccaaacgtcacaccaccaccatcatatacctaaacctcaaaaaagcttggaaatcaggacatgtttctcagagcagggagcatatatatggagtagtgtctgtattggataatgaacgattgaaacaattgtatttgatatatcacgaatgacgacgagtcacaagggtgacaatgaaagtaattttacttcaccgcggaagccatccaattttgatatatcatgcatcacaagggtgacaatgacagtagttttactgcaccgtggaagccatccagcaagttccaaacaagactaataaaaatcacatttgagtgtgcaagatgtggacatatttttgaagggccgatatcgaggaatgataaagataacaaaagctagatgattttttttctaggctccatacctgatacttgaataaatgtaaatagaataaggagatccggtcgaataactacctatataaatggtggctattcagtatgcacactttgttccacctttttacgtattgtggcatgaatatctcatactcctggcctatgaactgttcatgccttactaacatcattgggtatcactaaacataatttgactgtgattatttcaagaatgttgtgtcaagataaaaaaaaggataaacaaattgatataatatatttgaaccctccaatcatcattgttgatcttataaaagaatatgtgggtataatcagggttttatgggaaagactatgtaaaatacaacgagaggactaatcacagattcttatacactttaattgttatgctacccaaatagaatatggtcctgttccaactctctcatgttgatgaatgtcatattacctttcaatcatcattgctgaagactgaataaattgtcagaaaacacaacaagagtaactacatagcgagaaaacaccaatactgtttacgattgattaagccatcaactttacgtgatgatgttctttggctttgagtacatgtcgacttgtctctgtacatgatacttaaacttgtatgatcctattcttgaaccgtagtccttgtaatcattatactcgactttttttatatgtgcttaattcagccgaggtaaatgtattttgtttgattttgcctattaaataatgaaagtataaacaattttcataaaacaataatcacggattaaaaaaacgtctgtacatgtgcaatatttccgatgtgtaaaattaagaagacgtgttttatattaaatacaatagcaagttatttgccaatttaccaatttaatgtaggtttccatgagatagggatgcaagtggggcagattgcgggctacccgcacccgtccgcacgagccgcaatcctatatgcgggattaagcggcagcccgcgtacgtccgccagattgttgcgggctctgcggccacccgcgtgaccgctggcaccgcgaagtgagtcttctgtcgcggtgttgccgtgttccttctgtttccttggttctagaatcggcatcgtaacctctgctattgtggtcacctagttcacttggttattcaggtttgtcttgcaatgctgaaattccactgaagctgaagtaggttcctgaaatttagaggagcagccacgcaagattctgacactgccattctcagaccttcgcatgaactctgttgtccttggttgtatgatatttagaattttagatagtgttgtaatgttgttggattcgcaccacatatagtagagatcaaatctcaattctcaagcgtgtaacttgccactcgaccagggtcgtcgctgggaagcacggcgtcctgcccgatcggcctccactccaccacaaactcccctcccacgcacaggccatagatgctgtgtgtgccggcgagtactcggagaaggcacaggagctcggagatggaggcttgttggcgtgcgcgggtccctcgtagcgaatgcctagaattaagttgtgccatcgctgatgacaaaatcggaggatgcgacgcgcggtgtggagagcaggaggtccatggtcaagctatcgaggattcgaggtgcatatgaccggttgttgccgtgttgggcggcgccgaggtgcggagtgcgcgaacgcgggtatgcagcgcggctaggttacgcgggttgcccgcataacgtcgcgaagaagatgcaggttagatgccttgtttgcgggcttgcagcgcgagctggcccagcgggctagcagctcaacccgtgctgcttgcaactgtaccatgagttgactgcaattcacactatacaacaaatgtccttttac

SEQ ID NO: 4768 - DNA, 2057 bp, Zea mays
accacaccagctcgactactagacccttgaggccttgaccagccacttccaaactttagcatcactatatctcaacgccatcaagctgtctgtcatcagtcatcacggcacagcagcttctactggccttagctcgatcgttccaatggagcttccaccatgggcgtccttcctcggcatcgtgctagccaccgtgatgcttctgaaagccctcaccggccgccgcagccgccgcatgtacaacctcccgcctggccccaagccgtggccgatcatcggcaacctcgacctcgtgggcgcgctcccgcaccgctccatccacgagttgtccaggaagtacggcccgctgatgcagctccggttcgggtcgttccccgtggtggtcggctcgtcggtggacatggccaagttcttcctcaagacccacgacgtggtgttcacggaccggccaaagacggccgccggcaagtacaccacctacaactaccgcgacatcacatggtccccctacggcgcgtactggcggcaggcgcgcaagatgtgcctcaccgagctcttcagcgccaagcggctcgagtcgtacgagtacatccgcgccgacgaggtgcgcgcgctgctgcgcgacctgcacgcggcgtccagctccggccgcgcagtcatgctcaaggactacctgtccacggtgagcctgaacgtgatcacgcgcatggtgctcggcaagaagtacctggataaggaggaggcggccgccgccggcgggtcagtgaccacccccgaggagttcaagtggatgctcgacgagctgttcctgctcaacggcgtgctcaacatcggcgactccatcccgtggctcgactggatggacttgcaggggtacatcaagcggatgaagaagctcagcaagatgttcgatcggttcctggagcacgtcgtcgaggagcacaaccagcggcggcttcgcgaggggaaaggctttgtcgccaaggacatggtcgacgtgcttctgcagattgccgacgaccctacccttgaggtcgagctcgaccgggaaagcgtcaaagcttttactcaggacctcatcgccggtggcaccgagagctcggcggtcacagtggagtgggccatctcggagctcctcaagaagccggaggtcatcgccaaggccacggaggagctggaccgcgtcatcggccgcggccgctgggtgacagagaaggacatgcccagcctcccctacgtcgacgccatcgtcaaggagaccatgcgactgcacccggtggcaccgctgctggtgccccgcctcgcgcgcgaggacacgaccgtggccggctacgacatccccgccggcacgcgcgtgctcgtcagcgtgtggtccatcggccgcgaccccgcgctgtgggacgcgccggaagaattcatgcccgagcgattcctcggcagcaagctggacgtgaaggggcaggactacgagctgctgccgttcgggtccggccgccggatgtgccccgggtacagcctcggcctcaaggtcatccaggtgagcctagctaacctgctgcacggcttcgcgtggagcctccccgacggcgtgaccaaggaggagttcagcatggaggagatcttcggcctgtccacgccgcgcaagttcccgctcgaggccgtcgtcgagcccaagctgccggctcacctctacgccgagccttgatcgatgcgcgcgtgattctacagcatagttacctcttttgcgtcggttgtttgtccagagtgcgtacacttattgctcctgttgttgccgttactttaaactcctattagcttgcgtagtgccgtcgtgcgctgccttgtgacggaataatggtgtaaccaattttatatttataatagtacttctacacaacatagatatatatactcctagttgtctcagattgagcatacattgtatgttgaaggtatgcaagatcagtactgataataaatgaatgcgacacaaataggattaattacagagaagatacggatttaacgtggaaaatttttttaaagtgaaggggaaa

SEQ ID NO: 4769 - DNA, 2037 bp, Sorghum bicolor
accagtcacttgaacagccacttccaaactttaccatcagtgcatcagtatcaacgccgtcaagccgtctgtgtaggtgtcatcgctgcagcagcttctagtagccttacctcgatcgttcctatggagcttccgccatgggcgtccttcctcggcgtggtgctcgccaccgtgatgcttctgaaggccatcatcggccgccgccgcagccgccgcgtgtacaacctcccgcccggccccaagccgtggccgatcatcggcaacctcaacctggttggcgcgctccctcaccgctccatccacgagctgtccaggaagtacggcccgctgatgcagctccggttcgggtcgttccccgtggtggtcggctcgtcggtggacatggccaagttcttcctcaagacccacgacgtggtgttcacggaccgcccaaagaccgccgccggcaagtacaccacctacaactaccgcgacatcacctggtccccctacggcgcctactggcgtcaggcgcgcaagatgtgcctcaccgagctcttcagcgtcaagcggctcgagtcgtacgagtacatccgcgccgccgaggtgcgcgcgctgctgcgcgacctgaactccgcctccggctccggccgcgccgtcatgctcaaggactacctgtccacggtgagcctgaacgtgatcacgcgcatggtgctcggcaagaagtacctggacagggaggaggcggccgccgggtcggtgaccaccccagaggagttcaagtggatgctggacgagctgttcctgctcaacggcgtgctcaacatcggcgactccatcccgtggctcgactggatggacctgcaggggtacatcaagcggatgaagaagctcggcaagatgttcgatcggttcctggagcacgtcgtggaggagcacaaccagcggcggctgcgcgagggcaagggcttcgtcgccaaggacatggtcgacgtgctgctgcagatcgccgacgaccctacgcttgaggttgagctcgacaggaaaagtgtcaaggcttttacccaggacctcatcgccggtggcacggagagctcggcggtcacggtggagtgggccatctcggagctcctcaagaagcccgaggtgatcgccaaggccacggaggagctggaccgcgtcatcggccgcggccgctgggtgacagagaaggacatgcccagcctcccctacgtcgacgccgtcgtcaaggagaccatgcgtctgcacccggtggcgccgctgctggtgccccgccttgcgcgcgaggacacgaccgtggccggctacgacatccccgcgggcacgcgcgtgctcgtcagcgtgtggtccatcggccgcgaccccgcgctgtgggacgcgccggaggaattcatgccggagcggttcctcggcagcaggctcgacgtgaaggggcaggactacgagctgctgccgttcgggtccggccggcggatgtgccccgggtacagcctcggcctcaaggtcatccaggtgagcctcgctaacctgctgcacggcttcgcgtggagcctccccgacggcgtgaccaaggaggagctcagcatggaggagatcttcggcctgtccacgccgcgcaagttcccgctcgaggctgtcgtcgagcccaagctcccggcacacctctactcggaggcttgatgcgtgcgcgtgcgtctcttcactcttcagtatatatagctagggcgtcgatcttgtggtgctggcttgctgctctgtgtgtacgcttgttgctcgtgtgttttattgctgctggtggtgtcgctttgtcggtttttactcaagcttggatcgcagccaaacgagtgtaaatcgtaataaaagataatacgttgtgtatggagtacatttttttttcttaagctagcaaaatatatcagtgtgttgtaacgagacgtacaatttattactcgatgattgtacaatttttgtaaatttaaatgagtttggtccaacctgaaatcaaataaatataatcccatatgaaaaattgacaac

SEQ ID NO: 4770 - DNA, 1848 bp, Panicum virgatum
actcatcactcgaccacccacttcaatccttccattccatttcagtcacctccagccggcgtcggtgtcccgatggagcttccacttccaccatgggcgcctttcctcggcgtggtgctggccaccgtgatgcttctcaaggccgtcctcggccggcgcagccgccgcgcgtacaacctcccgccggggcccaagccgtggccgatcatcggcaacctcgacctgatgggcgcgctcccgcaccgctccatccacgagctctccaggaagtacggccagctgatgcagctccggttcgggtccttccccgtggtcgtcggctcgtcggtggacatggccaagttcttcctcaagacccacgacgtggtgttcacggaccggcccaagaccgccgccggcaagtacaccacctacaactaccgggacatcacctggtccccctacggcgcctactggcggcaggcgcgcaagatgtgcctcaccgagctcttcagcgccaagcgtctcgagtcgtacgagtacatccgcgccgccgaggtgcgcgcgctgctgcgcgacctgcacgccgcgtctggctccggccgcgccgtcatgctcaaggactacctgtccacggtgagcctgaacgtgatcacgcgcatggtgctcggcaagaagtacctggacaaggaggtggcggtggccggcggatcctccgtgaccacgccggaggagttcaagtggatgctcgacgagctgttcctgctcaacggcgtgctcaacatcggcgactccatcccgtggctcgactggatggacctgcaggggtacatcaggaggatgaagaagctcagcaagatgttcgaccggttcatggagcacgtcgtggaggagcacaaccagcggcggctgcgcgaggggaagagcttcgtcgccaaggacatggtcgacgtgctgcttcagatcgccgacgaccctaccctggaggttgagctgaacagggaaagcgtcaaggctttcactcaggatctcatcgccggcggaacagagagctcggcagtcaccgtcgagtgggccatctcggagctcctgaagaagcccgaagtcatcgccaaggccccggaggagctggaccgcgtcatcggccgcggccgctgggtcacggagaaggacattccccagctcccatacgtggacgccatcgtcaaggagaccatgcggctgcacccggtggcgccgctgctggtgccccgccttgcgcgcgaggatgccaccttcgccggctacgacatccccgccggcacgcgcgtgctcgtcagcgtctggtccatcggccgcgaccccgcgctgtgggactcgccggaggagttcatgccggagaggtttctgggcagcaagctcgacgtgaaggggcaagactacgagctgctgccgttcgggtcgggccggcggatgtgccccggctacagcctcggcctgaaggtgatccaggtgagcctcgccaacctgctgcacggcttcgcgtggagcctccccgacggcgtgaccaaggaggagctgagcatggaggagatcttcggcctgtccacgccgcgcaagttccctctcgaggccgtcgtcgagcccaagctgccggcacatctctacgccgccgaggcttgatcgatgtgcgccgcgtggtttgttcggttataggtgccgttaattttgcgttgctgtgcagagtccactcgctgctcctgctgttgttagagtcactctgtaatgtttctctccaagcttgcgtcgtgtgtggcttgtcactatagtgtggaataatgctgtaactcagttatacccttacatctatatacacaacacagaaaaata

SEQ ID NO: 4771 - DNA, 1607 bp, Sorghum bicolor
cgcacgcgcacgcatcaagcctccgagtagaggtgtgccgggagcttgggctcgacgacagcctcgagcgggaacttgcgcggcgtggacaggccgaagatctcctccatgctgagctcctccttggtcacgccgtcggggaggctccacgcgaagccgtgcagcaggttagcgaggctcacctggatgaccttgaggccgaggctgtacccggggcacatccgccggccggacccgaacggcagcagctcgtagtcctgccccttcacgtcgagcttgctgccgaggaaccgctccggcatgaattcctccggcgcgtcccacagcgcggggtcgcggccgatggaccacacgctgacgagcacgcgcgtgcccgcggggatgtcgtagccggccacggtcgtgtcctcgcgcgcaaggcggggcaccagcagcggcgccaccgggtgcagacgcatggtctccttgacgacggcgtcgacgtaggggaggctgggcatgtccttctctgtcacccagcggccgcggccgatgacgcggtccagctcctccgtggccttggcgatcacctcgggcttcttgaggagctccgagatggcccactccaccgtgaccgccgagctctccgtgccaccggcgatgaggtcctgcacgtgccattcatttcgagatggtgaatgactcacctgggtaaaagccttgacactttccctgtcgagctcaacctcaagcgtagggtcgtcggcgatctgcagcagcacgtcgaccatgtccttggcgacgaagcccttgccctcgcgcagccgccgctggttgtgctcctccacgacgtgctccaggaaccgatcgaacatcttgccgagcttcttcatccgcttgatgtacccctgcaggtccatccagtcgagccacgggatggagtcgccgatgttgagcacgccgttgagcaggaacagctcgtccagcatccacttgaactcctctggggtggtcaccgacccggcggccgcctcctccctgtccaggtacttcttgccgagcaccatgcgcgtgatcacgttcaggctcaccgtggacaggtagtccttgagcatgacggcgcggccggagccggaggcggagttcaggtcgcgcagcagcgcgcgcacctcggcggcgcggatgtactcgtacgactcgagccgcttgacgctgaagagctcggtgaggcacatcttgcgcgcctgacgccagtaggcgccgtagggggaccaggtgatgtcgcggtagttgtaggtggtgtacttgccggcggcggtctttgggcggtccgtgaacaccacgtcgtgggtcttgaggaagaacttggccatgtccaccgacgagccgaccaccacggggaacgacccgaaccggagctgcatcagcgggccgtacttcctggacagctcgtggatggagcggtgagggagcgcgccaaccaggttgaggttgccgatgatcggccacggcttggggccgggcgggaggttgtacacgcggcggctgcggcggcggccgatgatggccttcagaagcatcacggtggcgagcaccacgccgaggaaggacgcccatggcggaagctc

SEQ ID NO: 4772 - DNA, 2044 bp, Triticum aestivum
atggagctccaaccatggctgaccttccttgggattgtgctcgccaccgtgctcttcatcaaaacggtggcttgtcgacccagtggacgtggacacaacctccctccgggacctaagccatggccaatcatcggaaacctcaacctcattggcgcgctcccacaccgctccattcacgcgctctcggaacggtacggcccactcatgtacctccgcttcggatccgtcccggtcgtcgtcggatcttccgtcgagatggccaagttctttctcaagacccatgacgtggtgttcactgaccggcccaaaaccgccgccgggaagtacaccacgtacaactatagggacatcacctggtcccagtacggtccgtactggcgccaggcgcgtaagatctgcctcacggagctcttcagcgtgaagcgcctcgagtcatacgagtacatccgcggagaggagctgcgagcactcctgcacgatctgcacggagcgtccggccgcgtcgtgacactcaaggactacttgtccacgttgagcttgaacgtgatctcgcgcatgatgctgggcaagaattacttggacaaggaagcggcaggctccgcgatcacgacgcctgatgaattcaggtggatgctcgacgagctgttcttgctcaacggcgtgctcaatatcggtgactccatcccgtggctcgactggatggacgtgcagggttacgttaagaggatgaagaagctgagcaagatgtacgatcggttcctcgaacacgtggtcgacgagcacaacgaacggcgcagccgcgagggggagagcttcgtggcaaaagacatggtcgatgtgctgcttcaggtagccagcgaccccaatcttgaggtcaaactcagccgggatggcgttaaggccttcatacaggatctactcgctggcggcacggaaagctcgacggtgactgtggaatgggccatttccgaactcctaaagaagcccgagatttttggcaaggcaactgaggagctggaccgcgtcgtcggccggtgccgctgggtcacagaggacgacattccgagcctcccgtacgtggatgctatcatgaaagaggccatgcggatgcatccggtggtgccgttgctggtgccccgcctgtctcgcgaggacacgaccgtcggcggctacgacatcccggctggcacacgcgtccacataagcgtgtggtccattggccgtgacccggccctgtgggacgcgcctgagcatttcatgccggagcggttccttgacagcaagctggacgtgaatgggcaggactacgagctcctgccgtttggctccggccggcggatgtgccccgggtacagcctcggcctcaaggtgatccagatgagcctcgcaaatctgctgcacggcttcacgtggaggctgcccgacggcgttgccgcggagcagctgagcatggaagagatatttgggctgtccactccacgcaagttcccgttagagactatcatggagcccaagctcccaggtcacctctacgacggggctactgcgtttgtggagtaattaatgagtcagtgttttcgtggatgttcattttctctctgttgttcttccactatgttgcgccatatgtattgcgtgatccccctacagtcactagaataaataacggactacttcccttgcacggactccatgcctaacgacgacggttccaagaagaaagccgcggaagaggaggaaattgttgtggccgtagcctgacttactggatggtattatttgttcatcccctacttgcttgttcgtatgctagttgtatgtgtcatgtgcatagatgattcaattctatgttgtacacatgctcaaatgtttagttatcggtatgagttgcatactgtgaatgccatgtttactatttacttgtggattagattattctaaaatgtgctaatatttccagcacttatgtgtttaagttatatagaatcgatattgtatgattcaaaatcaaaagaaatgtcaattggtttaatttcaatgacat

SEQ ID NO: 4773 - DNA, 2616 bp, Sorghum bicolor
atcggtggatccacggtgcagatcgaggcgcggttctccccgtcgccgtagggtttttgtcctcgcttctcttaccaagttaccagagccacctcctccgtcggccgcagctaccccacgccgtcggccgccatgagagccctcctctccctctcccgtcttgcccgacgggttccagcttctctcgcccctgtaagcgcgccgacaacattcctcctccggcacatccatgccgacgtccctccgccgccgccgccaccgccacctcatgactcgccgctcttcgtctcccgcatcctcgaatcggagccgagcctgaccccgaacgccgagtcggagccggcatccgatccgatcctcgacgagtttctcgcgcgattcgtggctgccttccgcccgcgactcacggctgccttccccaaccatgaccgtgacgtgctcgacgaaatgctccgcctcgtcgcggacgccgtgctgtgccgcctcactggggccgaccgggggcccgatgctatcgagctcaatgacgacctctgggcggtcgtatgggaggtcagcgcctccgtgcgcgaggctatgcgccgggatcaggtccgcgccgacctccgccaataccttcactgcgacgaggttaaggagatgacgcggttcgctgtcgatgtcggcatccgcggtgccatgctccgggagctccgcttcaagtgggcccgcgagaagctcgatgaggtcgagttctatcgaggccttgatgacaagcgctccgatgctgaggccgccgctgacccggcgcctgcgcctgtgccgaggctgaccgctttgccgaagaggaagggagaggtgaagttcacgatgtacggactggacatgtctgacccaaagtgggctgaggtggcggagcgagtggcggaggctgaggcgcattttgtgcctgaggaggccaaggctgtagaagggagggcgaagaaggccgaggagcggctgctgttggttgacccgaggagaggagatccggtgcctgccattgaggagtggaaggaggatctccggccaaaacgtgttgattggatagcactgcttgagcggattaaggcacggaatgtcgagttgtacctcaaggttgctgaaattctgctagatcaagaatcttttgaggcaaacatccgagattactcaaaattaattgatcttcacgctaaagcaaatcatgtggaaagcgcagagagagtacttggtaaaatgaaagagaagggtattgcacctgatgtcatcacatccatcgtattagtccacatgtatagcaaggcaggcaatctagagcaggccaaggaggcttttgaatttattcgaagggagggttttaaaccagatctgaaactcttcagttcaatgattaattgctatatcaaccatggagaaccagaagaagcagaaaatctgataaaatctatgaggggcacacgtgtcattgtcaaacccactagagaaatctacacagacattgtacgagcatatgctcagcgaggcatgatgacatgtgcacagagggttcttaatatgatgacacatgatgaaatcaagcctacagaggaactctatgcaatatgtatagaagcatatggacgtattggtgatcctattcaagcccgtgccatgtttgatcaaatcaggaggaggcttggacacgaaccaggtgacagttcaattgctggtgtggtggctgcgcacatcgagaagaaccaactagacgaggctttgcagtggttgctgagtttagagaaggaaggagttgaacttggtgtcaagacgaacctcgtgttactggattggctgtctatgttgcagctagttctggaggctgaacagcttgtgcagaagataaagaagcttggagaagagcccatagaagtccatgtgttccttgccggtatgtatgcaaagtctcgccaggaagagaaagcccgcaggtccctcaagatcttggaagagaagaagaaactattgaagtctgatcagtttgagagggttataagaggccttcttgatggtgggttctcagaagaggcaaataaatactacaaaatgatgaaatcctgtggttttgaaccatcagaaacaatcgaggtcggtgttaaggctagtctcaggattaggggtgcttctcgtcacattggcaggcattgagattagggcctgtatgctggtagagtggcagcgatctactgggcacgcaggcaagcaaggagggattctggtgtgagaaccttgtggcactgacacggcacaatcaaattgaccaaactcagtgctgaaagatagcttggccatttttcttttctggttatcaattgtctgaaggcacgacgttgcttccatagactatgaaattaataggccctggtttcatgattttgttgttttcagtgatcaggattttcacttgtattagatgaggtttgaagtgattgtaacactgatccatcttccaggttttcaaagaaaacatatatccgcgaatagtgattattgctgtgttcagacatacaatgatgtaagttaattaataaatattccctcaatgatgtaagttaataaatattccctgcggcctccggtcac

SEQ ID NO: 4774 - DNA, 1793 bp, Triticum aestivum
aggacctgaattttgtcctgatggaggactgctattagttgagttatttgttggttttacaggtgtagcagcagatggggcactgtctctattattcttgagtgcagcttttgtaacagcagaccaaagttcatttactccagttccatcttttgaagaaacatcaaaacattgagaaattctgtcatgtttctctttcattgctttaacttctgcatctgttacagcatgatcaagatctgagcaagttccgactaagaaatatggagttggaactgtgcattggtgagtaattgttaagtccttaacccaggttgggacattggaaagtgatgcaggatcagaatagttgaaacaaatcaaaaaacaattcgtgtccatataagcgagacgtcgggctcgatcgtcgtttgcgagagtatcggagactgcgacttgcatttgtttgccttccagattgacaggcacattaaattcgtccagtctttgtggcaaatcggctcaagctagcttcacctcaagctcgagcttcacttgagccccaaaaatggcgagcagctcactagtagtcctggccgtcctggccaccgtggccgcgctgctgctctctccggccatgcccctacccgtcttcaccggcgactcctccccgggcttccacgcggcgtcgtgcccgcagctggacggcatcgtgtggtcgtccgtggaggcggcgctgcggcaggaggtggcggtggcggcgggcatgctccgcctctacttccacgactgcttcccgcagggctgcgacgcctccatcctcctcaacaccaccgccgcccgcgagaccgctctcggacccaacctcagcatccagccgcgcgccatgcagctcatcgagtccatccgcgccagggcgcacgccgtttgcgggcccgtcgtctcctgcgccgacatcaccctgctcgccacccgcgacatcatcgtcatctccggcgggccctggttcaacgtgccgcagggcaacctcgacagcctcgccccggcgtcgcaggacaaggtgttcgacctcccggcgcctgacacggccagcgtggcgacgctcgtgaactccttcgccaccaggggcctcggcgacgtggccgacctcgtggcgctctccggcgcgcacaccatcgggcggtcgcagtgcggcagcttcgtcgaccggtccaagcgcgccgacgacaccttctcgaggaagctggcggccaactgcagcaagcacccggagcggctgcagaacctggacgtgatcaccccggacctgttcgacaacgcgtactacaaggcgctggggttcaaccagggcgtgttcacctccgacatggccctcgtgaagaacaagaccaccgcgcccatcgtgaagcggttcgccgagagcaaggacgccttcttcgggcagttcgccaggtccatggagaagctcgcgagggtgcccaaaccggccggcaacgtgggcgagatccggcgcttcagctgcttcaggaccaacgcccagcgcgccgacgctgccgtcgaggccgccggtgaggaggaggaggagggcttctccgcctccgcttgatctgatggttcggtcaagtactaccgtgcgcaagatggtcgtcggcaggcaggctagcaggtacccgtgcgttgtgttagcgtgcatgcacggcatggccgtaggccatagccaatcgtgtttgagttgtcggcatgcttcctttttctgcgtgtagcaataaagagacagagatttcgatcgtcgttgcatctcatcttgatgaact

SEQ ID NO: 4775 - DNA, 1384 bp, Triticum aestivum
gtcaagctagcttcagctcaagctccgcagtccgcaccaaagaaaccatggcgaccaccagcccagcagtagtcctggccgtcctggccaccgcagccgcgctcctgctctccccggccatgtccctgcccgtcttcaccggcgactcctccccgggcttccactccgcgtcgtgcccgcagctggacggcatcgtctggtcgtccgtggaggcggcgctgcggcaggaggtggcggtggcggcgggcatgctccgcctctacttccacgactgcttcccgcagggctgcgacgcctccatcctcctcaacaacaccgccgcccgcgagaccgctctcggccccaacctcaccatccagccgcgcgccatgcagctcatcgagtccatccgcgccagggcgcacgccgtgtgcgggcccgtcgtctcctgcgccgacatcaccctgctcgccacccgcgacatcatcgtcatctccggcgggccctggttcaacgtgccgcagggcaacctcgacagcctcgcccccgcggcgcaggacaaggtgttcgacctcccggcgcccaacacggccagcgtggcgacgctggtggagtccttcgccaccaggggcctcggcgacgtggccgacctcgtggcgctctccggcgcgcacaccatcgggcggtcgcagtgcggcagcttcgaagaccggtcgcagcgcgccgacgacaccttctcgcgcaagctggcggccaactgcagcaagcacccggagcggctgcagaacctggacgtgatcaccccggacctgttcgacaacgcgtactacaaggcgctggggttcaaccagggcgtgttcacctccgacatggcgctcgtcaagaacaagaccacggcggccatcgtgaagcggttcgccgagagcaaggacgccttcttcggacagttcgccaggtccatggagaagctcgccagggtgcccaagccggccggcaacgtgggcgagatccgccgcttcagctgcttcaggaccaacgcccagcgcgccgacgctgatcatgtcgacgccgccggcgaggaggaggaaggcttcgccgcctccgcttgatctgatggttcggtcaagtacgtgcgtaagatggtcgccgcctccgcttgatctgatggttcggtcgtcggcaagtaggctaggtgcccgtgcgttgtgttagcttgcatgcatggcatggccgtgggccgtagccaatcgtgtttgagttctcggcatgcttcttttttctgtgtgcaatgttggtgtagcaataaagagaaagtggtttggatcgtcgttggatcttgagttcttgaccaactatgtcaattagtctcgacacctatttatgtagtacgtattgatggcgaaat

SEQ ID NO: 4776 - DNA, 1307 bp, Pseudoroegneria spicata
ctcaagctaacttcagctcaagctcgagcttcacttgagcaccaaaaatggcgagcagctcactagtagtactggccgtcgtggccaccgtggccgcgctgctgctctccccggccatctccctacccgtcttcaccggcgacgccgacgtcgacttccacgccgcgtcgtgcccgcagctggacggcatcgtgtggtcgtccgtggaggcggcgctgcggcaggaggtggcggtggcggctggcatgctccgcctctacttccacgactgcttcccgcagggctgcgacgcctccatcctcctgaacaacacggccgcccgcgagaccgcgctgggccccaacctcaccatccagccgcgcgccatgcagctcatcgagtccatccgcgccagggcgcacgccgtctgcgggcccgtcgtctcctgcgccgacatcaccctgctcgccacccgcgacatcatcgtcatctccggcgggccctggttcaacgtgccgcagggcaacctcgacagcctcgccccggcgtcgcaggacaaggtgttcgacctcccggcgcccaacacggccagcgtggcgacgctcgtgaactccttcgcgacccggggcctcggcgacgtggccgatctcgtggcgctctccggcgcgcacaccatcgggcggtcgcagtgcggcagcttctccgacaggtcccagcgcgcggacgacaccttctcccggaagctcgccgccaactgcagcaagcacccggaccggctgcagaacctggacgtgatcaccccggacctgttcgacaacgggtactacaaggcgctggggttcaaccagggcgtgttcacctccgacatggcgctggtcaagaacaagaccaccgcgcccatcgtgaagcggttcgccgagagcaaggaggccttcttcgggcagttcgccaggtccatggagaagctcgccagggtgcccaagccggccggcaacgtgggagagatccgccgcttcagctgcttcaggaccaacgcccagcgcgccgacgctggctccgtggacgccgccggtgaggaggaggagggcttcgccgcttccgcttgatggctcggtcaagtacgtgcgtacggtcgtcgtcggcaagccggctctgcccgtgcgttgcgttagcgtgcatgcacggcacggccgtagccaaccgtgtttgagttctgggtttgcttcttttctctgcgtgcaatgctggtgtagcaataaagagacagagctttcgattgtcctgtcaattaatctggacacctatgtaaacatattgataccgataat

SEQ ID NO: 4777 - DNA, 1443 bp, Secale cereale
ggcgcgcgctgtggaaaacctttcctatttctatattacacgaagacacatggttggaatggaagagatcaatggagtcgttggtgccgctgtttctacgctctgcgtctcacccggttttgtagattggttcccgttataaatgacacccactgcttggcgtgaggaagccacaagcccagtcaagctcaagctctacaccaaagaaaccatggcgagcagcagctcagtagtagtactggccgtcctggccaccgcagccgcgctagtgctctccccggccatgtccctccccgtcttcaccggcgacgactccccgggcttccacgccgcgtcgtgcccgcagctggacggcatcgtgtggtcgtccgtggaggcggctctgcggcaggaggtggcggtggcggcgggcatgctccgcctctacttccacgactgcttcccgcagggctgcgacgcctccatcctcctcaacaacacggccgcccgcgagacggctctcggccccaacctcagcatccagccgcgcgccatgcagctcatcgagtccatccgcgccagggcgcacgccgtctgcgggcccgtcgtctcctgcgccgacatcaccctgctcgccacccgcgacatcatcgtcatctccggcgggccctggttcaacgtgccgcagggcaacctcgacagcctcgcccctgcggcgcaggccaaggtgttcgacctcccggcgcccgacacggccagcgtggcgacgctggtgagctccttcgccaccaggggcctcggcgacgtggccgacctcgtggcgctctccggcgcgcacactatcggccggtcgcagtgcggcagcttcgaagaccggtctaagcgcgcggacgacaccttctcgaggaagctcgccgccaactgcagcaagcacccggaccggctgcagaacctggacgtgatcaccccggacctgttcgacaacgggtactacagggcgctggggttcaaccagggcgtcttcacctccgacatggcgctggtgaagaacaagacgacggcggccatcgtgaagcggttcgcggagagccaggacgccttcttcgggcagttcgccaggtccatggagaagctcgccagggtgcccaagccggccggcaacgtgggggagatacggcgcttcagctgcttcaggaccaacgcccagcgcgccgacgctgccgccgtcgacgccgccggtgaggaggaggaggatggcttcgccgcctccgcttgatctgatggttcggtcaagtacctgcgtaagatggtcgtcggcaagcaggctagctaccagtgcgttgtgttagcgtgcatgcacggcatagccataggccgtagccatccgtgtttgagttctcggcatgcttcgtttttctgcgtgcggtgttcgtgtgtgtagcaataaagagacagagctttcga

SEQ ID NO: 4778 - DNA, 1214 bp, Secale cereale
agcctccaaaaatggcgaccagcagcacagtagtagtactggccgtcctggcaaccgcagccgcgctgctgctctccccggccacgtcgctgcccgtcttcaccggcgactccccaagcttccactccgcgtcgtgcccgcagctggacggcatcgtgtggtcgtccgtggaggcggcgctgcggcaggacgtggcggtggcggctggcatgctccgcctctacttccacgactgcttcccgcagggctgcgacgcctccatcctgctcaacaacaccgacgcccgggagacggcgctggaccccaacctcagcatccagccgcgcgccatgcagctcatcgagtccatccgcgccagggcgcacgccgtgtgcgggcccgtcgtctcctgcgccgacatcaccctgctcgccacccgcgacatcatcgtcatctccggcgggccctggttcaacgtgccgcagggcaacctcgacagcctcgcccctgcggcgcagggcaaggtattcgacctcccggcgcccgacacggcgagcgtggcgacgctcgtgaactccttcgccaccaggggcctcggcgacgtggccgacctcgtggcgctctccggcgcgcacaccatcggccggtcgcagtgcggcagcttcgaagaccggtctaagcgcgcggacgacaccttctcgcggaagctggccgccaactgcagcaagcacccggaccggctgcagaacctggacgtgatcacaccggacctgttcgacaacgggtactacaaggcgctcgggttcaaccagggcgtcttcacctccgacatggcgctggtgaagaacaagacgacggcggccatcgtgaagcggttcgcggagagccaggacgccttcttcgggcagttcgccaggtccatggagaagctcgccagggtgcccaagccggccggcaacgtgggggagatccggcgcttcagctgcttcaggaccaacgcccagcgcgccgacgctgccgccgtcgacgccgccggtgaggaggaggaggatggcttcgccgcctccgcttgatctgatggctcggtcaagtacctgcgtaagatggtcgtcggcgagcaggctagctaccagtgcgttgcgttagcgtgcatgcacggcatagccataggccgtagccatccgtgtttgagttgtcggcatgcttcgtttttctgcgtgcggtgttcgtgtgtg

SEQ ID NO: 4779 - DNA, 1383 bp, Triticum aestivum
agcttcagctcaagctcgagcttcacttcggccccaaaaaatggcgagtagctcagcaatactggccgtcctggtcaccgcggccgcgctgctctccccggccatgtccctgcccgtcttcaccggcgacgcctccccggacttccacgcggcgtcgtgcacgcagctggacggcatcgtgtggtcgtccgtggaggcggcgctgcggcaggaggtggccgtggcggcgggcatgctccgcctctacttccacgactgcttcccgcagggctgcgacgcctccatcctcctcaacaacacggccgcccgcgagaccgcgctcggccccaacctcaccatccagccgcgcgccatgcagctcatcgagtccatccgcgccagggcgcacgccgtgtgcgggcccgtcgtctcctgcgccgacatcaccctgctcgccacccgcgacatcatcgtcatctccggcgggccctggttcaacgtgccgcagggaaacctcgacagcctcgcccccgcggcgcaggccaaggtgttcgacctcccggcgcccaacacggccagcgtggcgacgctggtggagtccttcggcaccaggggcctcggcgacgtggccgacctcgtggcgctctccggcgcgcacaccatcgggcggtcgcagtgcggcagcttcgaagaccggtcccagcgcgccgacgacaccttctcccgcaagctcgccgccaactgcagcaagcacccggaccggctgcagaacctggacgtgatcaccccggacctgttcgacaacgcgtactacaaggcgctgggtttcaaccagggcgtgttcacctccgacatggccctcgtgaagaacaagaccaccgcgcccatcgtgaagcggttcgccgagagcaaggaggccttcttcgggcagttcgccaggtccatggagaagctcgccagggtgcccaagccggccggcaacgtgggcgagatccggcgcttcagctgcttcaggaccaacgcccagggcaccgacgctgccgtggacgccgccgtcgaggaggagggcttcgccgcttccgcttgatctgatggttcggtggtcggcaagcaggctagctgcccgcccgtgcgttgtgttagcgtgcatgcatggcatggccgtaggccgtagccaatcgtatttgggtttcttggcatgctgcttttttctgtgtgcaatgttggtgtagcaataaagagacaggggtttggatcgtctttgcatctgatcttgagttcttgacgaactatgtcaattagtctggacacctattatgtacgtattgatagcgataatagtagttgtacgtatgcgtgagggtaaacacgaggaaagcaaaggtggtgggtcgaccatgacag

SEQ ID NO: 4780 - DNA, 1582 bp, Hordeum vulgare
acacagacacatggactgaagggagtagttggtgcgtgatctaagccaagattggtgccgctgtttctacgctctgcatctcacccggttttgttgattggttcccgttataaatgacgcccactacttgacgtgaggacgccacaagccccctcactcaagctagcttcagctcaagctcgagcttcacttgagcacaaaaaatggcgagcagctctgtagcagcactggccgtcgtcctggccaccgcggccacgctgcttctctccccggccacgtccctgcccgtcttcaccggcgacgacggcgcctcccctggcttccactcggcgtcgtgcccgcagctggacggcatcgtgtggtcgtccgtggaggcggcgctgcggcaggacgtggcggtggcggcgggcatgctccgcctctacttccacgactgcttcccgcagggctgcgacgcctccatcctcctcaacgacaccgccgcccgcgagacggcgctgggccccaacctcaccatccagccgcgcgccatgcagctcatcgagtccatccgcgccagggcgcacgccgtctgcgggcccgtcgtctcctgcgccgacatcaccctgctcgccacccgcgacatcatcgtcatctccggcgggccctggttcaacgtgccgcagggcaacctcgacagcctggcccccgcggcgcaggagaaggtgttcgagctcccggcgccggacacggcaagcgtggccacgctcgtgacctccttcgccaccaggggcctcggcgacgtcgccgacctcgtggcgctctccggcgcgcacaccatcgggcggtcgcagtgcggcagcttcgtcgaccggtcccagcgcgccgacgacaccttctcgaggaagctggcggccaactgcagcaagcacccggaccggctgcagaacctggacgtgatcaccccggacctgttcgacaacgcgtacttcaaggctctcgggttcaaccagggcgtgttcacctccgacatggcgctggtcaagaacaagaccacggcgcccatcgtgaagcggttcgcggagagcaaggaggccttcttcgggcagttcgccaggtccatggagaagctcgccagggtgcccaagccggcgggcaacgtgggcgagatccgccgcttcagctgcttcaggcccaacgcccagcgcgccgacgctgccgtggacgacgccgccggtgaggaggaggaggaggagggcttcgccgcctccgcctgatctgacctgatggctcggtcaagtacgtagtacgcgcgtgcgtcaggtcgtcgtcggcaagcaggctagctgcccgtgcgttgtgctagcgtgcatgcagggcatggccatgtttgagttctcggcttgcttcttttttctgagtgcaatgttcgtgtagcaataaagagacggagcttttgatcgtcgttgcatctgatcttggtgaacacctatgtacgtgtgtgggagggtaaatacgagaaacgaaaaggtggtgggtcgagcatgacagagaatgatagataggggcctgaggtaagttttcttcaaagtgtgctcataat

SEQ ID NO: 4781 - DNA, 1284 bp, Secale cereale
gactccactctagctcgagcttcacttcagcccaaaaaatggttaaatggcgaccagcagcacagtagtaatactggccgtcctggcaaccgcagccgcgctgctgctctccccggccatgtcctccctgcccgtcttcaccggcgacgactcccctggcttccactccgcgtcgtgcccgcagctggacggcatcgtgtggtcgtccgtggaggcggcgctgcggcaggacgtggcggtggcggctggcatgctccgcctctacttccacgactgcttcccgcagggctgcgacgcctccatcctcctcaacaacacggccgcccgcgagacggctctcggccccaacctcagcatccagccgcgcgccatgcagctcatcgagtccatccgcgccagggcgcacgccgtctgcgggcccgtcgtctcctgcgccgacatcaccctgctcgccacccgcgacatcatcgtcatctccggcgggccctggttcaacgtgccgcagggcaacctcgacagcctcgcccctgcggcgcaggccaaggtgttcgacctcccggcgcccgacacggccagcgtggcgacgctcgtgagctccttcgccaccaggggcctcggcgacgtggccgacctcgtggcgctctccggcgcgcacaccatcggccggtcgcagtgcggcagcttcgaagaccggtctaagcgcgcggacgacaccttctcgaggaagctcgccgccaactgcagcaagcacccggaccggctgcagaacctggacgtgatcaccccggacctgttcgacaacgggtactacaaggcgctcgggttcaaccagggcgtcttcacctccgacatggcgctcgtcaagaacaagacgacggcggccatcgtgaagcggttcgcggagagccaggacgccttcttcgggcagttcgccaggtccatggagaagctcgccagggtgcccaagccggccggcaacgtgggggagatccggcgcttcagctgcttcaggaccaacgcccagcgcgccgacgctgccgccgtggacgccgccggcgaggaggaggggggcttcgccgcctccgcttgatctgatggttcggtcaagtacctgcgtaagatggtcgtcggcgagcaggctagctaccagtgcgttgcgttagcgtgcatgcacggcatagccataggccgtagccatccgtgtttgagttgtcggcatgcttcgtttttctgcgtgcagtgttcgtgtgtgtagcaataaagagacagagctttcgatcagtc

SEQ ID NO: 4782 - DNA, 1368 bp, Secale cereale
gtcgttggtgccgctgtttctacgctctgcgtctcacccggttttgtagattggttcccgttataaatgacacccactgcttggcgtgaggaagccacaagcccagtcaagctcaagctccacaccaaagaaaccatggcgagcagtagctcagttgtagtactggccgtcctggtcaccgtggccgcgttgctctccccggccatgtccctccccgtcttcaccggcgacgactccccgggcttccacgccgcgtcgtgcccgcagctggacggcatcgtgtggtcgtccgtggaggcggcgctgcggcaggaggtggcggtggcggccggcatgctccgcctctacttccacgactgcttcccgcagggctgcgacgcctccatcctcctcaacaacaccgacgcccgggagacggcgatggaccccaacctcagcatccagccgcgcgccatgcagctcatcgagtccatccgcgccagggcgcacgccgtgtgcgggcccgtcgtctcctgcgccgacatcaccctgctcgccacccgcgacatcatcgtcatctccggcgggccctggttcaacgtgccgcagggcaacctcgacagcctcgcccctgcggcgcaggccaaggtgttcgacctcccggcgcccgacacggccagcgtggcgacgctggtgagctccttcgccaccaggggcctcggcgacgtggccgacctcgtggcgctctccggcgcgcacactatcggccggtcgcagtgcggcagcttcgaagaccggtccaagcgcgccgacgacaccttctccaagaagctcgccgccaactgcagcaagcacccggaccggctgcagaacctggacgtgatcaccccggacctgttcgacaacgggtactacagggcgctggggttcaaccagggcgtcttcacctccgacatggcgctggtgaagaacaagacgacggcggccatcgtgaagcggttcgcggagagccaggacgccttcttcgggcagttcgccaggtccatggagaagctcgccagggtgcccaagccggccggcaacgtgggggagatccggcgcttcagctgcttcaggaccaacgcccagcgcgccgacgctgccgccgtggacgccgccggcgaggaggaggagggcttcgccgcctccgcttgatctgatggttcggtcaagtacctgcgtaagatggtcgtcggcgagcaggctagctagcagtgcgttgcgttagcgtgcatgcacggcatagccataggccgtagccaaccgtgtttgagttcccggcatgttcgtttttctgcgtgcagtgttcgtgtgtgtgtagcaataaagagacagagctttcgatcgtcg

SEQ ID NO: 4783 - DNA, 1352 bp, Secale cereale
gactagagatcaatggagtagttgttcccgttataaatgacgcccactgcttgatgtgaggaagccacaagccccactcgagctagcttcagctcaagctcgagcttcacttgagccccaaaaatggcgagcagctcagcaatactggccgtcctggtcaccgtggccgcgctgcactccccggccatgtccctccccgtcttcaccggcgacgactccccgggcttccacgccgcgtcgtgcccgcagctggacggcatcgtgtggtcgtccgtggaggcggcgctgcggcaggaggtggcggtggcggccggcatgctccgcctctacttccacgactgcttcccgcagggctgcgacgcctccatcctcctcaacaacacggccgcccgcgagacggctctcggcccaaacctcagcatccagccgcgcgccatgcagctcatcgagtccatccgcgccagggcgcacgccgtgtgcgggcccgtcgtctcctgcgccgacatcaccctgctcgccacccgcgacatcatcgtcatctccggcgggccctggttcaacgtgccgcagggcaacctcgacagcctcacccctgcggcgcagggcaaggtgttcgacctcccggcgcccgacacggccagcgtggcgacgctggtgagctccttcgccaccagggggcctcggcgacgtggccgacctcgtggcgctctccggcgcgcacaccatcggccggtcgcagtgcggcagcttcgaagaccggtctaagcgcgcggacgacaccttctcgaggaagctcgccgccaactgcagcaagcacccggaccggctgcagaacctggacgtgatcaccccggacctgttcgacaacgggtactacagggcgctcgggttcaaccagggcgtcttcacctccgacatggcgctggtgaagaacaagacgacggcggccatcgtgaagcggttcgcggagagccaggacgccttcttcgggcagttcgccaggtccatggagaagctcgccagggtgcccaagccggccggcaacgtgggggagatccggcgcttcagctgcttcaggaccaacgcccagcgcgccgacgctgccgccgtggaagccgccggcgaggaggaggggggcttcgccgcctccgcttgatctggtggttcggtcaagtacctgcgtaagatggtcgtcggcgagcaggctagctctaccagtgcgttgtgttggcctgcatgcacggcatagccataggccgtagccaaccgtgtttgagttgtcggcatgcttcgttttctgcgtgcagtgttcgtgtgtgtagcaataaagagacagagctttcgatcgtcgt

SEQ ID NO: 4784 - DNA, 1256 bp, Secale cereale
agccccactctagctagcttcagctcaagctcgagcttcacttcagcctccaaaaatggcgaccagcagcacagtagtagtactggccgtcctggcaaccgcagccgcgctgctgctctccccggccacgtcgctgcccgtcttcaccggcgactccccaagcttccactccgcgtcgtgcccgcagctggacggcatcgtgtggtcgtccgtggaggcggcgctgcggcaggacgtggcggtggcggctggcatgctccgcctctacttccacgactgcttcccgcagggctgcgacgcctccatcctcctcaacaacaccgacgcccgggagacggcgctggaccccaacctcagcatccagccgcgcgccatgcagctcatcgagtccatccgcgccagggcgcacgccgtctgcgggcccgtcgtctcctgtgccgacatcaccctgctcgccacccgcgacatcatcgtcatctccggcgggccctggttcaacgtgccgcagggcaacctcgacagcctcgcccctgcggcgcaggccaaggtgttcgacctcccggcgcccgacacggccagcgtggcgacgctggtgagctccttcgccaccaggggcctcggcgacgtggccgacctcgtggcgctctccggcgcgcacaccatcggccggtcgcagtgcggcagcttcgaagaccggtccaagcgcgccgacgacaccttctcgcggaagctggcggccaactgcagcaagcacccggaccggctacagaacctggacgtgatcaccccggacctgttcgacaacgggtactacaaggcgctggggttcaaccagggcgtgttcacctccgacatggcgctggtgaagaacaagacgacggcggccatcgtgaagcggttcgccgagagccaggacgccttcttcgggcaattcgccaggtccatggagaagctcgccagggtgcccaagccggccggcaacgtcggcgagatccggcgcttcagctgcttcaggaccaacgcccagcgcggcgacgctgccgccgtcgacgccgacggtgaggaggaggatggcttcgccgcctccgcttgatctgatggctcggtcaagtacctgcgtaagatggtcgtcggcaagcaggctagctaccagtgcgttgtgttagcgtgcatgcacggcatagccataggccgtagccaaccgtgtttgagttcccggcatgcttcgtttttctgcgtgcagtgttcgtgtgtgt

SEQ ID NO: 4785 - DNA, 1213 bp, Secale cereale
cagcaatactggccgtcctggtcaccgtggccgcgctgcactccccggccatgtccctccccgtcttcaccggcgacgactccccgggcttccacgccgcgtcgtgcccgcagctggacggcatcgtgtggtcgtccgtggaggcggctctgcggcaggaggtggcggtggcggcgggcatgctccgcctctacttccacgactgcttcccgcagggctgcgacgcctccatcctcctcaacaacacggccgcccgcgagacggctctcggccccaacctcagcatccagccgcgcgccatgcagctcatcgagtccatccgcgccagggcgcacgccgtctgcgggcccgtcgtctcctgcgccgacatcaccctgctcgccacccgcgacatcatcgtcatctccggcgggccctggttcaacgtgccgcagggcaacctcgacagcctcgcccctgcggcgcaggccaaggtgttcgacctcccggcgcccgacacggccagcgtggcgacgctggtgagctccttcgccaccaggggcctcggcgacgtggccgacctcgtggcgctctccggcgcgcacaccatcggccggtcgcagtgcggcagcttcgaagaccggtccaagcgcgccgacgacaccttctcgcggaagctggccgccaactgcagcaagcacccggacggctgcagaacctggacgtgatcaccccggactgttcgacaacgggtactacaaggcgctggggttcaaccagggcgtcttcacctccgacatggcgctggtgaagaacaagacgacggcggccatcgtgaagcggttcgcggagagccaggacgccttcttcgggcagttcgccaggtccatggagaagctcgccagggtgcccaagccggccggcaacgtgggggagatacggcgcttcagctgcttcaggaccaacgcccagcgcgccgacgctgccgccgtcgacgccgccggtgaggaggaggaggatggcttcgccgcctccgcttgatctgatggctcagtcaagtacgtacgtgcgtaagatggtcgtcggcaagcaggctagctaccagtgcgttgcgttagcgtgcatgcacggcatagccataggccgtagccaaccgtgtttgagttgtcggcatgcttcgtttttctgcgtgcggtgttcgtgtgtgtagcaataaagagacagagctttgaac

SEQ ID NO: 4786 - DNA, 1283 bp, Leymus cinereus x Leymus triticoides
gctaccttcagctcaagctcgaggttcacgtgagcacaaaaaatggcgagcagctcagtagtagtactggccgtcctggccaccgtggccgcgctgctgctctccccggccatgtccctgcctgtgttcaccggcggcgacgtcggcgtgtccccgggcttccacgccgcgtcgtgcccgcagctggacggcatcgtgtggtcgtccgtggaggcggcgctgcggcaggaggtggcgctggctgcgggcctgctccgcctctacttccacgactgcttcccgcagggctgcgacgcctccatcctcctcaacaccaccgctgcccgcgagacggcgctgggccccaacctcaccatccagccgcgcgccatgcaactcatcgagtccatccgcgccagggtgcacgccgcctgcgggcccgtcgtctcctgcgccgacatcaccctgctcgccacccgcgacataatcgtcatctccggcgggccctggttctccgtgccgcagggcaacctcgacagcctcgccccggcgtcgcaggagaaggtgttcgacctcccggcgcccaacacggccagcgtcgccccgctggtgcagtccttcggcaccaggggcctcggcgacgtcgccgacctcgtggcgctctccggcgcgcacaccatcggccggccgcagtgcggccccttccccgaccggtcccagcgcgccgacgacaccttctcccccaagctcgccgccaactgcagcaagcacccggaccggctgcagaacctggacgtggtgaccccggacctgttcgacaacgggtactacaaggcgctggggttcaaccagggcgtcttcacctccgacatggccctcgtcaagaacaagaccaccgcgcccatcgtgaagccgttcgccgcgagcaaggacgccttcttcgggcagttcgccaggtccatggagaagctcgccagggtgcccaagccggcccgcaacgtcggcgagatccgccgcttcagctgcttcaggaccaacgcccagcgcgccgacgctgccgtggacgctgccggtgaggaggaggaggagggcttcgccgcttccgcttgatggctcggtcaagtacgtgcgtaagatcgtcgtcggcaagcaggctgcccgtgcgttgtgttagcgtgcatgcatggcacggccgtaggccgtagccaaccgtgtttgagttctcggcttgcctttttttttttttgtgcgtgcatggttcgtgtatgtagcaataaagagacagagctttcgatcgtggtgca

SEQ ID NO: 4787 - DNA, 1561 bp, Secale cereale
aaatggcgaccagcagcacagtagtagtactggccgtcctggcaaccgcagccgcgctgctgctctccccggccacgtcctccctgcccgtcttcaccggcgacgactcccctggcttccactccgcgtcgtgcccgcagctggacggcatcgtgtggtcgtccgtggaggcggcgctgcggcaggacgtggcggtggcggctggcatgctccgcctctacttccacgactgcttcccgcagggctgcgacgcctccatcctcctcaacaacaccgacgcccgggagacggcgctcggaccccaactcagcatccagccgcgcgccatgcagctcatcgagtccatccgcgccagggcgcacgccgtgtgcgggcccgtcgtctcctgcgccgacatcaccctgctcgccacccgcgacatcatcgtcatctccggcgggccctggttcaacgtgccgcagggcaacctcgacagcctcgcccctgcggcgcaggccaaggtgttcgacctcccggcgcccgacacggccagcgtggcgacgctggtgaactccttcgccaccaggggcctcggcgacgtggccgacctcgtggcgctctccggcgcgcacaccatcggccggtcgcagtgcggcagcttcgaagaccggtccaagcgcgccgacgacaccttctccaagaagctcgccgccaactgcagcaagaacccggaccgtctgcagaacctggacgtgatcaccccggacctgttcgacaacgggtactacagggcgctcgggttcaaccagggcgtcttcacctccgacatggcgctcgtcaagaacaagaccaccgcggccatcgtgaagcggttcgcggagagccaggacgccttcttcgggcagttcgccaggtccatggagaagctcgccagggtgcccaagccggccggcaacgtgggcgagatccggcgcttcagctgcttcaggactaacgcccagggcgcctacgttgacagcgacgccgccggcgaggagggggaggagggcttcgccgcctccgcttgatggctcggtaagatcgtcgtccgcaagcaggctgcccgtgcgttgtgttagcgtacatgcacggcacggccgtagccaatcgtgtgagcgtttttggcttgcttcttttcttcatgcatgattcatgtagcaataaagagacagagcttttaatcgtcgttgcatcatctcagtaaggctggaaaaaaaatctcgaaactcgtaagttaagcgaataacttgtgacatggcttgaattgactcgaactcaaagaataatgagtcgagccgagatttagtttaagatcgtttataaagcgagttaaacgagtcaatctcacgagcattgttgtaactcgttacgctcggtacaaaagactgttaaactgaatagttatcttgtatagggttgtagttatctcctctaacaaccttctcttatctccttgtaaaaccctagcggcagccctagaggcgccctatatattgaacctaagaccaccgggtttaggtgtgtcgatccaaaaaaaaaaaaa

SEQ ID NO: 4788 - DNA, 1164 bp, Secale cereale
cagccgcgctagtgctctccccggccatgtccctccccgtcttcaccggcgacgactccccgggcttccacgccgcgtcgtgcccgcagctggacggcatcgtgtggtcgtccgtggaggcggctctgcggcaggaggtggcggtggcggcgggcatgctccgcctctacttccacgactgcttcccgcagggctgcgacgcctccatcctcctcaacaacacggccgcccgcgagacggctctcggccccaacctcagcatccagccgcgcgccatgcagctcatcgagtccatccgcggcagggcgcacgccgtctgcgggcccgtcgtctcctgcgccgacatcaccctgctcgccacccgcgacatcatcgtcatctccggcgggccctggttcaacgtgccgcagggcaacctcgacagcctcacccctgcggcgcagggcaaggtgttcgacctcccggcgcccgacacggccagcgtggcgacgctggtgagctccttcgccaccaggggcctcggcgacgtggccgacctcgtggcgctctccggcgcgcacactatcggccggtcgcagtgcggcagcttcgaagaccggtccaagcgcgccgacgacaccttctccaagaagctcgccgccaactgcagcaagcacccggaccggctgcagaacctggacgtgatcaccccggacctgttcgacaacgggtactacagggcgctggggttcaaccagggcgtcttcacctccgacatggcgctggtgaagaacaagacgacggcggccatcgtgaagcggttcgcggagagccaggacgccttcttcgggcagttcgccaggtccatggagaagctcgccagggtgcccaagccggccggcaacgtgggggagatccggcgcttcagctgcttcaggaccaacgcccagcgcgccgacgctgccgccgtggacgccgccggcgaggaggaggagggcttcgccgcctccgcttgatctgatggttcggtcaagtacctgcgtaagatggtcgtcggcgagcaggctagctaccagtgcgttgcgttagcgtgcatgcacggcatagccataggccgtagccatccgtgtttgagttgtcggcatgcttcgtttttctgcgtgcagtgttcgtgtgtgtagcaat

SEQ ID NO: 4789 - DNA, 1250 bp, Secale cereale
ctctagctagcttcagctcaagctcgagcttcacttcagccccaaaaatggcgaccagcagcacagtagtagtactggccgtcctggcaaccgcagccgcgctgctgctctccccggccacgtcgctgcccgtcttcaccggcgactccccaagcttccactccgcgtcgtgcccgcagctggacggcatcgtgtggtcgtccgtggaggcggcgctgcggcaggaggtggcggtggcggcgggcatgctccgcctctacttccacgactgcttcccgcagggctgcgacgcctccatcctgctcaacaacaccgacgcccgggagacggcgatggaccccaactcagcatccagccgcgcgccatgcagctcatcgagtccatccgcgccagggcgcacgccgtgtgcgggcccgtcgtctcctgcgccgacatcaccctgctcgccacccgcgacatcatcgtcatctccggcgggccctggttcaacgtgccgcaggacaaccgcgacagcctcgccccggcgtcacgggacaaggtgctcgacctcccgtcgccggccaccgccagcgtcgccgctctcgtggagtccttcggcaccagggggctcggcgacgtggccgacctcgtggcgctctccggcgcgcacaccatcggccggtcgcagtgcggcagcttcgaagaccggtccaagcgcgccgacgacaccttctccaagaagctcgccgccaactgcagcaagaaccctgaccgtctgcagaacctggacgtgatcaccccggacctgttcgacaacgggtactacaaggcgctggcgttcaaccagggcgtcttcacctccgacatggcgctcgtcaagaacaagaccaccgcggccatcgtgaagcggtacgccgagagccaggacgccttcttcgggcagttcgccaggtccatggagaagctcgccagggtgcccaagccggccggcaacgtgggcgagatccggcgcttcagctgcttcaggaccaacgcccagggcgcctacgttgacggcgacgccgccggcgaggagggggaggagggcttcgccgcctccgcttgatggctcggtaagatcgtcgtccgcaagcaggctgcccgtgcgttgtgttagcgtaaatgcacggcacggccgtagccagtcgtgtgagcgtttttggctttcttcttttcttcatgcatgattcgtgtagcaataaagagacagagcttttaatcatcgttgcatc

SEQ ID NO: 4790 - DNA, 1288 bp, Secale cereale
gcgtccgcgtgacctggccgcgcctcgcgactcccggccactagtacctccccggccttcaccggcgaccggataccccgggcttccacgaccgcgtcgtgccgctagctgacggcgatcgtctggtcgtcctcggagtcggcgtactgcggcaggacgtgcgtgacgcgggcatgctcgcctcacttcctacgactggttcccgcagggctagcgacgcctccattcctcctcaacaacacggccgcccgcgagacggctctcggcccaacctccagcatccagccgcgcgccatgcagctcatcgagtccatccgcgccagggcgcacgccgtctgcgggcccgtcgtctcctgcgccgacatcaccctgctcgccacccgcgacatcatcgtcatctccggcgggccctggttcaacgtgccgcagggcaacctcgacagcctcgcccctgcggcgcaggccaaggtgttcgacctcccggcgcccgacacggccagcgtggcgacgctggtgagctccttcgccaccaggggcctcggcgacgtggccgacctcgtggcgctctccggcgcgcacactatcggccggtcgcagtgcggcagcttcgaagaccggtccaagcgcgccgacgacaccttctccaagaagctcgccgccaactgcagcaagcacccggaccggctgcagaacctggacgtgatcaccccggacctgttcgacaacgggtactacagggcgctcgggttcaaccagggcgtcttcacctccgacatggcgctggtgaagaacaagacgacggcggccatcgtgaagcggttcgcggagagccaggacgccttcttcgggcagttcgccaggtccatggagaagctcgccagggtgccgaagccggccggcaacgtgggggagatacggcgcttcagctgcttcaggaccaacgcccagcgcgacgacgccgccggtgaggaggaggaggatggcttcgccgcctccgcttgatctgatggttcggtcaagtacctgcgtaagatggtcgtcggcaagcaggctagctagcagtgcgttgtgttagcgtgcatgcacggcatagccataggccgcagccaaccgtgtttgagttcccggcatgcttcgtttttctgcgtgcagtgttcgtgtgtgtgtagcaataaagagacagagctttcgatcgtcgttgcgtctcatcttgatgaactatgtcgtacgtgttttctgctaggttgagtcaaccaaaggactcctcttgcgtgtcatctagaggggg

SEQ ID NO: 4791 - DNA, 1352 bp, Triticum aestivum
ctcaagctcaaggtccacaccaacaatggcaagcagcagctcagtgctggccgtcctggccaccctagccctactgctctccccagccgccgcagccctctcgtccacgctgtccccggacttccacgcggagacgtgcccgcagctggacggcatcgtgcgcgcggcggtgcaggccgccctcacgagggaaatcgccatcgccgccggcctcgtacgcatctacttccacgactgcttcccgcagggctgcgacgcatccatcctcctcaacaacaccgccgcccgcgagacggcgctgggccccaacctcaccatccagccgcgcgccatgcagctcatcgaatccatccggtccacggcgcacggcgcctgcggggcggtcgtctcctgcgccgacatcaccctgctcgccacccgcgccgccatcgtcgcgtccggcgggcccaccttcccagtgcccctcggcaacctcgacagcctcgccccggcgccacaggagaaggtgttcgacctcccgtcgccggccaccgccagcgtcgccgctctggtgcagtccttcggcaccagggggctcggcgacgtggccgacctcgtggcgctctcgggagcgcacacaatcgggaggtcgcagtgcggcagcttctccgaccggtcccagcgcgctgacgacaccttctccaggaagctcgccgccaactgcagcaagaacccggaccgtctgcagaacctggacgtgatcaccccggacctgttcgacaacgggtactacaaggcactcgggttcaaccagggcgtgttcacctccgacatggcgctcgtcaagaacaagaccacggcggccatcgtgaagcggttcgccgagagcaaggacgccttcttcgcgcagttcgccaagtcgatgaccaagctcgctagcgtgcccaagcctgcgggcaacatcggggagatccgccgcttcagctgcttcaggaccaacgcccagagcgtcgtcctcatcgaagccgccgtcgacgccgccgatgaggaggagggcttcgccgcttccgcatgatcggtcgttccggcagccgaccggccagcatgcagtacttcccgcagaccgtgcgtgacgttagcgtgtagtgcactgctgtcctagtggtgttcgtgcgtgtgtttgagggtttgtgttgactgtttttgtcgcgttgtactagtagtaataataaggcgacacatgcgcgactcatcgatgtcatcgagaagacgagaaatgtttgtagattctcatgccggccagtctcactattgaaatctacaagctctttattttgtacgtatatttcatatagtagcatgtaaaaaaaaaa

SEQ ID NO: 4792 - DNA, 1372 bp, Cajanus cajan
gagaacaacaacacaaccaaataaagaaagagaaataaataaaaataaaaataaggaaaattttgaaaacaaaaagtttttgaaaaactcgtctttctttttgtttctctccgtggggattgaaactctatggcctggtttcttgttaaccaggtccctctcagctcttaaatccccttttcctcacattccttgtttccctttcaatttctcatctttcttccaaaatgaacgatcttctaacggaatcatttgacatcccacgtggccaaggtcacggaggtggggaccttgagttaggagaatatgcaaggaattcaggagacctgggcttggatagtttcttcaaaaaggttcaagagcttgataaacaatatgctaagctggataagcttttgagaaagctccaggatgcccatgaagaatccagagctgtgaccaaggctcctgccatgaaggctataaaggagaaaatggagaaagatgttgatgaagttaagaaaactggtcattacttaaagaccaaaattgaagaactggacaaagagaatttggcaaacaggcagaagcctggatgtggaaaaggatcaggtgttgaccggtcaagaacagcaacaactatttctttaaaaaagaaactaaaagataaaatggccgaatttcagactctgagagagaccatccatcaagagtatcgcgaggttgttgagagacgtgtttttacagttacgggtgcaagagctgatgaggagacaattgacagattaattgaaactggagatagtgaacaaattttccagaaggcaattcaggaacaaggacgaggccagataatggacaccttggcagaaattcaagagcgacatgaagcagttagagatgttgagagaaagcttcttgaattacaacagatatttcttgatattgcggtgttagtggatgcacaaggtgatatgcttgacaacattgaatcacaggttacaagtgcagtagatcacgtgcagcaaggcaacaatgctctccagaaggccaagaaactacaaaagaactctagaaaatggatgtgcattgcaatcatgatacttctcatcgttattataatcatcgttgttgctgtcatcaaaccatgggttagcaaaagtggtgcatagtttgcaatcggtaatgcataatgaaataacttatagctcatgtcttcatgatttatatatatatatattttttttgccgatccattcttttgttttcttatgttttaaaaactttctttcatgttatactcacttgaaagaaacattggaacaacgtataaaatattgaattgagttgtataaagaaaagatattgattactgtctccaatcacttttgaa

SEQ ID NO: 4793 - DNA, 1191 bp, Lupinus angustifolius
gtttttttcctcctgcaattgaatctgtggcctggtttgttgttaaccaggtccataccattccgttttcacattcattcttccacaatgaacgatcttctaacggaatcatttgagatcccacgtggtcaaagtcgtggaggtggagatgttgagttaggagcatatgcattaaattcaggagaactaggcttggattttttcttcaagaaggttcaagagcttgataaacaatatgctaagctggataagcttttgggaaagctacaggaagcccatgaggaatccaaatctgtcacaaaagctccttccatgaaaaatataaagcagagaatggagaaagatgttgatgaagttaagaaaactgcgcatcacataaagactaaacttgaagaactggacaaagagaatttggcaaatagacagaagcctgggtgtggaaaaggatcaggtgttgaccggtctagaacagcaacaaccatttccttgaaaaagaaactgaaggacaagatggctgaatttcagaccctaagagaagccatccatcaagaatatcgcgaggttgttgagagacgtgtctttacagtaaccggcacaagagcagacgaggagacaattgacagattaattgagactggagacagtgagcaaattttcaagaaggcaattcaggaacaagggcgaggccagataatggacaccctggcagaaattcaagagcgacatgatgcagttagagacgttgagagaaaacttcgtgatttaaaccagatatttatggatattgcagtgttagtagatgcacaaggagacatgctcaacaacatagaaacacaggtttcaagtgcagtagatcatgtgcaacaaggcaataatgcactccagaaggccaagaaactacaaaggaattctagaaaatggatgtgcattgcaatcataatacttcttatcattgttgtgatcatcgtcgttgccgtcatcaaaccatggggtgataaaaagggtgtctagttattaatcggttttgcaacaagactttttgttatcaggtaggagcaggatcaaacaacacaattatattaaatgcaaatcatttttcatggtttcatttactattttttttggtttctaatggttccctttacatggccatatcaccaaatatgaaaatttaacatttttctcaatata

SEQ ID NO: 4794 - DNA, 1486 bp, Cicer arietinum
taaaaaattctaaaatttaaaatataaacagaatctttagtaaaatataaaaaggaaaaaaaataaaaataaaacacgttgtttcttcttcttcatctctctgtttatggcctggtttgtttttaaccaggtcttttccagctcaaactcctttttctcacattccattttttccatttaggtttcaattttctaacctttcttcaacaatgaacgatcttctaacggaatcgtttgatatcccccgtggccaaggtcatcgaggtggtgacattgagttgggagaatatgcaaggaattcaggagagctgggcttggatactttcttcaaaaaggttcaagagcttgataaacaatatgctaagctggatagtcttttgagaaagctccagggtgcccatgaggagtccaaagctgttaccaaagctcctgccatgaaggctataaagcagagaatggagaaagatgtcgatgaagttaagaaaactgcacattacctaaagaccaaagttgaagaactcgacaaagagaatttggctaataggcagaagcctggttgtggaaaaggatcagctgttgaccggtcaagaacagcaacgacaatttccttgaaaaagaaattgaaggacaagattgctgaatttcagaccctaagagaatccatccatgaagaatatcgtgaggttgttgagagacgtgtatttacagtaacgggcacgagagctgacgaggagacaattgacagattaattgagactggagacagtgaacaaattttccagaaggcgattcaggaacaagggcgtggccagatagtggacacccttgcagaaattcacgaacgacacgaagcagtcagagatgttgagaagaagctgctcgatttacaacagatattcatggatattgcagtgttagttgatgcacaaggagacatgcttgacaacatagaatcaatggtttcaagtgcagcagatcatatacagcaaggcaataataccctccacaaagcaaagaaactgcaaagaaactctagaaaatggatgtgcattgccatcatgatacttctaatcgtcgttataatcatcgttgtttccgtcatcaaaccatgggttaataacaacggcgcttaattactgattagtaacacataattacacaacaattgcatattaattttcatattcatatagtccattctttttgtgatttatttaacttgaaagaagcattggaccaaatatataaatttgtatcctttgaaagtgaagaatgtactaaagaaaaacttcagtctattatacatgtatttatcacatttaaaaatatcttcgataatagattatacataaattctatcgtataattgtgttgaggttgttgattttctttgacatagacattgtgacttgtcactcttataatctgaatttttctttgttagaaaagaaaataatgtattgatattgattatttattagtgaac

SEQ ID NO: 4795 - DNA, 1172 bp, Medicago truncatula
tctcttctcttctcttctatggcctggttgttaaccaggtcttaaccagcttcgaattctctctcttttccctctcacattcttcaattttccacccttttcaccaacaatgaatgatcttctaacggaatcatttgagatccctcgtggtcgtggaggtggtgacattgagttgggagaatatggaaggaattcaggagagcttggcttggatagtttcttcaaaaaggttcaggagcttgagaaacaatatgtgaagctcgataaccttttgagaaagctccaggatgcccatgaggagaccaaggctgtgaccaaagctcctgccatgaaggctataaagcagagaatggagaaggatgttgatgaagttaagaaaactgcatatttcttaaagaccaaagttgaagagctggacaaagagaatttggctaataggcagaagcctgcttgtggaaaaggatcggctgttgaccggtcaagaacagcaacgacaattgccttgaaaaagaaactgaaggagaagatggctgaatttcagatcctgagagaagccatccatgaagaatatcgtgaggttgttgagagacgcgtatttacagtaaccggcgcgagagctgatgaggagacaattgacagattaattgagaccggtgacagcgaacaaattttccagaaggctattcaggaacaaggacgaggccaggtaatggacaccctagcagaaattcaagaacgacacgaagcagtcagggatgttgagaggaaattgcttgatttacaacagacatttatggatattgcagtgttagttgatgcacaaggcgacatgcttgacaacatagaatcacaggtttcaagtgcagtagatcatgtgcagcaaggaaataattccctccaaaaggcaaagaaaatgcaaagaaactcaagaaaatggatgtgtattgccatcatgatacttctcattgttgttgtaatcattgttgtttctgtcatcaaaccctgggttaccaaaaagggtgcatagttaatcggtaacacattgtttccacaacaattaagtatcaatagtcctattcataatccattctttttgttattattaaggttgaaacaaacattggtctcctttttaagagattaatgtacttaagaaaattaattaacttcac

SEQ ID NO: 4796 - DNA, 1450 bp, Populus trichocarpa
agagaaaaaaaaaaaaaaaaactgacaactatttctctctgtctctgacgataatttcaacacgggaacagcaaatctattttcattctctcagaaaaggaaaggaaagaaaaactcctcctcctcctcctcctcctcctccatcccttaattaagacctggggtttccctttttgttttatctgttgaaagttaaaacaaaatcccggtcttaattaacaagcaattgttgtttgttttttaagaaaaacaatacaataacaataacaaaaggaggcttctttttttcagctgctgtttcttcaacaatgaatgaccttttgtcggagtcctttgagatccctcggggtcagggttccagaggcggggatattgagatgggaatgaattctgcagacttgggcttggagagtttctttaaaaaggttcaagagattgagaaacagaatgagaagctggacaagttgctcaaaaagctccaggatgcacatgaggagtcaaaggctgtgaccaaggctcctgccatgaaaggaatcaaacagcgaatggagaaagatgtcgatgaagttggaaaaattgctcgttcaataaagtcaaaactcgaggaacttgacaaagagaatttatctaataggcagaagccgggatgtggtaaaggaacaggtgtagaccgatcaagaacctcaactactatagccttgaaaaagaaattgaaagacaagatggctgaatttcagactcttagggaaaacatccatcaagagtaccgggaggttgttgagaggcgtgtttttacagtgacgggaacaagagcagatgaagagacgattgacacattgattgagactggagacagtgaacaaatttttcagaaagcaattcaggaacaagggcgaggccagataacagatactttggcagaaattcaagagcgccatgatgcagtcagagatctggagaggaaacttctggacttacaacagatttttctggatatggctgtcttggtggatgcacaaggggacatgcttgacaacatagaatcacaggtctcaaatgcagtagatcatgtgcagtcagggaatgttgctctccaaaaggcaaagaagttacaaaggaactccaggaaatggatgtgcattgccattataatccttcttatcattgttgccatcatcgttgtgaccgtgcttaagccatggaataacaacaagggcgcttagcctctgtggtcttgtataatgtacaaatgtaatgagtttgtgagattgacctttgtaaccctccggcaatttgtcaatttatatttgaagtccgtgtttgaaactcaacttgtctgtccattttctataatgaatttgttcgagtgtgctacttctataaccatgtattattattattattattatattattattattattatataaaagaaatggagattacagat

SEQ ID NO: 4797 - DNA, 1057 bp, Prunus persica
ttttttcgcaaattgtagtgtctaagttgcattgctcagctgccctcgacaatgaacgacctgctaaaggattcttttgagatccctcggggtcaagcatctagagatggagatatcgaactaggaacaaatggttcaatgaattctggagaatttggtttggagaatttctttaaaaaggttcaagagattgagaagcaaaatgagaagcttaataagctcctgaaaaaactccaggatgcacatgaggagtccaaggctgtgactaaggctccttcaatgaaatcaatcaagcagcggatggagaaagatgtcgatgaagttggaaaaattgctcgttggataaagtcaaaaattgaagaacttgacaaagagaatttagcaaatagacaaaagcctgggtgcggaaaaggaacaggtgtagatcgatcccgaacagcaacaacccttgccttgaaaaaaaaattaaaggacaagatggctgaatttcagactctaagagaaaccatccatcaagagtatcgggaggttgtcgagaggcgagtttttacagtaacgggcacaagagctgatgaagagacaattgaaagattaattgagacaggagacagtgaacaaatttttcaaaaggcaatccaggaacaaggacgaggccagataatggacactctggcagagattcaagagcgccatgatgcggttagagatcttgagaggaagcttcttgatttacaacagatatttctggatatggcggtgttggtggatgcacaaggggacttacttgacaacatagaaacccaggtatcgagtgcagtagatcatgtacagcaagggaatacagctcttcagaaggcgaagaagctacagaagagttccaggaaatggatgtgcattgcaatcctcatccttctcatcattgttataatcattgtggtggccgtgctcaagccgtggaatagcaacaagggcgcttagctctagcaatttgtactttgtaagtatagtgtattacaactgacccctctgggactccagcaaatcacatgaataattt

SEQ ID NO: 4798 - DNA, 1450 bp, Prunus mume
caaaattcgaaaaaataaaataaaatcgctgccttcacgctccgtctctgatctctctccctctctttctttcccaactttccaacacaaaaagcacattctgtctttctctttcattggtttccttttctctcctttctggaaaccctaagtgacctggtttttttttttttttttcattaaccaggtcctcagaggagagaacttaattttaaaaaaaaaaaaaattttgggtagaaaaaaagttgcaggcttttttttttccgcaaattgtagtgtctaagttgcattgctcagctgccctcgacaatgaacgacctgctaaaggattcttttgagatccctcggggtcaagcatctagagatggagatatcgaactaggaacaaatggttcaatgaattctggagaatttggtttggagaatttctttaaaaaggttcaagagattgagaagcaaaatgagaagcttaataagctcctaaaaaaactccaggatgcacatgaggagtccaaggctgtgactaaggctccttcaatgaaatcaatcaagcagcggatggagaaagatgtcgatgaagttggaaaaattgctcgttggataaagtcaaaaattgaagaacttgacaaagagaatttagcaaatagacagaagcctgggtgcggaaaaggaacaggtgtagatcgatcccgaacagcaacaacccttgccttgaaaaaaaaattaaaggaaaagatggctgaatttcagactctaagagaaaccatccatcaagagtatcgggatgttgtcgagaggcgagtttttacagtaacgggcacaagagctgatgaagagacaattgaaagattaattgagacaggagacagtgaacaaatttttcagaaggcaatccaggaacaaggacgaggccagataatggacactctggcagagattcaagagcgccatgatgcggttagagatcttgagagaaagcttcttgatttacagcagatatttctggatatggcggtgttggtggatgcacaaggggacttacttgacaacatagaaacccaggtatcgagtgcagtagatcatgtacagcaagggaatactgctcttcagaaggcgaagaagctacagaagagttccaggaaatggatgtgcattgcaatccttatccttctcatcattgttataatcattgtggtggccgtgctcaagccgtggaatagcaacaagggtgcttagctctagtaatttgtaatttgtaagtagtgtattacaactgacccctctgggactccagcaaatcacatgaataatttgcggttcgttttacaaacgtggtttctagcacttttattatcctatgataatgagtgcatgtaacactattaatttgaagaaactgtcactatattctttaatatacataaaataaaaaactttcaatcaatttttt

SEQ ID NO: 4799 - DNA, 1234 bp, Theobroma cacao
agatctctttataatctccttttagctttctgaaattccattttgcttttgaaaatcttcaattttggtctcttctctttgaagcttcgttgagcttgttcatctttccactatgaacgaccttctaacggagtcatttgagatccctcgaggtcaaggatcccgaggtggagatattgagctaggagctcaaatgaattctggagaactcggccttcaaaatttctttaaaaaggttcaagacatagataaacaatatgagaagctggataagctactcaaaaagcttcaggatgcacatgaggaatccaaggcagtgactaaggctccagccatgaaatctatcaaacagcggatggagaaagatgtcgatgaagttggaaaaatttctcgttttataaaggctaaaattgaggaattggacaaagagaatttagccaacaggcagaagcctggatgtggaaaaggaacaggtgtagaccggtcaaggacagcaacaactcttgcgattaaaaagaagttgaaagacaaaatggctgagtttcagactctgagggaaaccatccatcaggagtatcgggaggttgttgagagacgtgttttcacagtgacgggcacaagaccagatgaagagacaattgaaaagctgattgatactggagatagtgaacaaatattccagaaagcaattcaggagcagggacgaggccggataatggacactgtttccgaaattcaggagcgccatgaagcagtgagagatttggagagaaagctgcttgagttacaacagatatttttggatatggcggtgttggttgatgcgcaaggagacatgcttgacaacatagaatctcaggtctcgagtgcagtagatcacgtgcagtcaggcaataccgccctccaaaaggcgaagaaactacagaagaactcgaggaagtggatgtgcattgccatcatcatcctcctcctaattgttgtaattatcgtggttgctgtgatcaagccctggagcagcaacaaaggtgcttagattgttgtgtcatttgtttttgtataaaagtatatgaatacggtgaaaatgatccttctttcggctgttcctgttaataactcgaggtctatgctacaaaacccccatatctcgcgtctgtgtgtgttggttgaatactgttatgattgaaaatttaatattcttttgatatattaatatagtaactaaaatcatgccttg

SEQ ID NO: 4800 - DNA, 1249 bp, Rhizophora mangle
cgtgaaccttattattacaccatttccatctatcttttatctgatcttattgaatttttatcacaagggaaaagggtttctttggagcttcttgttcttcgacaatgaacgacctcctaacggattcctttgagatccctcggggtcagggttctcgaggcggagatattgagatgggaatgaattctggagatttggccttagaaaatttctttaaaaaggttcaagagattgataaacaaaatgagaagctggataagctgcttaagaagctccagaatgcacatgaggactcaaaggctgtgaccaaagcccctgccatgaaagcaatcaagcagcgaatggagaaagatgttgaagaagttggaaaaattgctcgttcagtgaagtcaaaaattgaggaacttgacagagagaatttagcaaacagacaaaaacctggatgtggtaaagggacaggtgtggaccgttcaagaacctcaacaaccatagccttgaaaaagaagttaaaagataagatggctgaatttcagactttgagggaaactatccatcaagagtatcgtgaggttgttgagaggcgtgttttcacagtgacgggtacaagagcagatgaagagacaattgacaaattgattgaaactggagatagtgagcaaattttccaaaaagctatccaggagcaagggcggggccagataatggatactctggcagaaattcaggaacgacatgttgcagttagagaactggagaggaaacttttggaattacaacagatattcctagacatggcagtcttggtgaacgcacaaggggacatgcttgataacatagagtcacaggtctcaagtgctgtagatcatgtgcagtcgggaaacactgccctccaaagggcaaaatcattgcaaaagaactccaggaaatggatgtgcattgctattataatacttctcatcatcgttgcaatcattattgttgctgtggtgaagccatggagtaacaagaagggtgcctagcttttgcaactgttttgtacattgtataaatatgagccaactacagatgatgaccctttggaccttaccggcaatttctatcaaattttttccccgagtccatgttctgtgcctgtttagcccttatatatggcaaatggtttgagtgtggtttgagagtgtgatatttcaatgtgtaacgtgaatattctttttaactattaagatggtaggagagattgttgcttgga

SEQ ID NO: 4801 - DNA, 1338 bp, Malus domestica
aaaaagcatcgtctttctttctttctttctttccttccctttcttttggtttcgctctccctctcctctggaaaccctaacagtggcctggttttttcaattaaccaggtccctcacagggaaaaaaccttcaatttgtttttcttaaatttttagtttttgttaaatttcttcgcaagctgtagtttttctttgttgcatttgtcagctgccctcgacaatgaacgacctgctaacggattcttttgagatccctcggggtcaagcttcgagagatcaggatattgaactaggagcacatgcttcaatgaattctggagaacttggtttggagaatttcttcaaaaaggttcaagagatcgagaagcaaaatgagaagcttgataagcttttgaaaaagctccagggtgcacatgaggagtccaaggctattactaaggctccttcaatgaaatcaatcaagcaacggatggaaaaagatgtcgatgaagttggaaaagttgctcgttggataaagtcaaaaattgaagaacttgacaaagagaatttagcaaatagacagaaggctggttgcggaaaaggaacaggtgtagatagatcccgaacagcaacaacccttgccttgaaaaagaaattaaaggacaagatggctgaatttcagactctaagggaaaccatccatcaagagtatcgtgatgttgtcgagaggcgagtttttacagtgacgggcgcaagagctgatgaagagacaattgaaagattaatcgagacaggggacagtgaacaaattttccaaaaggcaatccaggaacaagggcgaggccagataatggacactctggccgaaattcaagagcgacatgatgctgttagagatcttgagaagaagcttctcgatttacaacagatatttatggatatggcggtgctggttgatgcacaaggggaattgcttgacaacatagaaacccaggtatcaagtgcagtagatcatgtacagcaggggaataccgctcttcagaaggccaagaagctacaaaagaattcgaggaaatggatgtgcattgcgattctcattcttcttatcatcgttgcaatcattgtggtggcggtgttcaagccgtggcagagcaacaagggtgcttaaattagctcctatgataatttgtaactgataagtataggggattacaactgacactttgggactcgaacaaatcttgtgaatcatttctagcccttttgttctcctgtgataatgcccgcatgtaacactattaatcgaaacaaactgtcactatattctttaagggattctttaatatgcataaaagaaaa

SEQ ID NO: 4802 - DNA, 1354 bp, Quercus alba
atgggggcaagcaaagcctgccttcacggtttgtcactgatctgttctgctggcaactttctcaaacccatacattaacagtattctcgttctctctttctctctcttccaaacccttcagacctggctttttcttaaaccagtttcaaatttctcagctccacttcgacaatgaacgacctcttaacggactcatttgagatcccccagggtcaagcttctagaggtggagatatagagctaggtgcacaggcttcaatgaattcaggagagctgggtttggagagtttctttaagcaggttacagagattgagaaacaatatgggaagctggacaatctactaaaaaagctccaggatgcacatgaagagtccaaggctgtgactaaggctcctgcgatgaaagcaatcaagcagcgaatggagaaagatattgatgaagttggaaaagtttcccgttacataaaatcaaaaattgaaggactcgacaaagagaatttaacaaataggcagaagcctggttgtggaaaaggaacagctgtagaccgaacgagaatggcaacaactatttccttgaaaaagaagttgaaggataagatggctgaatttcagactttacgggaagctatccataaagaatattgcgaggttgttgagaggcgtgtctttacagtaacgggcacaagagctgatgaagagacaattgagagattgattgagactggagacagtgaacaaattttccagaaggcaattcaggaacaagggcgaggccagataatggccacagtggcagaaattcatgagcgtcatgatgcagttagagaagtggagaggaagcttctcgacttacaacagatatttctggatatggcggtcttggtggatgcacaaggggaaatgcttgacaacatagagtcacaggtctcaagtgcagtagatcatgtgcagcaagggaatactgccctccaaaaggccaagaagctacagaagaactccaggaaatggatgtgcattgcaattatcatccttcttatcattgttgcaatcattgttgtggccgtaatcaagccgtggagtagcaacaagggtgcttagtgctttatcatttgaatgtataaatgtatgagttgcataccatagataactttttgaagagcacccaggcgacccaacattttcatctaattatttgcagtccatgcttcaaacctgcttcttgtcatccatctattttataattgatcaagtgtgtattagttttaattaaaaatgtaaaatgttatgccctatatatatatatatatatatatatatatagtattgatttttattgtgaaaagatgactttcct

SEQ ID NO: 4803 - DNA, 1292 bp, Manihot esculenta
gaacctgaaaggaagctgtctcctacctggcttcccggtctgttgagtcacacctctcctgtcttctctctctctccatgatttcatcaccggagcagcgacccgatcgattattctctctgcaagtgggaaagtagaaccctaattaacagctccttttatctttctacaaattaagccctggttttatgttggcctcctaaccttcgtacttgaacacttgctacttgaacagtcgctacttttctatacgccatctcttcttcactttttaattttacgtaatttagataaaaaaggaggttcctttgatctgattcttccaaaatgaacgaccttctatcggagtcctttgagatccctcgtgggcagagttctagagctggagatgttgagatgggaatgagttctggagatttgggtctggagagtttctttaaaaaggttcaagagattgagaaccaaaatgagaagctggacaagctacttaaaaagcttcaggatgcacatgaagagtcaaaggctgtgactaaagctcctgccatgaaagcaatcaagaagcgaatggagaaagatgttgacgaggttggaaaaattgctcgttcagtaaagtcaaaagttgaggaacttgacaaagagaatttagcaaataggcagaagcctgggtgtggaaaaggaacaggtgtagaccgatcaagaacctcaacaactatggccttgaagaagaagttgaaagacaagatggctgaatttcagagtctaagggagactatccatcaagagtatcgggaggttgttgagagacgtgttttcacagtgacgggcactagagcagatgaagagacaattgacagattgattgaaactggagatagcgaacaaattttccagaaagcaatccacgagcaagggcgaggccaggtaatggatactctggcagaaattcaagaacgccatgacgctgtcagggatttggagaagaaacttctggacttacaacagatttttctggatatggcagtattagtggatgcacaaggagaaatgttagacaacatagaatctcaggtgtctagtgcagtagatcatgtgcagtcggggaacactgcgctccaaaaggcaaagaagttgcagaggaactccaggaaatggatgtgtattgccatcataatccttcttcttattgttgtaatcatagttgttgccgtgatcaaaccatggagcaacaacaagggtgcctagtgtcattgtgcaatttgtacattgtataaatgagtcattcatcaactctt

SEQ ID NO: 4804 - DNA, 1185 bp, Castanea mollissima
attttactttttattcatttattaattaattttccagtttcaaatttctcagctccacttcgacaatgaacgacctcttaacggactcatttgagatcccccggggtcaagcttctagaggtggagatatagagctaggtgcacaggcttcaatgaattcaggagagctgggtttggagagtttctttaagcaggctacagagattgagaaacaatatgggaagctggacaatctactaaaaaagctccagggtgcacatgaagagtccaaggctgtgactaaggctcctgcgatgaaagcaatcaagcagcgaatggagaaagatattgatgaagttggaaaagtttcccgttacataaaatcaaaaattgaaggactcgacaaagagaatttaacaaataggcagaagcctggttgtggaaaaggaacagctgtagaccgaacaagaatggcaacaactatttccttgaaaaagaagttgaaggataagatggctgaatttcagactttacgggaagctatccataaagaatattgcgaggttgttgagaggcgtgtctttacagtaacgggcacaagagctgatgaagagacaattgagagattgattgagactggagacagtgaacaaattttccagaaggcaattcaggaacaagggcgaggccagataatggccacagtggcagaaattcatgagcgccatgatgcagttagagaagtggagaggaagcttctcgatttacaacagatatttctggatatggcggtcttggtggatgcacaaggggaaatgcttgacaacatagaatcacaggtctcaagtgcagtagatcatgtgcagcaagggaatactgccctccaaaaggcgaagaagctacagaagaactccaggaaatggatgtgcattgcaattattatccttcttatcattgttgcaattattgttgtggccgtaatcaagccgtggagtagcagcaagggtgcttagtgctttatcatttgaatgtataaatgtatgagttgcataccatagataacattttgaagagcacccaagtgacccaacattttcatctaattatttgcagtccatgcttcaaaccctgcttcttgtcatccatctattttatgattgatcatgtgtgtattagttttaattgaaaatgtaaaatgttatgccc

SEQ ID NO: 4805 - DNA, 1356 bp, Castanea mollissima
caaagcctggcttcacggttgtcactgatctattctgttggcaactttctcatatacatacattaatctccttctttctttctctctcttccaaaccattcagacctggctttttcttaaaccaggtcttaacctcacctagctccgttttactttttatttatttattaattttccagtttcaaatttctcagctccacttcgacaatgaacgacctcttaacggactcatttgagatcccccggggtcaagcttctagaggtggagatatagagctaggtgcacaggcttcaatgaattcaggagagctgggtttggagagtttctttaagcaggctacagagattgagaaacaatatgggaagctggacaatctactaaaaaagctccagggtgcacatgaagagtccaaggctgtgactaaggctcctgcaatgaaagcaatcaagcaacgaatggagaaagatattgatgaagttggaaaagtttcccgttacataaaatcaaaaattgaaggactcgacaaagagaatttaacaaataggcagaagcctggttgtggaaaaggaacagctgtagaccgaacaagaatggcaacaactatttccttgaaaaagaagttgaaggataagatggctgaatttcagactttacgggaagctatccataaagaatattgcgaggttgttgagaggcgtgtctttacagtaacgggcacaagagctgatgaagagacaattgagagattgattgagactggagacagtgaacaaattttccagaaggcaattcaggaacaagggcgaggccagataatggccacagtggcagaaattcatgagcgccatgatgcagttagagaagtggagaggaagcttctcgatttacaacagatatttctggatatggcggtcttggtggatgcacaaggggaaatgcttgacaacatagaatcacaggtctcaagtgcagtagatcatgtgcagcaagggaatactgccctccaaaaggcgaagaagctacagaagaactccaggaaatggatgtgcattgcaattattatccttctcatcattgttgcaattattgttgtggccgtaatcaagccgtggagtagcagcaagggtgcttagtgctttatcatttgaatgtataaatgtatgagttgcataccatagataacattttgaagagcacccaagtgacccaacattttcatctaattatttgcagtccatgcttcaaaccctgcttcttgtcatccatctattttatgattgatcatgtgtgtattagttttaattgaaaatgtaaaatgttatgccctatatatatatagtattgatttttattgt

SEQ ID NO: 4806 - DNA, 1133 bp, Manihot esculenta
aacgtcaaaagagctttcaatttctctctccacaatagaaacaaataaaaaagaaccctagttatgagcttgtcttgacgtttttctacaaattaagacctggtttatattcctttcctgatctgacactctatacctctcctcttcttcactttttgatcctttttattttcaaaaattgagaaaaaaggagggttctttgagctgattattccacaatgaacgatcttctatcggaatcttttgagatccctcgtggtcagggttctagaggtggagatattgagatgggaatgacttctacagaaacgggcttggagaatttctttaaaaaggttcaagagattgagaaacaaaatgagaagctggataagctacttaaaaagctgcaggatgcaaatgaagagtcaaaggctgtgactaaagctcctgccatgaaagcaattaagcagcgaatggagaaagatgttgatgaagttggaaaaattgctcgttcattaaagtcaaaaattgaggaacttgacaaagagaatttagcaaataggcagaagccaggatgtggaaaaggaacaggtgtagaccgatcaagaacctcaacaactatggccttgaaaaagaagttgaaagacaagatggctgaatttcagaatctaagggaaactatccatcaagaatacagagaggtcgttgagaggcgtgttttcacagtgacgggcactagagcagatgaagagacaattgacaggttgattgaaactggagatagtgaacaaattttccaaaatgcaattcatgagcaagggcgaggccagataatggatactctggcagaaattcaagaacgccatgatgctgttagagatttggagcggaagcttctggacttacaacaggtttttctggatatggcagttttggtggatgcgcagggggaaatgttagacaacatagaatcacaggtgtctagtgcagtagatcatgtgcagtcagggaatactgctctccaaagggcaaagtcattgcagaagagctccaggaaatggatgtgtattgccatcataatccttcttatcattgttgcaataatcgttgttgctgtaatcaaaccatggagtagcaacaagggtgcttag

SEQ ID NO: 4807 - DNA, 1268 bp, Fagus grandifolia
gtgttggcaactttcaaatacaaaaatcaaattcacatttgtctccctctgttcccaaacctccaggcctggctttttgttgaaccaggtcctaacctcacctagctgctgctccatttatacttttccactgtcgaatatctcagcttcacttcgacaatgaacgacctcctatcggactcatttgagatccctcggagtcaagcttctagaggtggagatatagagctaggtgcaaatgcttcaatgaattcaggagaactgggtttggagaacttctttaagcaggttacagagattgagaaacaatatgggaagctggacaatctactaaaaaagctccaggatgcacatgaagagtccaaggctgtgaccaaggccccttccatgaaagcaatcaagcagcgaatggagaaagatattgacgaagtaggaaaagtttcccgttacttaaaatcaaaaattgaaggactcgacaaagagaatttaacgaacaggcagaagcctggatgtggaaaaggaacagctgtagaccgaacgagaatggcaacaactgtttccttgaaaaagagttgaaggataagatggctgaatttcagaccttacgggaagctatccatcaagaatattgcgaggttgttgagaggcgtgtctttacagtaacgggcacaagagctgatgaagagacaattgagagattaattgatactggagatagtgaacaaattttccagaaggcaattcaggaacaagggcgaggccagataatggccacagtggcagaaattcatgagcgccatgatgcagttagagaagtagagaggaagcttctcgatttacaacagatatttctggatatggcggtcttggtggatgctcaaggggaaatgcttgacaacatagagtctcaggtctcaagtgcagtagatcacgtgcagcaagggaatactgccctccaaaaggcgaagaagctgcagaagaactccaggaaatggatgtgcattgcaattatcatccttcttatcattgttgcaatcattgttgtggccgtgatcaagccatggagtagcaacaagggtgcttagttctcatccatcatatgagtgtataaatgtacgagttataaaccatagatacatttggaagagcacccaacattttcatctaattatttgcggtccatgcttcaaacccagcttcttcccatccttctattttatgattggtgagtgcgtattctttttaattgaaatgtagattgctatgcc

SEQ ID NO: 4808 - DNA, 1288 bp, Carica papaya
tgctggggaaaaaaaaaccaggtcctaacaattgcgagttagagatctcattgcattctccttttccgttctcgcattatctttttcaaatttgatcttgttttggagttcgtaattcgaattttttctctgtcaaggttattcaatctcctcgtccaacaatgaacgaccttttaaaggattcatttgagatccctcggggtcactcttctagaagtggagatattgagatgggaggaaatgcaccaagcaattctggagatctgggactggaagatttcttcaaaaaggttcaagagattgagaaacaaaatgagaaactggacaagcttcttaaaaagctccagaatgcacatgaggagtcaaaggctgtgaccaaggctcctgccatgaaagcaattaaacagcgaatggaaaaggatgttgatgaggttggaaaaattgcccgttccatgaaggggaaaattgaagaacttgacagagagaatttatctaataggcagaagcctgggtgtggaaaaggttctggagtggaccgatcaagaacagcaacaactctttctttgaaaaagaaattgaaagacaagatggctgaatttcagattttgagagaaaccattcatcaagaataccgggaagttgttgagaggcgtgtttttacagtaacggggacacaagctgatgaggagacaattgacagattgattgagactggagatagtgaacaaatatttcagaaagcaattcaggagcaagggcgaggccagataatggacactcttgctgaaattcaagagcgtcatgatgctgttagagatttggaaaagaagctccttgagttacagcagatatttctggatatggcagtcttggtggacgcacagggtgagatgctcgacaatatcgaatcccatgtctcaagtgctgtagatcatgtgcaatcagggaatactgctctccaaaaggcaaagaaactacagaagagctctaggaaatggatgtgcattgccataatcatccttcttataattgttgcgatcattgttgttggtgttctcaaaccgtggactagcaacaagggtgcatagcaagcttttccatttcttatgtaaaaatgtatcgatcctgcgctgaaatgttcttagacatctcccggcaattgttaattatttgaggtctttgtttcagacccagttttcttcctgtgtattattctacgaagaacttgatgtatcattttaactgaagtatatatatatatccttaatatattcttttaccagtgggc

SEQ ID NO: 4809 - DNA, 1169 bp, Vaccinium corymbosum
acctttcagaattcagacctggttttcgggaccaggtcgagaaaaaggaattcctcatcacccaaggatctcattggcattcatttatatacatacacacatctgtatctccagcttcaacgacaatgaacgaccttctatcgggttctttcgagatccctcgaggtcaggataatggtggagatcttgaaatgggaacacaacgtccaatgaattcaggagaattgggcctagataacttctttaaacaggttcaagagattgagaaacaatacgataagctgaataagctactcaaaaaagctccaggatgcccatgaggaatcaaaggctgtaaccaaggctgctgccatgaaagcaatcaagcagagaatggagaaagatgtcgatgaagttggaaaagtcgcccgttcaataaaatcaaagatagaggagcttgatagagaaaatttagccaacaggcagaagcctggatgtggaaaaggatcaggtgtagaccgatcaagaacagctacaacaattgccttgaaaaagaagttcaaagacaaaatgtctgaatttcagactttaagggaaagcatccaccaagagtatcgagaggttgttgagaggagagtttatacagtaacgggcacccgagccgatgaagagacaattgatcaattaatagagacgggggatagcgaacagattttccagaaagctatcagggaacaagggcgaggccagataatggatactctagcagaaattcaagaacgccacgatgcagttagagaggtagagaggaagcttcttgagttgcaacagatatttatggacatggcggttctggtggatgcacaaggggacctgctcgacaacatagaatcacaggtttcaagtgcggttgaccacgtccaatctgggaatactgctctgcagcacgcgaagaaattgcaaaggaactctaggaaatggatgtgcattgccatcctcatccttcttatcattgtcgcagtcatcgttgtcggtgtgctcaagccatggaatagcaacaagggtgcctaaaccgcgatacaaccttactgtataataatacatatgaaaaagaaccaacgtggttgaagtattttcttcttatttctttcttactgatctcttctcttctactctctccctgtgatcta

SEQ ID NO: 4810 - DNA, 1206 bp, Tripterygium wilfordii
gaaattattgtggattacagaaattacgaaccctaagaaggcctggtttttgaaacaaaaaccaggtcttgcgtgaattttgttcaacaacaatttagatccgaaagtttgagtttttaagctcattcagtttaatttcttcccgaccccctttggtgtctgaatttcggaatatttgtaagatttctctcgcgaggtcctttgagctccgtcttcgacaatgaatgaccttttagcggattcttttgagatccctcggggccaaccttctagaggtggagatattgagatgggaactaatgctccaatgaattcgggaaatctaggcttggaagattttttcaaaaaggtccaagagattgaaaagcaaaatgagaagcttgataagctacttaagaagctccaggatgctcatgagcagtcaaaggctgtgacaaaggctcctgccatgaaagctatcaaacagcgaatggagaaagatgttgatgaagttgggaaagttgcccgtcttattaaaacaaaaatcgagcagcttgacaaagagaatttggcaaataggcagaagcctggatgtggaaaaggaacaggggtagaccgctcaagaacggcaacaaccattgctttaaagaagaagttcaaagacaagatgactgaatctcagactttaagggagaatattcatcaagagtaccgggaggttgttgagaggcgtgtttttacagtgacgggcacaagagctgatgaagagacaattgatagattgattgagactggagacagcgagcaaattttccagaaagcaattcatgagcaaggacgaggccaggtagtggacactgtagcagaaattcaagagcgccatgttgctgttagagatttggagaaaaagcttcttgagctacaacagattttcatggacatggctgttttggtggatgcacaaggagacatgcttgacaatatagaatcacaggtctcgagtgccgtagatcatgtgcagtcaggaaataccgcacttcaaaaggcaaagtcgctacagaagagctccaggaaatggatgtgcatcgccattatcatccttctcataatcgttgcaatcatcattgtggctgtgttcaagccatggaataagaacaatggtgcttagctggcatgccatctgtacactgtataaatgtaagataagcgtcgagacactgatacttc

SEQ ID NO: 4811 - DNA, 1055 bp, Tabernaemontana elegans
agaaaagagagatctcataacttttccacaatcttcctctttgaatctctcgaaacctctctgcattatctggattgcaacatgaacgacctcttatcggaatcatttgtgatccctcgggatcaaaactctaacaatggggatattgagatgggaacacaacgaccaatgaactcgggagaactgggcctagacatttttttaagcaggtgcaagagattgagaaacaatatgagaaactgaataagctacttaaaaagcttcaggatgctcatgaggagtcgaaagccataactaaggcttcctctatgaaagctattaagcagcgaatggagaaagatgttgatgaagtcgggaaaatcgcccgttttatcaaatcaaaaattgaggagattgacagagaaaatttagccaacagacaaaagcctggatgtggaaaaggatcagctgtagatagatcaagatcagcaacaactgtttctctgaaaaagaaatttaaagacaagatgtccgagtttcagactctgagagagagcatccatcaagagtaccgtgaggttgttgaaagacgtgtatttacagtaacgggaactcgagcagatgaagagactgtagatcgattgatagagactggggatagtgaacagatcttccagaaagcaattcaagaacaagggcgtggacagataatggacacacttgcagaaattcaagagcgccatgatgcagtcagagaattagagagaaaacttcttgaattgcaacagatatttatggacatggctgtattggtggatgctcaaggggacatgcttgataacattgaatcacaggtttcaagtgctgtagaccatgtgcagtcagggaatactgctcttcaaaaggcaaagaaactgcagaagaactccaggaaatggatgtgcattgctataattatcctactcattattgttgcaatcattgttgtgggggtgctaaagccatggaaaagcaacaacggtgcttagattttgttaaccttggtaggaattgtataaatatagacagatggtatt

SEQ ID NO: 4812 - DNA, 1058 bp, Ricinus communis
ttaaggagaaaggagtgtcctttgagctgcatctccaacaatgaacgaccttttatcagaatcctttgagatccctcgtggtcagggctctagaggcggagatattgagatgggaatgaattctggagatttgggcttggaaaatttctttaaaaatgttcaaggtattgagaaagaaaatgagaagctagacaggctactcaaaaaactccaggatgcccatgaggaaacaaaggcagtgaccagagctcctgctatgagagcaatcaggcaacgaatggacaaagatgttgatgaagttggaaaaattgctcgtacagtgaagtcaaagattgaggaacttgatagagagaatatatcgaataggcagaagccaggatgcggaaaaggaacaggtgtagaccgatcaagaacctcaacaacaatggccttgaaaaagaagttgaaagataagatggctgaatttcagaacctaagggaaactatccaccaagagtatcgagatgttgttgatagacgtgtttttacagtgactggtgcaagagcagatgaagagacgattgacagattgattgaaactggagatagtgaacaaattttccagaaagcaattcaagagcaaggccgaggccagataatggatactctggcagaaattcaagagcgccatgatgctgttagagatttggagaggaagcttctggatttgcagcaggtttttctggatatggcagtcttggtggatgcacaaggggaaatgctcgacaacatagaatcacaggtctcgagtgctgtggatcatgtgcagtcggggaatactgctctccaaaaggccaagaagttgcaaaggaactccaggaaatggatgtgcattgctatcatcatccttctaatcatcgttgtaatcatcgttgttgctgtgatcaagccatggaataacaacaagggtgcttagcatcttcactatttgtatattgtataaatgagtgagcatcaacttctatacctctttcggcaatttctattattttgcagcttattttatgaactcagcttct

SEQ ID NO: 4813 - DNA, 1515 bp, Ricinus communis
ttcccgcaccataatctgaaaacaggaaacttttagaattgatctaagaaaatacaacgtccattcgattacattcaagaagggaaccgcaaaagtctgacggctgagatctatgtaacctatacactctgctgtactcaataaactccccaatagattaaattaagacctggtttttgaaaaaaaaagaaaaccaggtccaattcaatcccttccacacctcatcagaaagttctcctcttttttcagcatttgatccttgtttcttcttcgttccctaatttgagcagttaaggagaaaggagtgtcctttgagctgcatctccaacaatgaacgaccttttatcagaatcctttgagatccctcgtggtcagggctctagaggcggagatattgagatgggaatgaattctggagatttgggcttggaaaatttctttaaaaatgttcaaggtattgagaaagaaaatgagaagctagacaggctactcaaaaaactccaggatgcccatgaggaaacaaaggcagtgaccagagctcctgctatgagagcaatcaggcaacgaatggacaaagatgttgatgaagttggaaaaattgctcgtacagtgaagtcaaagattgaggaacttgatagagagaatatatcgaataggcagaagccaggatgcggaaaaggaacaggtgtagaccgatcaagaacctcaacaacaatggccttgaaaaagaagttgaaagataagatggctgaatttcagaacctaagggaaactatccaccaagagtatcgagatgttgttgatagacgtgtttttacagtgactggtgcaagagcagatgaagagacgattgacagattgattgaaactggagatagtgaacaaattttccagaaagcaattcaagagcaaggccgaggccagataatggatactctggcagaaattcaagagcgccatgatgctgttagagatttggagaggaagcttctggatttgcagcaggtttttctggatatggcagtcttggtggatgcacaaggggaaatgctcgacaacatagaatcacaggtctcgagtgctgtggatcatgtgcagtcggggaatactgctctccaaaaggccaagaagttgcaaaggaactccaggaaatggatgtgcattgctatcatcatccttctaatcatcgttgtaatcatcgttgttgctgtgatcaagccatggaataacaacaagggtgcttagcatcttcactatttgtatattgtataaatgagtgagcatcaacttctatacctctttcggcaatttctattattttgcagcttattttatgaactcagcttctgtcccactaattctatgacaagcttggttgcgagtctattactttccataattatatgtatttattcttttgttatgcaagaaaataaagctaaagaaaagtttgtttatttttgcttgatatctgaaaggatattgttgttctgtgcttgtgagaattctttaccc

SEQ ID NO: 4814 - DNA, 1294 bp, Fragaria vesca
tttggtcgctgcttccctctgggtctcttctcctcttgtgcgtaagtgacctggtctccttcaggtcctcacgacgggcaggggagggagtccttttctcaatcttcttgtttgcgttttcagctcacaatgaacgacctcctcacggattcttttgagatccctcggggtcaacctcctagaaatggagatattgaactaggaacaggatcaacagatatcacaatgaattctggagaacttggtttggaaaatttctttaaaaaggttcaagagattgagaaacaaaatgagaagctagataagcttctcagaaagctccaggatgcacatgaggagaccaagacagtgactaaggccccttccatgaaagccattaaaaagcgaatggagaaagatgtagatgaagttggaaaaattgctcgctttataaagtcaaaaattgaagaactagacagagagaatttagcaaataggcagaaacctgggtgcgggaaaggaactggtgttgatcgatcgcgaacagcaacaactcttgctttgaaaaagaaattaaagaacaagatgtcagaatttcagactctaagagaaatcattcatcaagagtatcgggaggttgtagagaggcgagtttttacagtgacgggcacaagagctgatgaagagacaattgagagattaattgagactggagacagcgaacagattttccaaaaggcaatccatgaacaagggcgaggccagataacggacactctagcagaaattcaagagcgccatgatgctgttagagaccttgagaagaagcttcttgatttgcagcagatatttcttgatatggctgtgttggtggatgcacaaggggaattgcttgacaacattgaaactcaagtatcaagtgcagttgatcatgtacagcaagggaatactgctctgcacaaggctaagaagctacagaagaattctaggaaatggatgtgcattgcgatcctcattcttcttatcattgtcgtaatcattgtggttgccgtgttgaagccatggagtagcaacaatggtgcttaaccctgccaatttatgattgatggattgaatatagcgaatttgaagcagacaccactgagactgaagcggtgaactcctcaaattatttgaatcttataatttaggttctgtgatgcactcattctaataatattaattggaagaatctgtcatctacaatttacatatagtatgaacacccaactggtaataaacttgtttagatttaattcatatttcacagaattga

SEQ ID NO: 4815 - DNA, 1456 bp, Citrus clementina
ctctttttgtttcaagcttcgacacgaaaatcacgaaactttttcattcttcatttccttttctctctcgaaaggaaccctaaaaaagacctggtttttaaattattattaaccaggtcttaatatctaatggtaataataattttgaatttgaaaaaaagcagcaacactattacaaattttaattttagatctcatctcattgtaagctaatatatttcgtttggtcattcatcgcataaagcttctctagaggttcttcgtcaagcttctcgacaatgaacgacctattagggggttcttttgagctccctcgggatcaaagctccagaggtggagatattgagttaggagcgcaaatgaattctggagaacttggcttggaaaatttctttaaaaaggttcaagatattgacaaagaatatgagaagttggagaaactactcaaaaagctacagggtgcacatgaggagtcaaagtctgtaaccaaggctcctgccatgaaagcaatcaagaagcgaatggagaaagatgttgatgaagttgggaaaatttctcgtttcataaagtcgaagattgaagaactggatagagagaatttaacaagtaggcagaagcctggctgtggaaaaggaacaggagtagatcgatcaagaacagcaacgactcttggcttgaaaaagaagttcaaagacaaaatgggtgaatttcaggttctaagggaaaacatccatcaagagtatcgagaggtggtggagaggcgagtttatacagtaaccggcaaaagggctgatgaagagacaattgaccaattgattgagaccggggacagtgaacagatattccagaaagcaatccaagaacaaggtcgaggccagataatggacactctggctgaaattcaagaacgccatgatgctgttagagatttggaaaggaagcttcttgagttacaacagatctttctggatatggcggtgttggtagatgcacagggagacatgctggacaatatagaatctcaggtgtcaagtgctgtagatcacgtgcagtcaggcaatactgccctccaaaaggcgaaaaagctacagaagaactccaggaaatggatgtgcattgccatcatcatccttctcattattgttgcaatcatagttgttgcggtgatcaagccatggagtagcaacaaaggtgcttagctgctggacatttgtttgtatagatatgagtggtcaatggtcatttgccttttctttacccttcctgccaatttctgtgattcgagttccatgttccgattctgtagctctttcattccctccctcgcccttttctgatcaagtcaactctgtgtcatgccattttaaccgaagtatatatttctatattctttgacatactttatgtaacatttgaatttgtttggctttgaaaatgaatcgtttcatatcagtga

SEQ ID NO: 4816 - DNA, 1451 bp, Gossypium hirsutum
gagtattagctgcttcacacactttcccaactcccaaacagatctctctctctctctccccttattttctcttccttttctctctggaaaatcactgaagaaaaaaaacccttggaaccctagaaatagacctggttttaaatttgaaaccagttcatagacttatagtgaatgtttagtattaaaattaatcacattttcgtttagtgttttttttagatctcttgataatttgctttctttaggtttctttttctttcagttttggtttttatctttgaagcttcgtcgagccttttattcatctttccacaatgaacgaccttctatcggattcatttgagatccctagaggtcaaggtcaaggatctcatggtggggatatcgaattaggagctcaagcaaatgcagatgaactaggccttcaaaatttctttaaaaaggttcaagagatagataaacaatatgagaagctggacaagctactcaaaaagcttcaggatgcacatgaggaatcaaaagcagtgactaaggctcctgccatgaaatctattaagcagcgaatggaaaaagatgttgatgaagttggaaaaatatctcgttttgtaaaggggaaaattgacgaattggaccgagagaatttagccaataggcaaaagcctggatgcggaaaaggaacaggtgtagaccggtcaaggacgtcaacaactcttgctgtgaaaaagaagttgagggacaaaatggctgaatttcagactctgagggaaaccatccatcaagagtatcgggatgttgttgagagacgtgttttcacagtgacgggcactaggcctgatgaagagacaattgaaaaattgattgatactggagatagcgaacaaatattccagaaagcaattcaggagcagggacgaggccggataatggacaccgtatctgaaattcacgagcgccatgaagcagttagagatttggagaaaaagcttcttgatctacaacagatatttttggacatggcggttctggttgatgcacaaggagacatgcttgacaacatagaatctcaggtctcaagtgcagtagatcacgtgcagtcagggaataccgctctccaaagagccaagagcttgcagaagaactctaggaagtggatgtgcattgctattatcatccttctcctaattgttgtaattatcgtcgttgcggtgatcaagccctggagcagtaacaaaggtgcttagattgtgtcttcaatatgttatatataatctttatatacatacacacattataggaattccatcaattattgttatatcggccgttggtgtgaataatttgaggtctatattacgaactccgatcgtctttgtttggtttgattactgtgatgatggaagtttgaaaaatattatgttcttttgatatcatggttcgtggttgatttgcaa

SEQ ID NO: 4817 - DNA, 1441 bp, Gossypium raimondii
ctgagtattagctgcttcacacactttcccaactcccaaacagatctctctctccttattttctcttccttttctctctggaaaatcactgaagaaaaaaggcccttggaaccctagaaatagacctatagtgaatgtttagtattaaaattaatcacatttttgtttagtgttttttttagatctcttgataatttgctttctttaggtttcttttttcttttcagtttttggtttcttatctttgaagcttcgtctagcctttattcatctttccacaatgaacgaccttctatcggattcatttgagatccctagaggtcaaggtcaaggatctcatggtggggatatcgaattaggagctcaagcaaatgcagatgaactaggccttcaaaatttctttaaaaaggttcaagagatagataaacaatatgagaagctggacaagctactcaaaaagcttcaggatgcacatgaggaatcaaaagcagtgactaaggctcctgccatgaaatctattaagcagcgaatggaaaaagatgttgatgaagttggaaaaatatctcgttttgtaaaggggaaaattgacgaattggaccgagagaatttagcgaataggcagaagcctggatgcggaaaaggaacaggtgtagaccggtcaaggacgtcaacaactcttgctgtgaaaaagaagttgagggacaaaatggctgaatttcagactctgagggaaaccatccatcaagagtatcgggatgttgttgagagacgtgttttcacagtgacgggcactaggcctgatgaagagacaattgaaaaattgattgatactggagatagtgaacaaatattccagaaagcaattcaggagcagggacgaggccggataatggacaccgtatctgaaattcatgagcgccatgaagcagttagagatttggagaaaaagcttcttgatctacaacagatatttttggacatggcggttctggttgatgcacaaggagacatgcttgacaacatagaatctcaggtctcaagtgcagtagatcacgtgcagtcagggaataccgctctccaaagagctaagagcttgcagaagaactctaggaagtggatgtgcattgctattatcatccttctcctaattgttgtaattatcgtcgttgcggtgatcaagccctggagcagtaacaaaggtgcttagattgtgtcttcaatatgttatatataatctttatatacatacacacattataggaattccatcaattattgttatatcggccgttggtgtgaataatttgaggtctatattacgaactccgatcgtctttgtttggtttgattactgtgatgatggaagtttgaaaaatattatgttcttttgatatcatggttcgtggttgatttgcaatatagatgtgttttcaattttcat

SEQ ID NO: 4818 - DNA, 1199 bp, Olea europaea
agtggaagaatagagtgccaggaaaatcaaaaccttcagtaacagatttcgaattctagcttcttcaattgctccaaaatgaacgaccttttaaaggattcatttgagattccacgggatcaatcttctaagaatggagatattgaaatgggaacacagattgctcaaaattctggagatttaggcttggacaatttctttaagcaggttcaagagattgaaaaacattctgaaaaactcaataagctactcaaaaagcttcaggatgctcatgaggaatccaaggccataactaaggctgctgctatgaaagcaatcaagaaacgaatggaaaaggatgtcgatgaagttggaaaaattgcccgccttattaaatcaaaaattgaggaacttgacaaagagaatttagctaacagacaaaagcctggatgtggaaaaggatcaggggtagacagatcaagaactgcaactacagttgccatgaagaagaagttcaaagacaagatgtctgaatttcagactttaagagaaagcatccatcaagagtatcgcgaagtagtcgagaggcgtgtattcacagtgacgggaaatcgagctgatgaagagacaattgatagattaatagagactggggacagcgaacagattttccataaagcaattcaagaacaagggcgaggccagataatggacacgcttgcagaaattcaagagcgtcatgatgccgttagagatttagagaagaagcttctagacttgcaacagatattcatggacatggcagtattagtggatgctcaaggagatatgctcgacaatattgaatcacaggtttcatctgcggtcgaccatgtgcaatccggtaacaccgcgcttcaaaaagcaaaaagtttacagaaaaactcgaggaaatggatgtgcattgcaatcctcattctccttattatcgtggcaataatcgttgtgggtgtactgaagccatggcagaacaataatggtgcttagctattaccacaccatgtattatatcaacacaaaaaggatgctaaatggaattgttttcctacttacacttcatcttcattctcgaggtcaattcgtttaaatttgtttgagtgtgagtggaaccaattatatttatatatgacactctatttgtaagtgtaatgttctatcttaaaaagtatgcacattgtctt

SEQ ID NO: 4819 - DNA, 1469 bp, Cucurbita pepo
tgatctgtcgctctctttctttttctcaatctgttgctgttctaaattttgaacctcgacgacgaattctctgcttcaggaacattgaaagctcggttcctttcgccatttctttccctctcgaagatttcattctcgcacttttttctctctggtttccgagcttccttccataatgaacgatcttctttcggattcctttgagatccctcggggtcagccttctagaggaggagacattgagcttggaacaaatgctcctacaagtgcaggagatctggggttggatgatttctttaaaaaggtccaagatattgaaaacagaatgagaagctggacaggttattgcgaaagctccaggattcacacgaggagtccaaagctgtgactaaagctccagcaatgaaagcaatcaagcagcgaatggaaaaggatgttgatgaagttggaaaagttgcacgttttgtgaagagcaaggtcgaagaacttgacaaggagaatctggcaaataggcagaagcctggatgtggtaaaggatcaggtgtagatagatcaagaacagcaactactcttgccttaaaaaagaagttgaaagacaagatgactgagttccagattttgcgggaaaaagttcatcaagagtatcgggaggttgttgagagacgggttttcacagtcacgggcgctagggctgacgaagagaccatcgagaaattaatcgaaactggggatagcgaacaaatttttcagaaggcaattcaagaacaagggcgaggacaggtaatggacactctagctgaaattcaagagcgtcacagcgcagttagagaactggagaggaagttactcgagctacagcaggtatttctggacatggctgttttggtagatgcacagggggatatgctcgacaatatcgaatcacatgttacaagtgcagtagatcatgtgcaacaagggaacactgcacttcaaaaggcaaagaagcttcaaaagaattcaaggaaatggatgtgcattgccataataatccttctaatcattgttgtggtggtagtagtgggagtcctaaagccatggaatagtggtaagggtgcgtaagtggtctccatcatcatatcatctctctgttatatcatttctcaaaggatttgttgtacctctacctctacctctgcctggacctgcaatttgtgttgttgatccattttttggaacaaggcttgtaggtgtgtgtgttatattgtttgcaagaagaagcatatacaaatatatgtgagtatattctttatatcttcacacaaaacgcccatctgcttcagctttctctgaaattatacaccttttcttttcatgttcagttcattcaatcaaggaacccattatgagctatatttgaaagaactgttaatttcatggttatgcactatgtgatgccaatattgggatgatatcaggaacggcttctt

SEQ ID NO: 4820 - DNA, 1269 bp, Tripterygium wilfordii
aggtcttgcataaattttctgcaacaacaattagatccgaaagctttccttttttggcccctttagtgccgaatttcagaatatctggaagatttctctcgcgaggtcctttgagctccgtcttcgacgatgaacgaccttttagtcggattcttttgtagatccctcggggtcaaccctctagaagtggagatattgagatgggagctaatgctccaatgaattctggagatctaggcttggaagattttttcaaaaaggtccaagagatcgagaagcaaaatgagaagcttgataagctacttaagaagctccaggatgctcatgagcagtcaaaggctgtgacaaaggctcctgccatgaaagctatcaaacagcgaatggagaaagatgttgatgaagttgggaaagttgcccgtcttattaaaacaaaaatcgagcagcttgacaaagagaatttgacaaataggcagaagcctggatgtggaaaaggaacaggggtagaccgctcgagaacggtgacaaccattgctttaaagaagaagttcaaagacaagatggatgaatttcagactttaagggagaatattcaacaagagtaccgggaggttgttgagaggcgtgtttttacagtgacgggcacaagagctgatgaagagacagttgatagattgatcgagactggagacagcgagcaaattttccagaaagcaattcatgagcaagggcgaggccaggtagtggacactgtagcagaaattcaagagcgccatgatgctgttagagatttggagaaaaggcttcttgagctacaacagattttcatggacatggctgttttggtggacgcacaaggagatatgcttgacaatatagaatcgcaggtctcgagtgctgtagatcacgtgcagtcaggaaatactgcccttcaaagggcaaagtcactacagaagaactctcggaaatggatgtgcatcgccattatcatccttctcatcatcgttgtaatcatcgttgtggctgtgatcaagccatgggctaagaagaacggtgcttagccggcctgccttctgtacacactataaaaatataagatacgtgtcgaccttcttgaactcatccagcaatctcagttaaattatataccttttgtgtttaaaatcagcttcaattactgtttatttgccaagtgaggatggttgagtgtgtaacattttttcatgggaatgatctgttgtattctttttgtgatatttgagaaacatattt

SEQ ID NO: 4821 - DNA, 1222 bp, Fraxinus spp
agtggaagactagagagccaggaaagcgaaactatcagtaacagatttcgaattctatcttcttcaattgcgccactatgaacgaccttttatcggattcattcgagataccacgggatcaagcttctaggaatggggatattgaaatgggaacacagattgcacaaaattctggagatttaggcttggacaatttctttaagcaggttcaagagattgaaaaacattctgaaaaactcgataagctactcaaaaagcttcaggatgctcatgaggaatccaaggccataactaaggctgctgccatgaaagcaatcaagaaacgaatggaaaaggatgtcgatgaagttggaaaaattgctcgccttattaaatcaaaaattgaggaacttgacagagagaatttagccaacagacaaaagcctggatgtggaaaaggatcaggcgtagacagatcaagaacagcgactacaattgccatgaagaagaagttcaaagacaagatgtctgaatttcagactttacgagaaagcatccatcaagagtatcgcgaagtagtcgagaggcgtgtattcacagtgacgggaaatcgagctgatgaagagacaatcgatagattaatagagacgggggatagtgaacagattttccataaagcaattcaagaacaagggcgaggccagataatggacacgcttgcagaaattcaagagcgtcatgatgccgttagagatttagagaagaagcttctagatttgcaacagatattcatggacatggcagtattggtggatgctcaaggggacatgctcaacaatattgaatcacaggtttcatctgcagtcgaccatgtgcaatccggtaacactgcgcttcagaaagcaaaaagtttacagaaaagctcaaggaaatggatgtgcattgctatcctcattctccttattatcgtcgcaataatcgttgtgggtgtactcaagccatggaagaacaataatggtgcttagctattcaacacaccatgtattatatgaacacaaaaaggatgctaaatggaattgttttcccacttacactgcattttcattcttgtggtcaattcgtttaaatttgtgtgagtgtgagtgtgagttgtgaccagttaaatttttataggactttctatttgtaagtgtaatgttctattttgaaaagtacacgttgtcttctctagtttttacctccg

SEQ ID NO: 4822 - DNA, 1223 bp, Olea europaea
agtagagagacaggaaaatcaaaacactttgtcacagatttcgcactctccatcttcttcaattgctccaatatgaacgaccttttaacggattcgttcgaggtaccgcgggatcaagcttctaggaatggagatattgaaatgggaacacaactcgcacaaaattcaggagatttaggcttggacaacttctttaagcaggttcaagagattgagaaaaattatgaaaaactcgataagctactgaaaaagcttcaggatgctcatgaggaatccaaggccataaccaaggctgctgctatgaaagcaatcaagaaacgaatggagaaggatgttgatgaagttggaaaaattgcccgcctaattaaatcaaaaattgaggaacttgacagagagaatttagccaatagacaaaagcctggatgtggaaaaggatcgggcgttgacagatcaagaacagcaactacagttgccatgaagaagaagttcaaagacaagatgtctgaatttcagactttaagagaaagcatccatcaagagtatcgtgaagtagtcgagaggcgtgtattcacagtgacgggaaatcgagctgatgaagagacaattgataaattaatagagactggggatagcgaacagattttccaaaaagcaattcaagagcaagggcgaggccagataatggacacgcttgcagaaattcaagagcgtcatgatgctgttagagatttagagaagaagcttcttgacttgcaacagatattcatggacatggcagtattggtggatgctcaaggagacatgctcaacaatattgaatcacaggtttcgtctgctgttgaccatgtgcattccgggaataccgcacttcagaaagcaaaaagtttacagaaaaactcgaggaaatggatgtgcattgctattgtcattctccttattattgtcgcaataatcgttgtgggcgtgctcaagccatggcagaacaataatggtgcttagctattcaccacaatttattgtataaacagaaaaatgatgctaaatggaattgttttcctacttacactccattatagctatttcttttattcttgcagtcaatacttttggatttgtgtgtgcgcgcccagtaaagtttatatacaagtttactatttgcaagtgtaacgttatatcttcaaaaatatgctcattgtttgctttaattttttaccttggaggaa

SEQ ID NO: 4823 - DNA, 1354 bp, Gossypium hirsutum
atagacctatagtgaatgtttagtattaaaattaatcacatttttgtttagtgttttttttagatctcttgataatttgctttctttaggtttcttttttcttttcagtttttggtttcttatctttgaagcttcgtctagcctttattcacatttccacaatgaacgaccttctatcggactcatttgagatccctagaggtcaaggtcaaggatctcatggtggggatatcgaattaggagctcaagcaaatgcagatgaactaggccttcaaaatttctttaaaaaggttcaagagatagataaacaatatgagaagctggacaagctactcaaaaagcttcaggatgcacatgaggaatcaaaagcagtgactaaggctcctgccatgaaatctattaagcagcgaacggaaaaagatgttgatgaagttggaaaaatatctcgttttgtaaaggggaaaattgacgaattggaccgagagaatttagcgaataggcagaagcctggatgcggaaaaggaacaggtgtagaccggtcaaggacgtcaacaactcttgctgtgaaaaagaagttgagggacaaaatggctgaatttcagactctgagggaaaccatccatcaagagtatcgggatgttgttgagagacgtgttttcgcagtgacgggcactaggcctgatgaagagacaattgaaaaattgattgatactggagatagtgaacaaatattccagaaagcaattcaggagcagggacgaggccggataatggacaccgtatctgaaattcatgagcgccatgaagcagttagagatttggagaaaaagcttcttgatctacaacagatatttttggacatggcggttctggttgatgcacaaggagacatgcttgacaacatagaatctcaggtctcaagtgcagtagatcacgtgcagtcagggaataccgctctccaaagagctaagagcttgcagaagaactctaggaagtggatgtgcattgctattatcatccttctcctaattgttgtaattatcgtcgttgcggtgatcaaaccctggagcagtaacaaaggtgcttagattgtgtcttcaatttgttatatataatctttatatgcatacacatcataggaaatccatcaattatattgttatgtcggccgttgatgtgaataatttgaggtctatattacgaactccgattgtccttgtttggtttgattactgtggtgatggaagtttgaaaaatattatgttgttttgatatcatggttcgtggttgatttgcaatatggatgtgttttcaattttcatttttatggtaaaatattaagtttgccttttta

SEQ ID NO: 4824 - DNA, 1452 bp, Triphysaria pusilla
tcttcacgctccgactctatacatctgcgctgtttttcaatagaaacacacacgtctgtctctctcctcgctgtatctttatctctatttgaacccgcgtgccaaaaaaaattccaaatacaaacgaaaataaagttagaggagagagagagatagagagagatagggggaggactaaggagtctttccagggaagacgatcttttttgcctaaacctatatctcctctcatctctcgttaatccgtcaacttcatttgctccaaaatgaatgaccttttgacggattcttttgcggccccacgggaccaagataatagaggtggtgatattgaaatgggaatggagagacaaatgaattcgggagatctagggttggaagatttctttaagcaggttcaagagattgagaaacaatatgaaaaactcaatactctactgagaaagctccaggatgctcacgaggaaaccaaggctgtgacgaaggctgcatctatgaaagcaatcaagaagcggatggagaaggatgttgacgaagttggaaaaattgctcgttctattaaatcaaaaatcgaggaacttgacaaagagaatttagccaatagacaaaagcctgggtgcggaaaagggtcaggtgtagacagatcaagaacatcaacaacagtggctctaaagaagaagtttaaagacagaatgactgaatttcagactttgagagagaatatacatcaagagtatcgtgaagttgtagagagacgtgtattcacagtgacgggcaatcgagctgatgaagagacaattgaccaattaatagagaccggggatagcgagcagatttttcagaaagcaatccgagaacagggccgaggccaggtaatggacactttggcagaaattcaagagcgacatgacgctgttagagatttagagaagaagcttctagatttacaacaaatattcctcgacatggcagtactggtggatgctcaaggggacatgctcgacaacatcgagtcacaggtttcatctgcagtagaccacgtgcagtcggggaacacggcccttcagaaggcaaagagtttgcagaagaactcgagaaaatggatgtgcatcgctataatcatccttctcattattgtagcaatcgtcgttgtgggtgtgcttaagccgtggcagaacaagaacggagcgtaacatatgtaaattaagagcaagggtgctaagtggaaatttgaatgatttaatttccacaaactatggattgactatttccttttttacttgtgcatttagaacgggggtttgtaacccgacttgtgtagccaatttacctgtgtggacttttttttaaccagtgcagatgtgtatctttatgttcctacacatgaactgtggctgattgttgtatacaaatttattggactatgacttattataaatatattattgcatt

SEQ ID NO: 4825 - DNA, 1212 bp, Euphorbia peplus
tgtttgaaattagaaaaacagcaatcctcgtcaaaagcagcagccatcctcagatctctcttctcatttccgtcgctgattttgccacgatgaacgaccttttatctgaatcttttgagatccctcgtggtcaggcttctagaggaggagatattgagatgggaatcacttctgaagataccggattggatacttttttcaaaaaggttcaaactattgagaaacaaaatgacaagctcgacaacctacttaaaaagctgcaggctgcaaatgaagagtcaaaggctgtgactaaagctcctgcaatgaaagccatcaagcagcgaatggagaaagatgttgatgaagttgggaaaattgctcggtcattaaagtcaaagattgaggaacttgacagagagaacttagcaaatagacagaagccaggatgtggtaagggaacagccgtagaccgatcaagaacctcgacaacaatggccttgaaaaagaagttcaaagataagatgggtgaatttcagaatttaagggaaactatccatcaagaataccgggaggtagtggagaggcgtgtctttacagtaacgggaacaagagcagatgaagagacagtggaaagattaattgaaaccggagatagtgaacaaattttccagaaagcaattcaggagcaagggcgaggccaggttatggatactctagcagaaattcaagagcgccatgatgctgtcagagatttggagaggaaacttttggaattacaacaggtgttcctggatatggcagttttggtggactcacaaggggaaatacttgacaacatagaatcacaggtatcaagtgcagtagatcatgtgcagtcaggaaatacagcacttcaaagagcaaagaagttgcaaaagaattcgaggaaatggatgtgtattgctatcataatcctcctaattattgtcgcaatcatcgttgttgctgttatcaagccatggaatagcaacaagggtgcttagcttagcctaatctcactctcactccgtcttctttgcgctctgtttgtatattatatttatatttatatataatgttgagttgtgcatcattttttcaaaaatttatccggctatcttctgttttctataaattcatagaccaattttgatctgttttcttctgttgagccttcttgtgtaatagtttgtaatatttgcctcatgtttg

SEQ ID NO: 4826 - DNA, 1357 bp, Echinacea purpurea
cggccggggggaatctctctataccctgctgtatctatacattctctctctaccccacctcaataaacccaaacccagacctaaacccaaaccaatttgagtttccacaaatcaaagatacagaaaacccctcgtcttgataacaagatctagcctcaatccgccatgaacgatcttttatctgaatcatttgagaaccctcggggtcaagatcatggctatggagatcttgaaatgggaacacaacgtaatgcggattctggagagtcaggattggatgattttttcaagaaggttcaagccattgagaaacaatatgagaagctaaataaactactaaagaaattacaggatgctcatgaggaatcaaaggctgtaaccaaagctgctgccatgaaagcaataaagcagcgtatggagaaagatgtggatgaagttggaaagattgcgcggtttattaaatcaaaaattgaagaacttgacaaagagaatttggccaacagacagaagcctgggtgtggaaaaggaacgggagttgaccgatcaagaacctcaactacactttctttgaagaaaaagtttaaagacaagatgactgaatttcagactctaagagaaagcatccatcaagagcatcgtgaggtggtggagaggcgtgtctatacagtgaccggaacaagggccgatgaagagacaattgatcggctcatagagacaggtgacagtgagcagatatttcagaaagcaattcaggaacaggggcgaggacaggtacttgacaccctggcagaaatccaagaacgccatgatgcagtaagagaagtagaaaggaagcttcttgatttgcaacagatatttatggatatggctgtattggtggatgctcaaggggaaatgctagacaacatagagacacaggtgtcgagtgcagtagaccatgtgcaggacgggaacaaagccttacacaaggcgaaaagtctacaaaagaactccaggaagtggatgtgcattgcaatcttgattttacttgtaattattgcagttgttgtcgtcggtgtgctcaagccatggaaaagtggtaacggggcgtagtaaatccgtgtattgtggttgcatcgcgtatttgagtgagaagtcttgttcaggagtacgtgagttgtggtctttacaaaacattctatgtctattcttgtgtaaattgagatcctttttacttgttgaccttcaggtcgtctctagatgccattgactctgattgctcttacattctctccatctttgacttttctatttatttattttgtttaatgacatcttgttattgtagtgagaagaaatgaaaatgtgttttctatct

SEQ ID NO: 4827 - DNA, 1276 bp, Flaveria ramosissima
gtcaccaatattctctctctctcttcaccctgttcatcatccttctaaacccaaacctaaacccaaatcatcaatttgagtttcccaaaatcaaagatacacgaaacccatcttcttcagaacaagatctacctttagtccaccatgaacgatcttttatctgaatcatttgagaatcctcggggtcaagataatggctatggagatcttgaaatgggaacacaacgtaatgctgattctggagagttagggttggatgattttttcaagaaggttcaagcaattgagaaacaatatgagaagctaaataaactactaaagaaattacaggatgctcatgaggaatcaagggctgtgaccaaagctgctgctatgaaagcaatcaagcaacgtatggagaaagacgtggacgaagttgggaagattgcacgatttattaaatcgaaaatcgaagaacttgacaaggagaatttggccaacagacagaagcctgggtgtggaaaaggaactggagtagaccgatcgagaactgcaactacactttccttgaagaaaaagtttaaagacaagatgtctgaatttcagactcttagagaaagcatccatcaagagcatcgtgaggtggtggagaggcgtgtctatacagtgacgggaactagggctgatgaagagactatcgatcgactcatagagacaggtgatagtgaacagatttttcagaaagcaattcgggaacaggggcgaggacaggtacttgacaccctggcagagatccaagaacgccatgatgcagtaagagaagtagaaaggaagcttcttgatttgcaacagatatttatggatatggctgtattggtggatgctcaaggggaaatgctagacaacatagagacacaggtgtcgagtgcagtagaccatgtgcaggatgggaacaaagccttgcacaaggcgaaaagtctacaaaagaactcaaggaagtggatgtgcattgcaatcttgatattactcattattattgcagtcgttgtggtcggtgtgcttaagccatggaagagcggaaatggtgcttagtaaatccatgtattgtggttgcatcgcgtatttgagtgtgaggtcttgttcaggagcacgcgatggtctttacaaaacattctatgccttattcttgtgtaaattaagttccttttttgttgttgttgttgaccttcaacatgtctcttatgccattgactctgcttgctcttacattctctccatgtttgacttttatttattt

SEQ ID NO: 4828 - DNA, 1479 bp, Citrullus lanatus
aaagtacattataagggaaaggaccttcgtttccgctctgtctctgatctgtcgctctctctctctctttgttgctgttccaaattttgaacctcaacgacggattctctctgtttcaggagcattgaaagctctgttcctgtagccatttctttccctcttggagctttcatcctcacacatttctctgcctgacttccgagctcgcttccataatgaacgatcttctttcggattcgtttgagatccctcggggtcaaccttctagaggaggagacattgagctaggaacaaatgttcctactagtggaggggatggcttggaggatttctttaaaaaggttcaagagattgaaaaacagaacgagaagctggataggctattgagaaagctccaggattcacatgaggagtccaaagctgtgactaaagctccagcaatgaaagcaatcaagcagcggatggaaaaagatgtcgatgaagttggaaaagttgcacgttttgtgaagatcaaagtcgaagaacttgacagagagaatctggcaaataggcagaggcccgggtgtggaaaaggatcaggtgtagatagatcaagaacagcaactactctttccttaaaaaagaagttaaaagacaagatgactgaattccagattttacgggaaaaaatccatcaagagtaccaggaggttgttgagagacgggttttcacagtcacgggcgctagggctgacgaagagaccatcgagaaattaattgaaactggggacagtgaacaaatttttcagaaggcaattcaagaacaagggcgaggacaggtaatggacactctagctgaaattcaagagcgtcacagtgcagttagagaactggagaggaagttactcgagctacagcaggtatttctcgacatggcagtattggtggatgcgcaaggggatatgctcgacaatattgaatcacatgttacaagtgcagtagatcatgtgcaacaagggaatactgctcttcaaaaggcaaagaagctgcaaaagaattctaggaaatggatgtgcattgccatcataatccttctaatcattgttgtggtcatagtagtgggagtccttaagccatggaataatggtaagggtgcctaagtgcccatcatctgtctgtataaatatatatcatttcaaaggatttgtacctctgccttgacctacaatttgtgttgattttgtgatccatttttggaacaaagatgctaggtgtgtgtcatattgttttcaagatgaagcatatataaatatatatgagcatattctttatatcttcaacaaaatgcccatctacttgagcattctgtgacattaaacactttttccaagttcagttcatggacctctcttttctctcaattaagaggtttcagcttgagatgtttgtgaaataactgtaccttcattgttatgcagtatgtgttgggaatattgggat

SEQ ID NO: 4829 - DNA, 1024 bp, Ambrosia trifida
tcaaattataagaaaaaccctacgtcttgataacaagatctactctcaatccaccatgaacgatcttttatctgaatcatttgataatcctcggggtcaagatcatggctatggagatcttgaaatgggaacacaacgtaatgccgattctggagagttagggttagatgattttttcaagaaggttcaagccattgagaaacaatacgaaaagctaaataaattactaaagaaattacaggatgctcatgaggaatcacgggctgtaaccaaagctgctgctatgaaagcaatcaagcagcgtatggagaaagacgtggatgaagttggaaagattgcgcggtttattaaagcaaaaattgaagaacttgacaaggagaacttggctaatagacagaagcccgggtgtggaaaaggaacgggagttgaccgatcaagaaccgcaactacagtttctttaaagaaaaagttcaaagacaagatgactgaatttcagactttaagagaaagcattcatcaagaacatcgcgaggtggtggagaggcgtgtctatacagtgacgggaaccagagccgatgaagagacaatagatcggctcattgagacaggtgatagtgaacagatatttcaaaaagctattcgggaacagggtcgagggcaggtacttgacaccttggcagagatacaagagcgccatgaggcagtaagagaagtagaaaggaagcttcatgatttgcaacagatatttatggatatggctgtactggttgatgctcaaggcgaaatgctagacaacatagagacacaggtgtcgagtgcagtagaccatgtgcaggatgggaacaaggccttacacaaggcgaaaagtctacaaaagaactcaaggaagtggatgtgcattgcaatcttgattttacttgtaattatagcagtcgttgtggtcggtgtgctgaagccatggaaaaacggaaatggtgcttagtaaatcagtgtattgtggttgcatcgcgtatttgagtgagag

SEQ ID NO: 4830 - DNA, 2096 bp, Zea mays
ctcgccatcgctagtctcaaaccacaaccctagagaagaagaagagagagagaaagggagatggtggggctgcagtacgatctcgtcgggaacccattgggcgcggtgcgcgccaccttcgagaggacggccgccgccgctgcagcgcagtctggaggagctgaccctgtggcggcgttccgtggcaaagactggggcgccggtgacctcttccgctccttcctcttcgagcaagacggtcttggcaaggttccggtgttggattcgtcaaatcttggattgatcaaaccgaacaccctggtccggtatcggggaatggttcaggatatgcttgggaatgagtactacattggtgctttcaaggatgggtcaacttggaggacaaacaagtacactgacttctcaccgtactcaatgccgcatccttgtgattcacatctttgggagcgccatctcttccactgtgtgcctgcacctggacaaaattcttggacactggagtcttcaccaggacctgatgtctgcaggatgtcgaactgtttggcacctgaactaagagagaaaaggaagagagatggagatgacgatgccatggatgtttcagaaaatggccatggcaattcttcattctgcaagaagccgaaggaaggtgatgttcatgtctcttccagttcaactgaagtggcaggaaccattccagagatgaatggaggcgatcatcatatacctggaagctccttttcatgtctagtgaagatctatgacatgcctgatagtcaagtgaaattaaatgatgttattgagtttattggcgtatatacatttgacccagaacttgctgctcctagtgacaacccagatgatataatgttagacctcatcgaagatgtaacagttcagttgcctccgagcaaggtgccacgtcttcactgtttggtatggagaaaattatcattccatgattttatttcaaggcctgttgttgagccttcacccagcctgttaagaggcattcggcaatctttgctctcacacctcacccttgtattaggcaatgacgagcttgcagcccagtgcttgctgttgcatcttctatccagacttcgtaatagggtggatgtggtcaccgttggcagactctccttgaatttcactggcttcaacagggaaagtgcttccatatttgggaatcagctgtattctttgatccagaaattggtgccgtattcacaagccatacctctgtcaattgagtatctcaacacagctacacttcaacctagaaaggacaacaagtcaggaaggttggtcacaggagttctgcagctacctcaaggcactcatctgatctttgatgagactcttctgcagacaggatcattgacatccaaaggtgtggagaataccatgctgctcaagaacctgatggagtcgcagaaggttgactacgattttgagtactacaagctggaaatggcagctgatgtgcagctactcactctctctgaggggaaatcaaacatccttccttcagatttggtagtgcctttccggccatcctctgttcccacagttaatgcaggtgctgaggaaactgagagctggaggtggtttttgaccacagtaaggtctcttcctcagtccactgaacctgaaacttaccagatgattcaggatgaaatggtcagtgccatgcgtgatgataggagcttgggttgttctgaacttagcagatggctaacaatggcacaaataatggcctccagctttggcgagaagagtctttctttggagcactggcagatggtgaaggagcttgagaggcttagaaagcagaggatgcaatgagaatgactcatcattagcatgtgtttttgcactctaattgtttatgttggtatgctgttatgtgtatagtactagacgtttgaatcaagacatggatctaaggcatttctgtaacaactgacaacttttatgatcctatgcatgtcagcatgtgtatctgctgctcattttctttgctcaaatttgagatttactctgggaactatggaatgccaatgtcagacctgtgatttcaggattgtaatgct

SEQ ID NO: 4831 - DNA, 2185 bp, Setaria italica
ctatccacctccccgccattgctcccgactcccaagtccaaaactccaacgtgagagaagaagagaaaggagatggtggggccgcagtacgacctcgtcgggaacccactgggagcggtgcgcgccaccttcgagcggacggcggccgccgccgccgcggagtccggaggaagcgatccagtggcggcgttccgggggaaggactggggtgcctgcgacctcttccgctcctttctgctcgaggaagacgggctcgacaaggttccggtgttgaatgcttcaaatcttggattgatcaaaccaaacaccctcgtccggtacaggggaatggttcaggacatgcttgggaatgagtactacattggtgcattcaaggatgggtcgacttggaggacaaacaagttcactgatttctcaccgttctcaatgccacatccttgtgattctcacctttgggagcgtcatctctttcactgtgtgcctgcgcctggacaaaattcttggacaatggagtcttcaccaggacctgatctgcgcaggatgtcaagctgcttggcaactgaattaagagagaaaaggaaaagagatggagataaagatgatatggatgtttcagaaaatggacatgaagagtcttctgcgctctgcaagaagccgaaggaagatgatgttcatgtctcatccggttcaaatgaagtggcagaaggtgtgccagagatgaataggggtgatcatatacctggaagctccttttcatgtctagtgaaggtctatgacatgcctgatagccaggtgaagctaaatgatgttattgagttcattggtgtatatacatttgacccagaacttgctgctcctagtgataacccagacgatataatgttagacctcatagaagatgtaatagttcaattgcctccgagcaaggtgccccgacttcattgtttggtatggagaaaattatcacctcatgactttatttcaaggcctcctgttgttgagccttcacctagcatattaaaaggcatccgacagtctttgctctcacacctcactctggtgttaggaaacgatgaacttgcagcccagtgcttgctgttgcatcttctatccagacttcgcaatagggtggatttggttactgttggtagactctccttgaatttcactggctttaacagggaaagtgcttccatatttgggaatcaactgtattctttgatccagaaattggtgccatattcacaagccatccctatgtcaatagagtatctgaacacagccacgcttcaacctagaaaggacaacaaatcaggaaggttggtcacaggagttctgcagctacctcaaggctcccatctgacctttgatgagacccttttacagacaggatcattgacgtctaaaggtgtggaaaataccatgctgctcaagaatttaatggagtcacagaaggtcgactatgattttgagtactacaagctggatatggcaactgatgtgcagctacttactctctctgagggaaaatcaaacattcttccttcagacttggtggtgccttttcgtccatcctccgttcccacgattgatgcaggttctgaggaacttgagaattggagatggtatttggccacagttaggtctcttcctcagtccactgaacctgagacttaccagatgattcaagatgaaatggtcagtgccatgcgcgatgataggagcttgggttgttctgaacttagcagatggctaacaatggcacaaataatggcctcaagcttcggcgagaagagtctttctttggagcactggcagatggtgaaggagcttgagaggcttagaaagcagaggctgcaatgagattgaagccgcatttgcatttgtttttacaccacttgctgtggtggtatgctgtgatgtgtatagtactaggttgtgtgaatcaagacttggatagtttggatggtgccatggtgggacttctgtaacagctgtcgtcctatgcgagctatttgatcacttgttctcaagtttatgccacgcatattctcctgcacaaatttgaagtttacttctgggatgtcactgccggtgccagatctgtaatttcaactttagaattatcgtagcctgaatgctaaattgtcatgaatgggctacataacataatggagattttgaa

SEQ ID NO: 4832 - DNA, 2165 bp, Setaria italica
cacctccccgccattgctcccgactcccaagtccaaaactccaacgtgagagaagaagagaaaggagatggtggggccgcagtacgacctcgtcgggaacccactgggagcggtgcgcgccaccttcgagcggacggcggccgccgccgccgcggagtccggaggaagcgatccagtggcggcgttccgggggaaggactggggtgcctgcgacctcttccgctcctttctgctcgaggaagacgggctcgacaaggttccggtgttgaatgcttcaaatcttggattgatcaaaccaaacaccctcgtccggtacaggggaatggttcaggacatgcttgggaatgagtactacattggtgcattcaaggatgggtcgacttggaggacaaacaagttcactgatttctcaccgttctcaatgccacatccttgtgattctcacctttgggagcgtcatctctttcactgtgtgcctgcgcctggacaaaattcttggacaatggagtcttcaccaggacctgatctgcgcaggatgtcaagctgcttggcaactgaattaagagagaaaaggaaaagagatggagataaagatgatatggatgtttcagaaaatggacatgaagagtcttctgcgctctgcaagaagccgaaggaagatgatgttcatgtctcatccggttcaaatgaagtggcagaaggtgtgccagagatgaataggggtgatcatatacctggaagctccttttcatgtctagtgaaggtctatgacatgcctgatagccaggtgaagctaaatgatgttattgagttcattggtgtatatacatttgacccagaacttgctgctcctagtgataacccagacgatataatgttagacctcatagaagatgtaatagttcaattgcctccgagcaaggtgccccgacttcattgtttggtatggagaaaattatcacctcatgactttatttcaaggcctcctgttgttgagccttcacctagcatattaaaaggcatccgacagtctttgctctcacacctcactctggtgttaggaaacgatgaacttgcagcccagtgcttgctgttgcatcttctatccagacttcgcaatagggtggatttggttactgttggtagactctccttgaatttcactggctttaacagggaaagtgcttccatatttgggaatcaactgtattctttgatccagaaattggtgccatattcacaagccatccctatgtcaatagagtatctgaacacagccacgcttcaacctagaaaggacaacaaatcaggaaggttggtcacaggagttctgcagctacctcaaggctcccatctgacctttgatgagacccttttacagacaggatcattgacgtctaaaggtgtggaaaataccatgctgctcaagaatttaatggagtcacagaaggtcgactatgattttgagtactacaagctggatatggcaactgatgtgcagctacttactctctctgagggaaaatcaaacattcttccttcagacttggtggtgccttttcgtccatcctccgttcccacgattgatgcaggttctgaggaacttgagaattggagatggtatttggccacagttaggtctcttcctcagtccactgaacctgagacttaccagatgattcaagatgaaatggtcagtgccatgcgcgatgataggagcttgggttgttctgaacttagcagatggctaacaatggcacaaataatggcctcaagcttcggcgagaagagtctttctttggagcactggcagatggtgaaggagcttgagaggcttagaaagcagaggctgcaatgagattgaagccgcatttgcatttgtttttacaccacttgctgtggtggtatgctgtgatgtgtatagtactaggttgtgtgaatcaagacttggatagtttggatggtgccatggtgggacttctgtaacagctgtcgtcctatgcgagctatttgatcacttgttctcaagtttatgccacgcatattctcctgcacaaatttgaagtttacttctgggatgtcactgccggtgccagatctgtaatttcaactttagaattatcgtagcctgaatgctaaattgtcatgaatgggctacataacat

SEQ ID NO: 4833 - DNA, 2115 bp, Panicum virgatum
taacaccccacccctctcctctcctcccctcgcctgcccacctccccgcaattgctccccacttccaagtccaaaaccccaaggcgagagaagaagagagagggaggagatggtgggcccgcagtacgaccttgtcgggaatccactgggcgcggtgcgcgccaccttcgagcgagcggcggccgccgccgccgcggagtccggaggaagcgatccagtggcggcgttccggggcaaggactggggtgcctgcgagctcttccgctcctttctgttcgaggaagacggagtcgacaaggttccggtgctgaatgcttcaaatcttggactggtcaaaccaaacacccttgtacgataccggggaatggttcaggatatgcttgggaatgagtactacattggtgcattcaaggatgggtcaacttggaggacaaacaagttcactgatttcccaccgttctcaatgccacatccttgtgatttccatctttgggagcgccatctcttccattgtgtgcctgcgcctggacaaaattcttggacactagagtcttcaccaggacctgatgtgcgcaggatgtcaagctgcttggcaactgaattaagagagaaaaggaagagagatggagataatgatgacatggatgtttcagaaaatgggcatgaagagtctcctttgctctgcaagaaagcgaaggaagatgatgttcatgtctcatccagttcaactgaagtggcagatggtgtgccagagatgaatggtggcgatcatcacatacctggaagctccttttcatgtctagtgaaggtctatgacatgcctgatagtcaggtgaagctaaatgatgttattgagttctttggtgtatatacatttgatccagaacttgctactcctagtgataactcagatgacataatgttagacctcatagaagatgtaacagttcaattgcctccgagcaaggtgcctcgtcttcattgtttggtatggagaaaattatcacctcatgattttatttcaaggtctcctgttgttgagccttcacctagcatactaaaaggcattcgacaatctttgctctcacatcttactctggtgttaggaaatgatgaacttgcagcccagtgtttgctgttgcatcttctatccagacttcgcaatagagtggatgtggttactgttggcagactctcgttgaatttcactggctttaatagggaaagtgcttccatatttgggaatcaaatgtattctttgatccagaaattggtgccatattcgcaaaccatccctatgtcaattgagtacctgaacacagccacacttcaacctagaaaggacaagtcaggaaggttggtcacaggagttctgcaactacctcaaggctctcacctgacctttgacgagactctcttacagacaggatcactgacatctaaaggtgtggaaaataccatgctgctcaagaatttgatggagtcacagaaggtcgactatgattttgagtactacaagctggatatgccaactgatgtgcagctacttactctctctgagggaaaatcaaacatccttccttcagacttggtagtgccttttcgtccatcctccgttcccacgattaatgaaggttctgaggaacttgagaattggagatggtatttggccacagttaggtctcttcctcagtccactgaacctgagacttaccagatgattcaagatgaaatggtcagtgccatgcgcgatgataggagcttgggctgttctgaacttagcagatggctaacaatggcacaaataatagcctcaagcttcggcgagaagagtctttctttggagcactggcagatggtgaaggagcttgagaggcttagaaagcaaagattgtaatgagatgacgccatgttagcatttgtttctacaccacttgctgtggtggtatgctgttgtgtatagtactaggttgtgtgcatcaaaacttggatcaagggatttctataacaagtatgatcctatgcaaactatgtgatgagttattctcaagttcgcatcatgcggtctcttgatcaaatttgaagttctctgggaaccactggcatgtcactgcc

SEQ ID NO: 4834 - DNA, 2147 bp, Secale cereale
tcagcgccattgctcctgcctcctggtctcccagtctcccaactccccaagatccactgccggagaaagacagagaggatggtggggccgcagtacgacctcgtcggcaacccgctgggcgcggtgcgcgccaccttcgagagggcggcggcagccgccgcggcggagtccgggggccgcgacccggtggcggcgttccggtccaaggactggggcgccagcgagatcttccgctccttcctcttcgagcagggcggcctcgacaaggttccgttgttggatgcatcaaatctcggattgatcaagcccaacacccttgttcggttccgggggatggttcaggacatgcttgggaacgagttctatgctggggctttcaaggatgggtctacctggaggacgaacaagttcacagatttctcaccattcacgatgccgcacccgtgtgactcacatctctgggagcgccatctctttcattgtgtgccagtgcctggacagaactcttggacactggagtcttcccccgggcctgacgtgcgccaaatggcaaactgcttgacacctgaacaaagggagaaaaggaagagggatggagatgatgatgccatggatgtttcagaaaatggaaacggcgagagttcttcatgcagcaagaaaccaaaggaagatgacgtccagatcccatctagttcagcggaaatgccagcaagtgaaaatgtgccacagatgaatgggaatgatcatcatattcctggaagctctttttcatgtctagtgaagatctatgatatgcctgaaagtcaagtgaaactaaatgatgttgctgagttcataggggtatacacatttgacccagaacttgctgctcccaatgataattcggatgatataatgtatgatctcatagaagatgtaacagctcagttgcctcccagcaaggtgccccgtcttcactgtttggtattgcgaaaattatcatctgttgattttctagcaaagcatcctgctgttgagccttcgccaagtctactaaaaggcatccggcaatctttgctctcacatctcactctggtattagggaaagatgacctggcagctaactgtttactgctgcatcttctatccagactacgaactagggtggatgtggtcactgttggcaggctctccttgaatttgactggatttaacagagaaagtgtttccattttcggaaaacagctaaatactttgatccagggactaatgccatattcacaagctattcctctgtcaattgagtatctcaacacagccacacttcaacctagaaaggacaacaagtcaggaaggttggttacaggagttctgcagctacctcaaggctctcacttgacatttgatgaaactctcttgcaatctggatctttggcatctaaaggtgttgagaatacggtgctgcttaagaacttgatggagtcacagatggttgagtatgattttgagtactacaagctggagatggcgaccgatgtacagctacttactctctctgagggaaaatcaaacatcctgccttcagacttggtagtaccttttcgtccatccactgtttctgcggtgaatgcaacttctgaggaacttgagagctggaggtggtacttggccacagtgaggtctcttcctcagtcatctgaacctgatatttaccagacgattcaagatgaaatggtcagcgccatgcgtaacgacaggagcttgggttgcactgaacttagcagatggctgacaatggctcagattacagcctcaagctttggtgagaagagcctttccctggagcactggcagatggtgaaggagcttgagaggcttagaaaggagaggatgcaatgagaagacacgtctcatcagcacatggatctgtgaaagtgaaactttagttgtagtaatggcctgctgtgatgtgtatatttctttctactagggtctaaatcatcaagacttggatctgcaccattgtttgtgatccttcctgtgggtgtcatttgacaactcaattatcaagttaagcctgtgtttttgtgtaatgtgctctggtaactatattctgtctggtctttgatggacaactaaatactaactaactaaaaaaaactaagaag

SEQ ID NO: 4835 - DNA, 2294 bp, Hordeum vulgare
tcggcccagtacacgcacccagcccacaggaattggcgggaactggagggagaaacggcgggaagcgccgccgccagtggcgcgaaacccctaaccacttataaccccgctcccctccccgccgcaccacctccccgccattgctcctagcctcccggtctcccaactccccaagaagagcgagatccaccgccagggaaagacagagaggatggtgggcccgcagtacgacctcgtcggcaaccccctgggcgcggtgcgcgccaccttcgagagggcggcggcggccgccgcggcggagtccgggggccgcgacccggtggcggcgttccggtccaaggactggggcgccagcgaggttttccgctccttcctcttcgagcagggcggcctcgacaaggttccagtgctggatgcatcaaacctcggactgatcaaacccaacaccctagttcggttccgggggatggttcaggacatgctcgggaacgagttctacgccggtgctttcaaggatggggctacctggaggacgaacaagttcacagatttctcaccattctccatgccgcacccgtgtgactcgcatctctgggagcgccatctcttccattgtgtgcctgtgcctggacagaattcttggacactggattcttctcctggacctgacttgcgccaaatggtaaactgcttgtcacctgaacaaagggagaaaaggaagagagacggcgatgatgatgccatggatgtctcagaaaatggaaatggcgagagttcttcatgcagcaagaaaccaaaggaagatgacgtccagatcccatctagttcagcagaaatgccagcaagtgaaaacatgccacagatgaatgggaatgatcatcatattcctggaagctccttttcatgtctagtgaagatctatgatatgcctgaaagtcaagtgaaactaaacgatgttgctgagttcataggggtatacacatttgacccagaacttgctgctcccaatgataattcagatgatataatgtatgatctcatagaagatgtaacagctcaattgcctcccagcaaggtgccccgacttcactgtttggtgtggcgaaaattatcatctgttgattttctagcaaagcatcctgccgttgagcctttgccaagtctactaaaaggcatccggcaatctttgctctcacatctcactctggtattagggaaagatgaccttgctgctaactgtctactgctgcatcttctatccagactacgaactagggtggatgtggtcacggttggcaggctctccttgaatttcactggatttaacagggaaagtgtttccatttttggaaaacagctaaatactttgatccagggactaatgccatattcacaagctattcctctgtcaattgagtatctcaacactgccacacttcaacctagaaaggacaacaagtcaggaaggttggttacagcaattctgcagctacctcaaggcactcacttgacatttgatgaaactctcttgcaatctggatctttggcatctaaaggtgttgagaatacggtgctgcttaagaacttgatggagtcacagatggttgagtatgattttgagtactacaagctggagatggccacggatgtgcagctacttactctctcggaggggaaatccaacatcctgccttcagacttggttgtgccttttcgtccatccactgtttctgaggtgaatgcaacttctgaggaacttgagagctggagatggtacttggccacagtgaggtctcttcctcagtcatctgaacctgagatttaccagacgatccaagatgaaatggtcagtgccatgcgcaacgacaggagcttgggttgcactgaacttagcaggtggctaacaatggctcagataacagcctcaagctttggtgagaagagcctttccctggagcactggcagatggtgaaggagcttgagaggcttcgaaaggagaggatgcaatgagaagacacgtctcatcagcacatggatgtgtgaaactctagttgtagtaatggcctgctctgatgtgtatatttccttctaatagggtctaaaatcatcaagacttgggtatgcacaattgtttgtgatccttcctgtgggtgtcatttgacaactcagttatcaagttaagtctgtgttcttgtgaaatgtgctctgataactatattgtgtctggccttgaatggacaactaaatctagttcctcttaactctggagaatcaaggtgatcttaacacttgt

SEQ ID NO: 4836 - DNA, 2073 bp, Lolium multiflorum
ccccgccattgctcccaacctcccagtctcccaagactacagagagaaatccatcaccagagagagagggagaggatggtgggcccacagtacgacctcgtcgggaaccccctgggcgcggtgcgcaccaccttcgagaaggcggcggccgccgccgcggcggagtccggaggccgcgacccggtggcggcgttccggtccaaggactggggtgccagcgaggtcttccgctccttcctcttcgaccaaggcggcatcgacaaggttcccctgttggatgcatcaaatctcggattgatcaaaccgaacaccctcgttcggttccggggaatggttcaggacatgcttggaaatgagttctatgccggggcgttcaaggatggttctacctggaggacgaacaagttcacagatttctcaccgttcgcaatgccgcacccgtgtgattcacatctctgggagcgccatctcttccactgcgtgcctgtgcctgggcagaattcctggacactggagtctacccctggacctgacttgcgccaaatgtcaagctgcatgtcacctgaacaaagggagaaaaggaagagggatggggatgatgatgtcatggatgtttcagaaaatggtaatggcgagagttcatccagtaaaaaaccgaaggaagatggcatccagatctcatctaactcagcagaaatgccagcaactgaagctgtgccagagatgaatgggaatgatcatcatattcctggaagctccttttcatgtcttgtgaagatctatgatatgcctgaaagtcaagtcaagctaaacgatgtggctgagttcataggggtatatacatttgacccagaacttgctgctcccaatgataattcggatgatataatgtttgacctcatagaagatgtaacagctcagctgcctcccagcaaggtgccccgtcttcactgtttggtatggcgaaaattatcatctcaagattttctagcaaagcaacctgttgagcctttaccaagtctactaaaaggcatcagacaatctttgctctcgcatctcactcagctactagggaatgatgaccttgcagctcaatgtttgctgttgcatcttctatccagacttcgtactagggtggatgttgtcaccgttggcaggctctccttgaatttcactggatttaacagagaaagtgcttccatttttggaaaccagctaaatactttgatccagagactagtgccatattcgcaagctattcctctgtcaattgagtatctcaacacaaccacacttcaacctagaaaggataacaagtcaggaaggttggtcacaggagttctgcagctacctcagggcactcacttgacatttgatgagactatcatgcaatctggatctttgacatctaaaggtgttgagaataccatgctgctcaagaacttgatggagtcactgatggttgagtatgattttgagtactacaagctggagatggcaactgatgtgcagatgcttactctctctgaaggaaaatcaaacatcctgccttctgacttggtagtgccttttcgtccatccaccgttcctgcagtgactgcaactcctgaggaacttgagagttggagatggtacttggccacagttaggtctcttcctcagtcaaatgaacctgagattttgcagacgatccaagatgaaatggtcaatgccatgcgtgaagataggagcttgggttgctctgaacttagcagatggctaacaatggcgcagataacagcttcaagctttggtgagaagagcctttcaatggagcactggcagatggtgaaggagctggagaggcttaggaaacagaggatgcaatgagaagatatctcattagcacatgaatgtgcaaactccacttgtggtagtagcctgatgctatgtgtgtatatatctctagtgatccaaatcacaagacatgcatctgcaacattatctgtaatcctatggatgccattggcaacttaatcaagattggcatgtaactttgtcaagtttgctattgtggccatatcctgaattgaa

SEQ ID NO: 4837 - DNA, 2090 bp, Brachypodium distachyon
gcaccacttccccgccattgctcccaaatctcccattcccctaagaagagagagagagaaggagagaggatggttggaccgcagtacgacctcgtcgggaatccgttgggcgcggtgcggtccaccttcgagagggcggcggcggctgccgcggcggagtccgggggccgcgacccggtggcggcgttccgggcgaaagactggggcgccaccgaggtgttccgctccttcctcttcgaccaaggcggcatcgacaaggttccggtgttggacgcatcaaatctcggattgatcaaaccgaacaccctcgttcggttccggggaatggttcaggatatgctcgggagtgagttctatgctggcgctttcaaggatggttctacctggaggacgaacaagttcacagatttctcaccgttcacaatgccgcacccttgcgattcacatctctgggagcgccatctcttgcactgtgtgcctgtgcctggacagaactcttggacaatggagtcttctcccggacctgacttgcgccagatgtcaaactgctcgacatctgaacaaagggacaaaagaaaaagggatggagatgatgatgccatggatgtttcagaaaatggtaatggtgagggttcttcattcagtaagaaaccgaaggaagatggtgtccagggctcatctagttcaccagaaatgccagtgagtgaagatcgcgtgccagagatgaatggggatgatcatcatattcctggaagcttcttttcatgtctagtgaaggtctatgatatgcctgaaagtcaagtgaaactaaacgatgttgctgagttcataggtgtatatacatttgacccggaacttgctgctcccgttgataattcagacgatataatgtttgacctactagaagatgtaacagctcagcttcctcccagcaaggtaccccgtcttcactgtttgatgtcgcgaaaattatcatgtcatgattttctgtcaaagcaacctgctgttgagccttcgccaagcttactaaaaggcatccgacaatctttgctctcgcatctcactctggtattagggaaagatgacctggcagctcactgcttgctgttgcatcttctatccaggcttcgtactaaggtggatttggttaccgtcggtaggctctccttgaatttcactggattcaacagagaaagtgcttccatatttggaaatcggctaaatactttggtccaaagactagtgccatattcgcaagccattcctctgtcaattgattatctcaacacagccactcttcaacctaggaaggataacaagtcaggaaggttggttacaggagttctgcagctacctcagggcactcacctgacctttgatgagactctcttgcagtctggatctctggcatctaaaggtgttgagaatactgtgctgcttaagaacttgatggagtcacagatggttgagtatgattttgagtactacaagctagaaatggcaacggatgtgcagctacttactctatctgaggcaaaatcaaacatattgccttctgacttagtagtgccttttcgtccatcctctgttcctgcagtaaatgcaagtcttgaggaacttgagagttggagatggtacttggccacggttaggtctcttcctcagttatctgaacctgagacttaccaggccatccaagatgatatggtcaatgtcatgcgcaatgataggagcttgggttgctctgaacttagcagatggctaacaatggcacagctaacagcttcaagctttggtgagaagagtctttctatggagcactggcagatggtgaaggagcttgagaggcttaggaaggagaggatgcaatgagaagagacattttattagcccatgaatctgtaaactccgttagtgtagtgtctgttgctatgtgtatataccacccctggtgtctaaatcaagacaatctgcaacattgttcgtgatcctatgaggatgccatttgacaacttaattatcaagtttaccctgcttctgtgaaatttgctcttgtagttacattctggctttgaatggacaactaatta

SEQ ID NO: 4838 - DNA, 2005 bp, Brachypodium distachyon
cctaagaagagagagagagaaggagagaggatggttggaccgcagtacgacctcgtcgggaatccgttgggcgcggtgcggtccaccttcgagagggcggcggcggctgccgcggcggagtccgggggccgcgacccggtggcggcgttccgggcgaaagactggcgcgccaccgaggtgttccgctccttcctcttcgaccaaggcggcatcgacaaggttccggtgttggacgcatcaaatctcggattgatcaaaccgaacaccctcgttcggttccggggaatggttcaggatatgctcgggagtgagttctatgctggcgctttcaaggatggttctacctggaggacgaacaagttcacagatttctcaccgttcacaatgccgcacccttgcgattcacatctctgggagcgccatctcttgcactgtgtgcctgtgcctggacagaactcttggacaatggagtcttctcccggacctgacttgcgccagatgtcaaactgctcgacatctgaacaaagggacaaaagaaaaagggatggagatgatgatgccatggatgtttcagaaaatggtaatggtgagggttcttcattcagtaagaaaccgaaggaagatggtgtccagggctcatctagttcaccagaaatgccagtgagtgaagatcgcgtgccagagatgaatggggatgatcatcatattcctggaagcttcttttcatgtctagtgaaggtctatgatatgcctgaaagtcaagtgaaactaaacgatgttgctgagttcataggtgtatatacatttgacccggaacttgctgctcccgttgataattcagacgatataatgtttgacctactagaagatgtaacagctcagcttcctcccagcaaggtaccccgtcttcactgtttgatgtcgcgaaaattatcatgtcatgattttctgtcaaagcaacctgctgttgagccttcgccaagcttactaaaaggcatccgacaatctttgctctcgcatctcactctggtattagggaaagatgacctggcagctcactgcttgctgttgcatcttctatccaggcttcgtactaaggtggatttggttaccgtcggtaggctctccttgaatttcactggattcaacagagaaagtgcttccatatttggaaatcggctaaatactttggtccaaagactagtgccatattcgcaagccattcctctgtcaattgattatctcaacacagccactcttcaacctaggaaggataacaagtcaggaaggttggttacaggagttctgcagctacctcagggcactcacctgacctttgatgagactctcttgcagtctggatctctggcatctaaaggtgttgagaatactgtgctgcttaagaacttgatggagtcacagatggttgagtatgattttgagtactacaagctagaaatggcaacggatgtgcagctacttactctatctgaggcaaaatcaaacatattgccttctgacttagtagtgccttttcgtccatcctctgttcctgcagtaaatgcaagtcttgaggaacttgagagttggagatggtacttggccacggttaggtctcttcctcagttatctgaacctgagacttaccaggccatccaagatgatatggtcaatgtcatgcgcaatgataggagcttgggttgctctgaacttagcagatggctaacaatggcacagctaacagcttcaagctttggtgagaagagtctttctatggagcactggcagatggtgaaggagcttgagaggcttaggaaggagaggatgcaatgagaagagacattttattagcccatgaatctgtaaactccgttagtgtagtgtctgttgctatgtgtatataccacccctggtgtctaaatcaagacaatctgcaacattgttcgtgatcctatgaggatgccatttgacaacttaattatcaagtttaccctgcttctgtgaa

SEQ ID NO: 4839 - DNA, 1836 bp, Pennisetum glaucum
tcctttctgttccaggaagacgggctcgacaaggttccggtgttgaatgcttcaaatcttggattgatcaaaccaaacacccttgtccggtacaggggaatggttcaggacatgcttgggaatgagtactacattggtgcattcaaggatgggtcgacttggaggacaaataagttcactgatttctcaccgttctcaatgccacatccttgtgattcacacctttgggagcgtcatctctttcactgtgtgcctgcgcctggacaaaattcctggacactggagtcttcaccaggacctgatgtgcgcaggatgtcaagctgcttgactactgaattaagagataaaaggaagagagatggagataatgctgatatggatgtttcagaaaatgggcatgaagagtcttctgcactctgcaagaagccgaaggaagatgatgttaatatctcatccagttcaactgaagtggcagaaggtgtgccagagatgaacgggggcaatcatcatataccaggaagctccttttcatgtctagtgaaggtctatgacatgcctgatagtcaggtaaagctaaatgatgttattgagttcattggtgtatacacattcgacccagaacttgctgctcccagcgataacacagatgatataatgttagacctcatagaagatgtaacagttcaattgcctccaagcaaggtgccccgtcttcattgtttggtatggagaaaattatcaccccatgactttatttcaaggcctgctgttgagccttcacctagcatattaaaaggcatccgacagtctttgctctcacacctcactctggtgttaggaaatgacgaacttgcagcccagtgcttgctgttgcatcttctatccagactccgcaatagggtggatgtggttactgttggtagactctccttgaatttcactggcttcaacagggaaagtgcttccatatttgggaatcaactgtattctttgatccagaaattggtgccatattcacaagccatccctatgtcaatagagtatctgaacacagccacactccaacctagaaaagacaacaagtcaggaaggttggtcacaggagttttgcagctacctcaaggctcccatctgaccttcgatgagacccttttacagacaggatcattgacatctaaaggtgtggaaaacaccatgttgctcaagaatttaatggagtcacagaaggtggactatgattttgagtactacaagctggatatggcaactgatgtgcagctgcttactctttccgagggaaaatcaaacatccttccttcagacttggtagtgccttttcgtccatcctctgttcccaagattaatgaaggttctgaggaactcgagaattggagatggtatttggccacagttaggtcttttcctcagtccactgaacctgagacttaccagatgattcaagatgaaatggtcagtgctatgcgtgatgataggagcttgggttgttctgaacttagcagatggctaacaatggcacaaatagtggcctcaagctttggcgagaagagtctttctttggagcactggcagatggtgaaggagcttgaaaggcttagaaagcagaggctgcaatgagattgaagtagcatttgcatgtgtttttacacttgctatggtagtatgctgttatctgtatagtactaggttgtgtgaatcatgacttcagtttggatggtgccatggtgggacttttgtaacagctgatcctatgcaagctatgtgatcacttgttttgagtttatgccactcatattttcctccacaaatttacttatg

SEQ ID NO: 4840 - DNA, 2594 bp, Oryza sativa
ttttttaattctaatgccacgtaggcgccacgcggaatgaagaccggattagtatcgccacgtcagcgccacgtggaatgaagactgggttggtatcgccacatcagcgccacgtcagcaaaaccgtcctacaaaaccaccgagggagtcaatttgtaccggttttagtaattgggggagtcgttctaaccggttttctggttgaggggtacaaattagattcgttttacatttaagggagtcaaagtggactttttccagatttggatcgctaaccaataagcaggcctcatatgggccggaggcatctcggcccggcagcagcgcgcacccgcagacgggccgcactcccgtgccgaatgctaggacggcccattaggcccaatagacgcaccaaggtccaagtaccaggagaggcgcgcattggcgggaagagggggagaaaacggcgggaagcgccgccgccagtggcgcgaaaaccccacccgctataactcctctccctcctcacctcaccacttctcccgccattgctccgctccccaatctccccaacgagagagagagagagcgaggagagggagagggaggatggtggggccgcagtacgacctcgtcgggaaccccctgggggcggtgcgctccaccttcgagagggcggcggcggagtccggtgggcacgagccggtggcggcgttccgggggaaagactggggcgccaccgaggtgttccgctcctttctcttcgagcaaggcgggcttgacaaggttccggtgttggatgaatcaaatcttggattgatcaagccgaatacccttgttcggttccgggggatggttcaggacatgctcgggaacgagttctatgttggtgctttcaaggatggctccacttggaggacaaacaaattctccgattcctcgccgttctcaatgccacacccttgtgattcacatctctgggagcgccatcttttccactgtgtgcctgtgcctggacaaaattcttggacacgcgagtcgtcccctggccctgacttgcgcagaatagcaagctgcttcacatctgaacaaagggagaaaaggaagaggggtgcagataatgacgccatggatgtttcagaaagtggtagtggagagacttcttcatccagcaagaagacgaaggatgatggtgtcaagatctcaaatagttcagtagaaatgtcaatgaatgaagaacatcatgtcccagagatgaatgggggagatcatcatattcctggaagctccttttcctgcctagtgaaggtgtatgatatgcctgaaagtcaggtgaaactgaacgatgtttctgagttcataggtgtatatacatttgaccctgaacttgctgctcctaacgataattcggatgatataatgtttgaccttatggaagatgtaaccgctcagctgcctcccagtaaggttccccgtcttcactgcttggtatggagaaacttatctgctcatgattttctaccaaggcctcctgcggttgagccatcaccaatcctgctaaggggaattcggcaatctttgctctcacatcttactctggtattagggaaagatgaactggcagctcaatgtttactgttgcatcttctatccagacttcgtaataaggtggatgtggttaccgttggtaggctctccttgaatttcactggctttaacagagagagtgtttctatatttggaaaccagctaaataatttgttccagaggctactaccatattcacaagttattcctctgtcaattgagtatctcaacacagccacacttcagcctagaaaggacaaccaatcaggaagattggttacaggagttttacagttacctcagggtactcacctgacctttgatgagactctcttgcagtctggatcattgacatccaaaggtgtcgagaatactatgctgcttaagaacttgatagagtcacagaaggttgagtatgattttgagttctacaagttggaaatggcaactgatgtgcagctactaattctctccgagggaaaatcaaatatcctaccttctgacttgatagtacctttccgcccatcatctgttcctgcggtaaatgcaagctccgaggaacttgaaagttggagatggtatttggccacagttaggtctcttcctcagtcaactgaaactgatacataccagatgattcaagatgaaatggtcaatgccatgcgtgatgataggagcttgggttgttctgaacttagcagatggctaacgatggcacagataatggctgcaagctttggtgagaagagtctctccatggagcactggcagatggtgaaggagctggagaggctcaggaaggagaggctacaatgagatgagatcacagtaaaatgtgcttgtaaaatccacttgtggccgtggcccaatgttatgtgtataccactagggtctaaaatctaaatcaagatgtggatctgcaacatcttctgtgatcctatggaagtatgaatgccatttgataagttatctgacctgaaaagcatctcttgcaatacctgtgaaaaaaaaaattgaacttgcac

SEQ ID NO: 4841 - DNA, 1927 bp, Panicum virgatum
atgtcaaggaaaaaatatttgcaggttccggtgctgaatgcttcaaatcttggactgatcaaaccaaacacccttgtacggtaccggggaatggttcaggatatgcttgggaatgagtactacattggtgtattcaaggatgggtcaacttggaggacaaacaagttcactgatttctcaccgttctcaatgccacatccttgtgattcccatctttgggagcgccatctcttccattgtctgcctgcgcctggacaaaattcttggacactagaatcttcaccaggacctgatgtgcgcaggttgtcaagctacttggcacctgaattaagagagaaaaggaagagagagggagataatgatgacatggatgtttcagaaaatgggcatgaaggatctcctttgctctgcaagaaaccgaaggaagatgatgttcatgtctcatccagttcaactgaagtggcagatggtgtgccagagatgaatgggggcgatcaccatatacctgggagctccttttcatgtctagtgaaggtctatgacatgcctgatagtcaggtgaagctaaatgatgttattgagttctttggtgtatatacatttgatccagaacttgctactcctagtgataactcagatgacataatgttagacctcatagaagatgtaacagttcaattgcctccgagcaaggtgccccgtcttcattgtttggtatggagaaagttatcacctcatgattttatttcaaggcctcctgttgttgagccttcacctagcatattaaaaggcattcgacaatctttgctctcacatcttactctggtgttaggaaatgatgaacttgcagcccagtgcttgctgttgcatcttctatccagacttcgcaatagggtggatgtggttactgttggcagactctcgttgaatttcactggctttaacagggaaagtgcctccatatttgggaatcaactgtattgtttgatccagaaattggtgccatattcacaagccatccctatgtcaattgagtatctgaacactgccacacttcaacctagaaaggacaacaagtcaggaaggttggtcacaggagttctgcagctacctcaaggctctcacctgacctttgacgagactctcttacagtcaggatcactaacatctaaaggtgtggaaaataccatgctgctcaagaatttaatggagtcacagaaggtcgactatgattttgagtactacaagctggacatggcaactgatgtgcagctacttactctctctgagggaaaatcaaacatccttccttcagacttggtagtgccttttcgtccatcctccgttcccacgattaatgaaggttctgaggaacttgagagttggagatggtatttggccacagttagatctcttcctcagtccactgaacctgagacttaccagatgattcaagatgaaatggtcagtgccatgcgtgatgataggagcttgggctgttctgaacttagcagatggctaacaatggcacaaataatagcctcaagcttcgccgagaagagtctttctttggagcactggcagatggtgaaggaacttgagaggcttagaaagcaaagattgcaatgagatgtcgccatgttagcatttgtttttacactacttgctgaggtggtatgctgttgtgtatagtactaggttgtgtgaatcaaaacttggatttagggatttctataacaagtatgatcctatgcaaactatgtgatgagttattctcaagttcgtgccatgcagtctcttgatcaaatttgaagttctctgggaactgacatgtcactgccggatctgtaattttaagttcagaactatcggaactgtaattctaaattgatcttattggactacctaacataatggagattttgaa

SEQ ID NO: 4842 - DNA, 2343 bp, Zea mays
agctcgacgcatcttcgcctccgctcaacgctcgcccacgcccccagcccccaaccgatccaagagaaaccttctcgcctccgcgggacgattcgccagggagagcaaaggtagcagaggcgccatggacgctgccaagtcggtgacgccgggcgccgtgtcatacatcctggcgcacccgtctacgggctccgatggcgccgtgtcggatctcgtcgttcaggtcctcgatctcaagtccatcggcatgggcagccggttcagtttcacggcaaccgatgggaacgacaaaatcaaggcgatgctccccacttactttgcgtcggaggtccactccggcaatctgaagaatttcggtctcatccgcatcctcgactacacttgcaactccgtcaaaggcaacgctgacaaagtcctgattgtcgtcaaatgcgagactgtgtgcgaagcgctcgatgccgagatcaacggcgaggccaagaaagaggatcctccaattgtgctgaagcctaaagacgaaggctcagtcgtggctgaggaaacaaattctcccccactcgtgatgaagcctaagcaagaggtgaagtccgcgtcccagatcgtgactgagcagcgtggaaatgctgctcctgccacgcgcctttccatgacaaggagggtccatcccttgatcactctgaacccctaccagggtaactgggtcattaaggtgcgggtcacgagcaaaggcaatctcagaacctacaggaatgctcgtggagaaggctgcgtcttcaacgtagaacttactgatgaggatggcacccagatccaggccaccatgtttaacgaggctgcaaagaagttctatccaatttttgagctgggaaaggtctattatgtctcaaaaggatctcttagaattgccaacaagcagttcaagacagtcaaaaatgactatgagttgtcactaaacgagaatgctattgttgaagaagcagagggggagactttccttccaccagtgcaatacaaccttgtcaagattgatcagctaggaccatacgtcggtggcagggagcttgtagatattgttggtgtggttcagagcgtatctcccacactcagtgttaggagaaagattgacaacgagacaataccgaagcgtgatattgttgtagcagatgactctggcaaaactgttactatttctctctggaatgatcttgctactacgactggccaagagcttttggacatggttgacagttcgcctgttgttgcgataaagagcctaaaagtatctgacttccaaggcgtatctctttcaactattggcagaagtactctcgagattaatcctgacctgcctgaggctaagaatctgaagtcctggtatgactctgaaggcaaagatacttcactggcaccaatcagtgcagaagtgggtgccacacgcgctggtggtttcaagtccatgtattctgatagagtttttctgtctcacatcaccagtgatcctgctatgggccaggaaaagcctgttttcttcagtctgtacgccatcataagccacatcaagcctgatcagaatatgtggtaccgtgcttgcacgacctgtaacaagaaggtgactgaagcttttgggtctggatactggtgcgaggggtgccaaaagaattactctgagtgctcgctgagatacatcatggtgatcaagctctccgatcccactggcgaggcttgggtgtctgtgttcaatgagcatgcagagaagatcattggctgcagcgccgacgagcttgatcggatcaggaaagaggagggggacgacagctacgttctcaagctcaaggaagccacctgggttcctcacctgttccgtgtcagcgtcacgcagcatgaatacatgaacgagaagaggcagagaatcaccgtgaggggtgaagcaccggtcgacttcgcagctgagtccaagtacttgcttgaagagatcgcgaagctcaccgcttgctagaagacgcagtctttctggtggttcttgaaggactggcccccgatgtctccctcgcagtttttcttttgagctccagtaacttgattactgttctgtgtgttgctctcactgggttttagcacttctgtaaggtatatgtagatgctagattaccttggtgtcaaggaacagatgctatgataagccttgcaaaattgcagttccaattccgtgtatctgcaactttgagcaaataggaaaagattatgagtactgattgatgatgttaggtcgctgcagctaacaagtgtttggtttttatggactactgtttagtccctgtattttattctattttagtatttaag

SEQ ID NO: 4843 - DNA, 2190 bp, Zea mays
atcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttcgggtcggaggtccgctctggcaacctgaagaacctcggcctcatccgcatcatcgactacacttgcaacgtcgtcaaaggcaaagatgacaaagtcttggttgtcatcaaatgcgagcttgtgtgccaagcgcttgacgccgagatcaacggcgaggccaaaaaagaggagcctccaattgtgctgaagcctaaggacgaatgcgtgggcgtgactcccccactcgctatgaagcccaagcaggaggtgaagtctgcgtcccagatcgtgaatgagcagcgtggaaatactgctcctgtcaagcccctttccatgacaaagagggtccatcctttgatcactctgaacccctaccagggtaactgggtcattaaggtgcgggtcacgagcaaaggcaacctgagaacctacaggaatgctcgcggagaaggctgtgtcttcaatgtagagctcaccgatgaggatggcacccagatccaagccaccatgtttaatgacgctgcaaagaagttctatccgatttttgagctgggaaaggtctattatgtctcaaaaggatctcttagaattgctaacaagcagttcaagactgtccaaaatgactacgagatgtcactaaacgagaatgctattgttgaagaagcagagggggagacttgcattccgcaagtgcaatacaaccttgtcaagattgatcagctaggatcgtatgtcggtggcagggagcttgtagatattgttggtgtggttcagagcgtatctcccacactcagtgttaggagaaagattgacaacgagacaataccgaagcgtgacattgttgtggcggatgactctggcaaaactgttagtatctctctttggaatgatcttgctactacgactgggcaagagcttttggacatggctgacagttcgcctgttgttgcgataaagagcctaaaagtgtctgacttccaaggcgtgtctctttctactgtaggcaaaagtactcttgcgattaatcctgatctacacgaggctcagaatctcaagtcatggtatgactctgaaggcaaagatacttcgctggcaccaattggtgcagaaatgggtgccgcacgggccggtggcttcaagtccacgtattctgatagagtttttctgtctcacattactagtgatcctgccatgggccaggaaaagcctgttttcttcagtttgtatgccaccataagccacatcaagcctgaccagaacatgtggtaccgtgcttgcaagacctgcaacaagaaggtgactgaaacttttggatctggatactggtgtgagggatgccaaaagaatgactcggaatgctcactgagatacatcatggtcatcaaggtctccgatcctactggcgaggcatgggtctctgtgttcaacgagcatgcagagaagatcattggctgcagcgccgacgagcttgatcggatcaggaaagaggagggggacgacagttatgttctgaagctcaaggaagccacctgggttcctcacctgttccgcgtcagcgtcacacagcatgaatacaataacgagaaaaggcagagaatcactgtgaggagtgaagcgccggtcgagcacgcagctgaatccaagtacctgcttgaacagatagcgaagcttactgcttgatagtagaagatgcaaccttactgcaaatagcgaggattattaggactaattgatggtgtcaggtcattgcggccctaagctttagctatgtatcagcagtcagatgtattaaccattccctgctctaatagtcatctatcagcagtcagatgtatttaaccattccctgcttaatagctctctaccaggagtcggaagtttttaaccattccctgctctaagacaagat

SEQ ID NO: 4844 - DNA, 2457 bp, Setaria italica
ccgcctgcaggaaagacgcatttccgccgccgcccagcgctcccccacagatccgcgcgaaaccttccttcctccggcagacgattccgcaggcgagaggagaggagccatggacgccgccaagtccgtgacgccgggcgccgtgtcccacatcctggagaagccgtcgccggccgacgccgccacggtcccggagctcgtcgtccaggtcgtcgacctcaagtccatcggcaaccgttttggtttcatggcgagcgacggcaaggacaagatcaaggcgatgctccccacccaattcgcggcggaggttcgctccggcaacctgcagaacctcggcctcatccgcatcctcgattacacctgcaacgccgtcggcggcaacaacgacaacaaggccttgattatcaccaaatgcgaggttgtgtctcaagcgctcgacgccgagatcaagagcgaggccaagaaagaagaggagcctgcgattgtcatcaagcccaaggacgaagaaatggttttgtccaagcccgtaaatgctcccccggtcgtgctgaagccgaagctggaggtgaaatccgcgtcccagatcgtgaacgagcagcgtggaaatgctgctccagcggcgcgcctgtccatgacaaggagggtccatcctttgatctctctcaacccctaccagggtaactgggtcatcaaggtgcgggttacgagcaaaggcaacctgagaacctacaagaatgcccgtggagaaggctgtgtcttcaatgtagagctcactgatgaggatggcacccagatccaggccaccatgttcaatgaggctgcaaagaagttctacccaatgtttgagctggggaaggtctactatgtctccaagggatcacttaggattgccaacaagcagttcaagactgtccagaatgattatgagatgacgctgaatgagagtgctgttgttgaagaagcagagggggaaactttcattccaccggtgcaatacaattttgtcaagattgatcaactaggatcatatgtcaatggcagggagcttgtagatattgttggtgttgttcagagcgtatcacccacaatgagtattaggagaaagcttgacaatgagacaatcccaaagcgtgacattgttgttgcagatgactcgggcaaaactgttagtatttcactttggaatgatcttgctactaccactggccaagaactcttggacatggttgacagttcgcccatcattgcgataaggagcttaagagtgtctgacttccaaggtgtgtccctttcaactgtaggcaaaagtactcttatggttaatccagaccttcctgaagtgcacaatcttaaatcatggtatgacaatgaaggcaagggtacttcaatggcaccgattggtgcagacatgggtgcagcacgggctggtggcttgagatccatgtattctgatagagtttttctgtctcacatcaccagtgatcccaacatgggtcaggaaaagcctgttttcttcagtttgaatgctatcataagccacatcaagcctgatcagaacatgtggtaccgtgcttgcaagacctgcaacaagaaggtgactgaagctgttggaggtggatactggtgtgaaggatgcaataagaatgatgctgagtgctcactgagatacatcatggtcatcaaggtttctgatcccactggtgaggcatgggtttctgtcttcaacgagcatgcagagaggatcattggctgcagcgctgatgagcttgatcggatcaggaaagaggagggcgacgacagctacattcagaagctcaaggaagccacatgggttccccatctgttccgcgtcagcgtggcgcagcatgagtacatgaacgagaggaggcagaggatcaccgtgaggacagaggcgccggttgactacgcagctgaatctaagtacctgctcgaggagatcgcgaagcttactgcttgctagaagatgtagtgtatctggtgaatcgtggagggctggccctcttgatgttttcccacacaaggcaggcttttgagatgtagtaacttaatgttatcctgtgttaagtaggtgctcactagttttagcgctgatgtaagatatgtaggtgtatgtttagcttgatttcaagcaacaagatgctaagacagttcagtatgaagcctttgtagaattccatcatatccgcaatattttgagcttgtagaattccagttcgagtaacatcatatctgcaatattttgagcaaatagccaaagattattaggagtaattgaagtaagctcgccgctcattttctcagttctgtatctatcggcattcggcaaccagatgtagacttgtagagtcaaccttttctttctcaccagtcatcagtgtatatataatacaaattgcactatgcattattgtgacttccattcaagtgtctttcctg

SEQ ID NO: 4845 - DNA, 2216 bp, Setaria italica
ccgcctgcaggaaagacgcatttccgccgccgcccagcgctcccccacagatccgcgcgaaaccttccttcctccggcagacgattccgcaggcgagaggagaggagccatggacgccgccaagtccgtgacgccgggcgccgtgtcccacatcctggagaagccgtcgccggccgacgccgccacggtcccggagctcgtcgtccaggtcgtcgacctcaagtccatcggcaaccgttttggtttcatggcgagcgacggcaaggacaagatcaaggcgatgctccccacccaattcgcggcggaggttcgctccggcaacctgcagaacctcggcctcatccgcatcctcgattacacctgcaacgccgtcggcggcaacaacgacaacaaggccttgattatcaccaaatgcgaggttgtgtctcaagcgctcgacgccgagatcaagagcgaggccaagaaagaagaggagcctgcgattgtcatcaagcccaaggacgaagaaatggttttgtccaagcccgtaaatgctcccccggtcgtgctgaagccgaagctggaggtgaaatccgcgtcccagatcgtgaacgagcagcgtggaaatgctgctccagcggcgcgcctgtccatgacaaggagggtccatcctttgatctctctcaacccctaccagggtaactgggtcatcaaggtgcgggttacgagcaaaggcaacctgagaacctacaagaatgcccgtggagaaggctgtgtcttcaatgtagagctcactgatgaggatggcacccagatccaggccaccatgttcaatgaggctgcaaagaagttctacccaatgtttgagctggggaaggtctactatgtctccaagggatcacttaggattgccaacaagcagttcaagactgtccagaatgattatgagatgacgctgaatgagagtgctgttgttgaagaagcagagggggaaactttcattccaccggtgcaatacaattttgtcaagattgatcaactaggatcatatgtcaatggcagggagcttgtagatattgttggtgttgttcagagcgtatcacccacaatgagtattaggagaaagcttgacaatgagacaatcccaaagcgtgacattgttgttgcagatgactcgggcaaaactgttagtatttcactttggaatgatcttgctactaccactggccaagaactcttggacatggttgacagttcgcccatcattgcgataaggagcttaagagtgtctgacttccaaggtgtgtccctttcaactgtaggcaaaagtactcttatggttaatccagaccttcctgaagtgcacaatcttaaatcatggtatgacaatgaaggcaagggtacttcaatggcaccgattggtgcagacatgggtgcagcacgggctggtggcttgagatccatgtattctgatagagtttttctgtctcacatcaccagtgatcccaacatgggtcaggaaaagcctgttttcttcagtttgaatgctatcataagccacatcaagcctgatcagaacatgtggtaccgtgcttgcaagacctgcaacaagaaggtgactgaagctgttggaggtggatactggtgtgaaggatgcaataagaatgatgctgagtgctcactgagatacatcatggtcatcaaggtttctgatcccactggtgaggcatgggtttctgtcttcaacgagcatgcagagaggatcattggctgcagcgctgatgagcttgatcggatcaggaaagaggagggcgacgacagctacattcagaagctcaaggaagccacatgggttccccatctgttccgcgtcagcgtggcgcagcatgagtacatgaacgagaggaggcagaggatcaccgtgaggacagaggcgccggttgactacgcagctgaatctaagtacctgctcgaggagatcgcgaagcttactgcttgctagaagatgtagtgtatctggtgaatcgtggagggctggccctcttgatgttttcccacacaaggcaggcttttgagatgtagtaacttaatgttatcctgtgttaagtaggtgctcactagttttagcgctgatgtaagatatgtaggtgtatgtttagcttgatttcaagcaacaagatgctaagacagttcagtatgaagcctttgtagaattccatcatatccgcaatattttg

SEQ ID NO: 4846 - DNA, 2591 bp, Panicum virgatum
gcaaaaccagtgcgaaaacgaaaccagccgcgaacccgcggcggcaaacgcccaaacgcgcaaaatccaccgagcgccgcccgcctcccgccatttctccccaaaatccaccttataagcgcgcgcatccgcctgggcagctccgcctccgacgcacttccgccgccgctcagagctcgcccaccggcccgcgcgaaacctacctttcctaccttcctggagacgattgcacaggcgagaggaggcatggacgccgccaagtccgtcacgccgggcgccgtgtcccacatcctggcgaacccgtcgccgggcgacgccgccgaggtcccggagctcgtcgtccaggtcgtcgacctcaagtccatcggcacgggcagccggttcagtttcgtggcgagcgacgggaaggacaagatgaaggcaatgcttcccacccaattcgcggaggaggttcgctccggcaaactgcagaacctcggcctaatccgcatcctcgactacacctgcaacgacgtcccccgcagcaacgacaaggccttgattatcagcaaatgcgaggttgtgtcccaagcgctcgacgccgagatcaagagcgaggccaagaaagaagaggagcctgcgattgtcctcaagcccaaggacgaaggcgtggttgtgcccaagcccgtaaatgctccgccggttgtgttgaagccgaagcaggaggtgaaatccgcgtcccagatcgtgaacgagcagcgtggcaatgctgctccagcagcgcgcctggccatgacaaggagggtccatcctttgatctccctgaacccttaccagggtaactgggtcatcaaggtgcgggttacgaacaagggcaacctcagaacttacaagaatgcccgtggagaaggctgtgtcttcaatgtagagctcactgatgaggatggcactcagatccaggccaccatgttcaatgaggctgcaaagaagttctatccaatgtttgagctggggaaggtctactacgtctccaagggatcacttaggattgccaacaagcagttcaagacggtccagaatgactatgagatgacattgaatgagaatgctgttgttgaggaagcatggggggaaactatcattccacaggtgcaattcaattttgtcaagattgatcagctaggatcatatgtcaatggcagggaactagtagatattgttggtgttgttcagagcgtatcccccacactgagtgttaggagaaagagagacgatgagacaataccaaagcgtgacattgttgttgcagatgattcgggcaaaactgtgagtgtttcactctggaatgatcttgctactaccactggcgaagagctcttggacatggttgacagttcgcccatcattgcgataaagagcctaagagtatctgacttccaaggtctctctctttcaactgtaggcaaaagtactcttctggttaatccagaccttccagaggcacagaaccttaaatcatggtatgactctgaaggcaagggtactaaaatggcaccgattggtgcagacatgggtgcagtacgcgctggtggcttgagatccatgtattccgatagagtttttctgtctcacatcaccagtgatcctaatctgggccaggaaaagcctgttttcttcagtttgaatgccatcataagccacattaagcctgatcagaacatgtggtaccgagcttgcaagacctgcaacaagaaggtgactgaagctgttgaaggcgggtactggtgtgaaggatgcaacaagaatgatgctgagtgctccctgagatacatcatggtcatcaaggtctctgatcccactggtgaggcatgggtttctgtcttcaacgagcatgcagagaagatcattggttgtagcgccgatgagcttgatcagatcagaagagaggagggcgaggacagctacattctcaaactcaaggaagtcacctgggttccccatctgttccgtgtcagtgtcgcgcagcatgagtacatgaacgagaggaggcagaggatcaccgtgaggactgaggcgccggtcgactacgtagctgaatccaagtatctgctcgaggagatcgcgaagcttactgcttgctagaaggctgtttctgttgaattctggaggactgatcctccctgatgttttcctgtggcggaggcttttgagatgttaattctgtgttcagtaggtgttcatcggttttagcacttctgtaagatatgtaggtgtttgtttagcttgatttcaagcaacaggatgctaagacaggtcagtatgaagcctttgtacaactgcagttccagttccatcttatctgcaatgcagttgaacaaatagccaatattattaggactaattgatgtgagctcgctgctcatttgctccagttctgtatctattatcagcaaccagatgtagaggcaaccttttcctactcgaatcatctgcgtacaatacaaattgcgctctgcattgttgtgccatctatgatcaatttaaactgtttcctgataaggtttttaaaaattgccactgtcaccttatcgaggattcatactcttcctgag

SEQ ID NO: 4847 - DNA, 2372 bp, Panicum virgatum
caaaactatcaaccggtaccaatgggcgatctcttgccatttctcccccaaatccaccttataagcgcgcgcatcggcctgggcagctccgatgcatttccgccgccgctcagagctcgccaccggtccgcgcgaaacctaccttccttccgggagacgagtccgcagatgagaggaggcatggacgccgccacgtccgtcacgccgggcaccatgtcccacatccttgcgaacccgtcaccggcgacgccgccgagatcccagagctcgtcgtccaggtcgtcgacctcaagtccatcggcacgggtagccggttcagtttcatggcgagcgacgggaaggacaagatcagggcgatgctccccacccaattagcgccggaggttcactccggcaacctgcagaacctcggcctaatccgcatcctcgactacacctgcaacgccctccctcccaaaaacgacaaggccttgattatcagcaaatgcgaggttgcgtcccaagcgctcgacgccgagatcattagcgaagacaagaaacaagaggggcctgcgattgtcctcaagcccaaggacgaaggcgtggttctgtccaagcccgcaaatgctcccctggttgtgttgaagccgaagcaggaggtgaaatccgcgtcccagatcgtgaacgagcagcgtggcaatgcgtgcagtgctgctccagcagcgcgcttggccatgacaaggagggtccatcctttgatctccctgaacccttaccagggtaactgggtcatcaaggtgcgggttacgaacaagggcaacctcagaacttacaagaatgcccgtggagaaggctgtgtcttcaatgtagagctcactgatgaggatggcacccagatccaggccaccatgttcaatgaggctgcaaagaagttttatccaatgtttgagctggggaaggtctacttcgtctccaagggatcacttaggattgccaacaagcagttcaagacggtccagaatgactatgagatgacactgaatgagaatgctgttgttgaggaagcagagggggaaactatcattccacaggtgcaattcaattttgtcaagattgatcagctaggatcatatgtcaatggcagggaacttatagatattgttggtgttgttcagagtgtgtcacccacactgagtgttaggagaaagagagacgatgagacaataccaaagcgtgacattgttgttgcagatgactcgggcaaaactgtgagtgtttcactctggaatgatcttgctactaccactggccaagagctcatggacatggttgacagttcgcccatcgttgcgataaagagcctaagagtatctgacttccaaggtgtttctctttcaactgtaggcaaaagtactcttctggttaatccagaccttcctgaggcacagaaccttaaatcatggtatgactctgaaggcaagggcacttcaatggcaccgattggtgcagacatgggtgtagcacgggctggtggcttgagatccatgtattccgatagagtttttctgtctcacatcaccagtgatcctaatatgggccaggaaaagcctgttttcttcagtttgaatgccatcataagtcacattaagccagatcagaacatgtggtaccgagcttgcaagacctgcaacaagaaggtgactgaagctgttgaaggtgggtactggtgtgaaggatgcaacaagaatgatgctgagtgctcactgagatacatcatggtcatcaaggtctctgatcccactggcgaggcatgggtttctgtcttcaacgagcatgcagagaggatcattggctgcagcgctgatgagcttgatcggatcagaagagaggagggtgacgacagctacattctcaaactcaaggaagccacctgggttccccatctgttccgtgtcagcgtcgcgcagcatgagtacatgaacgagaggaggcagaggaccaccgtgaggactgaggcgccggtcgactacgccgctgaatccaaatacctgctcgaggagatcgccaagcttactgcttgctagaaggctgtttctctccctgatgttttcctatggcagaggcttttgagacgttaattgtgttaagtaggtattcagtgggtttagcacttctgtaagatatgtaggtgtttgtttagcttgatttcaagcagcaggatgctaagacagttcagtacgaagcctttgtagaactgcagttccagttccatcttatttgcaatgcaattgaacaaatagccaatattatcttactactatttgctaatattggctactgttttcttaaaatgctccaaatgaataaacatgtacagcatgcgcttactccta

SEQ ID NO: 4848 - DNA, 1343 bp, Zea mays
ctagccctcaatcacgccgagctcgacggaaccagcccaacccgagcccatttctgctcgggtcccggccgatccggcagctcctcatcagcacaacccggggcaacgtcccccagcggatgctagcctgatcgggtccccacggtcgatgggttcgcccgggtccgccaatggcagacgcggcgagtacgtgaggatccctgaggaggtggaggtggcgtccaagggggaggcagatgccgcggcggccatcaaggcggccgtggcagcggagtgcccgagggtgctgcggtgccgcgcgatccggtggtgggccaaggtcgccgtgcttgggatcttccttgcaggggccggagctgctgccgtggtcttcctcggcccgctcgttattaagaaggttgttgcacctattctttactgggaatcaataactttcagcagaccagctattgctctaatatgttttggcacaatcgccttattcccaagtgttttgttaccttcttcgcccttcatgtggcttgctgggatgacttttggatatctttatggctttttgataatcacagtggggatgagcataggcatgtcgttgccgtattttataggttctgcattccactgcaggatacatagatggctggagaagtggccaaagaaagcagcttttgtaaggcttgctggcgagggagattggcatcatcaatttaaggctgttgctttactcaggatttctccatttccatatttagtttttaactacgcttctgtggctacgaacgtcaaatattacccatacatagctggttccatggctggaaccatacatgaaactttccttgcaatatacagtgggaaacttctacagagcttggctgtagcaactagccaagggtcattcttgtcggtggatcagattatctacaatggaatcggctttacaattgctgcaacttccactgctgctatcactatttatgcaaagaaagcgcttcaaaagctccaagcggaggacgagatattttgagaggtccaaggccaggatcaaacccgtaacgctagttttctttcaggtgtactatatatgaacagctgctactaatctggtttcctgtgtcgactaccggactgctactaccatccatctgaggaagaggagggggggaggtgcttcagcaattgtaaagaaaatagaggcccagagtttttcgttcttgttttgttttctgtagagagaattaccaacctcatctgtgtattgcaattgcgctatgtaaatccccaagttgaaagttgtttccttatcttgagaagtataacaaggtatgctggctgcgtcgaaa

SEQ ID NO: 4849 - DNA, 1586 bp, Setaria italica
ctctggcgcccgctctctctctccccgagtccgctccaatgccgttgcctctctcctccacctccgtatcataaacgcctccggcctccccgacccaaaccctaggcccgctcatccccgaccacgccgagctcgccggaacccgcccggcccgagccaaattccgctcgggtccctgccgatccggcggttccccacccgaacagcccggggccgcgtccccccgcggatgctagcctgatcgcgtccccacggtcgatgggttcgccggggtccgccaatggcagacacggcgagtacgtgaggatcccggaggaggtggaggtggcggtcaagggggaggccgacgccgcgacggccgtcaaggcggccgcggcggcggagtgcccgacggtgctccggtggcgcgcgatccggtggtgggcaaaggtcgccgtgctcgggatcttcctcgcgggggccggagctgctgcggtcgtcttcctcggcccgctcgtcattaagaaggttgttgcacctattctttactgggaatcaacaactttcagcagaccagctattgctctaatatgttttggcgcaatcgccttattcccaagtgttttgttaccttcttcacccttcatgtggcttgcggggatgacttttggatatctttatggctttttgataatcacagcggggatgagcataggcatgtcattgccgtattttataggctctgcatttcactgtaggatacatagatggttggaaaagtggccaaagaaagcagcttttgtaaggcttgctggtgaaggagattggcatcatcaatttaaggctgttgctttactcaggatttctccatttccatatatagtttttaactacgcttctgtggctacgaatgtcaaatattgcccatacatagctggttccatggctggaaccatacatgaaactttccttgcaatatacagtggaaaacttcttcaaagcttggctttggcaactagccaaggctccttcttgtcagtggatcagatcatctacaacggaatcggcttcacaatcgctgcagcttccactgctgcgatcactatctatgcaaagaaagcgcttcaaaagctccaagcggaggatgagatattctgagctcaagagcctgtgctctggatcaaacccgagaagctagtttccgttcaggtgtactatgtataaacacttgctactaatctggtttcctgcgtcgactacctgactacaaccatcagaggggagggtgatgcagcaattgtaaagaaaatagacccagaaaacacttacgttttccgttctttttcttgttttgttttctgtagagagaaccatcaacttcatcaatgtattgctttgcgcgatgtatattctaaagcgaaactttctccttcccttcaagctgcttgtaagtataacaaagatgtggactgttggatgcctgcagcgtcgatatccacagctttccgcaggcacgattcgcgtgttctgtagggatgcatcgttatgctcctgcaacgtttggacaatgcaattgttgtgtgtttctagcttgcagaactctctaa

SEQ ID NO: 4850 - DNA, 1460 bp, Setaria italica
ctggcgcccgctctctctctccccgagtccgctccaatgccgttgcctctctcctccacctccgtatcataaacgcctccggcctccccgacccaaaccctaggcccgctcatccccgaccacgccgagctcgccggaacccgcccggcccgagccaaattccgctcgggtccctgccgatccggcggttccccacccgaacagcccggggccgcgtccccccgcggatgctagcctgatcgcgtccccacggtcgatgggttcgccggggtccgccaatggcagacacggcgagtacgtgaggatcccggaggaggtggaggtggcggtcaagggggaggccgacgccgcgacggccgtcaaggcggccgcggcggcggagtgcccgacggtgctccggtggcgcgcgatccggtggtgggcaaaggtcgccgtgctcgggatcttcctcgcgggggccggagctgctgcggtcgtcttcctcggcccgctcgtcattaagaaggttgttgcacctattctttactgggaatcaacaactttcagcagaccagctattgctctaatatgttttggcgcaatcgccttattcccaagtgttttgttaccttcttcacccttcatgtggcttgcggggatgacttttggatatctttatggctttttgataatcacagcggggatgagcataggcatgtcattgccgtattttataggctctgcatttcactgtaggatacatagatggttggaaaagtggccaaagaaagcagcttttgtaaggcttgctggtgaaggagattggcatcatcaatttaaggctgttgctttactcaggatttctccatttccatatatagtttttaactacgcttctgtggctacgaatgtcaaatattgcccatacatagctggttccatggctggaaccatacatgaaactttccttgcaatatacagtggaaaacttcttcaaagcttggctttggcaactagccaaggctccttcttgtcagtggatcagatcatctacaacggaatcggcttcacaatcgctgcagcttccactgctgcgatcactatctatgcaaagaaagcgcttcaaaagctccaagcggaggatgagatattctgagctcaagagcctgtgctctggatcaaacccgagaagctagtttccgttcaggtgtactatgtataaacacttgctactaatctggtttcctgcgtcgactacctgactacaaccatcagaggggagggtgatgcagcaattgtaaagaaaatagacccagaaaacacttacgttttccgttctttttcttgttttgttttctgtagagagaaccatcaacttcatcaatgtattgctttgcgcgatgtatattctaaagcgaaactttctccttcccttcaagctgcttgtaagtataacaaagatgtggactgttggatgcctg

SEQ ID NO: 4851 - DNA, 2199 bp, Panicum virgatum
ctaatatgataatcctatcataaacagaccatgttactcaccctcatcagtcatcacaatcaacataggagtacgtgtgaaggcacaaaacgcaaaaacaatgcgtacaaacaacacaaacaaacaacttggatgaaggagggcagaaatgtcattccacgtcgtcctcaatgggacacctccctctccccctccctctctggctctctctgtgtccaatatcgcacccgaaaaatctctccattaaaatatactcacagaaattagaattccttcctcctctctctctctccgagtccgctccaatgccgttgcctctctcctccacctcatcataaacgcctccggctccgacggcctcccggacccaaaccctagccgcgcactcgccgaccacgccgagctcgccggaacccgcccgacccgagcacaattccgctcgggtcgcagccgatccggcggctcccctcccggacagcccggggccgtgcccccccccgcggatgctagcctgatcgcgtccccacggtcgatgggttcgccggggtccgccaatggcagacgcggcgagtacgtgaggatcccggaggaggtggaggcggcggccaagggggaggccgacgccgcgacggccctcaaggcggccgccgcggcggagtgcccgagggtgctccggtggcgcgcgatccggtggtgggccaaggtcgccgtgctcgggatcttcctcgcgggggccggagctgcggcggtcgtcttcctcggcccgctcgtcattaagaaggttgttgcacctattctttactgggaatcgacaactttcagcagatcagctattgctctaatatgttttggcgcaattgccttgttcccaagtgttttgttaccttcttcaccattcatgtggcttgcggggatgacttttggatatctttatgggtttttgataatccaagcggggatgagcataggcatgtcattgccttattttataggctctgcattccactgtaggatacatagatggttggagaagtggccaaagaaagcagcttttgtaagacttgctggcgaaggagattggcatcatcaatttagggctgttgctttgctcaggatttctccatttccatatatagtttttaattatgcttctgtggctacaaatgtcaaatattgcccatacatagctggttcaatggctggaaccatacatgaaactttccttgcaatatacagtgggaagcttcttcaaagcttggctgtagcaactagcaaggggtccttcttgtcagtggatcagattatctacaatggaatcggcttcacaatcgccgcagcttccacagctgcaatcactatctatgcaaagaaagcgctacaaaagctccaagcagaggatgagatattctgagcgcaagaggcctgtgctccggatcaaactagtttccattcaggtgtactatatataaacacttgctactaatctggtttcctgtgtcgactacctgactacaaccatctgaggggatgagggtgctgcagcaactgtaaagaaaatagagaaccaaaaaacacttacgttttctgttcttttttcttgttttgttttctgtagagagaactatcaacttcatcaatgtattgctttacgcgatgtaaattcctatggcgaagcttcctttcctttctttcaccaactatagcgaagatgtgcaatgcttgatgccggtagggtttgttactaaccttggagaattgagaagttgatatccttcagtagtgaaggccatttagaaatataatgagtctcttgggaatatagagactcatggaaatagtcctttatctatttaacagcgttgatatcctgcctgcaggcacgattcgcgtgctccatagtgatgcatcgttatgctcctgcaacgttggaccatgcattggtgttcgtttcatgctcgcagaactctctaaccgataatttgatacaagtacaacgctacgtctcgctggccctcaacttcaatgctacgttatatttatgcgaggacaattgattttgtaatcaggcgtcaccatctcaataaaggaagaagtaccaggtacaggtagagaaataaatctacattgttccattaatggtgtacgatctcccaaatcaagcttcactttaacaagatacaagaacaaggcaatatggca

SEQ ID NO: 4852 - DNA, 1640 bp, Panicum virgatum
attagaattccttccaccttggctcgcaccccccactgtcttctctccgagtccgctccaatgcccccgttgcctctctcctccacctcatcataaacgcctccggctccgacggcctcttcccggacccaaaccctagccgcgcactcgccgaccacgccgagctcgccggaacccgcccgacccgagcacaattccgctcgggtcgcagccgatccggcggctcccctcccggacagcccggggccgtgcccccccgcggatgctagcctgatcgcgtccccacggtcgatgggttcgccggggtccgccaatggcagacgcggcgagtacgtgaggatcccggaggaggtggaggtggcggccaagggggaggccgacaccgcgacggccctcaaggcggccgccgcggcggagtgcccgagggtgctccgctggcgcgcgatccggtggtgggccaaggtcgccgtgctcgggatcttcctcgcgggggccggagcggcggccgtcgtattcctcggcccgctcgtcattaagaaggttgttgcacctattctttactgggaatcaacaactttcagcagaccagctattgctctaatatgttttggcgcaattgccttgttcccaagtgttttgttaccttcttcaccattcatgtggattgcggggatgacttttggatatctttatgggtttttaataatccaagcggggatgagcataggcatgtcattgccttattttataggctctgcattccactgtaggatacatagatggttggagaagtggccaaagaaagcagcttttgtaaggcttgctggcgaaggagattggcatcatcaatttagggctgttgctttgctcaggatttctccatttccatatatagtttttaactatgcttctgtggctacaaatgtcaaatattgcccatacatagctggttcaatggctggaaccatacatgaaactttccttgcaatatacagtgggaaacttcttcaaagcttggctgtagcaactagcgaggggtccttcttgtcagtggatcagattatctacaatggaatcggcttcacaatcgctgcagcttccactgctgcaatcactatctatgcaaagaaagcgcttcaaaagctccaagcagaggatgagatattctgagcgcaagaggcctgtgctccggaccaaactagtttccagtcagatgtactatatataaacatttgctactaatctggtttcctgtgtcgactacctgactacaaccatctgaggggatgagagtgctgcagcaactgtaaagaaaatagagatccagagaacacttatgttttctgttttttttttcttgttttgttttctgtagagagaaccatcaacttcatcattgtattgcgttacgcgatgtaaattcctatggaaaaacttacttcccttcctttcaccaactacaaagatgtgcaatgcttcatgccgggggtagcgttgatatcctgcctgcaggcacgattcgcgtgctccattgtgatgcatcgttatgctcctgcaacgttggacaatgcatttggcgttcgttccatgcttgcagaactctcgaaccgataccttgatacaacgctcgtcccactggc

SEQ ID NO: 4853 - DNA, 1317 bp, Echinochloa colona
ccgcccgctctctctctccccgagtccgctccaatgccgttgcctctctcctccacctcctcataattcataaacgcctccggcctgcctcccggacccaaaccctagcccccgcgctcacccaccacgccgagctcgccggaacccgcccggcccgagcccaattcagctcgggtccccgccgatccggcggctcccctcccgaacagcccggggccgtgtccccccgcggatgctagcctgatcgcgtccccacggtcgatgggttcgccggggtccgccaatggcagacgcggcgagtacgtgaggatcccggaggaggtggaggtggcggccaagggggaggcggacgccgcgacggccgtcaaggcggccgccgcggcggagtgcccgagggtgctccggtggcgcgcgatccggtggtgggcccaggtcgccgtgatcgggatcttgcttgcgggggccggggctgccgcggtcgtcttcctcggcccgctcgcaattaagaaggttgttgcacctattctttactgggaatcaacaactttcagcagaccagctactgctctaatatgttttggcgcaattgccttattcccaagtgttctgataccttcttcaccattcatgtggcttgcggggatgactttcggatatttttatggctttttgataatcacagcggggatgagcataggcatgtcactgccgtattttataggctctgcattccactgtaggatacatagatggttggagaagtggccaaagaaagcagcttttgtaaggcttgctggcgaaggagattggcatcatcaatttagggctgttgctttactcaggatttctccatttccatatatagtttttaactacgcttctgtggctacgaatgtcaaatattgcccatacatagctggttcgatggctggaactatacatgaaactttccttgcaatatacagtgggaaacttcttcaaagcttggctgtagcaacaagcaaaggatccttcctgtcgctggatcagatcatttacaatggaattggattcacaatcgctgcagcttccactgctgcgattactatctacgcaaagaaagcgcttcaaaagctccaagcagaggatgagatattctgaacgcacaggaggtttgcgctttggatcaaactcctgaagctagtttccattcaggtgtactatatataaacacatgctactaatctggtttccttcgtcgactacctgactacaaccatctgaaggggaggagggtgctgcagcaattgtaaagaaaatagagacccagaaaacact

SEQ ID NO: 4854 - DNA, 1388 bp, Zea mays
gtccgctctccgctccaatgccgttgcctctctcctccacctgcttcttctcataaacgcttccggcctcccggagtcccggacacaaaccctagcattcaaccacgccgagctcgccggaacaagcccaacccgagcccaatcccgctcgggccccagccgatccgacggctcctcaccagcacaatccggggtaccccgcggatgctagcctgatcgggtccccacggtcgatgggttcgcccgggtccgccaatggcagacgcggcgactatgtgaggatcccggaggaggcggaggtggcgtccaagggggagggagatgccgcggcggccgtcaaggcggccgcggcggcggagtgccctagggtgctgcggtgcagcgcgatccggtggtgggccaaggtcgccgtgctcgggatcttccttgctggggccggagctgccgcggtcgtcttcctcggcccgctccttatcaagaagattgttgtacctattcttcactgggaatcaacaacgttcagcagaccatctattgctctaatatgtttcggcacaatcgcattattcccaagtgttttgttaccttcttcgcccttcatgtggcttgcggggatgacttttggatatctttatggttttttaataatcacagtgggtatgagcataggcatgtcattgccgtattttataggttctgcattccactgtaggatacatagatggttggagaagtggccaaagaaagcagcttttgtaaggcttgctggcgagggagattggcatcatcaatttaaggctgtagctttactcaggatttctccatttccatatatagtttttaactatgcttctgtggctacgaatgtcaaatattacccatatatcgctggttccatggctggaaccatacatgaaactttccttgcaatatacagtgggaaacttttacagagcttggctgtagcaactagccaagggtccttcttgtctgtggatcagatcatctacaatggaatcggatttatagttgcagcagcttctactgccacgatcactatttatgcaaagaaagcacttcaaaggctccaagcagaggaggagatattgtgagcgcatgaggtccaagcccaggatcaaaacccataacgctagtttcctttcaggtgtattatacatgaagggcttgtttggcagcaagggggaggggaatctagcccctccaaccccctccatttcccttgctgccaaacatgcctgaacagttgctactaatctggtttcctgtgtcgactacctgactgccactaccatctgaggagagggaagggtgggtgctgaagcaattgtaaagaaaaacagacccagaaaaacttacgttttcggttc

SEQ ID NO: 4855 - DNA, 1136 bp, Pennisetum glaucum
cccggaggaggtggaggtggcggtcaagggtgaggccgtcgcggcggagtgcccgacggtgctccggtggcgcgcgatccggtggtgggcaaaggtcgccgtgctcgggatcttccttgcgggggccggagctgctgcggtcgtcttcctcggcccgctcgtcattaagaagattattgcacctattctttactgggaatcaacaactttcagcagaccagctattgctctaatatgttttggcgcaatcgccttattcccaagtgttttgctaccttcttcacccttcatgtggcttgcggggatgacttttggatatttttacggctttttgataatcacagcggggatgagcataggcatgtcattgccgtattttataggctctgcatttcactgtaggatacatagatggttggaaaagtggccaaagaaagcagcttttgtaaggcttgctggcgaaggagattggcatcatcaatttaaggctgttgctttactcaggatttctccatttccatatatagtttttaactatgcttctgtggctacaaatgtcaaatattgcccatacatagctggctccatggctggaaccatacatgaaactttccttgcaatatacagtggaaaacttcttcaaagcttggctttggcaactagccaagggtccttcttgtcagtggatcagatcatctacaacggaatcggcttcacaatcgccgcagcttccactgctgcgatcactatctatgcgaagaaagcgcttcaaaagctccaagcggaggatgagatattctgaactcaagagcctgcgctctggatcaaacccgagaagctagtttccgttcaagtgtactatgtataaacactttctactaatctggtttcctgcgtcgactacctgactagtgactacaaccatcagaggggagggtgctgcagcaattgtaaagaaaatagaccaagaaaacacttacgttttccgttctttttttattttgttttctgtagagagaaccatcaacttcatcaatgtattgcattgcgtgatgtatattctaaggcgaaacttcctccttcccttcaagttgcttgtatgtataacaaaagatgtggactgttggatggcgtcg

SEQ ID NO: 4856 - DNA, 1112 bp, Saccharum officinarum
ggcggcggagtgctcgagggtgctgcggtgccgcgcgatccggtggtgggccaaggtcgccgtgctcgggatcttccttgctggggccggagctgctgcggtcgtcttcctcggcccgctccttatcaagaaggttgttgcacctattctttactgggaatcaacaactttcagcagaccagctattgctctaatatgttttggcgcaatcgccttattcccaagtgttttgttaccttcttcgcccttcatgtggcttgcggggatgacttttggatatctttatggctttttgataatcacagtgggaatgagcatacgcatgtcattgccgtattttataggctctgcattccactgtaggatacatagatggctggagaagtggccaaagaaagcagcttttgtaaggcttgctggcgaaggggattggcatcatcaatttaaggctgttgcattactaaggatttctccatttccatatatagtttttaactatgcttcggtggctacgaatgtcaaatattacccatacatagcgggttctatggctggaaccatacatgaaacttttcttgcaatatacagtgggaaacttctacagagcttggcagtagcaactagccatgggtccttcttgtcgttggatcagattatctacaatggaatcggctttacaattgctgcagcttctactgctgcgatcactatttatgcaaagaaagcacttcaaaagctccaagcggaggacgagatattttgagcgcatgaggtccaagcccaggatgaaacccataacgctagttttctttcaggtgtattatatatgaacagttgctactaatttggtttcctgtgtcaactacctgactactacaaccatctgaggagggggggagggtgctgcagcaattgtaaagaaaatagacccagaaaacacttacgttttccgttcttcttgttttgttttctgtagagagaactatcaacttcatcagtgtattgcattgcgcgatgtaaattcccaagtcgaaagttgtttccttgtcttgagaaggataacaagatactatgcattgttggatgctggcagcgtcgatatccattacata

SEQ ID NO: 4857 - DNA, 1594 bp, Triticum aestivum
gcacgaggctaaaaaataaataaaaatattgcggtttcccctgcctccagtgcccaccagaaccgagtccgccccaatgccgttgcctcgctcccactcctcacaaattcctccccctccctgaaaccaaaccctagcgctcctcaatcgcacatagcaccccggaaatccgcccagctcgagccagatttggctttgcgcggaccaattcggcacccaataaatccggggggtgtccccttgggcatgctcgcttgatcgcgtccggcccatgggaatgtcgggggccgccagtggcggtgccggatgcggacgcggcgagtacatgaggatcccggaggatgtggacgctatcaaggaggcggtaaaggaggagggggagtgcccaagactgctgcgatgccgcgcgatccggtggtgggcgaaggtcgccgtactcgggatcttcctcgccggcgccgccgcggccgccgtcgttttcctgggcccactcgtcatcaagaaggtggttgtgccgattattgactggcaatcaagaactttcagccgaccagttattcttctaatatgttttggtgcaatcgctttattcccaagtgtcttgataccttcttctccctttatgtggattgcggggatgacctttggatatggttatggctttctgataattacaacggcgatgagcataggcatgtcattaccattttgtataggatctgcgttccattccagaatacacagatggttggaaaaatggccgaagaaagctgcttttgttagacttgctggtgaaggagattggttccatcaatttagggcagttgctttacttaggatttctccatttccatatatagtttttaactacgcttccgtggctacaaatgtcaaatattgtccatatatagctggttcaatggcgggaaccatacatgaaaccctccttgcaatttatagtgggaagctcgttcaaagcttggctgcggcgactagccaagggtctttcttgtcagtggatcagatcatctacaacggaattggctttacggttgctgcagtttccactgctgcaataactatttatgcgaaaaaggcgctccaaaaattgcaagccgaggatgagctatgttgatatccttgctccggatcaaatcttgatgctaggtcccctccaggtgtaaactacaaacgggcactactaatctggtttcaatcgtcaacaacctgcaacagttgtaaagaaaatagagatccagaatcacttcccttctctcttcttttggttttgttttaagtagagagagaattgccaaaattaagaactccaatcaatgtacgaaccggggcctgtgcaatgtatatttcaagctgcttaaggtgaaattatctttgttttgtttattgatgaagaaaatacgagcaccatttttaccatctgtgatgcacacagtttgcctttcagttcaactttgttattagaaccaaaatgcacacgtagtgaataatagttggatatttttttccaataaagggtggattttattgacttgtaatgttgtatcaagagaatacaatcatcaagaatacacac

SEQ ID NO: 4858 - DNA, 3578 bp, Setaria italica
ttctctccgcacttccctcccaaatcccaaacctctcgccccgctccgccgtcgagcaaaaccctagccgccgccgcgatggacgacagcctctacgacgagttcggcaactacatcggcccggagctcgccgactccgacgccgacgatgactccgacgccggcggcgcatccccatccccctccgcgtcccgctcgccgtcccccgccgcgcgctccccttcgggatccccctcccgcccggccgcgctcatggacgtcgacgacgacgaggacggcgacccgtcgcagcaggccgtggtgctcgccgaggacaagaagtactaccccaccgccgaggaggtgtacgggccgggcgtggaggcgctcgtcatggacgaggacgagcagccgctggagcagcccatcgtcgcgccgccccgcgtcgtgaagttcgaggtcgggacccgcgccgcggccacgtccacctacgcgtccaccgacttcctcctggggctcgcggggaaccccgcgctggtgcgcaacgtcgccctcgtcggacacctccagcacgggaagacggtgttcatggacatgctcgtggagcagacgcacgaagtggacaccttcgactccgagggggagcgccacgtgaggttcaccgataccagggtggacgagcaggagcggcaggtctccatcaaggctgtgcccatgtctctcgtgctcgaggggggaaatggcaagtcatacctgtgcaatatcatggacactccggggcatgtcaacttctccgatgagatgactgcggcactgcggcttgctgatggggctgtgcttgttgttgatgctgctgagggagtaatggttaatactgagagggcaattcgtcatgcaatccaagaaaggcttcccattgttgttgtgattaacaaggttgacagattgataacagagctaaagctgccccccaatgatgcatatttcaaattgcgacatactctggaggcaattaatgatcttatctcgtcgtgttctactacagtaggtggcactcagttggtggatcctgccgctggaaacgtatgttttgcaagtggtgctgctggctggtcttttaccttacaatcttttgcccatctttatttaaagattcatgggattcaatttgaccatgagaaatttgcatctcgcctatggggagacgtgtattttcaccctgactcaagaaccttcaaaaagaagccgccaaaggaaggagctaatagatcatttgttgagtttatcctagagcctctgtacaaaatttatagtctggttgttggtgagcaaaaggggaatgttgaatcaaagcttgctgaattgggcgtcacgctgagcaatgcagcttacaagctgaatgttaggcctttgctgaggttagcttgccgctcaatttttggcaccgcaactggttttaccgatatgttagtgaaacatatcccctctgtgaaggatgctgctgcaaggaagatagaccacatatacactggcccacaggattcgtctattgttgatgctatgaaaaaatgtgatcccaatggacaccttatggttaatgtaacaaaattatatcctaaatctgattgcagcgtctttgatgcatttggacgagtttatagtggcacaatacagacaggacagacagtgagggtccttggagaaggctattctccagatgatgaagaggatatgactgtcaaagaggtgaccaaattgtgggtttatcaggcacggtaccgtgttgcaattagtaaagcacctgctggttcttgggttcttattgaaggcgtagatgcatcaatcatgaaaactgctacaatatgtcccatgaacattgatgaagatgtgtacatatttagacctctgcgtttcaacaccttgcctgttgtaaaaatagctgctgagcctcttaacccaagtgagcttcctaagatggtggaaggtcttcgtaaaatcagcaagagctatcctcttgctattactaaggtagaagagtctggagagcacactatactggggactggtgagctatatctggattctataatgaaggacctcagagagctttattcggaggttgaagtgaaggtagcagatcctgttgttacattttgtgaaacagttgttgatacttcttcaatgaaatgttttgctgaaacacctaacaagaggaacaaaattaccatggttgctgaaccactagagaagggcttgacagaagatattgagaatggccttgttaaccttgattcaagacagaaagaaatcactgacttttttcgccagcgctaccagtgggatgtacttgcagcaaggtcgatatgggcttttggacctgacaagcagggtcctaacattcttctggatgacacactttcagttgaggtggacaagaacttgctcaatgcgatcaaagattctattgttcaagggttccagtggggtgctagagaaggtcctttgtgtgatgaaccaattaggaatgtgaaattcaagatcttacatgcaaacattgctccagaaccattgcaccgtggtggtggtcagataattcccacagcacgtcgtgttgtctattctgcattccttatggctaatcctcgccttatggaacctgtgtattatgttgagatccaaacaccaattgactgtgtctctgctatttacacggtgctatccaggcgacgtggtcatgtaacagctgatgtacccaagccaggaactcctatatacattgtcaaggcatttttacctgttatagagtcttttggatttgagacagatctcagataccacacacaggggcaagcattttgtgtgtctgtattcgatcactgggctattgttcctggtgatcctttagataagagtattgtccttcgccctctggaaccagcacctatacagcaccttgcccgtgagtttatggtaaagaccaggcgaaggaaggggatgagtgaggatgtgagcatcagcaaattctttgatgaggccatgatgcacgagctggctcaacaggctgccgatctccatattcagatgtagttccagagcatgatgggatgtgcttgcttgacaaagttgtcactcttgagaagacgcaaatgggtccttggctttttgttacttacactagttgcagatgggaagctagaaccaccctactctcttcggaagttccaatcgcaccaccatatgctgtcatttgcccgggcctgttgccccctggattgcagattctgattccaggatatcatgtagggaattatcattataggattgggtaccatctaccgatcattgtatgtacgatttctgtagcatctacatcatctaactagcgcgacactgcgagatttcactgtagcaatggcatttttggggatgtagagctgaagtgagatttttactggcttgcctcgtttcttttcctgctccgtttttacaaatgtacaagggaaacgtctgaaagtattatcttgtattttatctgtatttttctggctgaaggtatgtaactcgtgtatgatgtgtccctgcgtaaaggcgtaaagatt

SEQ ID NO: 4859 - DNA, 3524 bp, Setaria italica
cgcacttccctcccaaatcccaaacctctcgccccgctccgccgtcgagcaaaaccctagccgccgccgcgatggacgacagcctctacgacgagttcggcaactacatcggcccggagctcgccgactccgacgccgacgatgactccgacgccggcggcgcatccccatccccctccgcgtcccgctcgccgtcccccgccgcgcgctccccttcgggatccccctcccgcccggccgcgctcatggacgtcgacgacgacgaggacggcgacccgtcgcagcaggccgtggtgctcgccgaggacaagaagtactaccccaccgccgaggaggtgtacgggccgggcgtggaggcgctcgtcatggacgaggacgagcagccgctggagcagcccatcgtcgcgccgccccgcgtcgtgaagttcgaggtcgggacccgcgccgcggccacgtccacctacgcgtccaccgacttcctcctggggctcgcggggaaccccgcgctggtgcgcaacgtcgccctcgtcggacacctccagcacgggaagacggtgttcatggacatgctcgtggagcagacgcacgaagtggacaccttcgactccgagggggagcgccacgtgaggttcaccgataccagggtggacgagcaggagcggcaggtctccatcaaggctgtgcccatgtctctcgtgctcgaggggggaaatggcaagtcatacctgtgcaatatcatggacactccggggcatgtcaacttctccgatgagatgactgcggcactgcggcttgctgatggggctgtgcttgttgttgatgctgctgagggagtaatggttaatactgagagggcaattcgtcatgcaatccaagaaaggcttcccattgttgttgtgattaacaaggttgacagattgataacagagctaaagctgccccccaatgatgcatatttcaaattgcgacatactctggaggcaattaatgatcttatctcgtcgtgttctactacagtaggtggcactcagttggtggatcctgccgctggaaacgtatgttttgcaagtggtgctgctggctggtcttttaccttacaatcttttgcccatctttatttaaagattcatgggattcaatttgaccatgagaaatttgcatctcgcctatggggagacgtgtattttcaccctgactcaagaaccttcaaaaagaagccgccaaaggaaggagctaatagatcatttgttgagtttatcctagagcctctgtacaaaatttatagtctggttgttggtgagcaaaaggggaatgttgaatcaaagcttgctgaattgggcgtcacgctgagcaatgcagcttacaagctgaatgttaggcctttgctgaggttagcttgccgctcaatttttggcaccgcaactggttttaccgatatgttagtgaaacatatcccctctgtgaaggatgctgctgcaaggaagatagaccacatatacactggcccacaggattcgtctattgttgatgctatgaaaaaatgtgatcccaatggacaccttatggttaatgtaacaaaattatatcctaaatctgattgcagcgtctttgatgcatttggacgagtttatagtggcacaatacagacaggacagacagtgagggtccttggagaaggctattctccagatgatgaagaggatatgactgtcaaagaggtgaccaaattgtgggtttatcaggcacggtaccgtgttgcaattagtaaagcacctgctggttcttgggttcttattgaaggcgtagatgcatcaatcatgaaaactgctacaatatgtcccatgaacattgatgaagatgtgtacatatttagacctctgcgtttcaacaccttgcctgttgtaaaaatagctgctgagcctcttaacccaagtgagcttcctaagatggtggaaggtcttcgtaaaatcagcaagagctatcctcttgctattactaaggtagaagagtctggagagcacactatactggggactggtgagctatatctggattctataatgaaggacctcagagagctttattcggaggttgaagtgaaggtagcagatcctgttgttacattttgtgaaacagttgttgatacttcttcaatgaaatgttttgctgaaacacctaacaagaggaacaaaattaccatggttgctgaaccactagagaagggcttgacagaagatattgagaatggccttgttaaccttgattcaagacagaaagaaatcactgacttttttcgccagcgctaccagtgggatgtacttgcagcaaggtcgatatgggcttttggacctgacaagcagggtcctaacattcttctggatgacacactttcagttgaggtggacaagaacttgctcaatgcgatcaaagattctattgttcaagggttccagtggggtgctagagaaggtcctttgtgtgatgaaccaattaggaatgtgaaattcaagatcttacatgcaaacattgctccagaaccattgcaccgtggtggtggtcagataattcccacagcacgtcgtgttgtctattctgcattccttatggctaatcctcgccttatggaacctgtgtattatgttgagatccaaacaccaattgactgtgtctctgctatttacacggtgctatccaggcgacgtggtcatgtaacagctgatgtacccaagccaggaactcctatatacattgtcaaggcatttttacctgttatagagtcttttggatttgagacagatctcagataccacacacaggggcaagcattttgtgtgtctgtattcgatcactgggctattgttcctggtgatcctttagataagagtattgtccttcgccctctggaaccagcacctatacagcaccttgcccgtgagtttatggtaaagaccaggcgaaggaaggggatgagtgaggatgtgagcatcagcaaattctttgatgaggccatgatgcacgagctggctcaacaggctgccgatctccatattcagatgtagttccagagcatgatgggatgtgcttgcttgacaaagttgtcactcttgagaagacgcaaatgggtccttggctttttgttacttacactagttgcagatgggaagctagaaccaccctactctcttcggaagttccaatcgcaccaccatatgctgtcatttgcccgggcctgttgccccctggattgcagattctgattccaggatatcatgtagggaattatcattataggattgggtaccatctaccgatcattgtatgtacgatttctgtagcatctacatcatctaactagcgcgacactgcgagatttcactgtagcaatggcatttttggggatgtagagctgaagtgagatttttactggcttgcctcgtttcttttcctgctccgtttttacaaatgtacaagggaaacgtctgaaagtattatcttgtattttatctgtatttttctggctgaag

SEQ ID NO: 4860 - DNA, 3820 bp, Panicum virgatum
actgagcccataggagaaagatgagaagatccaaacgatgggctgggctctcagtacgtcggttaaaaaagagatacgaatcgaaactccacagcgcctcggaatatcgcgataactcgcaatttcacttttgcacagcccgttctatcgttctccactcgccgtgccgcgcctctccgctcttcgcctcttccctcctctcccaaatcccaaacctctcgcgcccgctccgccgccgagcaaaaccctagccgctcctcgcctccgccgcgatggacgacagcctctacgacgagttcggcaactacatcggcccggagctcgccgactcggacgccgacgatgactcggatgccggcggcgcctccccgtcccccgccgcgtcgcgctcgccgtcccccgccgcgcgctccccgtcgggatccccctcccgcccggccgcgctcatggacgtcgacgacgacgaggacggcgacccgtcgcagcaggccgtggtgctcgccgaggacaagaagtactaccccaccgccgaggaggtgtacgggccgggcgtggaggcgctcgtcatggacgaggacgagcagccgctggagcagcccatcgtcgcgccgccccgcgtcgtgaagttcgaggtcgggacccgcgccgccgccacgtccacctacgcgtccaccgacttcctcctggggctcgcggggaaccccgcgctggtgcgcaacgtcgccctcgtcggccacctccagcacgggaagacggtgttcatggacatgctcgtggagcagacgcacgaggtggacacgttcgactccgagggggagcgccacgtgaggttcacagacactagggtggacgagcaggagcggcaggtctccatcaaggctgtgccaatgtcgctcgtgctcgaggggggaaatggcaagtcatacctgtgcaatatcatggacacaccagggcatgtgaacttctctgatgagatgactgcggcactgcggcttgcggatggggctgtgcttgttgttgatgctgctgagggagtaatggttaatactgagagggcaattcgtcatgcaatccaagaaaggcttcccattgttgttgtgattaacaaggttgaccgattgataacagagctaaagctgcctccaaatgatgcatatttcaagttgcggcatactctggaggcaattaatgatcttatctcatcatattctactacagtaggtggcactcagctggtggatcctgctgctggaaatgtatgttttgcaagtggtgctgctggctggtcttttaccttacaatcttttgcccatctttatttaaagattcatgggattcaatttgatcatgagaaatttgcatcgcgcctatggggagacttgtattttcaccctgattcgagaaccttcaaaaagaagccgccaaaggaaggagctaatagatcatttgttgagtttatccttgagcctctgtacaaaatctatagtctggttgttggtgagcagaaggggaatgttgaatcaaagcttgctgagttgggcgtcacgctgagcaatgcagcttataagctgaatgttaggcctttgctgaggttagcttgccgctcaatttttggcactgctactggttttacggatatgttagtgaagcatataccctctgtgaaggatgctgctgcaaggaagatagaccacatatacactggcccgcaagattcctctattgtggatgctatgaataaatgtgatcccaatggacctcttatggttaatgtaacaaaattatatcccaagtctgactgcagcgtctttgatgccttcgggcgagtttatagtggcacgatacagacaggacagactgtgagggtccttggagaaggttattctccagatgatgaagaggatatgactgttaaagaggtgaccaaattgtgggtttatcaagcacggtaccgtgttgcgattagtaaagcacctgctggttcttgggttcttattgaaggtgtagatgcatcaatcatgaaaactgccacaatatgtcctatgaacattgatgaagatgtgtacatatttagacctctacggttcaataccttgcctgttgtaaaaatagcagctgagcctcttaacccaagtgagcttcctaagatggtggaaggtcttcgtaaaatcagcaagagctatcctcttgctattactaaggtagaagagtctggagagcacactatactggggactggtgagctatatctggattctataatgaaggacctcagagagctttattcagaggttgaggtgaaggtagcagatcctgttgttacattttgtgaaacagttgttgatacttcttcgatgaaatgttttgctgaaacacctaacaagaggaacaaaattactatggttgctgaaccactagagaagggcttggcagaagatattgagaatggccttgttaaccttgatttcagacagaaagaaatcactgacttctttcgccagcgctaccagtgggatgtactggcagcaaggtcaatatgggcttttggacctgacaagcagggtcctaacattcttctggatgacacactttcagttgaagtggacaagaacttgctcaatgcaatcaatgattcaattgttcaagggtttcagtggggtgctagagaaggtcctttgtgtgatgagccaattagaaatgtgaaattcaagatcttacatgcaaacatagctccagaaccattgcaccgtggtggtggtcagataattcccacagcacgtcgtgttgtctattctgcattccttatggctaatcctcgccttatggaacctgtgtattatgttgagatccaaacaccaattgactgtgtctctgctatttatacggtgctatctcgccgacgtggtcatgtaacagctgatgtacccaagccaggcactcctatatacattgtcaaggcatttttacctgttatagagtcttttggatttgagacagatctcagataccatacacaggggcaagcattttgtgtgtcagtattcgatcactgggctattgttcctggtgatcctttagacaagagtattgtcctccgccctctggaaccagcaccaatacagcaccttgcccgtgagttcatggtaaagaccaggcgaaggaagggcatgagtgaggatgtgagcatcagtaaattcttcgacgaggccatgatgcatgagcttgctcaacaggctgctgatctccatattcagatgtagttcaaaagcgacatgagatgtgcttggttgaccaaactggatccaagatggtcacacctgagaagacgcaaatgagtccttggcatttttactgcagatgggaagctagaatcgcccggctcatcggaagttccaatcgcacctccatatgctgtcatttgactgcgtgtgttgtgcctggattgttgtttgatatcatgtagggactagggagtgaccattgtaggattgggtaccatgaccaattgtgtatgtacggtttctgttgcatctacatcatccaacgaactagcgcgacccgttgagggttaagagatttttttgtttactgtcttaactctgagcggcaatgacatcttcgggtatgtagacatgtagagcctgagattttgactggcttgatctcttgtcattttcctgctgcgtttcttgaaatcgttactcaagtataaatgcatggttttgaaaaggtgccattttatagtctctgtttcctgtctgcgagtatgtaaatcatgtagtatgatgtatccttgtgaaaagatatttcatccatggta

SEQ ID NO: 4861 - DNA, 3783 bp, Panicum virgatum
gcgtcagagatgggccttaggcatcgaagcccataggagagaaggcaggaggatgagaagatccaaaggatgggctgggctcactaccggttttaaaaaaaatacgaatcgaaactcacagtgccacggaatatcgcgataactcgcgatttcacttttgcacagcccgttctccactctccgttccgcgcctctctgctcttcgcctcttccctcctcccaaatcccaaacctctcgagcccgctccgccgccgagcaaaaccctagccgctcctcgcctccgccgagatggacgacagcctctacgacgagttcggcaactacatcggcccggagctcgctgactccgacgccgacgatgactcggacgccggcggcgcctccccgtccccctccgcatcgcgttcgccgtcccccgccgcgcgctccccgtcgggatccccctcccgcccggccgcgctcatggacgtcgacgaggaggaggacggggacccgtcacagcaggccgtggtgctcgccgaggacaagaagtactaccccaccgccgaggaggtgtacgggccgggcgtggaggcgctcgttatggacgaggacgagcagccgctggagcagcccatcgtcgcgccgccccgcgtcgtgaagttcgaggtcgggacccgcgccgcggccacgtccacctacgcgtccaccgacttcctcctggggctcgcggggaaccccgcgctggtgcgcaacgtcgccctcgtcggtcacctccagcacgggaagacggtgttcgtggacatgctcgtggagcagacacacgaggtggacacgttcgactccgagggggagcgccacgtgaggttcacagacactagggtggacgagcaggagcggcaggtctccatcaaggccgtgccaatgtcgctcgtgctcgaggggggaaatggcaagtcatacctgtgcaatatcatggacacgccagggcatgtcaacttctccgatgagatgactgcggcactgcggcttgcggatggggctgtgcttgttgttgatgctgctgagggagtaatggttaataccgagagggcgattcgtcatgcaatccaagaaaggcttcccattgttgttgtgattaacaaggttgaccgattgataacagaactaaagctgcctccaaatgatgcatatttcaagttgcggcatactctggaggcaattaatgatcttatctcatcatgttctactacagtaggtggcactcagctggtggatcctgttgctggaaatgtatgttttgcaagtggtgctgctggctggtcttttaccttacaatcttttgctcatctttatttaaagattcatgggattcaatttgatcatgagaaattttcatcgcgcctatggggagacttgtattttcaccctgattcgagaaccttcaaaaagaagccgccaaaggaaggagctaatagatcatttgttgagtttatccttgagcctctgtacaaaatatatagtctggttgtcggtgagcagaaggggaatgttgagtcaaagcttgctgaattgggcgtcaccctgagcaatgcagcttataagctgaatgttaggcctttgctgaggttagcttgtcgctcaatttttggctctgctactggttttacggatatgttagtgaagcatataccctctgtgaaggatgctgccgcaaggaagatagaccacatatacactggcccacaagattcctctattgtggatgctatgaaaaaatgtgatcccaatggaccccttatggttaatgtaacaaaattatatcctaagtctgactgcagtgtctttgatgcctttggacgagtttatagtggtacgatacagacaggacagactgtgagggtccttggagaaggctattctccagatgatgaagaggatatgactgttaaagaggtgaccaaattgtgggtttatcaggcacggtatcgtgttgcaattagtaaagcacctgctggttcttgggttcttattgaaggtgtagatgcatcaatcatgaaaactgccacaatatgtccaatgaacattgatgaagatgtgtacatatttagacctctgcggttcaacaccttgcctgttgtaaaaatagcagctgagcctcttaacccgagtgagcttcctaagatggtggaaggtcttcgtaaaatcagcaagagctatcctcttgctattactaaggtagaagagtctggagagcatactatactggggactggtgagctatatctggattctataatgaaggacctcagagagctttattcagaggtcgaggtgaaggtagcagatcctgttgttacattttgtgaaacagttgttgatacttcttcgatgaaatgttttgctgaaacaccgaacaagaggaacaaaattactatggttgctgaaccactagagaagggcttggcagaagatattgagaatggccttgttaaccttgattccagacagaaagaaatcactgacttctttcgccagcgctaccagtgggatgtacttgcagcaaggtcaatatgggcttttggacctgacaagcagggtcctaacattcttctggatgacacactttcagttgaagtggacaagaactttctcaattcaatcaaagattcaattgttcaggggtttcagtggggtgctagagaaggtcctttgtgtgatgagccaataagaaatgtgaaattcaagatcttacatgcaaacatagctccagaaccattgcaccgtggtggtggtcagataatccccacagcacgtcgtgttgtctattctgcattccttatggctaatcctcgccttatggaacctgtgtattatgttgagatccaaacaccaattgactgtgtctctgctatttatacggtgctatcccggcgacgtggtcatgtaacagctgatgtacccaagccaggcactcctatatacatagtcaaggcatttttacctgttatagagtcttttggatttgagacagatctcagataccatacacaggggcaagcattttgtgtgtcagtattcgatcactgggctattgttcctggtgatcctttagacaagagtattgtccttcgccctctggaaccagcaccaatacagcaccttgcccgagagttcatggtaaagaccaggcgaaggaagggcatgagtgaggatgtgagcatcagcaaattcttcgacgaggccatgatgcacgagctggctcaacaggctgctgatctccatattcaaatgtagttcgaaagcgagattagatgtgcttggttgaccaagctggatccaagatggtcacacttgagaagatgcaaatgagtcatcggcatttttattgcagatggaaagctagaatcgctcctctcttcggaagttccaatcgcacctccatgtgctgtcatttgccagcggctgttgcgcctggattgttgtttgatatcatgtggggagcgaccattgtaggatcgggtaccatgaccaatcgtgtatgtacgatttctgtagcatctacatcatctaacgaactagcgcgacccattgagggttaagagattttttgtttactgtcttaactctgagtggcgatgacatcttcggggatgtagacatgcagagcataagtgagattttgactggcttgatcccttttctttttgcttgttcctgctccgtttcttaaactcgttacaaaaatacaaatgtgtggttttgaaaaagtagaaggaactattttatattgtctctgtttt

SEQ ID NO: 4862 - DNA, 3564 bp, Oryza sativa
gcatcttcccctttccacccaaatcccaaacctcccccctccccgcgccggcgcccaaaaccctagccggcaaggcccctccctctccgatctcgccggccgccgccatggacgacagcctctacgacgagttcggcaactacatcggcccggagctcgccgactccgacgccgatgactccgacgcggacgcctccccgtccccctccccgtcccgctccccttccccctccgcgcgctccccgtcgggctccccctcccgccccgccgctctcatggacgtcgacggcggcgacgacgacgacgacgccgacccgtcccagagcgccgtcgtcctcgccgaggacaagaagtactaccccaccgccgaggaggtgtacgggcccggcgtggaggcgctcgtcatggacgaggatgagcagccgctagagcagcccatcgtcgcgcccccacgcgtcgtgaggttcgaggtcggcacccgcgcggaggccacctccacctacgccaccaccgacttcctcctcggcctcgccgccaacccggcgctggtgcgcaacgtcgcgctcgtgggccacctgcagcacgggaagacggtgttcatggacatgctcgtggaacagacccacgaggtggacaccttcgactccgagggcgagcgccatgtgaggttcaccgacacccgggtggatgagcaagagcggcgggtgtccatcaaggccgtgcccatgtcccttgtgcttgagggagggaatggcaagtcatacctgtgcaatatcatggacacacctgggcatgtcaatttttccgatgagatgactgccgcgttgcggatcgctgatggggctgtgcttgttgtcgatgctgccgagggtgttatggtaaatacagagagggcgattcgtcacgcaacacaagaaagactccccattgttgtcgtgattaacaaggttgatagattgattacagagctaaagctgccacctaatgatgcatatttcaagctacggcatacactggaggcgatcaatgatctcatctcgtcttgttctaccacagtaggtggcactcaactggttgatcctgctgctggaaatgtttgttttgcaagtggttctgcaggctggtcttttaccttgcaatcttttgctcatctttatttaaagatccatgggattcaatttgatcatgagaaatttgcatcgcgtctatggggagacctatattatcaccctgacactagaaccttcaaaaagaagcctccaaaggaaggagctaatagatcatttgttgagtttgtccttgaacctttgtacaaaatatatagtcaggttgttggagagtcaaagggtaaggttgaagcaactctttctgagctgggtgtgacgctgagcaatgcagcttataagcttaatgttaggcctttgctgagattagcttgtcgctcaattttcgggacttctactggctttactgacatgctagtgaaacacataccctctgtcaaggatgctgctccaaggaagatagaacacatatacactggtccacaagattccactattgtggatgctatgaaaaaatgtgatccacatgcgccccttatggttaatgttacaaagttgtatcctaagtctgactgtagtgtctttgatgcctttggacgagtttatagtggcacaatacagactgggcaaactgtgcgtgttcttggagaaggctattctcctgatgatgaagaagatatgactgtgaaagaggttactaagttgtgggtgtatcaggcacggtaccgtgttccaattagtaaagcccctgctggttcttgggttcttattgaaggtgtagatgcatcaattatgaaaactgcaactatatgtcctatgaagatggatgaagatgtctacatatttagacctctacgtttcaatactctacctgtcgtgaaaatagcagctgagcctctaaacccaagtgagctccctaagatggtggaaggtcttcgtaaaatcagtaagagttatcctcttgctgttactaaggtggaagagtctggagaacacactatccttgggactggtgagctttatctagattctataatgaaggacctcagagagctttactctgaggtagaagtgaaggttgcagatccagtcgtgacattttgtgaaacagttgttgatacttcttcgatgaaatgctttgctgaaacacccaacaagaggaacaaaattaccatggttgctgaaccattggaaaagggcttggctgaagatattgagaacggccttgttagcctggactcaaggcaaaaggaaatcactgacttctttcgtcaacgctaccagtgggatgtgctagcagcaaggtcaatatgggcttttgggcctgaaaagcagggtcctaacattctcttagatgacaccctttcagtcgaggtggataaaaacttgctcaatgcagtcaaagattcaattgttcaagggtttcaatggggtgctagagaaggtccgctgtgtgatgaaccaattagaaatgtgaaattcaagatcttaaatgcaaacatagctcctgaaccgttgcaccgtggtggtggtcagataattccaacagctcgtcgtgtggtttactcagcgttcctaatggctaatccacgccttatggagcctgtatattatattgagatccaaacaccaattgactgtgtctctgccatatatacggtgctatcccgtcgtcgagggcatgtaacagcggatgtacccaaaccaggaactccaatctatgttgttaaggcatttttacctgttatagagtcatttggatttgagaccgacctgaggtaccatacacagggacaggccttttgcctatcagtgttcgatcactgggctattgttcctggtgaccctttagacaagaatattgtcctccggccgctggaaccagcaccaatacagcatcttgctcgtgagtttatggtgaagactaggcgaaggaagggcatgagtgaggatgtgagcatcaacaagttctttgatgaggccatgatgaacgagctggcgcagcaggctgctgatctccatcttcaaatgatgtagttcgaaatcgtgaagtggggattggtttcttcatattgatgatctttagaagatgcgatggcttatgtcttcttttacactgggaactggaatcaacctttggaatcagccaagtgctcacctgttcgcatgcccattgctgctgcgctttatctgccgcatgttgatggtcgggtgtttttgtgattgatggttttggtagacgggagtcccatctatttcatctttatgtatgatctcttcctgtaacattttcatcatctaaccttatcagttttagttagccattcggaactggagataagttttgaggggcgatgatatcatctaatctggattgcagcatggatggtgtaatgactgatgtgatccttttgtccttgtccattgttccatctaatgtactacaagtagcattctacaccctttgagtttttgaaggatacaacacatgtcttgcagt

SEQ ID NO: 4863 - DNA, 3441 bp, Brachypodium distachyon
tcctcttcccccctctctccaaatcccaaacctcccccgctcccttccggcggccccaaaaccctagcccgcgtcccaccgatctcgacgccatggacgacagcctctacgacgagttcggcaactatatcggcccggagctcgccgactccgacgccgatgactccgacgccgccgcctccccgtccccctcgccgtcccgctccccctccccggcgcgctccctgtcaggctcccccaactcccgccgccccgccgccctcatggacgtcgacgacgacgactacgccgacgcctccccgaacgccgtcgtcctcgccgaggacaagaagtactaccccaccgccgaggaggtctacggcccgggcgtcgaggcgctcgtcatggacgaagatgagcaggcgctcgagcagcccatcgtggcgccgccgcgcgtggtgaagttcgaggtcggcacccgagctggcgccacctccacctacgcttccactgatttcgtccttgggctcgctgccaacccgctgctggtccgcaatgtggctctcgtgggccacctgcagcacgggaagacggtgttcatggacatgctcgtggagcagacgcacgaggtggacacgtttgactccgagggcgagcgccatgtgcggttcacggacacccgggtggacgagcaggagcgaagggtctccataaaggctgtgccgatgtcactcgtgctcgaggggggcaatggcaagtcgtatctctgcaacatcatggacacgcctgggcatgtcaacttttctgatgagatgactgctgcgctccggctcgcggatggagctgtgcttgttgttgatgctgccgagggcgtcatggtaaatactgagcgggcgattcgtcatgcaatccaagaaagacttcccattgttgttgtgattaacaaggttgacagactgataacagagctaaagctgcccccgaatgacgcatatttcaaaatacggcatacactggacacaatcaacgatcttatctcatcttgttctaccacagtaggtggcactcaactggtagacccagctgctggaaatgtttgttttgcgagtggttctgctggctggtcttttaccttgcaatcttttgcacatctttatggaaagattcatgggattccatttgaccatgagaaatttgcttctcgtctatggggagatttgtattatcaccatggctccagaaccttcaaaaagaagccgccagcagaaggagctaatagatcgttcattgagttcatccttgagcctctgtacaaaatctatagtcaagttgttggagagcaaaagagccttgtcgaatcaactcttgctgacttgggtgtgacgctgagcaatgcagcttacaagcttaacgttaggcctttgctaagacttgcttgccgctcaatttttggcactgctactggctttactgacatgttagtgaaaaacatcccctctgtgaaggatgctgctgcaaggaagatagaacacatatacactggtccacaggattcctccatcgtggaagcgatgaagaaatgtgattctaatggccctcttatggtcaatgttacaaaactgtatcctaaatctgactgtagtgtctttgatgcctttggacgagtttatagtggcacaatacagactggtcagactgtccgggtccttggagaaggctactctcctgatgatgaagaggatatgactgtcaaagaggtcaccaagttgtgggtttatcaggcacggtaccgtgttccaattagtaaagcccctgctggttcctgggttcttatcgaaggcgttgacgcatcaatcatgaaaactgcaactatatgtcctatgaacatggatgacgatgtgtacatatttagacctttacgtttcaatactttacctgttgtaaaaatagctgcggagcctcttaaccccagtgagctccctaaaatggtggaaggccttcgtaaaatcagtaaaagctatcctcttgctattaccaaggtagaagagtcaggagaacacaccatccttgggactggtgagctatatctagattctataatgaaggaccttagagagctttactctgaggtagaagtgaaggttgcagatccagttgtgacattttgtgaaacagttgttgatacttcttctatgaaatgttttgctgaaacacccaacaagagaaacaaaattaccatgctagctgaaccactagagaagggcttggcagaagatattgagaatggccttgttagccttgactccaggcagaaagaagtcactgacttctttcgccaacgctaccaatgggatgtgcttgcagcaaggtcaatatgggcttttggacctgacaagcagggtcctaacattctactggatgactcactttcagttgaggtggataagaacttgctgaatgcagtcaaagattcaatcgttcaagggtttcagtggggtgctagagaaggtcccttgtgtgatgaaccaattaggaatgtcaagttcaagatcttaaatgcaaacattgctccagaaccattgcaccgtggtggtggtcaaataattcccacagctcgtcgtgtggtctactcagcatttctgatggctaatcctcgccttatggagcctgtttattacattgagatccaaactccaatcgactgtgtctctgctatatacacggtcctgtcacgacggcgtggccatgtgacagccgatgtacccaagccaggcactccaatatacgttgttaaggcatttttacctgttatagagtcttttggatttgagacagacctcagataccatacccagggacaggccttttgtgtgtcagtctttgatcactgggctattgttcctggcgatcctcttgacaagagcattgtcctccgccctctggaaccagcacctatacaacaccttgcccgtgagttcatggtaaagacgaggcgaaggaagggcatgagcgaggatgtcagcatcaacaagttctttgacgaagctatgatgaacgagcttgcacagcaggctgcagacctccacttgcaaatgatgtagtcggggaaaggtccactgtctttttgcgacatggttgttgaacgagcgccacactttcgaaacttggatctgtgcgttttgatgatagccgggtaattatgtactccataacagatatcatagaccgggtaccttctgtcatcgtgtatgttcttgctatagcatctacatcatctaacgaatcagtgtaaccattgagagctgcgactggttttaacattttgatggcatctcaagggacgatgtcattactagtttgatctgtgttttctttcattccacaaccactgtagtgtagcattgtgcattgtttgaagtttctggatgatggttgctaaaaaaatcttactcggtgagtatt

SEQ ID NO: 4864 - DNA, 3455 bp, Brachypodium distachyon
accgcctcctcttcccccctctctccaaatcccaaacctcccccgctcccttccggcggccccaaaaccctagcccgcgtcccaccgatctcgacgccatggacgacagcctctacgacgagttcggcaactatatcggcccggagctcgccgactccgacgccgatgactccgacgccgccgcctccccgtccccctcgccgtcccgctccccctccccggcgcgctccctgtcaggctcccccaactcccgccgccccgccgccctcatggacgtcgacgacgacgactacgccgacgcctccccgaacgccgtcgtcctcgccgaggacaagaagtactaccccaccgccgaggaggtctacggcccgggcgtcgaggcgctcgtcatggacgaagatgagcaggcgctcgagcagcccatcgtggcgccgccgcgcgtggtgaagttcgaggtcggcacccgagctggcgccacctccacctacgcttccactgatttcgtccttgggctcgctgccaacccgctgctggtccgcaatgtggctctcgtgggccacctgcagcacgggaagacggtgttcatggacatgctcgtggagcagacgcacgaggtggacacgtttgactccgagggcgagcgccatgtgcggttcacggacacccgggtggacgagcaggagcgaagggtctccataaaggctgtgccgatgtcactcgtgctcgaggggggcaatggcaagtcgtatctctgcaacatcatggacacgcctgggcatgtcaacttttctgatgagatgactgctgcgctccggctcgcggatggagctgtgcttgttgttgatgctgccgagggcgtcatggtaaatactgagcgggcgattcgtcatgcaatccaagaaagacttcccattgttgttgtgattaacaaggttgacagactgataacagagctaaagctgcccccgaatgacgcatatttcaaaatacggcatacactggacacaatcaacgatcttatctcatcttgttctaccacagtaggtggcactcaactggtagacccagctgctggaaatgtttgttttgcgagtggttctgctggctggtcttttaccttgcaatcttttgcacatctttatggaaagattcatgggattccatttgaccatgagaaatttgcttctcgtctatggggagatttgtattatcaccatggctccagaaccttcaaaaagaagccgccagcagaaggagctaatagatcgttcattgagttcatccttgagcctctgtacaaaatctatagtcaagttgttggagagcaaaagagccttgtcgaatcaactcttgctgacttgggtgtgacgctgagcaatgcagcttacaagcttaacgttaggcctttgctaagacttgcttgccgctcaatttttggcactgctactggctttactgacatgttagtgaaaaacatcccctctgtgaaggatgctgctgcaaggaagatagaacacatatacactggtccacaggattcctccatcgtggaagcgatgaagaaatgtgattctaatggccctcttatggtcaatgttacaaaactgtatcctaaatctgactgtagtgtctttgatgcctttggacgagtttatagtggcacaatacagactggtcagactgtccgggtccttggagaaggctactctcctgatgatgaagaggatatgactgtcaaagaggtcaccaagttgtgggtttatcaggcacggtaccgtgttccaattagtaaagcccctgctggttcctgggttcttatcgaaggcgttgacgcatcaatcatgaaaactgcaactatatgtcctatgaacatggatgacgatgtgtacatatttagacctttacgtttcaatactttacctgttgtaaaaatagctgcggagcctcttaaccccagtgagctccctaaaatggtggaaggccttcgtaaaatcagtaaaagctatcctcttgctattaccaaggtagaagagtcaggagaacacaccatccttgggactggtgagctatatctagattctataatgaaggaccttagagagctttactctgaggtagaagtgaaggttgcagatccagttgtgacattttgtgaaacagttgttgatacttcttctatgaaatgttttgctgaaacacccaacaagagaaacaaaattaccatgctagctgaaccactagagaagggcttggcagaagatattgagaatggccttgttagccttgactccaggcagaaagaagtcactgacttctttcgccaacgctaccaatgggatgtgcttgcagcaaggtcaatatgggcttttggacctgacaagcagggtcctaacattctactggatgactcactttcagttgaggtggataagaacttgctgaatgcagtcaaagattcaatcgttcaagggtttcagtggggtgctagagaaggtcccttgtgtgatgaaccaattaggaatgtcaagttcaagatcttaaatgcaaacattgctccagaaccattgcaccgtggtggtggtcaaataattcccacagctcgtcgtgtggtctactcagcatttctgatggctaatcctcgccttatggagcctgtttattacattgagatccaaactccaatcgactgtgtctctgctatatacacggtcctgtcacgacggcgtggccatgtgacagccgatgtacccaagccaggcactccaatatacgttgttaaggcatttttacctgttatagagtcttttggatttgagacagacctcagataccatacccagggacaggccttttgtgtgtcagtctttgatcactgggctattgttcctggcgatcctcttgacaagagcattgtcctccgccctctggaaccagcacctatacaacaccttgcccgtgagttcatggtaaagacgaggcgaaggaagggcatgagcgaggatgtcagcatcaacaagttctttgacgaagctatgatgaacgagcttgcacagcaggctgcagacctccacttgcaaatgatgtagtcggggaaaggtccactgtctttttgcgacatggttgttgaacgagcgccacactttcgaaacttggatctgtgcgttttgatgatagccgggtaattatgtactccataacagatatcatagaccgggtaccttctgtcatcgtgtatgttcttgctatagcatctacatcatctaacgaatcagtgtaaccattgagagctgcgactggttttaacattttgatggcatctcaagggacgatgtcattactagtttgatctgtgttttctttcattccacaaccactgtagtgtagcattgtgcattgtttgaagtttctggatgatggttgctaaaaaaatcttactcggtgagtatttgagtatt

SEQ ID NO: 4865 - DNA, 3378 bp, Triticum aestivum
atggacgtcgacgacgacgactacgccgacgccgcccagaacgccgtcgtcctcgccgaggacaagaagtactaccccacggccgaggaggtctacggcccgggcgtcgaggcgctcgtcatggacgaggacgagcaggcgctcgagaagcccatcgtggcgccgccccgcgtcgtcaagttcgaggtcggcacccgcgccggcgcgacctccacctacgcctccaccgatttcatcctcggcctcgcctccaacccgctgctggtccgcaatgtggcgctcgtgggccacctgcagcacgggaagacggtgttcatggacatgctcgtggagcagacccacgaggtggacacgttcgactccgagggcgagcgccacatccggttcacagacacccgggtggacgagcaggagcgcagggtctccatcaaggctgtgcccatgtcactcgtgctcgagtcggggaatggcaagtcctatctctgcaatatcatggacacgcctgggcatgtcaatttttccgacgagatgactgctgcgctcaggctagcggatggggctgtgcttgttgtcgatgctgctgagggcgtcatggtaaacactgagagggcgattcgtcatgcaatccaagaaagacttcccatcgttgttgtgattaacaaggttgacagactgataacagagctaaagctacccccaaatgatgcgtattttaagctacgacatacactggacacaatcaatgatctaatctcatcttgttctaccacagtaggtggcactcaactggtagaccctgctgctggaaatgtttgctttgcgagtggttctgctggctggtcttttaccttgcaatcgtttgcgcatctttatttgaagattcatgggattcagtttgaccatgagaaatttgcatctcgtctatggggagatttgtattatgaccataactctagaaccttcaaaaagaagccgccagcagcaggtgctaataggtcattcattgagttcatccttgagcctctgtataaaatctatagtcaggttgttggagagcaacagaaaattcttgaaataactctcgctgacttgggtgtgacactgagcaatgcagcttataagcttaatgttaggcctttgctgagacttgcttgccgctcaatttttggcactgctactggttttactgacatgttagtgaaaaacatccccaatgtgaaggatggtgctgcaaggaaaatagaacacatatacaccggtcaacaagattcctccattgtggatgcaatgaagaaatgtgattcccatggtcctcttatggtcaatgttacaaaactgtatcctaagcctgactgtagtgtctttgatgcctttggacgagtttatagtggcacaatacagactggtcagacagttcgggtgcttggagaaggctattcccctgatgatgaagaggatatgactgtcaaagaggtcaccaagctgtgggtctatcaggcacggtaccgtgttccaataagtaaggcccctgctggttcttgggttcttattgaaggcgtggatgcatcaatcatgaaaactgcaaccatatgtcctatgaacatggatgaagatgtgtacatatttagacctctacgcttcaataccttacctgttgtgaagatagcagctgagcctcttaacccgagtgagctacctaaaatggtggaaggtctacgtaaaattagcaagagctaccctcttgctattactaaggtagaagagtcaggagaacacactatacttgggactggtgagctatatctagattctataatgaaggacctcagagagctttactctgaggtagaagtgaaggttgcagatccagttgtgacattttgtgaaacagttgttgatacttcctctatgaaatgttttgctgaaacacccaacaagaggaacaaaattaccatgttagctgaaccactagagaagggcttggcagaagatatagagaatggcctcgtaagccttgactcgaggcagaaagaagtcaccgacttctttcgccaacgctaccagtgggatgtgcttgcagcaaggtcaatatgggcttttggacctgacaagcagggtcctaacattctattggatgactctctttcggttgaggtggataagaatttgctgaatgcagtcaaagattcaattgttcaagggtttcagtggggggctagagaaggccccttgtgtgatgaaccaattaggaatgtgaagttcaagatcttaaatgcaaatatcgctccagaaccattgcaccgtggaggtggccaaataatccccacagctcgtcgggttgtctactcagcgtttctaatggctaatcctcgactaatggagcctgtttattatattgagatccaaactccaattgactgtgtgtctgctatatatacggtcctgtcgcggcgacgtggccatgtgacagccgatgtacccaagccaggcactccagtatatgttgtcaaggcatttttacctgtcatagagtcttttgggtttgagacagatctcagataccatacacagggacaagcattttgtgtgtcagtgtttgaccactgggctattgttcctggcgatcctcttgacaagggcattgttctccggcctttggaaccagcacctatccaacaccttgcccgtgagttcatggtaaagaccaggcgaaggaagggcatgagcgaggatgttagcatcaacaagttctttgacgaggccatgatgaacgagctggcacaacagactgcagatatccacttgatgatgtagtttgatgatggaagcgccccttgcaatcgtccattgtcattttgtactgggagcacttggaaggagacgcaaattcttatccaaattgtacttttatggggctatcatgatgcgatcttcaaggagatgcaaattgccgcgttttgatggttgagtattatttgtaacggatcattgtagaccaagtaccatctgtagtcatgtatgtactatcgctctaacatctacgccgtctaaccagttagtgtaaccatcgacagagagctgagacttgtggttgatttttgataggcgatggcatttccagggacaataatgcctttacttgtttgatcctttcttcacaaattacaaccattgtagcgccgagcacctttccaagtttctggaggatagttctgtttcttgccatgcctatttgatctgtgtttttatcaggattgattactggacgtaatgtgccttcctggtaaactcctgtgaggtggtgtatgtctattggtatggtcatgctgtgtcagacttaaatcttttatctatatttcaaagtttgtattctgtttt

SEQ ID NO: 4866 - DNA, 3237 bp, Lolium multiflorum
gtacggccccggcgtcgaagccctcgtcatggacgaggacgagcaggcgctcgagaagcccatcgtggcgccgccgcgcgacgtcaagttcgaggtgggcacccgcgcgggcgcgacatccacctacgcgtccaccgacttcgtgctcggcctcgcctccaacccgctgctggtccgcaacgtggcgctcgtgggccacctgcagcacggcaagacggtcttcatggacatgctcgtggagcagacccacgaggtggacaccttcgactccgagggcgagcgccacgtcaggttcaccgacacccgggtcgacgagcaggagcgcagggtctccatcaaggccgtgcccatgtcgctcgtgctcgaggggggcaacggcaagtcgtatctctgcaatatcatggacacgccagggcatgtcaatttctctgatgagatgactgccgcgctccggctggcggatggggctgtgcttgttgttgatgctgctgaaggcgtcatggtaaacaccgagagggcgattcgtcatgcaatccaagaaagactccccatcgttgttgtgattaacaaggttgatagactaataacagagctaaagctgccaccaactgatgcatatttcaagctacggcatacactggacacaatcaacgatctaatctcatcttgttctaccacagtaggtggcactcaactggtagatcctgctgctggaaatgtttgttttgcgagtggttctgctggctggtcttttaccttgcaatcctttgctcatctttatttaaagattcatgggataccatttgaccatgagaaatttgcatctcgtctatggggtgatttgtattatgaccatacctctagaaccttcaaaaagaagccaccagcagtaggagctaacagatcattcattgagttcatccttgagcctctgtacaaaatctatagtcaggttgtcggagagcagaagagaaatgttgaatcaactcttgctgatttgggtgtgacactgagcaatgcagcttataaacttaatgttatgcctttgctaagacttgcttgccgctcaatttttggcactgctactggctttacggacatgttagtgaaaaatattcctaacgtgaaagatgctgcagcaaggaagatagaacacatatacaccggtcaacaagattcagcacttgtggatgcaatgaagaaatgtgattctcaaggcccccttatggtcaatgttacgaaactgtatcctaagcctgactgtagtgtctttgatgcctttggacgagtttatagtggcacaatacagactggtcagactgtccgggtccttggagaaggctattctcctgatgatgaggaggacatgactgtcaaagaggtcaccaagttgtgggtctatcaggcacggtaccgtgttccaataagtaaagcccctgctggttcttgggttcttattgaaggtgtggatgcatcaatcatgaaaactgcaaccatatgtcccatgaacatggatgatgatgtgtacatatttagacctctacgcttcaataccttgcctgttgtaaaaatagcagctgagcctcttaacccaagtgagctacctaaaatggtggaaggtctccgtaaaatcagcaagagctatcctcttgcaattactaaggtagaagagtcaggagaacacactatccttggaactggcgagctgtatctggattctataatgaaggacctcagagagctctactctgaagtagaagtgaaggttgcagatccagttgtgacgttttgtgaaacagttgttgatacttcctccatgaaatgttttgctgaaacacccaacaagaggaacaaaattaccatgttagctgaaccattagagaagggcttggcagaagatattgagaatggccttgttagtcttgactccagacagaaagaagtcaccgacttctttcgccaacgctaccagtgggatgtgcttgcagcaaggtcaatatgggcttttggacctgataagcagggtcctaacattctactggatgactctctttcggtagaggtggataagaacttgctaaatgcagtcaaagattcaattgtccaagggtttcagtggggtgctagagaaggtcccttgtgtgacgaaccaattaggaatgtgaagttcaagatcttaaatgcaaacatcgctccagaaccattgcatcgtggtggtggtcaaataatccccacggctcgtcgggtggtctactcagcctttttgatggctaatcctcgtctcatggagcctgtttattatattgagatccaaactccaattgactgtgtctctgctatatatacggtcctgtctcggcgacgtggtcatgtgacagccgatgttccaaagccaggcactccagtatatgttgtgaaggcatttttacctgtcatagagtcttttggctttgagacagatctcagataccatacacagggacaagccttttgtgtgtcagtgtttgatcactgggctattgttcctggcgaccctcttgacaagaacattgccctccggcctctggaaccagcacctatacagcacctagcccgtgagttcatggtaaagaccaggcgaaggaagggcatgagcgaggatgttagcatcaacaagttctttgacgaggctatgatgaatgagctggcgcagcaggctgcagatcttcacttgcagatgatgtagttcaaagaatggaagccccggttgcctctgttaggatagcgtcatgacatgatcttcagatgatgcagtggtccattttcctttcacactggaaaccgatcaagttctttttggggctaccatgtggcgatcttccaagagatgcaaaatgcccacacttgttgcacttggatctgtgcgttctgatctttgtctattattgtaacacattatcatacaccgagcaccagctgtctgtcatgtatgtactattgctctaacatctacggcatctaactaattagtgtaacgatcaagagctgagactagttttgacatttgataggggagggcatctccagtgatgatgttggcattgttggtttaattctctctttgtttctttcctaaaccgatgtagcattgagcaccttattcagtttctggaggatagttatgtttcttgctgtgcctatttgatctgtgattttatcacgagggattagtgcatgtaatgtgcctttttgtgttgt

SEQ ID NO: 4867 - DNA, 3209 bp, Elaeis guineensis
aacctaccctgctcccctccctcccgtccctacttccaaacctaacggtggtcgtaatttcgatctccgcgcgaatccccaaatggacgagagcctctatgacgagttcggcaactacatcggcccggagatcgagtccgaccgcgactccgacgatgctggggattccggcgacgagtctcctgccggctccgcccgctccgacgacgaggccgacgccacacccagcccctccgccaatggctggattaccgcctccggcgccggcgccgacgacatggacaccgaccctgccgcctcccagatcgtcctcgccgaggacaagaaatactaccccaccgccgaagaggtctacggcgagggcgtggagaccctggtgatggacgaggacgagcagcccctcgagcagcccatcatcaagcccgtccgcaccgtcaagttcgaggtcggcgtgaaggactcctccacctatgtctccaccgagttcctcctcggcctcgcctccaacccttctcttgtccgcaacgttgctctcgtcggccacctccaccatggcaagacggtgttcatggacatgctggtggagcagacccacgagatctcgaccttcgatcccgacagcgagcggcatatgcggtacacggacaccaggatcgacgagcaggagcgccggatttccatcaaggccgtgcccatgtccctcgtgctcgaggacagcaacgccaagtcctatctctgcaacataatggacactcccggccatgtcaacttctctgacgagatgactgctgctctccgcctcgctgatggggctgtgctggttgttgatgccgccgaaggtgttatggtaaatactgagagggctatacgccatgcaatacaagaaagacttcctattgtagttgtgataaacaaggttgatagactgattacagagcttaagctgcctccgactgatgcttatttcaaactgcgacacactttggaagttatcaatgaccttatctcttctttctccactagtgtaggaggcacccaagtggttgatcctgctgctgggaatgtctgtttcgcaagtgcaagtgctgggtggtcattcaccttgcagtcatttgctaagctttatgtaaaactccatggcattccttttgactattcaaagtttgcagcccgtctatggggagacctgtattatcatcctaatgaaagggtcttcaggaagaaacccccaatgggtggaggagaaagatcatttgtccagtttattctagaacctttatacaaaatctacagccaagtaattggagagcataagaagagtgtggaggctactctctcagaacttggtgtaaccctgagcaatgccgcttataagttgaatgttaggcctttattgaggttggcttgtagttctgtctttggatctgcaacaggcttcactgacatgcttgtccagcacatcccctctgcaaaggatgctgcagcaaagaagatagaacacatatatacaggacctcaagactcatatattgccgaggctatgaaagactgtgatccttatggcccccttatggttaatgttacaaaactctatccaaagtctgactgtagtgtctttgatgcctttggccgagtttacagtggcaccatacagactggtcagaccttacgtgtacttggggaaggctattcacctgatgatgaagaagacatgacggttaaagaggttaccaaactgtgggtttaccaggctcgataccgtattcccatcagtaaagcacctgctggttcttgggttctaattgaaggtgtagatgcctccatcatgaagactgcaacattatgtcctttggatatggatgaagatgtttgcatatttaggcctcttcgcttcaatacactgccagttgtaaaaactgcaaccgaaccattgaatccaagtgagctaccaaagatggttgagggccttaggaaaatcagtaagagttatcctctagctatcaccaaagtagaggagtcaggagaacacactatactaggaacaggtgagatatatcttgattccatcatgaaggatctcagagagctttactctgaagttgaagtcaaggtggcagatccggttgtgactttttgtgaaacagtggttgagacttcctcgatgaaatgttttgctgaaactcccaacaaaagaaacaaaattaccatgattgcagagccactagagaggggtttggcagaagatatcgagaatggtgttgtgagcattgactcaaaacaaaaggatatcagtgatttctttcagaaacgttacgattgggatttgctttcagcaaggagcatatgggcatttggaccagacaagcagggccccaacattctattagatgataccctcccaagtgaagttgataagaacttgctgagtgctgtcaaggactccattgttcaaggatttcagtggggtgcccgggaaggtcctctttgtgacgaacctatccggaatgtcaaattcaaaattctaaatgcatctattgctgctgagcccttgcatcgaggaggtggtcagattattcccaccgctcggcgtgtggtgtattcagctttcctcatggcgaacccgaggcttatggagcctgtttactatgtagagatccatacaccaatcgattgtgtctctgcaatctatacagtattgtcacgcagacgtggacatgtaacagcagatgtccctaagcctggcacccctgtatatgtagtgaaggcatatttaccggtgatagaatcatttggctttgagacggacttgaggtaccatactcaggggcaagcattttgcctctcagtgtttgatcactgggccatagttcctggtgacccacttgataagagcatagtcctcaggcctctagaaccggcaccgattcagcaccttgctcgtgagttcatggtgaaaacaaggcgccggaagggaatgagtgaggatgtgagcatcaacaagttctttgatgaggctatgatggttgagcttgctcagcaggctgcagatcttcatttgcagatgatgtagtttgttgtgcatcaaaacagtggctttttccttctagttgcagatgatgtgtatagccggctatttcttctatgatgaggctctgatggttgagcttgctcagcaggctgcagatcttcatttgcagatgtagtttgtt

SEQ ID NO: 4868 - DNA, 3902 bp, Cocos nucifera
gtttccaggtccctctcgcccgttgctagaaccgccacaaagcagtggcctttcccatttcccatctccttaaaaccctaaacctagcccgctcccctccctcccttccctacttccaaaccctaacggtagtcctaatttcgatctccgcgcgaatccccaaatggacgagagcctctacgacgagttcggcaactacatcggcccagagatcgagtccgacggcgactccgaagatgctggggattccggtgacgagtcccctgccggctccgcccgctccgacgacgaggccgacgcctcacctagcccctccgccaatggctggattaccaccaacggcgccggcgccgacgacatggacaccgaccctgccgcctcccagatcgtcctcgccgaggacaagaagtactaccccaccgccgaagaggtttacggggagggcgtggaggccctggtgatggacgaggacgagcaacccctcgagcagcccatcatcaagcccgtccgcaccgtcaagttcgaggtcggcgtgaaggactcctccacctacgtctcaaccgagttccttcttggcctcgcctccaacccttcgctcgtccgcaacgttgctctcgtcggccacctccaccacggcaagacggtgttcatggacatgctggtggagcagacccacgagatctcgacctttgatgccgacagcgagcggcacatgcggtacaccgacaccaggatcgacgagcaggagcgccggatctctatcaaggccgtgcccatgtccctcgtgctcgaggacggcaacgccaagtcctatctctgcaacataatggacactcccggccatgtcaacttctctgatgagatgactgctgctctccgcctcgctgatggggctgtgctggttgtcgatgccgccgaaggtgttatggtaaacactgagagggctatacgccatgcaatacaagaaagacttcctattgtagttgtgataaacaaggttgatagactgattacagagcttaagctgcctccgactgatgcttatttcaaactgcgacacactttggaagttatcaatgaccttatctcttctttctccactagtgtaggaggcacccaagtggttgatcctgctgctgggaatgtctgttttgcaagtgcaagtgctgggtggtcattcaccttgcagtcatttgctaagctttatgtaaaacttcatggcattccttttgactattcaaagtttgcagcccgcctatggggagacctgtattatcatcctaatgaaagggtcttcaggaagaaacccccaatgggtggaggagaaagatcatttgtccagtttattctcgaacctttatacaaaatctacagccaagtaattggagagcataagaagagcgtggagactactcttggagaacttggtgtaaccctaagcaatgcagcttataagttgaatgttaggcctttattgaggttggcttgtagttctgtctttggatctgcgacaggcttcactgacatgcttgtccagcacatcccctccgccaaggatgctgcagcaaagaagatagagcacatatatacaggacctcaagactcatatattgctgaggctatgaaaaactgtgatccttatggtccccttatggttaatgttacaaaactctatccaaagtctgactgtagtgtctttgatgcctttggccgagtttacagtggcaccatacagactggtcagaccttacgtgtacttggggaaggctattcacctgatgatgaagaagacatgacggttaaagaggttaccaaactgtgggtttaccaggctcggtaccgtatccccatcagtaaagcacctgctggttcttgggttctaattgaaggtgtagatgcctccatcatgaagactgcaacattatgccctttggatatggatgaagatgtttacatatttaggcctcttcgcttcaatacactgccagttgtaaaaactgcaaccgaaccattgaatccaagcgagctaccaaagatggtggagggccttaggaaaatcagtaagagttatcctctagctatcaccaaagtagaggagtcaggagaacacactatactaggaacaggtgagatatatcttgattccatcatgaaggatctcagagagctttactctgaagttgaagtcaaggtggcggatccggttgtgactttttgcgaaacggtggttgagacttcctcgatgaaatgttttgctgaaactcccaacaaaagaaacaaaattactatgattgcagagccactagagaggggtttggcagaagatattgagaatggtgttgtgagtattgactcaaaacaaaaggatatcagtgatttctttcagaaacgttacgattgggatttgctttcagcaaggagcatatgggcgtttggaccagacaagcagggccccaacattctattagatgatacccttccaagtgaagttgataagaacttgctgagtgctgtcaaggactccattgttcaaggatttcagtggggtgcgcgggaaggtcctctttgtgatgaacctatccggaatgttaaattcaaaattctaaatgcatctattgctgctgagcccttgcatcgaggaggtggtcagattattcccaccgctcggcgtgtggtgtattcagctttcctcatggcgaacccgaggcttatggagcctgtttactatgtagagatccatacaccaatcgattgtgtctctgcaatctatacagtattgtcacgcagacgtggacatgtaacagcagatgtccccaagcctggcacccctgtatatgttgtgaaggcatatttaccggtgatagaatcatttggctttgagacggacttgaggtaccatactcaggggcaagcattttgcctctcagtgtttgatcactgggccatagttcctggggacccacttgataagagcatagtcctcaggcctctagaaccagcaccgattcagcaccttgctcgtgagttcatggtgaaaacaaggcgccggaagggaatgagtgaggatgtgagcatcaacaagttctttgatgaggctatgatggttgagcttgctcagcaggctgcagatcttcatttgcagatgatgtagtttgttgggtatcaaaacagtagccttttacttctatttgcagatgatgtgtatagccggctatttcttccatgatgaggctatgatggttgagcttgctcggcaggctgcagatcttcatttgcagatgaagtttgttgtgtatcaaaacagtagctttttccttctagttgcggatgatgtgtatagccagctatttcttccatgatgaggctatgatggttgagattgctcagcaggctgtagatcttcatttgcagatgtagtttgttgtgtatcaaaacagtagctttttccttctacttgcggatgatgtgtatagccggctatttcttctacatgcagtctcttatgcagctctttcactgcacaaagatgatctagggacttgagctctgttgtttattccacttgtcactgtagtgatgatctttaatcatcgaatggtgtgactttaaaaaatattggtatcatcttttgcttttagttagacatggtacttgtaatgtaacccacgtctatggtagttagatctgttgtttgggacagatctttgcttgtgtgcatggtggtgaccatgtgattttacctggtatcaactcatagcaatcagcgtgagaggagacagaattaggtgcaatgaattgttgttggagcatgatgctgatcaggtatatctatatttgtacatggactggaagaacatcctggattatagattgtgattaatattagatggcatggagaatca

SEQ ID NO: 4869 - DNA, 2946 bp, Musa acuminata
ccatccaaatccgccatggacgacagcctctatgacgaattcggcaactacatcggcccggagatcgagtccgacgtcggctccgacgcctccgacgacgacgcctccaccgtagacaacgccggcggacctgacgacatggacgtcgacgctgccgcctcacagatcgtcctcgccgaggacaagaagtactatcccaccgccgaggaggtctatggagagggcgtcgagacgctggtgatggacgaggacgagcagcctttggagcagcccatcatcaaacccgtccgcacccttaagttcgaggtcggcgtcaaggactcctccacctacgtttccaccgagttcctgttgggcctcgcctccaacccttcgttggtccggaatgtggcgctcgtagggcacctccagcacgggaagacggtgttcatggacatgctggtggagcagacgcacgagatctccacgtttgatgtgcagaacgagcggcatataaggtataccgacactaggatcgatgagcaggagcggagaatctcgatcaaggcagtgcccatgtcacttgtgctcgaggatagcaatgccaagtcgtatctctgcaacataatggacacgccaggccatgtcaatttctcagacgaaatgacagctgcacttcgcctcgctgatggagctgtgttggttgtggatgctgcagaaggtgttatggttaacactgagagggctataagacacgcaatccaagagaggttgcccatagtggttgtaatgaataaggttgatcgacttattacggagctaaaactccctcccactgatgcatattttaagttgaggcacacattggaagctatcaatgacttgatctcatcttgctctactactgttggaggcacccaaatggttgatcctgtggctggaaatgtttgttttgccagtgcaaatgctggttggtctttcacactgcagtcctttgctaagctatatcttaagcttcatggcataccatttgactctgtgaagtttgcatcacgcttatggggggatatgtactatcaccctgaccaaagagtatttaagaagaaacctcctatggctggaggagagagatcatttgtacagtttattcttgaaccattgtacaaaatctacagccaggtaattggagaacataagaagagtgttgaggcaacccttgcagaacttggagtcacactgagtaatgcagcttacaagttgaatgtgaagcctttactgagattggcttgcagctcggtctttggatttgcaactggcttcactgatatgcttgtccagcacattccctcagctcgggatgctgcaacgaagaaggtggagcacatatatacagggcctcaagactcttatattgctgaggctatgaaaaactgtgatccatatggtccccttatgattaatattacaaaactttatcctaagtctgattgtagcgtgtttgatgcctttggtcgggtctatagtggtactatacagactggtcaaaccttgcgtgtacttggcgaaggatattcacctgaagatgaagaagatatgacagttaaagaagtcaccaagttgtgggtttatcaggctcgatatcgtattcccatcagtaaagcccctgctggctcttgggttctaatcgaaggtgttgatgcatcaatcatgaagacagcaacattatgccctttatatatggatgaagatgtttatatatttaggccccttcgcttcaacacattatcagttgtgaagaccgcaaccgagccattgaatccaagcgagcttcccaagatggtggagggccttaggaaaattagtaagagttatccattagctattactaaggttgaggagtccggagagcacactatcctggggacaggtgagatatatcttgattcaataatgaaggacctgagggaactttactctgaagttgaagttaaggtggcagatcctgttgtcactttttgcgagacagtggttgaaacttcatcaatgaagtgttttgctgaaacaccaaacaaaaggaacaaaattactatggttgcagagccactggagaagggtttggcagaagatattgagaatggtgttgttagtattgatgcacggcaaagagatattagtgatttcttccagaaacgctatgactgggatttgctttcagcgaggtctatctgggcatttggtccagacaagcaggggcctaatatcttattagatgacactcttcctagtgaagttgacaaaaatctgttgaatgctgtcagagactccatcgttcaaggtttccaatggggtgcgcgagaaggtcctctctgtgatgagcctatccggaatgtgaaattcaaaatcctgaatgcatccatagctccagagccgttgcaccgaggtggtggtcagattatccccactgcaaggcgggtggtatattcagctttcctgatggcgaatcctcggcttatggagcccgtttactatgttgagatccaaacaccgatagattgtgtttctgctatttacacggtgctgtcacgaaggcgaggacatgtaacacaagatgtgccgaagcctggcactcccgtatatattgtaaaggcctttttgcctgtgatcgagtcatttggatttgagacggacttacgataccatactcaagggcaagctttctgtctctctgtttttgatcactgggctatagttcctggtgatccattggacaagaacatagttctccgtccccttgaaccagcaccaatacaacaccttgcacgtgaattcatggtcaagacacggcgtcgaaagggtatgagtgaagatgtaagcattaacaaattcttcgatgaggctatggtggtggagcttgcccagcaggctgccgatgttcatctgcagattatgtaaggccacagagcaagg

SEQ ID NO: 4870 - DNA, 3388 bp, Musa acuminata
ccaccccttccctctcttcacccagcagctgcagaaaccctaaacccaaaatagtgcaataaacttaccctaagcatctatctccatccaaatccgccatggacgacagcctctatgacgaattcggcaactacatcggcccggagatcgagtccgacgtcggctccgacgcctccgacgacgacgcctccaccggagacaacgccggcggacctgacgacatggacgtcgacgctgccgcctcacagatcgtcctcgccgaggacaagaagtactatcccaccgccgaggaggtctacggagagggcgtcgagacgctggtgatggacgaggacgagcagcctttggagcagcccatcatcaaacccgtccgcacccttaagttcgaggtcggcgtcaaggactcctccacctacgtttccaccgagttcctgttgggcctcgcctccaacccttcgttggtccggaatgtggcgctcgtggggcacctccagcacgggaagacgttgttcatggacatgctggtggagcagacccacgagatctccacgtttgatgtgcagaacgagcggcatataaggtataccgacactaggatcgatgagcaggagcggagaatctcgatcaaggcagtgcccatgtcacttgtgctcgaggatagcaatgccaagtcgtatctctgcaacataatggacacgccaggccatgtcaatttctcagacgaaatgacagctgcacttcgcctcgctgatggagctgtgttggttgtggatgctgcagaaggtgttatggttaacactgagagggctataagacacgcaatccaagagaggttgcccatagtggttgtaatgaataaggttgatcgacttattacggagctaaaactccctcccactgatgcatattttaagttgaggcacacattggaagctatcaatgacttgatctcatcttgctctactactgttggaggcacccaaatggttgatcctgtggctggaaatgtttgttttgccagtgcaaatgctggctggtctttcacactgcagtcctttgctaagctatatcttaagcttcatggcataccatttgactctgtgaagtttgcatcacgcttatggggggatatgtactatcaccctgaccaaagagtatttaagaagaaacctcctatggctggaggagagagatcatttgtacagtttattcttgaaccattgtacaaaatctacagccaggtaattggagaacataagaagagtgttgaggcaacccttgcagaacttggagtcacactgagtaatgcagcttacaagttgaatgtgaagcctttactgagattggcttgcagctcggtctttggatttgcaactggcttcactgatatgcttgtccagcacattccctcagctcgggatgctgcaacgaagaaggtggagcacatatatacagggcctcaagactcttatattgctgaggctatgaaaaactgtgatccatatggtccccttatgattaatattacaaaactttatcctaagtctgattgtagcgtgtttgatgcctttggtcgggtctatagtggtactatacagactggtcaaaccttgcgtgtacttggcgaaggatattcacctgaagatgaagaagatatgacagttaaagaagtcaccaagttgtgggtttatcaggctcgatatcgtattcccatcagtaaagcccctgctggctcttgggttctaatcgaaggtgttgatgcatcaatcatgaagacagcaacattatgccctttatatatggatgaagatgtttatatatttaggccccttcgcttcaacacattatcagttgtgaagaccgcaaccgagccattgaatccaagcgagcttcccaagatggtggagggccttaggaaaattagtaagagttatccattagctattactaaggttgaggagtccggagagcacactatcctggggacaggtgagatatatcttgattcaataatgaaggacctgagggaactttactctgaagttgaagttaaggtggcagatcctgttgtcactttttgcgagacagtggttgaaacttcatcaatgaagtgttttgctgaaacaccaaacaaaaggaacaaaattactatggttgcagagccactggagaagggtttggcagaagatattgagaatggtgttgttagtattgatgcacggcaaagagatattagtgatttcttccagaaacgctatgactgggatttgctttcagcgaggtctatctgggcatttggtccagacaagcaggggcctaatatcttattagatgacactcttcctagtgaagttgacaaaaatctgttgaatgctgtcagagactccatcgttcaaggtttccaatggggtgcgcgagaaggtcctctctgtgatgagcctatccggaatgtgaaattcaaaatcctgaatgcatccatagctccagagccgttgcaccgaggtggtggtcagattatccccactgcaaggcgggtggtatattcagctttcctgatggcgaatcctcggcttatggagcccgtttactatgttgagatccaaacaccgatagattgtgtttctgctatttacacggtgctgtcacgaaggcgaggacatgtaacacaagatgtgccgaagcctggcactcccgtatatattgtaaaggcctttttgcctgtgatcgagtcatttggatttgagacggacttaagataccatactcaagggcaagctttctgtctctctgtttttgatcactgggctatagttcctggtgatccattggacaagaacatagttctccgtccccttgaaccggcaccaatacaacaccttgcacgtgaattcatggtcaagacacggcgtcgaaagggtatgagtgaagatgtaagcattaacaaattcttcgatgaggctatggtggtggagcttgcccagcaggctgccgatgttcatctgcagattatgtaacgccacagagcaagggaagagtcaaccttctttttaatgcttggagccgataatattcttcttttggtgtgcccttgagaagcccctccatatgaggcaccggtgggcatcgagatgatgtacttttggtttatcagcctctgcttctgaaagccatcgtgcaagcctgaaccaaactgtgttgttgtttcttcctcccgtagtggtttaagcccttcccttcccttagtacacatacttcagctgtggcgcacttttatttatgtgtatgatgcgcactagtttctatttcgaaaactgttgtataaatctagttagacgctggcaaggcgaaactgcacgctggccaatccgtttctggactcttggatgaa

SEQ ID NO: 4871 - DNA, 3290 bp, Allium cepa
cctaaactataataatcgaatttgatttacgtttggtttgccatggacgattctctctacgatgagttcggaaactacatcggccctgacattctctctgacaatgaagatgaatccgaccattctgtttctgatgaaccagactctccatcaccttccgacgccatgggtcctgccctcaccaacggcggcggactcgacgcaatggacgaggatgacgtggaccccacgtccaaccaaattgtgcttgctgaagataagaagtactaccccaccgccgaagaagtctatggcgaagatgtcgaaaccttggtcatggacgaggacgaccagccgctagaacttccgatcattaaccctgttcgtgtggtcaagcacgaagtgcctcagactaaggatctagagaacgcagcatcaacttatgtttccaccgacttcttgctcggcttagcatcaaaccctagtttggtcaggcatgttgcgttagtcggacacttgcagcatgggaagacagtttttatggatatgttggtggagcagacacatgacaaaattgttacatttgatgtggagagggagaggcatgtgaggtttacagatacaagggtggatgaacaggagaggaggatttcaatcaaggcaatgccgatgagtcttgtattggaggatgggaacgggaagagttatctttgtaatataatggatactcctgggcatgttaatttctctgacgagatgacagctgcgcttaggttagcagatggggctgttttggttgttgatgcggctgaaggagtcatggtcaatactgagagggctatacgacatgcaatacaagaaagattacccatagtggttgtaataaataaggttgacaggctgataacagaacttaagcttccgcctcaggatgcttacttcaagcttcgacatactcttgaagttatcaatgatttgatatcctctgcctccacttctgctggaggtatccaaaatgtggatcctgctgctggaaatgtttgttttgccagtggaagtgcaggttggtcgttcacacttcaatctttcgccaaactgtacgtgaaactacatggcataccatttgatcacaataagtttgcatctcgcctgtggggagacatctattatcatcctgacactcgaaccttcaagaaaaaacctccagcaggtggaggtgagagatcatttgttcaatttatactcgaaccgctatacaaaatatacagccaagtcattggcgagcataaaaaagtgttgagactactttgtctgaactcggcgttacattaagcaatgctgcttacaagttaaatgtgaaacctcttctcagattagcttgtagctcagtctttggttctgcttctgggtttactgagatgctagtcaagcatattccttcagctaaagagggagcagctagaaagattgagcacatatacactggaccacaagattcagatattgctgaagttatgaaggactgtgatcctagtggccctctcatggttaatgttactaaactttatcccaagccagattgcagcgtttttgatgcttttggacgggtgtatagcggcactattcgaacaggtcagacattacaagtgctaggagaaggttattcacctgatgatgaggaggataaaactgtcaaagaagttactaagttgtgggtttatcaggctcgatacagaattcctatcagccatgcaccagctggctcttgggttcttattgaaggcgttgacgcatcaatcatgaaaactgctacattatgtccattagacattgatgaagaagtttacatatttagacctctccggtttaatacactttcggttgtgaagacagcgacggaaccgttgaacccaagcgagttaccaaaaatggtagagggtcttcgtaaaatcagcaagagttacccgctggctattactaaagtcgaggaatccggagagcatactatattaggaacaggagaaatctatttggattctataatgaaggatcttagagagctatattctgaagttgaggtgaaggtggcagatcctgttgttactttctgtgaaacagtggtggactcctcctcgatgaagtgttttgctgaaacacctaataggaaaaataaaattaccatgattgcagaacctcttgaaaggggattggcagaagacattgaaaatggtattgtcaatatcgattggagtcagaagaagattggtgaattcatgcaaagtcggtactcatgggatttgctttctgcaaggtccatttgggcttttgggccagataagcagggaccaaatattttgttagatgatactctaccaagtgaagttgacaagggtctgctcaaagctgtcaaagattccatagtacaagggttccagtggggtgctcgtgaagggcctctttgtgatgagcccatccggaatgtgaaattcaaaatcttggatgcaaacattgcttctgagcctcttcacagaggtggcggtcagatcattcctacagccaggcgtgtggcctactccgccttcctaatggctacaccgcgacttatggaacctatgtattatgtagagatccaaacaccaattgattgcgtttcagcaatctacacggtgttgtctcggaggcgtggacatgtcacagctgatgtaccaaagccaggcactccagcttacattgttaaggcgtttttgccagtaattgaatccttcgggtttgagacagacttgcgatatcacacacaaggtcaagcattttgctcatcggtatttgaccactggtctattgttcctggcgacccccttgacaaaagtatactcttacgccccttagaacctgcaccaatccagcatttggctcgtgagttcatggtcaaaacaaggcgtagaaagggcatgagtgaggatgtcagcatcaacaagtttttcgatgaggccatggttgctgagcttgcccaacaggctgcagaacttcacttgcaaatgacctaaattttagctctcctgcgattttactagatgtattagcctgcgttaattatcttggaacattcctgtaatttgttagatgaatgcataatttgtatatcatgcagctcgcctgccctagtttgaggttttaatttagtatagtttttatgtaacttttacctggtgtccttcgctgggaatgcccatctcaccaaggtatattgttgtaatattttatgtattgatttcctaccattttttatattacggaatgtcaacattatatta

SEQ ID NO: 4872 - DNA, 3262 bp, Amborella trichopoda
catggatgacagtttatacgacgagttcgggaactacataggcccggacatcgactctgaccaagatgcttctgatgccgatgaccgaccttctgatgacgatgatgagatgcccgatgctgcagctggcgcttcgccctcgcgcgcgggctccccggagaactggcttggagaggttgctgaaggcgaagcccccggccaagtggtattggcagaagacaaaaaatactatcccactgcccaagaggtctatggggagggcgttgaggcccttgtcatggacgaggatgcccagcccctcgagcaaccgattataaaacctcctcgtaacgtcaagtttgagatcggtgtcaaggactcgagcacttatgtctcgacacaattcctcttaggccttgcatcgaacccgtcgcttgtgcggaatgttgctctcgtagggcatttacagcatgggaagacagtgttcatggacatgctagtggagcagacccatatgattgagacattcgatccggacagtgagaagcacatgaggtacaccgacacacgcattgacgagcaggaacgaagggtctctatcaaggccgttcccatgtcgttggtgcttgaggacagcaatgcaaaatcgtatctgtgcaatatatttgatacaccagggcatgtcaacttctcggacgagatgactgctgctctcaggctggccgacggggctgtcgtagttgtggatgcagcagaaggggtcatggtgaacactgagagagctattcgccatgccattcaggaaaggcttccgattgtagttgtaataaataaggtagataggctgataacggagctgaaactaccaccagctgatgcataccacaaactaaggcacacgttagaagtgataaacgattttatctcttcgttctctaccactgcaggaggaatccaagccattgatccagctgctggaaatgtttgttttgctagcgctagtgctggttggtctttcaccctacaatcctttgctaaattgtatgtgaaactccatggcataccatttgatgctgctagatttgcatctttgctttggggagatatatattatcatccaaatgagaggacttttaagagaaaaccccctctaagtggaggtgagagatcatttgtgcagtttttgcttgagcctttgtacaaaatatacagccaagtgataggagaacacaggaagagtgtggaggttactcttgcagagctgggtgttaccctaagtaatgcagcatacaagttaaatgttaggccactcttaaggttggcttgtagctcgatttttggatcagccactggcttcactgatatgttggttgaacatatcccatctgcgaaagatgctgcaattaagaaggtagagcacatttataccgggcctcaggactctttagttgttgaggctatgaaagactgtgatccttcaggtcccctcatggttaatgtaaccaagcttttccctaaatctgactgcagtgtctttgatgcttttggtagagtttacagtggaaccatccaaactggtcagactgtacgtgtccttggggaaggatattcacctgaagatgaagaggacatgactgttaaagaagttacaaaattgtgggtctatcaagcacgttatcgacttcctattagtaaagcacctgctggttcttgggttctcattgaaggtgttgatgcttcgatcatgaagactgccactctttgtcctgagtatatggatgaagacatctacatatttcggcctctacgctttaacacccttccagttgtgaaaacagccaccgaacccttgaatcccagtgagctgcccaaaatggttgaaggtctacgaaaaattagcaagagctatccacttgccataacaaaggtcgaggaatccggtgaacacactattttggggactggggagttgtatttggattctattatgaaggatcttagagagctctattctgaagttgaagtcaaggtggctgatcctgtggtctctttctgtgaaactgtggtggaatcctcatcaataaaatgctttgcagaaacgcccaacaagaaaaacaaaatcaccatgcttgcggaaccactggaaaagggattggcggaggatatagagaatggtgttgtcagcatagattggcctcgaaagaaactcggtgactttttccaaagcaaatatgactgggatttgcttgcagcacggtctatatgggcttttggtccggataagcagggacccaacattctcctggacgatacacttcctagtgaagttgacaagaatatgctgaatgctgttaaggattcaattgttcaagggtttcagtggggtgctcgtgaagggcctctttgtgatgaacccattcgtaatgtcaaattcaaaatattggatgctactattgcaccagagcccctgcatcgtggtggtggtcagataattcctgctgctcgtcgtgtagcatattcggccttccttatggcaacgccacgtttgatggaaccggtgtattatgtggagattcaaaccccgatagattgtgtttctgcaatttatacagtcttgtctcgaagaaggggacacgttacagccgatgttcctaagccagggaccccttcttatattgttaaggcatttttgccagtcatagaatcctttgggtttgagactgacttgagatatcacacccaagggcaggccttttgcgtttctgtatttgatcactgggccatagttcctggagatcctcttgacaaatctgtggtccttcgcccacttgaacctgcacctgttcagcaccttgcacgagagttcatggtgaagacaaggcggcggaagggaatgagcgaggatgtaagcatcagcaagttctttgatgaccctatgttgcttgagctagcaagacaggatgctgaccttcaacacatactctaaattatcaggttttttgcttctcaagagattaaccacataaaaaatatgcaacttgtaacacctgtactatcagttttgcctggctttgtatgtcttctcttagccacctttgtttttcttttagttctgttggtggcaaatagtactgtagcttgagatcactcaggtcttggtctattttattcttgaggaaaaaaaagaagtctgtattaagtaaaaacagatgagctgatctctttctaacatcgttttgtcattagaactagctattcattctatgggcttgagttttttttt

SEQ ID NO: 4873 - DNA, 3711 bp, Aristolochia fimbriata
ctgcgcaacagtgagcactcactggttcctttcataaacgtctcgacttcgttgctcactttgccgccctagaagggtagaaccagaggtgagctccaatttgttgaactgcggctacgccttcctcgtctcaagactctcaacaagtaactatctccgtcgaccttccattgctgcagttaggtaattttctgttcactcctctcgaaccggagccggaatacaggacttgttcctccattttgttactcgtgtcccaagcggcgtatctctcagtctctctgcttttcattatcctctatcgagctctaacacgctgcagagtgaaatatccaaatggatgacagtctctatgatgaatttggtaactacattgggccagaaattgattccgaccgggagtcgggtcaggactctcaagaggaagaagaggatggtgacaaacccattgaagaagcagaaggctctgatggtgaggctacggcagcgcctccaaatggttggttaaccacgtctgctgacatggatgttgataatcagattgttcttgctgaggacaagaagtactaccctactgcagaagaagtttatggtgaagatgttgagaccctagtcatggatgaagatgaacaacctcttgagcagccaattataaagcctgttagaaacataaaatttgaagtgggtgtaaaggattcatctacttacgtgtcaacccaattccttctaggactcatgtcaaacccttctctcgttcgaaatgttgccctaattggccaccttcaacatggtaagacagttttcatggacatgttggtggagcagacacaccatatctcaaccttcgaccaaaacagtgagaagcacatgaggtacacggacactaggattgatgagcaagagagaaagatatcaatcaaagcagttccaatgtctcttgttctcgaagatagtaatgcaaaatcctacctctgtaatatcatggacactccagggcatgttaatttttctgatgagatgaccgctgctctcaggctggctgatggtgcagtgttgattgtagatgctgccgaaggagttatggttaacactgagagagccatacggcatgctattcaagaaaggcttcctattgtagttgtaatcaataaggttgacaggcttataacagaactcaagcttccaccaattgatgcttatcacaagctaaggcacaccttggaggttatcaacgatcttatctcatctttctctaccaaagctggaggcatccaaactgtagatcctgtggctggaaatgtttgctttgccagtgctactgcaggatggtctttcactcttcaatcctttgcgaaactgtatgtgaaactccacggtgtcccctttgatgctggtcactttgcaaaacgcctctggggtgacatgtactatcatcctgaagataggaaattcaagagaaaaccccccattagtggaggacaaaggtcctttgtgcaatttattcttgaacctttgtataaaatttatagccaggttgttggggagcataagaagagtgtagaggccactcttgctgaacttggtgtcaccctcagcaactcagcatatagattgaatgttcgacctttactgagattggcatgcagttcggtctttgggacggcgactggcttcactgatatgcttgtggagcatatcccttctgcaaaggtggctgctgctagcaagatagagcacatatatatgggtcctcaagattcatcaaatgtggaagcaatgaaagactgtgacgctgagggcccacttatggttaatgtcaccaaactttacccaaagagtgattgtagtgtctttgatgcttttggtagggtttacagtggtacaattcagacaggtcagactatacgagtgcttggagagggttattctcctgatgatgaagaagatatgactgtcaaagaagtaactaagttatgggtgtatcaagcacgctataggattcctattagcaaggcacctgcaggttcatgggttctcattgagggtgtggatgcctccatcatgaaaactgcaaccctctgtccgatggatctggatgaagaggtgttcattttccgcccccttaaatttaacactctgcctgttgttaaaactgcaacagaaccattgaatccaagtgagttacctaagatggtggagggcctcagaaaaatcagtaaaagttacccccttgccattaccaaggttgaggagtcaggggaacacacaattcttggaactggagagatttacctggattctatcatgaaagaccttcgagaactttattctgaagtagaagtgaaggtggcagatccagttgtttcattctgtgagacagtggtggagtcttcatcaatgaaatgttttgctgaaacacctaacaaaaggaataaaatcacaatgctggctgaaccgttggaaaggggattggcggaagatatagagaatggtgtagtaagtattgattggcctagaaggaaaattggcgactttttccaaagcaaatacgaatgggatctccttgctgcacgttccatatgggcatttgggccagataaacagggaccaaacattctgttagatgacactcttccaagtgaagtagacaagaatttgctgaatgctgtcaaggattcaattgtgcaggggttccagtggggtgcccgagaaggacccctctgtgatgagcccatcagaaatgtgaaattcaaaattcttgatgccacaattgcttcagagccattacatcgaggtggtggtcagatcattcctacagctagacgggttgcatattcagctttcctcatggcaacacctaggctcatggaacctgtatactatgtggagattcaaacacccatggactgtgtctctgcaatctatacagtgctgtctcgtagacgtggccatgtaacagctgatgttccccagccaggaacacctgcatatattgtaaaggcatttctacctgtgatagagtcatttggctttgagacggacttgcggtaccatacacaagggcaggcctttggtctttcagtctttgatcactgggctattgttccgggcgatccacttgataaaagcatagtcctccggcctctagaaccagctccaattcagcatcttgctcgagagttcatggttaagaccaggagacggaagggtatgagtgaggacgtgagcatcaataagttcttcgatgaagctatggttgttgagctcgctcagcaggctgctgaccttcaccagcagatgatatgatcgaactgataggggtgaggctccgcctggcaaagatgttgtgtactaagtgcacttatttagctaccatgtctccatctggttcctgcagcactaggctccagttttaaatgtacataccagtaactttttctgtggctaaaacgatctgtacgttgagaattgtagtgaagttttgtttgttgaggccattctgtatcggatttgaagacgctaaacccataacatactctaaaaatcggggacagcttgggcatgtcacagtgggatgcttgagtgagaagacatttatttatcccgttgcttcaaaagatttcatgtggttgttcttccctgcatgttgtaataccacttgttgatctggataagaaaggtaatatcaatgtgaagaaaagggactgtgtt

SEQ ID NO: 4874 - DNA, 3550 bp, Vitis vinifera
ctataaaccctctcgtttcaatactcttgaactctcagttggattcacttcctgtaactccctcttcaggtactctctatatctctttctctggatgtatacgtgtctgtaaggattagatttgaaagaaccatggatgacagtttatatgatgaatttggaaactacattggaccagaaattgagtctgacagagaaagtgatggagatgatcaagatgaggacatccctgacaagcctgatgaagaggaaatggtatctgatgttgaggatgcagttgcagcctctaatgggtggataactgcatctaatgatgttgacatggacaaccagattgtccttgctgaagacaaaaagtactatcctactgctgaagaagtctatggtgaagatgttgaaaccttggtaatggatgaagatgagcaacctcttgaacaaccaataatcaaacctgttaggaatattaagtttgagttgggagtgaaggattcgtcgacatatgtgtcaacccagtttcttttgggtcttatgtcaaacccagctttggttcggaatgttgctctggtcggacatttacagcatggaaagacactattcatggacatgctggttgagcaaacacaccatatttcaacatttgattcaaatagtgagaagcacatgagatacacagatacgaggattgatgagcaagagagaaggatatcaattaaggctgttcccatgtcacttgttcttgaggatagcaattcaaaatcttatctttgtaacatcatggacactccaggtcatgtaaatttctctgatgagatgactgctgctctcagacttgccgatggtgctgtcttgattgtggatgctgctgaaggagtaatggtaaatacagaaagggctatacgccatgcaatccaagagcgccttcctattgtagttgtaatcaataaggttgacaggctgatcactgaactcaaattgcccccaaaggatgcttatcataagctaaggcatactctggaactcatcaataatcacatatctgctgcctcatcaactgcaggaaatgtccaaatcatagacccggctgctggaaatgtctgttttgctagtgctagtgcaggatggtcttttactttgcaatcatttgctaaactatatgtcaaactccatggcgtcccatttgatgccaataagtttgcatctcggctttggggagatatgtattatcatcctgatgctagggttttcaggaagaaaccgcctgcaagtggaggggaaagatcatttgtccagtttgtgcttgagcccctctacaagatatatagccaagtaattggagaacataagaagagtgtggagagtacccttgcagaactgggtgtcactctcagtaatgcagcctacaaactaaatgttaggcctttgctgaggttggcctgtagctcagtctttggttcagcgacaggtttcactgatatgctggttcagcatattccttctgccaaagatgctgcagctaagaaggttgatcatatttatactggacccaaagattctgcaatataccaggccatggaagattgtgattcttctggtcctctaatggttaatgtgactaaactgtatccaaagtctgattgcagtgtttttgatgcttttggtagggtttatagtggtgaaatccaaacagggcagactttacgtgtgctgggagaaggctattcaccagaagacgaagaggatatgacagtaaaggaagttacaaaattatgggtttatcaagctcgttacagaatacccataagcaaggctcctcctggttcttgggttctcattgaaggtgtggatgcttcaattatgaagactgccacactttgtaatttggattatgatgaggatgtatacatatttcggcctcttctgtttaatactcttccagtagttaaaacagctactgagcctttaaatccaagtgagttgcccaaaatggtggagggtcttaggaagatcagtaagagctatcctttagcaattactaaagttgaggagtctggagaacacactattttaggtactggggagttgtatttggattctatcatgaaggaccttagagagctgtattctgaagttgaagtcaaggtggcagatcctgttgtatcattttgtgaaactgtggtggagtcttcatcaatgaaatgttttgctgaaacacccaacaagaagaataaaataaccatgattgcagagccattggagaaaggactcgcggaggatattgagaatggtgttgtaagcattgattggcatcgaaagaaacttggtgacttttttcaaacaaaatatgactgggatttgctggctgcaaggtccatatgggcatttgggccagataagcaggggcctaacattttgttagatgatactctctctagtgaagttgataagaacttactaaatgctgtcaaagattccattgttcaaggatttcaatggggtgcccgagaaggacccctgtgtgatgagcccatcagaaatgttaagttcaaaatagtcgatgcaaggattgcacctgagcccttgcatcgaggaactggtcagatcattcctacagctcggcgggtggcctactctgcattccttatggcaactccacgacttatggaacctgtatactatgtggagatacaaacaccaatagactgtgtctctgcaatctacactgtcttatctcgcaggcgtgggcatgttacagctgatgttcctcaaccagggaccccagcctatattgttaaggcatttttgccagtgatagaatcatttgggtttgagacagacttgaggtaccatactcaagggcaagcgttttgcgcctctgtgtttgatcactgggctatagttccaggggaccctcttgataagagtattgtcctgcggccactggaacctgcaccgattcagcaccttgctcgtgagttcatggttaagacaaggcgtagaaagggtatgagtgaagatgtaagcatcaataaattcttcgacgaggctatggtggtggagctagcccagcaggcagccgaccttcatcagcaaatgatttaagtcaggagacaggagtgcattcctctgtttaatctcatcttctgatcgctggatatcctgcatcaccaagcagggttttgttatagatgttttggtcctcttcctcacatttttcatcatagttagctgtacaagttcaattcaaatgcaaaaaacttgtgcatctgattgccattcggggattaaaaaaacaacggaattgccttaggtggatttttgttacgaaatttaatgcttttttagtcgttcccaaggcacaggccttgtgtttttctgttctttctccttttgacctggcaaccagattgaatagaaaaggtcaagaggtgtacttaaaagtatggggcagtcgtgttgattatcaagttcgccgcccaatgtattagtggaatgggcaagcttactggctcccgatggtattaaagggcatgctggagaatgttttagagcc

SEQ ID NO: 4875 - DNA, 3469 bp, Sesamum indicum
cccgctgccgctgtagtccattccgtcttcgcaacaggcttaaagaactatggatgatagtttgtatgatgagtttggcaactacattggacctgagattgaatccgatcaagagagtgacagggaggaggaagatgaggaactccctgaaagggctgaggatgagcagcctgtgtctgatgatgaacatgggcctggaaaaccaaatgggtggctaaccactactgaggatgttgatatggatggccaaattgtcctagcggaggataaaaaatactacccaaccgcagaagaggtttacggtgaagaagtcgaaactttagttatggatgaagacgagcagccacttgaacaacctattattaagcctgtaaaaaatcttaagttcgagttgggggttaaggattcatcaacgtatgtgtcaacacagttccttttgggtcttatgtcaaaccctgcgttggtcaggaatgttgctttggttggccacttgcaccatgggaagacgacgttcatggacatgttggttgaacagactcatcatatctcaacctttgatcaaaacagcgagaaacatatgaggtacacggatacgaggatagatgagcaggagagaagaatatccattaaggcagttcccatgtcacttgttcttgaggatagcaattcaaaatcatacctttgcaacatcatggatacgcctggtcatgttaacttttctgatgagatgactgctgccctcagactcgctgatggtgcggtgttgattgtagatgctgcagaaggagtgatggtaaacacggagagggcaatacgccatgctatccaggagcggatacccatagtagttgtgataaataaggtcgacagattgataactgagctgaagttgcctccaaaggatgcctaccataagcttaggcacacaattgaggtcatcaacaaccacataactgctgcatcttcaactgctggtaatgttcaagttgttgaccctgctgttggaaatgtttgttttgcaagtgccagtgcaggatggtcattcaccttgcagtcgtttgctaagctatatgttaagctccatggtattccgtttgatgctaataagtttgcttctcgcctttggggtgattattacttcgatcctgataccagaagtttcaagaagaaacaacctgctagtggtgcggaacggtcctttgtccaatttgtgctagaacccctttataaaatatatagccaagtgattggagaacataagaagagtgtggaggctacacttgctgaacttggtgtgaccttgagtaatgcggcttatcgattgaatgttaggcctctgttaagattggcatgcagctcagtttttggtagtgccaccggctttacagatatgttggttcaacacattccatctgctaaagatgctgcacctcgaaaagttgagcacatttacactgggccaaaggattccacaatctaccaagccatggaggattgtgatgcatcaggtcctctaatggttaacgtaacaaaactgtatcctaaatctgattgcagtgtttttgatgccttcggtagggtctacagtggggaaattatgacggggcagactgtgcgtgtgttgggagaaggctattctccagatgatgaagaggacatgacagtgaaagaagtgacaaaattatgggtctatcaagctcgttataggattcctattagcaaggcccctcctggttcttgggttcttattgaaggtgtggatgcttctattatgaagactgccacactctgcaacttggaatatgatgatgatgtgtacatattcaggccccttcagttcaacacgcttcctgtggtgaaaactgctactgagcctttgaatcccagtgagttgccaaaaatggtggagggccttaggaagatcagcaagagctatccactagcaattacgaaggtcgaagaatctggggaacatactattttaggtactggagaattatacctggattctataatgaaggacctcagagagctttattcggaagtagaagtcaaggtggcagatcctgttgtctcattctgtgaaacagttgtggaatcctcttcgatgaaatgttttgctgaaactccaaacaagaaaaataaaattaccatgattgcggagccactggaaagaggacttgctgaggacattgagaatggtgttgtaagcattgactggccacggaagaagcttggtgacttcttccagacaaagtatgattgggatctgcttgctgctcggtctatttgggcatttggtcctgacaagcaggggcctaatatcttattagatgatacactgtcgagtgaggtcgataagagtttgcttaatgcagtcaaagattctattgttcaaggttttcaatggggggctcgagaaggccccctctgtgacgagcctatcagaaatgtgaaattcaaaatagttgatgccaaaattgcccctgagccattgaatcgtggaactggtcagattattccaactgctcgacgagtcgcctattcagctttccttatggccactcctaggctgatggaacctgtatactatgtggagatacaaactccaattgattgtgtttccgcaatatatacggtattatcacgtcgacgtggtcatgtcactgcagatgttccacaaccaggaaccccagcctacattgttaaggcatttctgcccgtgatagagtcatttggttttgaaacagacctgaggtatcatactcaggggcaggcattttgcttatcagtatttgatcactgggctatcgtccccggagatccacttgataaaagtatagttttacgcccattagagccagctccgatccagcatttggcccgtgaatttatggtgaagacgaggcgtcgtaagggaatgtcggaagatgtaagcattaataaattcttcgatgaggcgatggttgttgaactagctcagcaggctgccgatcttcatcaacagatgatgtgaaaaagctgattcatgcaattcccaattggtgaggacgttttcggatcttcaggaacaggtagacctgtaacatgcacccttcaaattgttgtttgagaacttgttatggctcagaggaggtaaatgttcctagagagggcggactaaaaccatgatgcgctgtgacataagaagcaggttaatttctattgtaacttgaagtttctgtcaaagttatactcaacaagcctcgttcatgcagctacagttaaatgagagtccgaagctttggtgtatgtataatggtaaattctattttgcatgtgttatacgtccccacttaccaacatatagctgaatctttgtctcatagttttctgtttttctttttcatgtagagtgaaaaacaaacactacgttgggagtgttgatgtgggatgattgtgattctgcatttggtattatgcgcacccc

SEQ ID NO: 4876 - DNA, 3180 bp, Amorphophallus konjac
tccgatgatgaggaccgcggcgccgccgccgggcccgccaccaacggctgggatcaccgccggcggcgacgacatggaggtggacgctgccgcgtcgcagatcgtgctggcggaggacaagaagtactaccccaccgccgaggaggtctacggagagggggtggaggcgctggtgatggacgaagacgcgcaacccctggagcagcccatcatcaagcccgtccgcaccgttaagttcgaggtcggcgtcaaggacgcctccacctacgtctccaccgagttcctgctggggctcgcctccaacccggcgctggtgcggaacgtcgcgctggtcgggcacctccaccacgggaagacggtgttcatggacatgctggtggagcagacgcaccacatctcgacctttgattccgggagcgagcggcacatgaggtatacggacacgcgaatcgacgagcaggagcggcggatctctatcaaggccgttcccatgtcgctggtgctggaggacagcaacgccaagtcctacctgtgcaacatcatggacacgccggggcacgtcaacttctcggacgagatgaccgcggcactccgtctcgccgacggagcagtgctgatcgtggacgcggtggagggagtcatggtaaatactgagagggcaatacgccacgcaatccaggaacgcttgcctattgtggttgtgataaacaaggttgataggctgattacagagcttaagctacctccaactgatgcatactttaaactgcgtcatacactagaagcaatcaatgacctcatatccaccttctctaccacagcaggaggcattaaaccagttgatccagctgctggaaatgtttgctttgccagtgcaagtgatgggttgtctttcaccttgcagtcatttgctaaattgtatgttaagctacatggaatcccctttgaccatttgaagtttgcatcccgtctatggggagacctttattaccatcccgatacaagaagctttaagaggaaaccccctgaaagtggtggtgaaagatcatttgttcagtttatccttgaaccactgtacaaaatatatagtcaagtgattggagaacataaaaagagtgtggagacaacactttcagagctaggtgtgaccttgagtaatgcagcttacaagttaaacgttcggcctttactgagattggcttgtagctctgtctttggttcagctactggtttcactgatatgctagttcaacatatcccatcagcaaaagacgcagctgggaaaaagatcgaacacatttatacagggccacatgactcattcattgttgagtctatgaaagattgtgatccttctggtccccttatggttaatgttgtcaagctctatcctaaatctgattgcagtgtttttgatgcctttggacgtgtctacagtggtacaatccagactggccagaccttacgtgtgctaggagaaggctattcgccggatgatgaagaagatatgacagtaaaagaagtcacaaaattgtgggtttatcaagctagataccgtattcctatcagcaaagcacctgctggttcatgggttctcattgaaggtgtggatgcctcaatcatgaaaacggccactctctgccctttacatatggatgaagatgtttatatattccggcctcttcatttcaatactctgtctgttgtgaagacagcaactgaaccactgaatccaagtgagctccccaaaatggtagaaggtctccggaaaatcagtaagagttatcctctggcaattaccaaagttgaagagtctggggagcatacaattttagggacaggggagatctatttggactctataatgaaggaccttagagagctgtactctgaagtagaagtcaaggtggcagatccagtggtcactttttgtgaaacagtacaggactcttcatctttgaaatgttttgcagaaactcccaacaagaaaacaaaattactatgctcgctgaacctctggaaaagggattggctgaggatattgaaaatggcgttgtgagcattgattggccaaagagaaagctcggtgatttcttccaaagcaagtatgactgggatttacttgcagcacgatccatatgggcatttggaccagataagcagggaccaaacattttgttagatgatacacttcctactgaagttgacaaaaacttgcttaatgctgtcaaggactccattgtgcaaggatttcagtggggtgcccgagaaggaccactttgtgatgagcctatccggaatgtcaagtttaaaatcttagatgccaatattgctgctgaacctttacatagaggtggtggtcagattattcctactgctcgaagggtggcttattcagcttttctcatggccactccacggttgatggagccagtatactacgtagaggtcctaacccctgcagactgtctatcggctatctacactgtgatctctcgtcgacgtgggcatgtgacagctgatatccccaagcctgggacccctgcatatattgtcaaggcatttttacctgtcatagaatcatttggctttgaaacggatttgagatatcatacccaaggacaggcattctgtctctcagtatttgatcattggaacatagttccgggggatccacttgacaaaagcatcgtcctccggcctcttgaaccagcacccgttcagcatcttgcccgtgaattcatggtgaaaactagacgtaggaagggcatgagtgacgatgtaagtgccaacaaattctttgacgaggccatgatggttgagcttgcgcagcaggctgcagaactgcatcagcttatgtaacctgtgatacttgcgttgtgtaaaaggaggaaaaaaaatcgatctcatcctttttccttccagcttttgtagccagttatatttaattgtgtaaaaaaggggaatttttttgaaatgccagttagtcgtcatcgatatgtttcttacccccgaaatccacgtggttaaatctttcttttggtctccaatttccagggttcttggcatttgtagaggcttcctgttatccttgtttaagtattaaattgtaaaagcttttcttgactaaaccgtccctctgtttccttctcttcttctgtattccttggcgtcggacgc

SEQ ID NO: 4877 - DNA, 3784 bp, Phaseolus vulgaris
gtttatttctacgggcctggtccagtccacttgaaatcccatctcccctaccgttccatcgagtggtcacgttaccctaaaacccaaacaccctgtctccgtctgtttgaaacgacggtgagcatttccctcgcattctctattcttcactctccacgcttcacattccgccatggacgatagcttgtacgacgagtttggcaactacatcggcccggaaatggagtccgaccaggactctgaccgcgactccgaccccgaagccgacgacaacgccgacgggaagtccgacggcggcgctgcgtcggacggcgaggatccgagcaacggatggatgacgacgatctcggaggacatggagaatcaggtggttctggcggaagacaagaagtactacccaaccgcggaggaggtctacggcgacgacgtggaaaccctagtcatggacgaggacgagcagcccctggagcaacctatcattaagcccgtgaggaacatcaagttcgaggttggagtgaaggactcctccacctatgtctcctctcagttcctcctcggtctcatgtcgaaccctacgcttgtgcgcaacgtggcgctggtggggcacttgcagcacgggaagaccgtgttcatggacatgctcgtggagcagacgcatcacatgtccacgttcgatccccagagcgagaagcacacgcgatatacagacactcggattgatgagcaggagaggaagatttcgatcaaggctattcccatgtcacttgtgctggaggatagcaactccaagtcgtatctgtgtaacatcatggacgcgcctggccatgttaacttctccgatgaaatgaccgccgctttgaggcttgctgatggcgctgtcttgattgtagatgctgctgaaggagtcatggtaaacacggaaagggcgatacgtcatgcaattcaggagcggttgccgattgtagttgtaatcaataaggttgacaggcttataactgaacttaagttgccgccgaaggatgcttatcataaactaaggcatactttggaggttattaatactcacatatctgctgcctcctcgattgctggtgatgttcaagttgtggatccggttgctggaaatgtttgttttgctagtggtactgctggatggtcctttacgttgcagtcatttgctaagttgtatgggaagctgcatggaattcctttggaagctagtaaatttgcttctcgactgtggggagactattattttcatccagatactagagccttcaaaaagaagccccctgccactggaggggagcgatcttttgtagagtttgtgctggagcctctttacaagatatacagccaagtgatcggggaacataaaaagagtgtagagacaacacttgctgaactaggagtcacactaagtaatgcagcctacagattaaatgtcagacccttgctaaggttggcatgcagctcagtttttggtcaagcttcaggtttcactgatatgcttgttcaacatataccttcccctagggatgctgcaattacgaaagttgaccatatatatactggtccgaaagactcgtccatttacaaagccatggcacagtgtgatgctgatggccccctaatggttaatgtgaccaaattgtatccaaaatctgattgcagtgtgtttgatgcctttggtagagtttatagtggcaagatacagacaggacagactgtacgtgttctaggagaaggatactcaccagatgatgaggaggatatgacagttaaagaagtaactaagttgtgggtgtatcaagctcgagataggatgccagtagctgaggctcctcctggttcttgggtcctaattgaaggtgtggatgcttcaatcatgaaaactgccactctttgtaatgtggattatgatgaagatgtgtatatattccggcctcttcagttcaatacactgtcagtggtaaaaactgctactgaaccattaaatccaagtgaattgccaaaaatggtggagggcctgcgaaaaataagcaaaagttatcctcttgcagttactaaagtagaggaatctggtgagcacactatattagggactggtgagctgtacttggattcaattatgaaggacctgagagagctctattctgaagtagaagtcaaggttgcagatcctgttgtctcattttgtgaaactgtcgtggaatcttcatcaatgaaatgctttgctgaaacaccgaacaagaagaataaaataactatgattactgaaccattagaaagaggccttgcagaggatatagagaatggtgttgttagcactgactggaatagaaaaaaactaggtgaatttttccagacaaaatatgattgggatcttcttgctgcacggtcaatatgggcatttggccctgataagcagggccccaatattctgttagacgatactcttccaactgaagttgacaagaatctgctgaatgctgtgaaggattccattgttcagggatttcagtggggtgcacgagaaggacctctgtgtgatgagcccatcagaaacgttaagttcaagattgttgatgcaaggattgcccctgaaccacttcaccggggatctggccagatcattcccacagctcggcgagtggcctattcagccttcctcatggctactccgaggcttatggaacctgtatattatgtggagattcaaacaccaattgattgtgtatctgcaatctacactgtattatctagaaggcgtggacatgttactgctgatgttcctcagcccggcaccccagcctatatcgttaaggcatttttgcccgtgatagaatcttttggatttgagacagacttgagataccatacacaaggtcaagcgttttgcatgtcagtttttgatcattgggctattgttcctggagatcctctagacaaaaacattgttttgcgcccacttgaaccagcacctatccagcatcttgctcgtgagtttatggtgaagacaaggcggagaaaggggatgagcgaggatgtaagcataaataagttctttgatgaggctatgatggtggaattggctcagcaggcagcagaccttcatcaacaaatgatgtgattctgtataaataattattctgtcgatttgatcttcattccggggttttcttcagaagtttgggccttaagcagttccgttatatgtgatgcaagcaaagtttctagtgcttggcattgcgagttatctggatatggctcagctattttcacatactggtgcaagcttcgatgccgttgaaattgcagtctactaaattctctccagtgtgaaaaagctacttatttcggacggggcagctttttctatacaaaattctgtattgatggtatcattgatcgtgtggtagtacttaatcttttcttttcttttcttttctttcctccatagatcgtaattgtacgagtgcttgtatttctaacaccttcatactataggttcaactaaatcctatttgcaacgtagatgcagtagttatggacgttagtcaaaccacaaaaccagataatgcagagaaaaatttataaattcttcctggtcgtcgatttatatacggttgatagctgtcttgaacgactacagatcgagatttgctgaaaagcgttcaattgatgtttatattattttctcactgttagcggatggtgaaaacatggacgaaaaaaattatgataagtttctagcgagacaatcaaacactttttaatgttg

SEQ ID NO: 4878 - DNA, 3957 bp, Glycine max
tttttctctctctgccgtaattgtttgtttgtaccgggccaggcccagtcctctggaaatcccatctccactatcgtccatcgttaccctaaaacccgaaaaaccccatctccgtctgttcgaaacgacggtgacaccaattccctcccactccctctctattttcctctccacactccacattccgccatggacgacagcttgtacgacgagttcggcaactacatcggccccgagatcgagtccgaccgcgactccgaccgcgactccgacgccgatgacaaccccgacgaccaatccgacgccgtaggagccgcccactccgatggagaggacccgagcaacgggtggatgacgacaatctccgacgagctggagaaccaggtggtgttagcagaggacaagaagtactaccccaccgcagaagaggtgtacggcgaggacgtcgaaaccctagtcatggacgaggacgaacagcccctggagcaacccatcataaagcccgttagaaacataaaattcgaagtgggcgtgaaggactcctccacctacgtgtcctctcagttcctcctgggtctcatgtcaaaccctactttggttcgtaacgtggcactggtggggcacttgcagcacgggaagacggtcttcatggacatgctcgtggagcagacgcaccacatgtccacgtttgattcgcagagtgagaagcacatgcggtataccgataccaggattgatgaacaggagaggaggatttcgatcaaggcggttcccatgtcgctcgtgctggaggatagcaattccaagtcctatttgtgtaacatcatggacacgcctggccatgttaacttctccgacgagatgaccgcggcgttgcggctcgctgatggcgctgtcttgattgtagatgctgctgaaggagtcatggtaaacacagagagagcgatacgtcacgcaattcaggagcggttgccgattgttgttgtaattaataaggttgacaggcttataactgagcttaagttgccaccgaaggatgcttatcataaactaaggcatactttggaagttattaatactcacatatctgctgcctcctcgattgctggtggtgttcaagttgtggatccagttgctggaaatgtttgttttgctagtgctactgctggatggtcctttacgttgcattcctttgctaagttgtatgggaagctgcatggaattcctttggaggctaataaatttgcttctcggctttggggagattattattttcatccggataccagagccttcaaaaagaaaccccctgccagtggaggggaacgatcttttgtggagtttgtgctggagccactttacaagatatatagccaggtgatcggggaacataaaaagagtgtagagacaacacttgctgaacttggagtttctctaagtaatgcagcctacagattaaatgttaggcctttgctaaggttggcatgtagctcagtttttggtccagcttcaggtttcaccgatatgcttgttcagcatataccttctccgagggatgctgcaattaagaaagttgatcatatatatgctggtcctaaagactcatccatttacaaagccatggcacagtgtgattcttatgggcccgtaatggttaatgtgaccaaattgtatccaaaatctgattgcagtgtgtttgatgcctttggtagagtttatagtggtaagatacagacaggacagactgtacgggtactaggagaaggatactcgccggatgatgaggaggacatgactgtaaaagaagtaacaaagttgtgggtttatcaagctcgtgataggatgccagtagctgaggctcctcccggttcttgggttctaattgaaggcgtggatgcttcaatcatgaaaaccgccactctttgtaatgtggattatgatgaagatgtatatatattccggcctcttcagttcaatacactgtcagtggtaaaaacagctaccgagccattgaatccaagtgagttgccaaaaatggtggagggcctgaggaaaataagcaagagttatcctcttgcagttactaaggttgaggaatctggggagcacactattttagggactggtgagctgtacttggattcaattatgaaggacctgagagagctctattccgaagtagaagtcaaggtagcagatcctgttgtctcattttgtgaaactgttgttgaatcttcctcaatgaaatgttttgctgaaacaccaaacaagaagaataaaataactatggttgctgagccattagaaagaggtcttgcagaggacatagagaatggtgttgttagcactgactggagtaaaaagaaactaggtgactttttccagactaaatatgactgggatcttcttgctgcacggtcaatctgggcatttggccctgataagcagggtcccaatattctgttagatgacacccttccaactgaagttaacaaggatctaatgaatgccgtgaaggattccattgttcagggatttcagtggggtgcacgagaagggcctctctgtgatgagcccatcagaaatgttaaattcaagattgttgatgcaaagattgctacagagtcacttcatcgggggtctggccagatcattccaacagctagacgagtggcctattcagctttcctcatggctactcctcgtcttatggaaccagtatattatgtggagattcaaacaccaatagattgtgtatctgcaatttacactgtattatctcgaaggcgtggacatgttactgctgatgttcctcagcctggcaccccagcttatattgttaaggcatttttgcccgtgatagaatcttttggatttgaaacagacttgagatatcatacacaaggtcaagcattttgcatgtcagtttttgatcattgggctattgttcctggagatcctctggataaaagcattgttttgcgcccacttgaacccgcacctattcagcatcttgcccgtgagtttatggtgaagacaagacgtagaaagggaatgagtgaggatgtgagcataaataagttcttcgatgaggctatgatggtggaactggcacagcaggcagcagaccttcatcaacaaatgatgtgattctgtataaaaagattctgtccgatttgatcttcatttcacgttttttttccccagaagtttgggccttttaagctgttcccgtttcacgagtttgcaggatttggctccactttttcacatactggtgcaagctccaatgccattgagatagtaatctactaccttcttttctttgtgaaaaaagctacttattccggacgggggcggcttttgtactataattctgcactgatcttgtagtagcatttacatgttttctttaattttgaccccataaatcgcgaaattgtatgaatgattgtagttttaacgccttcatactatataggttaaacaaaattctatttgcaacgaagttacttgtggacgttagtcacaagaaaaccatataatgcagaagccgcaaaaaacatttgatggagatttagtaaatatcgtaattttattgtgttttaagtttcttgtgttgatggggatttgctgaaaagcttttatgatgtcaatgtgtcagcccaatggaccctaatagcactgataggcccaagcgaacagtaaacaaacctgtaaaatatagagactatgtttaaaaggtgttagtataagaccgttgggactctagacatttagtattttcctttccaagaagcttctaggactttaacagctggctgctagctgtatttgaccgttgtgtgttaattcaggctttagtctgtgtatttaaagccttttatcaacaatgagaagtaggaagaaagtattattttaatatttatcactatgttgctttttcactggccgatg

SEQ ID NO: 4879 - DNA, 3685 bp, Glycine max
cttaactcgactgtttgtttggaccgggccaggcccagtccactgcaaatcccatctccccttgtcgtccatcgttattcgttaccctaaaacccgaaaaaccccatctccgtctgttcgaaacgacggtggcaccaattccctcccactccctctctctcttctcctctccacactccacattccgccatggacgacagcttgtacgacgagttcggcaactacatcggccccgagatcgagtccgaccaggactccgaccgcgactccgacgccgatgccgacgacaaccccgacgaccaatccgacggcggaggcaccgcccactccgacggcgagggcccgagcaacgggtggatgacgacaatctccgacgagctggagaaccaggttgtgttagcagaggacaaaaagtactaccccaccgcagaagaggtgtacggcgaggacgtggaaaccttagtcatggacgaagacgaacagcccctggagcaacctatcataaagcccgtgagaaacataaaattcgaagtgggcgtcaaggactcctccacctacgtgtcctctcagttcctcctgggtctcatgtcaaaccctactttggttcgcaatgtggcgctggtggggaacttgcagcacggaaagacggtgttcatggacatgctcgtggagcagacgcaccacatgtccacgtttgattcacagagtgagaagcacatgcggtatactgataccagaattgatgaacaggagaggaggatttcgatcaaggccattcccatgtcgctcgtgctcgaggatagcaattccaagtcctatttgtgtaacatcatggacacgcctggacatgttaatttctccgacgagatgaccgcggcgttgcggcttgctgatggcgctgtcttgattgtagatgctgctgaaggagtcatggtaaacacggagagggcgatacgtcacgcaattcaggagcggttgccgattgttgttgtaattaataaggttgacaggcttataactgagcttaagttgccgccaaaggatgcttatcataaactaaggcatactttggaagttattaatactcatatatctgctgcctcctcgattgctggtggtgttcaagttgtggatccagttgctggaaatgtttgttttgctagtgctactgctggatggtcctttacattgcagtcgtttgctaagttgtatgggaagctgcatggaattcctttggaggctaataaatttgcttctcggctttggggagattattattttcatccggataccagaaccttcaaaaagaaaccccctgccagtggaggggaacgatcttttgtggagtttgtgctggagccactttacaagatatatagccaggtgatcggggaacataaaaagagtgtagagacaacacttgctgaacttggagtcactctaagtaatgcagcctacagattaaatgttaggcctttgctaaggttggcttgtagctcagtttttggtccagcttcgggtttcaccgatatgcttgttcagcatataccttctccgagggatgctgcaattaagaaagttgatcatatatatactggtcctaaagactcttctatttacaaagccatggcacagtgtgattcttatggccccctaatggttaatgtgaccaaattgtatcccaaatccgattgcagtgtgtttgatgcctttggtagagtttatagtggtaagatacagacaggacaggctgtacgtgttctaggagaaggatactcgccggatgatgaggaggacatgactgtaaaagaagtaactaagttgtgggtgtatcaagctcgtgataggatgccagtagctgaggctcctcccggttcttgggttctaattgaaggtgtggatgcttcaatcatgaaaacttctactctttgtaatgtggattatgatgaagatgtatatatattccgccctcttcagttcaatacactgtcagtggtaaaaacagctactgagccattaaatccaagtgagttgccaaaaatggtggagggcctgaggaaaataagcaagagttatcctcttgcagttactaaagtcgaggaatctggggagcacactattttagggactggtgagctgtacttggattcaattatgaaggacctgagagagctctattccgaagtagaagtcaaggtagcagatcctgttgtatcattttgtgaaactgttgttgaatcttcctcaatgaaatgttttgccgaaacaccaaacaagaagaataaaataactatgattgccgagccgctagaaagaggtcttgcagaggacatagagaatggtgttgttagcactgactggagtaaaaagaaactaggtgaatttttccagactaaatatgactgggatcttcttgctgcacggtcaatctgggcatttggccctgataagcagggtcccaatattctgttagatgacacccttccaactgaagttaacaaggatctgatgaatgccgtgaaggattccattgttcagggatttcagtggggtgcacgagaagggcctctctgtgatgagcccatcagaaatgttaaattcaagattgttgatgcaaagattgctaatgagtcactccatcgggggtctggccagatcattccaacagcacgacgagtggcctattcagctttcctcatggctactcctcggctcatggaaccagtatattatgtggagattcaaacaccaatagattgtgtgtctgcaatttacactgtattatctcgaaggcgtgggcatgttactgctgatgttcctcagcccggcaccccagcttatattgttaaggcatttttgcccgtgatagaatcttttggatttgaaacagacttgagatatcatacgcaaggtcaagcattttgcatgtcagtttttgatcattgggctattgttcccggagatcctctggataaaagcattgttttgcgcccacttgaaccagcacctatacagcatcttgcccgtgagtttatggtgaagacaagacgtagaaagggaatgagtgaggatgtgagcataaataagttcttcgatgaggctatgatggttgaactggcacagcaggcagcagaccttcatcaacaaatgatgtgattcagtataaaaagattatgtccgatttgatattcatttcacgtttttcttcagaagtttgggcctttaagctgttcccattatatgttatgcaagcaaaattacaagtgctttggattgcgagttggcaggatttggctccactttttcacatactggtgcaagctccaatgccattgaaacagtagtctactaccttctcttccatgtgaaaaaagctacttattatacttattccggacggggcggcttttgtactataattctgcactgatgatatcactgatcttgtagtagcacttacatgttttctttaattttttccccataaatcgcgaaattgtattattgtagttttaacgccttcatactatataggttaaacaaaattctatctgcaacgaagttactgcaatagttatggacgttagtcaaaccacaaaaaccaaaaaacatttgatagtatcttctgggcccccgatttagtagatatcgtaatttgattatcttttaacttttaagtgtcttt

SEQ ID NO: 4880 - DNA, 3630 bp, Cajanus cajan
ccgaaaacccccatctccgtcttctccaaacgacggtgagagcaaccaactcactcacacattccacactcacttcccactccgccatggatgacagcttgtacgacgagttcggcaactacatcggccccgagatcgagtccgaccaggactccgaccgcgactccgaccccgacgccgaggacaccgccgccgatcccgacgacgaagccgcccagtccgacggcgagggtccaaacaacggatggctgacgacgatctcgaacgacatggagaaccaggtggtgctggcggaggacaagaagtactaccccaccgcggaggaggtgtacggcgaggacgtggaaaccctagttatggacgaagacgaacagcccctggaacaaccaattataaagccagtgaggagcatcaaattcgaggtgggagtgaaggactcttcaacctacgtgtcttctcagtttctccttgggctcatgtcgaaccctacgctggtgcggaacgtggcgctggtggggcacttgcagcacggtaagacggtgttcatggacatgctggtggagcagacgcaccacatgtccacgttcgatgcgcagagcgagaagcacatgcggtatacggacactaggattgatgaacaggagaggaggatttcgatcaaggctgttcccatgtcgctggtgctggaggatagcaattccaagtcctatttgtgtaacatcatggacacgcctggtcatgttaatttttctgatgagatgaccgcctctttgaggcttgcggatggggctgtcttgattgtagatgctgctgaaggagtcatggtaaacacggagagggcaatacgtcatgcaattcaggagcggttgccgattgttgttgtaattaataaggttgacaggcttataactgaacttaagttgccaccgaaggatgcttatcataaactgcggcatactttggaggttattaatactcacatatcggctgcttcctcgattgctggtgatgttcaagttgtggatccagttgtgggaaatgtttgctttgctagtgctactgctgggtggtcctttacattgcagtcatttgctaagttgtatgggaagttgcatggaattcctttggaggctaataaatttgcttctcgtctttggggagactattattttcatccggataccagagctttcaaaaagaaacccccagccagtggaggggaacgatcttttgtggagtttgtgctggagccactttacaagatatatagccaagtgatcggggaacataaaaagagtgtagagactacacttgctgaacttggagttactctaagtaatgcagcctacagattaaatgttaggcctttgctaaggttggcatgtagctcagtttttggtcctgcttcaggtttcaccgatatgcttgttcagcatataccttctccaagggaagctgcaattaagaaagttgatcatatatatactgggcctaaagactcgtccatttacaaagccatgtcacaatgtgatagttatggccccctaatggttaatgtgaccaaattatatccaaaatctgattgcagtgtgtttgatgcctttggtagagtttatagtggcaagatacagacaggacagactgtacgtgttctaggagaaggatactcaccggatgatgaggaggacatgactgtaaaagaagttacaaagttgtgggtgtatcaagctcgtgataggatgccagtagccgaggcacctcctggttcttgggttctaattgaaggtgtggatgcttcaatcatgaaaactgccactctttgtaatgtagactatgatgaagatgtatatatattccggcctcttctgttcaatactctatcagtagtaaaaacagctaccgaaccattaaatccaagtgagttgccaaaaatggtggagggcctgagaaaaataagcaagagttatcctcttgcagttactaaagttgaggagtctggggagcacactatattagggactggtgagctgtacttggattcaattatgaaggaccttagagagctctattctgaagtagaagtcaaggtagcagatcctgttgtctcattttgtgaaactgttgttgaatcttcatcaatgaaatgttttgctgaaactccaaacaagaagaataaaataactatgattgcagagccattagaaagaggtcttgcagaagacatagagaatggtgtagttagcactgattggaatagaaagaaactaggtgaatttttccagactaaatatgactgggatcttcttgctgcccggtcaatctgggcatttggccctgataaacagggccccaatattctgttagatgacaccttaccaactgaagttgacaagaatctgctgaatgccgtgaaggattccattgttcagggatttcagtggggtgctcgagaaggacctctctgtgatgagcccatcagaaatgttaaattcaagattgttgacgcaaggattgcccctgaaccacttcatcggggatctggccagatcattcccacagcacgacgtgtggcctattcagctttcctcatggctacccctcggcttatggaacctgtatattatgtggagattcaaacacctatagattgtgtatctgcaatctacactgtattatctcgaaggcgtggacatgttactgctgatgttcctcagccaggcacccccgcttatattgttaaggcatttttgcctgtgatagaatcttttggatttgagacagacttgagatatcatacgcaaggtcaagcattttgtctgtcagtttttgatcattgggctattgttcctggagatcctctggacaaaagcattgttttgcgcccacttgaaccagcacctatccagcatcttgcccgtgagtttatggtgaaaacaaggcgtagaaagggaatgagtgaggatgtaagcataagtaagttctttgacgaggctatgatggtggaactggcacagcaagcagcagaccttcatcaacaaatgatgtgattctgtataaaagcttctgtccaatttgatcttcattttgagtttccaccgttaagctgttcccattatatgtggtgcaagcaaaattgaaagtgctttgccatgcgagttggcagtatttggcacagctatttgaaatgccggtgcaagctcctatgccattgaaatagtagtctctgctaccttctctcgtcaatgcgaaaaagctatagattccagacggggtggcttttgtatctattattgatcttgtagcagtactgacatcttttcttttatctctctccgctcctcctaaattgagagaattgtacgaattattgtactttttaacgccttcagactaaataggttcaacaaaattccatttgcaaccaagtttctgccaatagttatgcaagttagtgaaaccacaaaacctttgatagtatcgtctgggcctcgattttatagatgtaggtagacaggtgtgtaactgtgcaagtgtcttgtattgatggagatttgctgaaaagcttttattgatgtttatattgctttctcactttattagtcgatggtgaaaacaaacgtataagcatga

SEQ ID NO: 4881 - DNA, 3511 bp, Theobroma cacao
ggctttcaacctggctgaagtctcaaaaacctccgatagttccactctaaacctctctatttccttgtttttgttcttcttcagtgtgtcaagacttaggaatttaagcaatggatgataacttgtatgatgagtttgggaactacattggccccgagattgagtccgaccaggagagtgaaggcgaggaagaagaagaagaagaattccctgacaggcatgcccaagaggagggagaagaatctgatggtgaggctccacctggtgcatctaatgggtggattactgctgctaatgatgttgatatggataatcagattgttcttgctgaggacaagaagtattaccccactgctgaagaggtttatggtgaggatgttgagaccttggttatggatgaagatgagcagcctctcgaacaacctattattaagcctgttaagaatgtcaagtttgaggttggagtcaaggattcttcaacttatgtgtcaacccagtttcttattggtctgatgtcaaatccgggtttggtccgcaatgttgctcttgttggacacttgcagcatgggaagactgtgtttatggacatgttggttgagcaaacccaccatatgaacacttttgatgaaaatagtgagaagcacatgagatacactgatacgagaattgatgagcaagagagaaggatatctatcaaggcaatcccaatgtcacttgtccttgaggacagtaactcaaaatcctatctctgtaacatcatggacactccaggtcatgtgaatttttctgatgaaatgactgctgctcttaggcttgctgatggtgctgtgttcattgttgatgctgctgaaggagtgatggtaaacactgagagagctatacgccatgcaatacaggagcgcctacctattgtagttgtaataaacaaagttgaccggctgataacagaacttaagttgcccgccaaggatgcttaccataagctaaggcataccctggaagtaatcaataaccacatatctgccgcctctacaaccgctggtaatgttccagttattgatcctgctgctggaaatgtttgttttgctagtgcaagtgcaggatggtccttcactttgcagtcatttgcaaaattatatgtcaaactccatggaattccatttgatgctgagaagtttgcatctcgtctttggggagatatttattatcatcctgatacgagggcttttaaaaggaaaccccctgctggtggaggagaacgatcatttgttgaatttgtgcttgaacccctttataagatatatagccaggtgattggtgaacataagaagagtgtggagtcaactcttgcagagttgggcgtcactcttagcaatgccgcttacaagttaaatgtaaggcctttactaaggctggcttgcagtacagtttttgggtcagcctcaggcttcactgatatgctggttcagcatataccatctcccaaggatgctgcagttaagaaggttgatcatgcatatacaggacctaaacattctatgatttacaaagccatggttgattgtgatccttctggccccctaatggttaatgtgaccaaactatatcccaagtcagattgtagcgtttttgatgcttttggtagagtttatagtggtagaattcaaacagggcagactttgagagtgctgggagaaggctattcaccagatgatgaggaggacatgacagtaaaagaagtaaccaaattatggatctaccaagctcgatatagaatacccataagcagtgctcctcctggttcttgggttctcattgaaggtgttgatgcttcaattatgaaaactgccaccctctgtaatatggatcttgatgaagatgtgtatatattccggcctttacagtttaatactcttcctgttgtaaaaacagccactgagccattaaatcctagtgagttgcccaaaatggtggaagggcttcggaagatcagcaaaagctatcctttggctattactaaagttgaggaatctggtgagcacactatattaggtactggagagttgtacttggactcaattatgaaggaccttagggagctctattctgaggtggaagttaaggtggcagatcctgttgtctcattctgtgaaacagtggtggagtcttcatcaatgaaatgctttgctgaaacacccaacaagaagaataaaataactatgattgcagagccattggagagaggtcttgcagaggacattgagaatggtgttgtaagtgttgattggagtcggaagcaacttggtgacttcttcaagacaaaatatgactgggatttgcttgctgcacgttccatctgggcatttggccctgataagcagggacctaacattttattagatgatacactccctactgaagttgacaagacattgttgggtgctgtcagggattctattgtccaagggtttcagtggggtgctagagaaggacctctctgtgatgaaccaattagaaatgtcaagttcaaaatagtagatgcaaggattgcatctgagccattgcatcgaggatctggacagatcatccccacagctcgacgtgtagcctattcagctttccttatggcgaccccacgacttatggaaccagtatattatgtggagatacaaacgccaatcgactgtgtctctgctatctatacggtcttgtctcgtaggcgtggccatgttacggctgatgtcccacagcctggaacgccagcttatattgtgaaggcatttttacctgtgatagagtcatttggattcgagacagatctaaggtaccacacgcaagggcaagctttttgtctctcagtatttgaccactgggccatagttcctggagatcccctggacaagagcatagttttgcggcctctcgaacctgcaccaatccagcaccttgcacgggagttcatggttaagacaaggcgtagaaagggaatgagtgaagatgtgagcatcaacaagttctttgacgaggctatggtggtggagctggctcagcaggctgctgatcttcatcagcagatgatatagcagaagcaaatgtggactatgtaacaggatagcatacaatgtgtttgtcatgtttcctggaagtgcttaccaatgatatttataaaatgttttctagtttctaggatagttcagtacttgcctgccaagatggttgctcactttaaagataaatcccgttttcaagcgatgcagtgggctcaaacttgacaagttaacaatgttcatttttacttgcacactgctagactccagattacaggccattggtagagtttgaatttgtttagaattgtagttgtttcatttttgttcttttgtcaagttagaagtgttgtaacttgtaaagagactcgcatagcgcagagaatcgaaaaacttttcagccttattcatcaaaatgttattcgttttgactactgaaaagctggtacttaattgaattcaag

SEQ ID NO: 4882 - DNA, 4034 bp, Panax ginseng
cgctggtcgttatgaagtagatggatacgtatattaactaacaacttagaccaatttcatttaccctaacgaatttgtgcttacggggtcgggtcaatcagaccgggcaaatctaaaatatctccttcgctcgcaagtcgcaaatcctcttaaaccctctataattttgttatgcagtagagcttttctctttgcttgttcgtcgccagtagagcttttggactccaggtttgttagaaccatggatgacagtttgtatgatgagtttggtaactatattggacctgaaatcgagtctgatcaggacagtgatagagaggatgaagatgaaaacctcacagacaaacatgatggtgatgcgaccgcatccgatgatgagaatgcagccggtggttctaatgggtggataactaccaccgatgatgttgatattgataatcaaattgttcttgccgaggataaaaagtattatccgactgcagaagaggtttatggtgaagaggttgaaacattagtgatggatgaagatgaacaacccctcgaacaaccaataattaaaccagttaggaacgttaagttcgagttgggggtcaaagattcgtctacttatgtctcaacacagtttcttttgggtctttcatcaaacccgtctttggttcgtaatgttgccttggtgggtcatctacaacatgggaagacagttttcatggatatgctggttgagcaaacccatcacattacgacatttgatcagaatagcgagaaacatatgagatacactgatacaaggatagacgagcaagagagaaggatatcaatcaaggcagttcccatgtctcttgttcttgaggacagcaattcaaaatcatacctatgtaacataatggatacgcctggtcatgttaacttctctgatgagatgactgctgctcttcggcttgctgatggtgcagtgttggttgtggatgccgctgaaggagtaatggttaacactgagagggctattcgtcatgcaattcaagagcgccttccgatagtagttgtgataaataaggttgacaggttgataactgaacttaaaatgcctccaaaggatgcttaccataaactaaggcataccattgaagtcatcaataaccacataactgccgcctcctcaactgctggagatgtccaaattattgatccagcagctggaaatgtttgttttgcaagcggtagcgcagggtggtgtttcactctgcactcgtttgcaaaactatatgtcaaacttcatggtattccatttgatgctatgaattttgcctcacgcctttggggagattattactttgatcctgataccagaggttttaagaagaaacaaccttcaggcggagttgaaaggtcgtttgtccagtttgtgctggaacctctttacaaaatttatagccaagtagttggagaacataagaagagtgtggagacaacactcgcagaacttggtgtaactctcagcaatgcagcttacaagttaaatgttaggcctctgctgaggttggcatgtagctctgtttttggatctgcaacagggtttactgacatgctggttcatcacataccttccgccaaagattcggtggccaggaaggctgaacatatttataccgggcccaaggactctgcgatatacaaagctatggaagactccgatccttctgggcccctgatggttaatgtgaccaaattgtaccctaagtctgattgcagcgtatttgatgtgtttggtagggtttacagcggtgaaatccatactgggcagattgttcgtgttttgggagaaggctattcgccagatgatgaggaggatatgactgtaaaagaagtaacaaaactatgggtttatcaagctcgttatagaatacctgttagcaaggctcctcctggttcttgggttctgattgaaggtgtggatgcttcaattatgaagactgcgacactttgtaatttcgattatgatgaggacatatacatatttcggcctcttcagtttaatactcttccagtggtgaaaacagcaactgagcctttaaatccaagtgaattgccaaaaatggtggagggtcttaggaagatcagcaagagttatcctcttgcaataactaaagttgaggagtctggagagcacactattttaggtactggtgagttatacttagattctattatgaaggatctgagggagctttactcagaagtggaagtcaaggtggcagatcctgttgtctcattctgtgaaacagtagtggagtcttcatcaatgaaatgttttgctgaaacacccaacaagaaaaataaaataacaatgatcgcagagccattggagagagggcttgctgaggacattgagaatggtgttgtaagcattgattggcctcgaaagaaactaggggattttttccaaacaaaatatgactgggatctgcttgctgcacggtctatttgggcatttgggcctgataaacagggacctaacattctgttagatgacactctctcaagtgaagttgataaaagcttgctgaatgctgttaaagattccattgttcaaggatttcagtggggtgctcgagaaggacccctctgtgatgagccgatcagaaatgttaaattcaagatagttgatgcaaggattgcacctgaaccattgaatcgtggaactggtcagatcattccaacagctcgacgtgtggcttattcagcttttcttatggcgaccccacgactcatggaacctgtatattacgtggagatacaaacaccaatagactgcgtgtctgccatttacacagtgttgtctagaaggagagggcatgtcacagcagatgttccacagccagggacaccagcctatattgtaaaggcgttcctgcctgttatcgagtcattcggatttgagacggacttgagataccacactcaagggcaggcattttgcctttcagttttcgatcattgggctatagttccaggggatcccctggacaagagcatcatcttaagacctcttgagcctgcacctattcagcacctggctcgggagttcatggtcaagacgaggcgcagaaagggaatgagcgaggatgtcagcatcaacaagttctttgatgaagccatggttgtggagcttgctcagcaggatgccgatctccatctgcagatgatctaagcgggacgttttctttagttctataacgaactgctgtcttttgtataactctagtctaccagaatgatatttcagtttttttgtcttttattacatcttttcaggtttgtcatgatacttagtttggtcaggtccttttttcaaagtagttctgtatctgtgtaagcagtattcattcattgaaaaacttgaaactccaaaatggatttcatgatccattgaattagttcggccattactaaacaaatgaatattggtggagaagattgtcctgcaaacagagctcttcttttccaatatggaaattgagtttttactaatatttgattgatcagtaaatttagcacgttactttagtgacatttcaatggtctgtctgacttgagatttatctatatgccaattattatttctgcaaatatgctagttccgacaaggtcctgcatgacattccttgtgaaaccagcatgttgttagttttttcagttgatggttatgaatatggtgggttgctttatcccctcctagaatgcttcgtttttatttatttatttatttgtttgagaacctatttattctattaggattgtattatagtgatatatttcatcttagggctgaagggaacataggaaatgggccaagggtagcctagggggaaacttaccttctttatgcagtagtcttttggttaattctgaaatgttcaaaattggtagacccaatatgtaatcttaccaagttatcacatttgtcatgtaaaatagctacagttggtaacataaattcttgtcttagcattggtctcatatttattgttgtcgtc

SEQ ID NO: 4883 - DNA, 3368 bp, Citrus sinensis
aaaaaaaaaaaactttttgctgtgagtacaaccgaccaaggatggaagtacataatcgggtcagattcggctcggttctgtgttagccagagacctattttgcggattccggagatccgcacgggatttacccgaatccggattttcccatcgaaggaaatttaggccaaattaaacagtagagaactctctcggctctttctcccgctctcaattctcaataccctaaaccctaaacccttattagcaacttcttctacttcccagctgataaggaacctgtaatttgaagattttaaaaataatatggatgacagtttgtatgacgagtttgggaactatattggtcctgaaattgagtcggatcgagagagtgaggcagacgatgatgaggatgaagaccttccagacaaggcagacgaagacgggcatgcctctgatcgtgaggttgcagctactgcttccaatgggtggattactgcttctaatgatgttgatatggataaccagattgtccttgctgaggataagaagtattatccgactgcagaagaggtttatggtgaggatgtggagactttggttatggacgaggacgaacaacctcttgagcaacctataattaaacctgttaagaatatcaagtttgaggttggggtcaaagattcttccacctacgtgtcgacccagtttcttgttggtctcatgtcaaaccctactttggtgcggaatgttgctcttgtggggcacttgcatcatgggaagactgttttcatggatatgttgattgagcagacacaccatatgtctacttttgatcctaatagtgagaagcacacgaggtacacggatacaaggattgatgaacaagagagaaggatatcgatcaaggctgttcccatgtctcttgttctggaagacagcaactcaaaatcttacctgtgtaacatcatggactctcccggtcacgttaatttctctgatgaaatgactgctgctctcaggcttgctgatggtgccgttttgattgttgatgctgctgaaggagtgatggtgaatacagagagggctatacgtcatgctatccaggagcgcctacctattgtagttgtagttaataaggttgacaggctaataacagaacttaaactcccgcccaaagatgcttaccacaaactgaggcatacaattgaagtaatcaataaccacatttctgctgcttctaccacggctggaaatgttcaagttatagatccagctgctgggaatgtttgttttgctagtgccagtgcgggatggtcattcacattacattcatttgcgaagttatatgtcaaactccatggggtcccatttgacgctgagaagtttgcttctcgtctttggggagacatgtattttcatcctgataccagggtattcaagaagaaaccccctgctagtggaggggaaagatcatttgtccaatttgtgcttgaacccctctacaaaatatatagccaagtgattggagaacacaagaagagtgtggaggcaacacttgctgaacttggtgtcactcttagcaatgcgacttacagattgaatgtcaggcctctgctaaggctggcctgtagctcagtttttggttcagcctcaggctttactgatatgctggttaagtttattccttctgccaaggatgctgcagctagaaaagtagatcatatatacacaggacctaagaactctacgatttacaaggcgatggtagattgtgatccttctggccctcttatggtcaatgtgaccaagctgtatcccaagtctgattgcagtgtctttgatgcttttggtagagtttatagtggtattattcagacaggacagagtgtacgtgtattgggagaaggctattccccagaggatgaggaagacatgactgttaaagaagttacaaaattatggatttatcaagctcgagataggatacccataagcagtgctcctcctggttcttgggttcttattgaaggtgtggatgcatcaattatgaaatccgctactctctgtaacctagagtatgatgaagatgtttacatcttccggcctcttcaattcaatacccttccagtggtgaaaacagctactgagcctctaaaccccagtgagttgcctaaaatggtggagggtcttaggaaaattagcaaaagctatcctctagccatcactaaagttgaggagtctggagagcatactatattgggtactggagagttgtacttggattcaattatgaaagatctgagagagctctattctgaagttgaagtcaaggtggcagatcctgttgtctcattctgtgaaacagtggtggagtcttcatcgatgaagtgttttgctgaaactcccaacaagaaaaataaaataaccatgattgcagaaccattggagagaggacttgccgaggatattgagaacggcgttgtaagtattgattggagtcggaagacacttggtgatttctttaaaacaaaatatgactgggatttacttgcagcacgatctatatgggcatttggacctgataagcagggacctaatattttattagatgacacactcccaacggaagttgacaagagcttgctgaatgctgttaaggattccattgttcaaggatttcagtggggtgctcgagaaggacccctctgtgatgaacctatcagaaatgtcaagtttaaaatagtcgatgcaaggattgcacctgaaccgctgcatcgaggatctggtcagatcattcccacagctcgacgtgtggcttattcagcttttcttatggctacccctcggcttatggaaccggtgtattatgttgagatacaaactccaattgattgtgtctctgcaatctacacggtgttatctagaaggcgtggacatgttactgccgatgttcctcaaccaggaactccagcttatattgttaaggcatttctaccagtgattgagagttttggttttgagacggacttgaggtaccatactcaagggcaagcattttccctttcagtctttgatcattgggctatagttcctggagatccccttgacaagagcatagttctgcggccgcttgaacctgcaccaatccagcaccttgctcgtgaatttatggtcaagacaaggcgtagaaagggtatgagtgaagatgtgagcatcaacaagttctttgatgaggccatggtggtggaacttgctcagcaggcagctgatcttcatcagcagatgatttgatgagctcatacttaggcgcctccttcaattttatcaagttctttttctcctaagagcccagatgtataagtggtactgataatggtttatct

SEQ ID NO: 4884 - DNA, 3376 bp, Tripterygium wilfordii
ctctcactcgtcgggtcttagtactgtaactatcgtgctagttccctgattctggagcttgttctcactctagacccatattaacaaaatggatgatagtttgtatgatgagtttggtaactatgttggacctgaaatggagtctgatcaagagagtgatggagaggatgatgaggagtttcctgaccagccccatgaagaggaggtgacatcagatggtgagggtggaacctccggtcccaatgggtggattactgcctcacatgatgttgatatggataaccagattgttcttgctgaggacaagaagtattatccaactgcggaagaggtttatggtgaagatgttgaaacattggttatggatgaagatgagcaacctttagaacaaccgataattaaacctgttaagaacatcaaatttgaggtcggggtgaaggattcttcgacatatgtatcaacccagtttcttataggtctaatgtcaaatcctgctctggttagaaatgttgcccttgtaggccatctccagcatggcaagacagtattcatggatatgttggttgagcaaacacaccatatgtccacttttgacccgaataatgagaggcacatgagatatacagatacaaggattgatgagcaagagagaagaatatcaatcaaggctgtcccaatgtcacttgttctcgaggatagcaattcaaaatacatacctgtgtaacataatggacactcctggtcatgtcaatttctcagacgaaatgactgccgctctcaggctagccgatggtgctgttttgattgttgatgctgctgaaggagttatggtaaatacagaaagagccattcgccatgcaattcaagagcgcttgccaattgtagttgtgattaacaaggttgacaggctgataacagaacttaagttgcctccgaaggacgcttaccataagctcaggcatacattggaagtgattaatagccacataactgctgtatcttcaactgctggaaatgtgcaagtcatagatccagctgctggaaatgtttgttttgccagtgcgactgcagggtggtcatttactctgcaatcgtttgctaaactgtatgtaaagctgcatggaatcccatttgactttgaaaagtttgcatctcgtctttggggagatatctattatcatccagataccaggaccttcaaaaagaagcccccctccactggaggggaaagatcatttgttgagtttgtactcgagcctctctataaactctacagccaagtgattggggaacataaaaagagtgtggaggcaactcttgcagtgctcggggtcactctcagtaatgctgcttacaaattgaatgttaggcccttattaaggttggcttgtagctcagtttttggttctgcctcaggctttacagatatgctggttaaacatataccttctgctaaagaagctgcagccaggaaggttgatcatatatacacagggcccaaagattcaacaatttatcagtcaatggtagattgtgatccttctggtcccttgatggttaatgtgactaaactgtatccaaagcccgattgcagtgtttttgatgcttttggtagggtctatggtggtaagatccagacggggcagactgtgcgtgtgcttggagaaggctattctccagatgatgaggaagacatgacagtgaaagaagtaacaaaactatggatttatcaggctcgatataggatacctatcgcaagtgctcctccaggtacgtgggttctcattgaaggcgtggatgcttctataatgaagactgcgactctctgtaatgttgattacgatgaagatgtgtatatatttcggcctcttcagttcaatactcttccagtagtgaaaacagctacagagcctctaaatccaagtgaattgaccaaaaatggtaggaaggtctcaggaagatcagcaaaagctatcctttggccattactaaagttgaggaatctggggagcacacgattttaggcactggagaattgtacctggattcaatcatgaaggatcttagagagctctattctgatatagaagtgaaggtggcagatcctgttgtttcattttgtgagacagtggttgagtcctcatcaatgaagtgttttgctgaaacaccaaataagaagaataaaataaccatgatcgcagaaccattggaaaaggggcttgcagaggacattgagaatggtgttgttagcattgattggagtcgaagacagcttggtgacttctttaagacaaaatatgagtgggatttgcttgcagcacgatctatatgggcatttggccctgataaacagggacctaatatcttattagatgatacacttcccactgaggttgacaagagcttgctgggtgcagtcaaggattccattgttcaaggattccaatggggtgctcgagagggtcccctctgcgatgagcctatcaggaatgtcaagtttaaaatagttgatgcaaggattgcacccgaaccattgaatcggggatcaggtcaaatcatacccacagctcgacgtgtggcctattcttcgttccttatggcaacccctcgactaatggagcctgtgtattatgtggagatacaaacaccgatcgactgcctatctgctatttatacggtgttgtctcgtagacgtggacatgttacagctgatgttcctcagccaggcaccccagcatacattgtgaaggcatttttacctgttattgaatcatttggttttgagacggatttgaggtaccatactcagggccaagcattttccctctcagtgtttgaccactgggctattgttccgggggatccactagataagagcatagttctgcggccacttgaaccagcacccatccagcaccttgctcgtgaatttatggtgaagacaaggcggagaaagggaatgagcgaagatgttagcatcaacaagttctttgatgaggctatgatggtggaactggctcagcaggcagctgatattcatcagcagatgctatgatgggagtccacatgatgttgtgcacctgcattcatagccatgccgttgaggtttttacgggcaattaacttgcgtgccttgtcttgtaccaaaactctagcgctcgtttgtactagcgagccactggcaagctattgctgataaccgcaaacaatgccaacctcacgtctggtatcattggatcgaattaatattatagttccgtttcttctcttttgtgataaaaggtgttacagtttgagcggcttagtatctgtaattgtctgagatattagttcaatcggatcttacttgcatatttgatgagggaatgaacccaac

SEQ ID NO: 4885 - DNA, 3553 bp, Citrus clementina
aaaaaaaaaaaaactttttgctgtgagtacaaccgaccaaggatggaagtacataatcgggtcagattcggctcggttctgtgttagccagagacctattttgcggattccggagatccgcacgggatttacccgaatccggattttcccatcgaaggaaatttaggccaaattaaacagtagagaactctctcggctctttctcccgctctcaattctcaataccctaaaccctaaacccttattagcaacttcttctacttcccagctgataaggaacctgtaatttgaagattttaaaaataatatggatgacagtttgtatgacgagtttgggaactatattggtcctgaaattgagtcggatcgagagagtgaggcagacgatgatgaggatgaagaccttccagacaaggcagacgaagacgggcatgcctctgatcgtgaggttgcagctactgcttccaatgggtggattactgcttctaatgatgttgatatggataaccagattgtccttgctgaggataagaagtattatccgactgcagaagaggtttatggtgaggatgtggagactttggttatggacgaggacgaacaacctcttgagcaacctataattaaacctgttaagaatatcaagtttgaggttggggtcaaagattcttccacctacgtgtcgacccagtttcttgttggtctcatgtcaaaccctactttggtgcggaatgttgctcttgtggggcacttgcatcatgggaagactgttttcatggatatgttgattgagcagacacaccatatgtctacttttgatcctaatagtgagaagcacacgaggtacacggatacaaggattgatgaacaagagagaaggatatcgatcaaggctgttcccatgtctcttgttctggaagacagcaactcaaaatcttacctgtgtaacatcatggactctcccggtcacgttaatttctctgatgaaatgactgctgctctcaggcttgctgatggtgccgttttgattgttgatgctgctgaaggagtgatggtgaatacagagagggctatacgtcatgctatccaggagcgcctacctattgtagttgtagttaataaggttgacaggctaataacagaacttaaactcccgcccaaagatgcttaccacaaactgaggcatacaattgaagtaatcaataaccacatttctgctgcttctaccacggctggaaatgttcaagttatagatccagctgctgggaatgtttgttttgctagtgccagtgcgggatggtcattcacattacattcatttgcgaagttatatgtcaaactccatggggtcccatttgacgctgagaagtttgcttctcgtctttggggagacatgtattttcatcctgataccagggtattcaagaagaaaccccctgctagtggaggggaaagatcatttgtccaatttgtgcttgaacccctctacaaaatatatagccaagtgattggagaacacaagaagagtgtggaggcaacacttgctgaacttggtgtcactcttagcaatgcgacttacagattgaatgtcaggcctctgctaaggctggcctgtagctcagtttttggttcagcctcaggctttactgatatgctggttaagtttattccttctgccaaggatgctgcagctagaaaagtagatcatatatacacaggacctaagaactctacgatttacaaggcgatggtagattgtgatctttctggcccccttatggtcaatgtgaccaagctgtatcccaagtctgattgcagtgtctttgatgcttttggtagagtttatagtggtattattcagacaggacagagtgtacgtgtattgggagaaggctattccccagaggatgaggaagacatgactgttaaagaagtaacaaaattatggatttatcaagctcgagataggatacccataagcagtgctcctcctggttcttgggttcttattgaaggtgtggatgcatcaattatgaaatccgctactctctgtaacctagagtatgatgaagatgtttacatcttccggcctcttcaattcaatacccttccagtggtgaaaacagctactgagcctctaaaccccagtgagttgcctaaaatggtggagggtcttaggaaaattagcaaaagctatcctctagccatcactaaagttgaggagtctggagagcatactatattgggtactggagagttgtatttggattcaattatgaaagatctgagagagctctattctgaagttgaagtcaaggtggcagatcctgttgtctcattctgtgaaacagtggtggagtcttcatcgatgaagtgttttgctgaaactcccaacaagaaaaataaaataaccatgattgcagaaccattggagagaggacttgccgaggatattgagaacggcgttgtaagtattgattggagtcggaagacacttggtgatttctttaaaacaaaatatgactgggatttacttgcagcacgatctatatgggcatttggacctgataagcagggacctaatattttattagatgacacactcccaacggaagttgacaagagcttgctgaatgctgttaaggattccattgttcaaggatttcagtggggtgctcgagaaggacccctctgtgatgaacctatcagaaatgtcaagtttaaaatagtcgatgcaaggattgcacctgaaccgctgcatcgaggatctggtcagatcattcccacagctcgacgtgtggcttattcagcttttcttatggctacccctcggcttatggaaccggtgtattatgttgagatacaaactccaattgattgtgtctctgcaatctacacggtgttatctagaaggcgtggacatgttactgccgatgttcctcaaccaggaactccagcttatattgttaaggcatttctaccagtgattgagagttttggttttgagacggacttgaggtaccatactcaagggcaagcattttccctttcagtctttgatcattgggctatagttcctggagatccccttgacaagagcatagttctgcggccgcttgaacctgcaccaatccagcaccttgctcgtgaatttatggtcaagacaaggcgtagaaagggtatgagtgaagatgtgagcatcaacaagttctttgatgaggccatggtggtggaacttgctcagcaggcagctgatcttcatcagcagatgatttgatgagctcatacttaggcgcctccttcaattttatcaagttctttttctcctaagagcccagatgtataagtggtactgataatggtttatctgttgtcaagctacttggttataaacatggttaacaacacccccgagcagacctcagtttccagaagtcctgtggctgattgtatcattgatcttcatgagtaaattggaaatttttttcttatgatttcaattctatgcgagtgacggctgtatcaacggcatgttttgtacttgtgttcccaa

SEQ ID NO: 4886 - DNA, 3346 bp, Cucumis sativus
catggatgatagcttgtatgatgaatttggaaactacataggacccgaaattgattctgataaggatagtgacatcgaagatgaagatgaaaacctcatggagaagcctgaggaagatgaaggtgtatcggatggagaagatgcaggtggtgcttcaaatggttggattacaacgtctaatgatgttgatatggacaaccagattgtccttgcagaggacaaaaaatattatccaactgcagaagaggtttatggtgaagatgttgaaacattggttatggatgaagatgagctaccgctagagcaaccaattattaagcctgttagaaatgtaaaatttgaggttggggtaaaagattctagaacatatgtctcaaatcaatttctggtgggtctcatgtccaatccaactttggtccgcaatgttgcacttgtaggccacgtacatcatggaaagacggtcttcatggatatgctgattgagcaaacacatcacatgtcaacatttgatattaaaggagagaaacatttgaggtacacagatactaggattgacgagcaggagagaggaatatcaattaaggcagttcctatgtcactggtcctcgaggatggcaattcaaaatcgtacctttgcaatataatggacacccctggccataccaatttttctgatgaaatgactgctgctcttagacttgctgatggtgcagtgttgatcgtagacgctgctgaaggagttatggtcaatacagagagggctatacggcatgcaattcaggagcgattgcccattgttgttgtaattaacaaggttgacaggctgattacagaacttaaattgcctccaagggatgcatactataaattaaggcatacgttagaaattattaataatcatatatctgctgcctcatctactgctggaaatgttcaagttattgacccagccgccggaaatgtgtgttttgcaagtgctactgcaggatggtcgtttactttgcaatcgttcgcaaagttatatgtcaaacttcatggaatcccttttgatgctgataagtttgctacccgtctttggggagattattattatcatcctgataccagaggatttaagaaaaaacagcctgcaagtggaggagaaaggtcatttgttcaatttgtgcttgagccactatacaaaatatatagtcaagtcattggtgaacataggaaaagtgttgagactactcttgcggagcttggtgttactcttagcaatgcagcttacaagttgaatgttaggcctttgctgagactggcttgtagttcagtttttggtggagcttcaggattcactgacatgcttgttcagcacataccttctcccagggatgcttcttctcggaaggttgatcatatttataccgggcctaaagactccatgatttacaaagcaatgaaagaatgtgatccttctgggcctttaatggttaacatcaccaaactataccccaagtcagactgcagtgtatttgatgcgtttggtagggtttatagtggtaagattcaaacagggcagactgtacgggtattgggtgagggctattcaccagatgatgaggaagatatggtagttaaggaagtaacaaaattatggctttatcaagctcgagacagggttcccattgctgaggctcctcctggatcttgggttctcattgaaggagtggatgcatctattatgaaaactgcaaccctgtctaatgtagattatgatgaggatgtttacatattccgaccacttcaattcaatacccttcctgtggtaaaaacagctactgagcctctaaatccaagtgagttgccaaagatggtagagggtcttcggaagatcagcaaaagctatcctctggcaatcactaaagttgaggaatcaggcgagcataccattttaggcacgggagagctgtacttggattcaattatgaaggatcttagagagctctactcggaagtagaagtcaaggtagccgatcctgtcgtttcattttgtgaaaccgttgtagagtcttcttcaatgaaatgttttgctgagactcctaacaagaagaataaaataaccatgattgcagagccattggagagaggacttgcagaagacattgagaatggtgttgtaagccttgattggtcaagaaagaaacttggagatttcttccagacaaaatatgagtgggatttgctggctgcaaggtccatatgggcatttggccctgataagcagggacctaacattctattagacgatacgctctcttctgaagtagacaagaatttgctgaatgccgtcaaggattccattgttcaagggtttcaatggggagctcgagaaggaccactttgtgatgagcccattaggaatgttaagttcaaaattgttgatgctagaattgcacctgagccactgcatcgtgggtctggtcagatcattcccacagctcgacgagtggcctattcgtcttttcttatggcaaccccacgacttatggaaccagtatattatgttgagattcaaacacccatcgattgtgtctctgcaatctatactgtcctatcccgaaggcgtggacatgttacagctgatgttgctcaaccagggactccagcttacattgtcaaggcatttttacccgttattgaatcttttggctttgagacggatttgcggtatcatacgcaaggccaggctttttgtctctctgtgtttgaccactgggccattgttcctggcgatccccttgataagagcattgttttacggcctcttgagccagcaccaattcaacaccttgctcgtgaattcatggtgaagacaaggcgtagaaagggaatgagcgaggatgtgagcataaacaagttcttcgacgaggcaatgatggtcgagctggctcagcaagcagctgatcttcatcaacaaatgatataattgaagctcatccaagcaatgtttggtctgatttgttggtgaatccaagtgttgtaccatagttatttctcttcacttcctccaatatcctgcctcgatttaacaaccatcattcttatatattagaagataggcaagcagactgagatttgtagatcttattttcggagaattttcctttgtctgctaattttgagggattttgaagctgaatacatattttaggaatttatactgtaatgtttagagtatgtatgaaccttgtaatgtgaaaaaaggaagggcagatttggttgcatttacatgttttgaatggaaatgaaagaattagaatcaacctccttgatattagctattgatatattcacgtcttattgg

SEQ ID NO: 4887 - DNA, 3541 bp, Lupinus angustifolius
cttattctctgaactctcatactttgctcttctcttcacacaactcactcgccatggatgatagcttgtacgacgagttcggaaactacatcggacctgaaattgactccgattttgactccgacagagaagaagacaatgacgacgacggcgaagataacagagatagcctcactaaccagcacgacggcgctgcctccgacggtgagggtcccaccaatggctggatcacaacctcaaatgacatcgacatggtggacaatcaggtcgtacttgcagaagacaagaagtactatcccaccgcggaagaggtttacggtgaagacgtggaaaccctagttatggacgaagatgaacaatccctagagcaaccaattatcaaacccgttcggaacatcaaattcgaagttggagtgaaagattcatctacatatgtatcttctcagtttctacttggcctcatgtcaaaccctactttggtgaggaacgttgcgcttgttgggaacttgcagcatgggaaaacggtgttcatggatatgttggttgagcagacgcatcatatgagtacgtttgatccgcagagtgagaagcatatgaggtatactgatacaagggttgatgaacaggagaggaggatttcgattaaggcggttccgatgtctcttgtgatggaagatagtaattctaagtcttatttatgtaacattatggatacacctggtcatgtcaatttctctgatgaaatgaccgctgcgttgaggcttgctgatggtgctgtgttgattgtggatgctgctgaaggagtcatggttaacacagagagggcaatacgccatgccacccaggagcgactgcctattgttgttgtcatcaataaggttgacaggctcataactgaacttaaattgcctccgaaagatgcttaccataaaataaggcatacactggaagtgatcaacaaccatatatctgctgcctcttcaattgctggtgatgtccaagttatagacccagttgctggaaatgtttgttttgcaagtggtactgcaggatggtcctttacattgcaatcatttgctaaactatatgggaagatacatggcattcctctggaagctaataaatttgcttctcgtttgtggggagacttctattatcatccagataccagaaccttcaaaaagaaaccccctgccagtggaggagaacgatcttttgttgagtttgtgttggaaccactctacaagatatatagccaaattattggggaacataagaagagtttagagacaactcttgcagaacttggagtcactctaagtaatgcagcctatagattaaatgttagacctttgctaaggctggcttgtagctcagtatttggtgcagcttcaggtttcactgatatgcttgttcagcatataccttcaccaagagatgctgcaattaagaaagttgatcatatatacaccggccctaaagattcaaccatttacaaagccatgtcacagtgtgattcttctgggcccttaatggttaatgtgaccaaactgtatccaaaatctgattgcagtgtgtttgatgtttttggtagagtgtatagtggcaagatacagacaggacagacggtacgtgttctaggagaagggtactcgccggatgatgaggaggacatgactgtaaaagaagtgacaaagttgtgggtgtatcaagctagagataggatgccaatagctgaggctcctcctggttcttgggttctcattgaaggtgtagatgcttccatcatgaaaactgccactatttgtaatgtggattatgatgaggatgtatatatattccgacctcttcagttcaatactctgtcagtggtaaaaacagctactgagccattaaatccaagtgagttgccaaaaatggtggagggcctaaggaaaataagcaagagttatcctctggcagttactaaagttgaggagtctggggaacacactatattggggactggtgaactgtacttggattcaattatgaaggaccttagagagctgtattctgaggtcgaagtcaaggtggctgatcctgttgtttcgttttgtgaaactgttgttgagtcttcatcaatgaaatgttttgctgagacaccaaacaagaagaataaaataactatgattgctgagccactggaaagaggtcttgctgaggacatagagaatggtgttgttagcactgactggaatagaaagaaacttggtgaatttttccagactaagtatgactgggatctccttgctgcacggtcaatctgggcatttggccctgataagcagggccccaatattctgttagatgacacccttcccactgaagttgacaagaacctgctgaatgctgtaaaagattccattgttcagggatttcagtggggtgcacgagagggacctctctgtgatgagcccatcagaaacgttaagttcaagattgttgatgcaagaattgcccctgaaccacttcatcggggatctggccagatcattccaacagcacgacgagtggcctattcttctttccttatggctacccctcggcttatggaacctgtatattatgtggagattcaaacacccatagactgtgtatctgcaatatacactgtgctatctcgtaggcgtggacatgttactgctgatgttcctcaaccaggcactcctgcttatattgttaaggcatttttgcccgtgatagaatcttttggttttgagacagacttgagataccatacccaaggtcaagcattttgcctatcagtttttgatcattgggctattgttcctggagatcctctggacaaaagtattgttttgcgcccacttgaaccagcaccaatccagcatcttgctcgtgagtttatggtaaaaacaaggcgtagaaagggaatgagtgaagatgtaagcataggtaagttctttgatgaggctatgatggtggaactggcacagcaggcagcagatcttcatcaacaaatgatatgattctttataaaaagcttctatgtcaatttgatcattttgtatttttctgaagtttccttgggctgttttccattacgaaactggaaacaagttatgtgatgcaagaaaaatctggatgttctttgctttgcgagtagttggccagcatttgtcatttcaaattcaggtactggtgttagcacctatgcccttagaagaagtagactactatctccaatgtgaaaaagtttttttctccacagtggagcatctttgtttgtagactgtactttatgcattgctagaatctcttgtagtgttattacaaaccatggcaatggagaaaattgttactttttaacaaaatgtgggtgcctccaatttaatatttgccaagatgttgtcttgtcctgtaaaattgaattgaagactttgttatacgtttgcgtcagcatttgattataaagattctcattttgtggaaatgtatcccgtttacaatgttaatcaagattctctggattctattc

SEQ ID NO: 4888 - DNA, 3130 bp, Echinacea purpurea
gctggctacacgaatctgaaaccttccacacaaaccttaaacccttctctgaaaccctaacgttccgtcatcaaccgccattttttccggcaaagcttcaggatggatgacagtttatatgatgagtttggaaactacattgggccggaaatcgagtctgatcaggaaagtgacagagaggaggaagatgaggatcttccggagaagattgaagaaagggctgattctgatgaagagaatgcagctgcggggccgaacgggtggttaactaacggtgaagatgttgatatggagaatcagattgttcttgcggaggataagaagtattatcctacggcagaagaggtttacggtgaggaggtggaaactctggtaatggatgaagatgaacagccacttgagctacctataattaagcctgttagggatattaagtttgaagttggtgttaaggattcgtccacttatgtttcgactcagtttcttttgggtctttcttcaaaccctactttggttaggaatgttgctttggttgggcacttgcagcatgggaagacggtttttatggatatgttggttgagcaaactcatcatatttcgacttttgatcagaacagtgagaaacatatgaggtacactgatacaagagtagatgagcaggagagaagaatatcgattaaggcggttcctatgtcacttgttcttgaggatagcaattcaaaatcgtatatgtgtaatatcatggataccccagggcatgttaatttctctgatgaaatgacggctgctctcaggcttgctgatggtgctgtattggttgttgatgctgctgaaggagtcatggtgaacactgaaagagcaattcggcatgcaatccaggagcgcctacctatagtagttgtgataaacaaggttgaccgattaataactgagcttaaactacctccaaaagatgcatatcataagctgagacatacaattgaagtcatcaataaccacatcactgcagtctcttcaacagctggcaatgtccaaatcattgatccagctgctggaaacctttgttttgctagtggtagtgccggatggtgcttcactttgcaatcatttgccaaattatatgttaagcttcatggaattccttttgatgccaacaagtttgcatctcggctttggggagattactattatgaccctgctactagaaccttcaaaaagaaacaacctgcaagtggggcagaaaggtcatttgtacagttcatccttgaacccctttacaagatttacagccaagttattggagaacataaaaagagcgtggagacaacactggcagaactcggggtaactttaagcaatgctgcatacaagttgaatgtgagacctttgcttagattagcatgccgctcggtttttgggtcagccaccgggttcaccgacatgctggttcaccacatcccatctgcgaaagaggctgcatctaaaaaagttgagcatatttacactgggccaagaaattcaacaatctacactgccatgtcagattgtgacccgtctgggccacttatggtcaatattaccaaactgtatccaaagtcagattgttctgtttttgatgcatttggaagggtttatagtggagaaatccatacgggccagactgtgcgtgttcttggagaaggttattctcctgatgatgaagaagatatgactgtaaaagaagtaacaaaactatgggtctatcaagcccgttacaggatacctatcaataaggcgccacctggctcttgggttcttattgaaggtgttgatgcttccattatgaaaaccgctacactttgtgattcagaatatgatgatgatgtgtacatattcaggcctcttcagtttaacactcttcccgtggtaaaaacagcaaccgaaccgttaaatcctagcgaattaccaaaaatggttgagggtcttaggaagattagcaaaagttatcctttagcaattactaaagttgaagagtctggagaacatactattttaggtactggagagttgtatcttgattctataatgaaggatctcagggaactatattcagaagtcgaagtcaaggtggccgacccagttgtctcattttgtgaaacggtggtggagtcttcatcaatgaaatgctttgccgaaacgcctaacaagaaaaataaaattaccatgattgctgaaccattggagagaggacttgcagaagatatcgagaatggtgttgtaagtgtggactggcccaaaaagaagctaggggacttttttcaaaaaagatacgaatgggatctgctcgctgcaagatctatatgggcatttggaccagacaagcagggacctaacatattgttggatgacactctctcaagcgaagtcgacaaaagtctgttgaattctgtgaaggattcaattgttcaagggttccagtggggtgcacgtgagggtccgctttgtgacgagccgatccgtaacgtcaagttcaaaatagttgacgcgaaaattgcaccagagccactacatcgcggaacaggtcaaatcattccaacagctcgacgtgtcgcctactcagcttttcttatggcaaccccacgccttatggagccagtatattatgtggagatacagacacctatcgattgtgtttcggctatatacactgtgttatctcgaagacgtgggcatataactgctgatgttcctcaaccaggaacccctgcctacatagtcaaggcgtttgttcctgtaatcgagtcgtttggttttgagacagacttacggtatcatacccaggggcaggcatttgcggtctcaacttttgatcactgggccattgttcctggtgatccattggataaaagcattgtattacggccactcgagcctgcaccaattcagtatcttgcacgtgaattcatggtgaaaacgaggcgtaggaagggaatgagcgaggatgtgagcatcaacaagttcttcgatgaggctatgatggtggagcttgcccagcaggaagccgatctacaccagcagatgatgtaagccaccatgccgaatgacttgtagcagttgtatttcagttttggtaatttgtttctttagcttt

SEQ ID NO: 4889 - DNA, 3451 bp, Populus trichocarpa
cccgaacccaaccccttcaaaaacctctccctctatctccactcaaacccctccccctcttttgcttctcttgcagcgaacttctctctctctacagggtttgaagtggtgccatggatgacaatttgtatgatgagtttgggaactacattggtccggaaatagagtcggaccgagagagcgatggcgaggaagaagatgaagaacttccagacaagcctcatgaagacgaggaggaatctgacggtgaagaggcagttcatgcttccaatggttggcttactgcccctaatgatgttgatatggataaccaagttgtccttgctgaggacaagaagtactacccaaccgcggaggaggtttatggtccaggtgttgaaacgttggttaatgatgaagatgagcagcctcttgagcaaccgataattaagcctgttaggaacatcaagtttgaggttggggttaaggattcctcaacttatgtttccagccagtttcttgttggtcttatgtcaaatccctctttagtacgcaacgttgccctcgtgggccatctacagcatgggaagacagtttttatggacatgttggttgagcaaacacatcatacgccaacttttgatataaatagcgagaaacatattaggtacacagatacaaggattgatgagcaagaaagaaggatatctatcaaggcagttccaatgtcacttgtccttgaggatagcaattcaaagtcgtacctctgtaacatcatggacacccctggtcatgtgaacttctctgatgaaatgactgctgccctcaggcttgctgatggtgcagtgttggttgtggatgctgctgaaggagtgatggtaaacacagagagggccatacgccacgcaattcaggaacagctgcctattgttgttgtgatcaataaggttgacaggctcataacagagctcaaattgcccccaaaggatgcgtatcacaagctaaggcataccatagaagtcattaacaaccatatatctgctgtctcttcaactgctggaaatgttcaagtgatagatccagctgctggaaatgtttgttttgctggtgcaaccgcaggatggtccttcactttgcattcctttgctagattgtatctcaaactccatggtatcccatttgatgctgaaaagtttgcatctcgtctctggggggatatgtattataatcccgaggacaggactttcaagaagaaacctcctgctagtggagcagaaagatcgtttgtccaatttgtgctggaacctctctacaaaatatacagccaagtgattggagaacataaaaaaagcgttgaggctactcttgctgagtttggtgttactcttcctaattcagcttataaattaaatgtcaggcctttgctaagactggcttgcagtcaagtttttggctcagcctcaggtttcactgacatgcttgttaagcatataccttcggctaaggttgctgctgccaggaaggttgatcatacatatactgggcccaaagattcaatgatttaccaggccatgctagactgtgatcctgctggccccttaatggttaatgtgacgaaattgtatccgaagtcagattgcagttcatttgatgcttttggtagggtttatagtggtaaaattatgacagggcagtctgtaaaagttttgggagaaggctattcaccagaggatgaggaggacatgacagtaaaagaagtgacaaaactatgggtatatcaagctcggtataggttacccataagtatggcacctcctggttcctgggttctcattgaaggtgtggatgcttcaattatgaaaactgcaactctctgtaatgtgaattataatgaagaagatgtatacatatttcgacctcttcagttcaatactcttccagtagtgaaaactgctactgagcctctaaatccaagcgagttgcccaaaatggtggagggtcttaggaagatcagtaaaagctatcctctggccataactaaagttgaggagtctggggagcacactatacttggtaccggagagttgtacttagattctattatgaaggaccttagggagctatattctgaagtggaagtcaaggtagccgatcctgttgtctcattctgtgaaactgtggtggagtcctcgtcaatgaaatgctttgctgaaacacccaacaagaagaataaaataaccatgatcgctgagccattggagaaagggcttgcagaagacattgaaaatggtgttgtaagcattgactggaatcggaaagctctaggtgacttcttcaagacaaaatatgattgggatttgcttgcagcacgatccatatgggcttttggccctgataagcagggacctaacattttgctagatgacacacttccaactgaagtggacaagggattactaggtgccgtgaaggattctattgttcaagggtttcagtggggtgcacgagaaggaccactttgtgatgaaccaatcagaaatgttaagttcaagatagttgatgctaggattgcgcctgaaccacttcatcgtggatctggtcaaataattccaacagctcggcgtgtggcctactcagcttttcttatggcaaccccaaggctcatggaacccgtatattatgtggagatacaaacaccaattgactgtctcactgcaatctatacggtgttatctcgcagacgtgggcatgttacagcagatgttcctcagcctgggactccagcttatattgttaaggcatttttacctgtcatagaatcatttggttttgagacggacttgaggtaccatacccaaggtcaagcatttagcctctcggtgtttgatcattgggctatagtccctggagatccccttgataagagcattgttctgaggccacttgagcctgcaccaatccagcaccttgcccgtgaatttatggtgaagacaaggcgtcgcaagggaatgagtgaagatgtgagcattaacaagttcttcgatgaggctatggtggttgagctggctcagcaagcagctgatattcatcaacaaatgatgtgatacttccaatgttggtgcttatgtagccatgggccataggaagcacttcttgcaggcagtttttatctgtctttacatgtgttgaaacctggatagcagatagtagtgcagactgatatccctagcagttggggctgaacaccgctaacaaaaagaaaggatgtccaacgagtaaattcaaaattttgaatgtttgatgtaatattgtataatatttactgctagtggcatgaaaaactctccttttgagcccagggaggtggtaatgcaagcaaggttggattatttgttcgaagatctcatgattggtttgctcaccttatttgggtttgccttactggcatgcctccccaccgcaatacgggcat

SEQ ID NO: 4890 - DNA, 3756 bp, Prunus mume
aaaaatgtaaaactaaccctaaacatcttgcgccgtctccatcctctcttattttcttctttccttctatcgctctccgtcaagtatcttgagagatttcattctctacttgttttccatctcccattttctcaattacagtctgtagagtttctgttgggattttgccctagaaccctagaaccctagaactcagttatcttcgttccaacttcaattctattgctttatccttctattctctgattttagtggctgtattggtgctgagtgaactaatcacttgtataaaatagcagattagataatatggatgacagtctgtacgacgagttcgggaactatatagggcctgaaattgagtctgaccaagaaagtgatagagaggatgaagatggagagcttccagataggcaagacgatggggctgcgtcagatggcgatgatgcagcagcggcttccaatgggtggctagctgcaacctccaatgatgttgatatggacaatcaggttgttcttgctgaggacaaaaagtattatcctactgcggaagaggtttatggggaagatgttgagactttggtcatggacgaagatgcacaacccctagaacagcccattatcaagcctgttaggaatgtcaagtttgaggttggcgtcaaggattcttccacctacgtgtctaaccaattccttttgggtctcatgtcaaacccttctcttgttcggaatgttgctcttgtggggcacttgcagcacggaaagacgatattcatggatatgttggtggagcagacacaccatatgtccactttcgattcaaatagtgataagcacatgaggtacacggatacaaggattgatgagcaagagagaaggatatctattaaagcagttcctatgtcccttgtacttgaggatagcaagtctaaatcgtacttgtgcaacatcatggatacacctggtcatgtcaatttctctgatgaaatgactgctgccctcaggcttgctgatggtgctgtcttaattgtggatgccgctgaaggaatgatggtaaatactgagagggctatacgtcatgcaatccaagatcgcctaccaattgtggttgtaatcaacaaggttgacaggttgataacagaacttaaattgcccccaagggatgcttacttcaagctaaggcatactttggaagtcattaataaccacataactgctgcctcttcaactgctggcaatgtgcaaattattgatcctttggcaggaaatgtttgctttgcaagtgctaccgcaggatggtcattcacgttgcaatcatttgcaaagctatatattaaacttcatggtgtcgaccttgatgcagataagcttgcttctcgtctctggggagatatgtactatcataggggtgacaggactttcaggagaaaaccccctgttgatggaggagaaagatcatttgtcgagtttgtgcttgaacccctgtataaaatttatagccaggtaattggagaacataaaaagagtgtggaggcaactcttgcagaatttggtgtcacccttagcaatgcagcttataaattgaatgttagacctctgctgaggttggcttgtagctcagttttcggatctgcctcaggcttcactgatatgctggttcaacatattccttcccctaaagatgccgcaactaggaaagttgaccacatatatacgggaccaaaagactctttgatttacaaggccatgaaaaattgtgaacctgatggtcctttaatggtcaatgtaaccaaattgtatcccaagtccgactgtagtgtgtttgatgcatttggtagagtttatagtggcaagattcagacagggcagactgtacgcgtattgggagaaggctattcaccagaggatgaggaagacatgacagtcaaagaggtgacaaaattatggctttatcaagctcgagataggatacccatagctgaggctcctcctggtacttgggttcttattgaaggtgtagatgcttctattatgaaaactgccaccctctgtaatgagtattatgatgaggatgcttacatattccgtcctcttcagttcaatacgttgccagttgtgaagacggcaactgagcctctaaatccaagtgagttgccaaaaatggtggagggtcttagaaagatcagcaagagttatccacttgcaatcactaaagttgaggagtctggggagcacacaatcttaggtacaggagaactgtatttggattcaataatgaaggaccttagagagctctattctgaagtagaagttaaggttgcggatcctgttgtttcgttttgtgaaacagtggtggagtcctcatcaatgaaatgttttgctgaaacacccaacaagaagaataaaataactatgattgcagagccgttggaaagaggacttgcggaggacattgagaatggtgttgtaagcattgattggtctcggaaggatataggcaatttcttccagactagatatgagtgggatgttcttgctgcacggtccatatgggcatttggccctgataagcagggacctaacattctattagacgatacactttcaactgaagttgacaaaagcttgctgaatgctgtgaaggattcaattgttcaagggtttcagtggggtgctcgagaaggacccctttgtgatgaacccatcagaaatgtgaagttcaaaatagtggatgcaaggattgcacaagagccattgcatcgtggatctggtcagatcattcccacatctcgtcgtgtggcctattcatcattcttaatggcaaccccgcggcttatggagccagtatattatgtggagatacaaacaccaatcgactgtatttctgctatctacactgttctatctcgcaggcgtggacatgttacggctgatgttcctcaacctgggacccctgcttatattgttaaggcatttttaccagttattgaatctttcgggtttgaaacggacttgaggtaccacacccaagggcaggcattttgcctatcagtctttgatcactgggctatagttccgggggatcctcttgacaagagtatcgttctgcgacccctggaacctgccccaattcaacacctagcccgcgaattcatggtgaaaaccagacgcaggaagggaatgagtgaggatgtgagcatcaacaaatttttcgatgaggccatgatggtggaactggctcagcaagcagcggatcttcatcagcaaatgatatgatggcggcggcttcatagtatccaaagtttagggaggagattgtaggcaaatttagtatgtgatgaaaaccggtagaagtattgtgatgttgagcttagaattggaatccacgtgacaaaaacgaaatggaaataggtggatgctagagtaatatttttctgttgtaactttcgggtgtcctactgtgactgttgtatccaaataatttttggtatccttcttataattccatacagaaaccaaaaaaccagtaacaatacagtgagattgttcttctctgtaatccaagaggtttcgatcatgctgcttgctaattatttttttcactttagaattcaattgagaaatgtttggttaatttcaatgtgccatgttgacatcacagatggatgctcctgcttgatcttgcatttctttctgcctattcgattggaatgtacttttcagggcatgtcggtgatcagattgatttgaggttgt

SEQ ID NO: 4891 - DNA, 3392 bp, Malus domestica
acaaggctttagactttgttatctctcgacctagccccaaaaaaggcctaaataaaaaagagcccaaaataatgaagcccaaatcatatcatcgcaaaatagggcccaatccagttaaaagactaaagcaccactacaaaacacagaagtgaaagaaaagagacgaagaagttccgctattcgcacaccgcccagaaacccctctataaacccctctctctctctctctcaactccgaacagtgcttccgactctgggctctgcccttgaagctttagagatttggtaggatggatgacagtctgtacgatgagtttgggaattacataggcccggaaatcgagtctgatcaagagagtgatagagaggacgaggatgaggagctgcccgataggcaagaggatagggatgcatcggacggcgatgatgcagctgctggtcccaatgggtggctgactgcgtccaatgatgtcgatatggataaccaggttgtccttgctgaggataaaaagtattatccaaccgcggaagaggtctatggtgaagatgttgagacattggttatggatgaagatgcacagcctctggaacaacccattattaagcctgttaggaatgtcaagtttgaggttggtgtcaaggattcttccacctacgtgtcgaaccagttccttttgggactcatgtcgaacccctctctggttaggaatgtagcacttgtggggcacttgcagcacgggaagacagtgttcatggatatgttggtggagcagactcaccatatgtctacttttgattcaaatagcgataagcacatgaggtacacggatacaaggattgatgagcaagagaggaggatatccattaagacagttcctatgtcccttgtactcgaggatagcaagtgtaaatcgtatttgtgcaacatcatggatacgcctggtcatgtcaatttctctgatgaaatgactgcagcccttaggcttgccgatggtgctgtcttgattgtggacgctgcagaaggaatgatggtaaataccgagagggctatacgccatgcaatccaagagcggctaccaattgtggttgtaatcaacaaggttgacagattgataacagaactcaaattgcccccaagagatgcttacttcaagataaggcatactttggacgtcattaatacccacataactgcggcctcttcaactgctggcaatgtacaaattattgaccctgttgcaggaaatgtttgctttgcaagtgctaccgcaggatggtcattcacgttgcaatcgtttgcaaagctatatcttaaactccatggggctgataatacggacgtagataagtttgcctctcgtctctggggagatatgtactatcatccggatgacaggagttttaggagaaaaccccctgccagtggaggcgaaaggtcatttgtccagtttgtgctcgaacccctgtataaaatttatagccaggtgattggggaacataaaaagagtgtggaggcaactcttgctgaatttggtgtcaccctcagcaatgcagcttacaagttgaatgttagacctctgctgaggttggcttgtagctcagttttcggatatgcctcaggctttactgatatgctggttcaacatattccttctcctaaaggtgccgcaacgaggaaagtagaccatatatatactggaccaaaagactctttgatttacaaggccatgaaagattgtgatcctgatggtcctttgatggtcaatgtgacaaaattgtatcccaagtccgactgtagtgtgtttgatgcatttggtagggtttatagtggcaagattcagacagggcagactgtgcgggtattgggagaaggctattcaccagaggatgaggaggacatgacagtcaaagaggtgactaagttatggctttatcaagctcgagacaggataccaatagccgaggctcctcctggtacttgggttcttattgaaggtgtggatgcttctataatgaaaactgccaccatatgtaatgaatattacgacgaggatgtgtacatcttccgtcctcttcagttcaatactctgccagttgtgaaaacagcaactgagccactaaatccaagtgagctgccaaagatggtggagggactaagaaagataagcaagagttatcctcttgcaatcactaaagttgaggagtctggggagcacacaatattaggtacaggagaactctacttggattcaataatgaaggatcttagagagttatattcggaagtagaagtcaaggttgcggatcctgttgtttcattttgtgaaacagtggtggagtcttcgtcaatgaaatgttttgctgaaacacccaataagaagaataaaataactatgattgcagagccattggagagaggacttgctgaggacattgagaatggtgttgtaagcattgattggtctcggaaggatataggcaattttttccagactagatatgagtgggatgttcttgctgcacgttccatatgggcatttggccctgataagcagggacctaacattctattagatgacacactttccactgaagtcgacaaaagcttgctgaatgctgtgaaggattcaattgttcaagggtttcagtggggtgctcgagaaggacccctttgtgatgaaccaatcagaaatgtcaagttcaaaattgtggatgcaaggattgcccaagagccattgcatcgtggatctggccagatcattcccacatctcgacgtgtggcctattcatctttcctgatggcaacaccgcggcttatggagccagtatattatgtggagatacaaacacccatcgactgtatttctgcaatctacactgttctatctcgcaggcgtggacatgttactgctgatgttcctcaaccccgggacccctgcttatatcgtcaaggcgttcttaccagtgatcgaatcatttggctttgaaactgatttgaggtaccatacccaaggacaggctttctgcctctcagtgttcgatcactgggctatagtccctggggatccacttgataagagcatcgttctgcgaccccttgaacctgccccaattcagcatctggcccgtgagtttatggtcaagacaagacgtagaaagggaatgagcgaggatgtgagcatcaacaaattcttcgacgaggctatgatggtggagctggctcagcaggcagctgatcttcatctgcaaatgatatgatcgtggcgggggcttcacaacacggtgtccgcttgtccaaagttgaggaacgaaattgtacgcgattttatttggatgaaaaccagtagaagtagttgttgaacacgcaagttacaattttgaatgcaatagta

SEQ ID NO: 4892 - DNA, 3433 bp, Ambrosia trifida
agtatcgatttgtcactaaattaaaccgcctaaaatcacaggcacaaatctgatacccctcacaccatcccacacacaaaaccttaaaccctccgaaacaacccttctttccgtcaccaccgtcactgcgtcaacgattcaggatggatgacagtttatatgatgagtttggtaactatatcggtccggaaatcgagtcggatcaggagagtgatagagaggaggaagacgaggatcttccggaaaaggttgaagcggaaagaggtgattctgatgaggagaatgcagcggcggggccgaacgggtggttaacgaatggagaagatgtggatatggataaccagattgttcttgcggaggataagaagtattatcctactgcggaagaggtttacggtgaggaggtggagacgctggttatggatgaagatgagcagccgcttgagctgccgattattaagcctgttagggatattaagtttgaagttggggttaaggattcgtcgacttatgtttcgacgcagtttcttttggggctttcttcaaacccgactttggttaggaatgtggctttggttgggcatcttcagcatgggaagacggtgtttatggatatgttggtggagcagactcatcatatttctacttttgatcagaatagtgagaagcatatgagatatacggacacaagggttgatgagcaggagcgtaggatttcaattaaagcggtgcctatgtctcttgtgttggaggacagtaattcgaagtcgtatatgtgtaatattatggatacaccgggacatgttaatttttcggatgaaatgacggctgctcttaggcttgctgatggtgctgtattgattgttgatgctgctgaaggagtcatggtgaacaccgaaagagcaattcggcatgcaatccaggagcgcctacctatagtagttgtgataaacaaggttgaccgattaataactgagcttaagctacctccaaaagatgcctatcataagttgagacatacaattgaagtcatcaataaccacatcactgcagtctcttcaacagctggcgatgtccaaatcattgatcctgctgctggaaacctttgttttgctagtggtagtgcaggatggtgcttcactctgcaatcgtttgccaaattatatgttaagcttcatggaattccttttgatgccaacaagtttgcatctcgactttggggagattactattatgaccctgctactagaactttcaaaaagaaacaacctgcaagtggggcagaaaggtcattcgtacagttcatccttgaacccctttacaagatctacagccaagttattggagaacataaaaagagtgtggagacaacactggcggaactcggtgttactttaagcaatgccgcctataagttgaatgtgagacctttgcttagattagcttgcaggtcggttttcgggtcagccaccgggttcactgacatgcttgttcaccatatcccgtctgcgaaagaggctgcatctaaaaaagttgaccatatttacaccgggcctaaaagttcaagcatctacactgccatgtcaacttgtgacccgtccgggcctcttatggttaatattaccaaactgtatccaaaatcagactgcagtgtttttgatgcctttgggagggtttatagcggtgaaatccatacgggtcagactgttcgtgttcttggagagggttattcacctgatgatgaagaagatatgactgtaaaagaagtaacaaaactatgggtttatcaagcccgttacaggatacctattaataaagcaccacctggctcttgggttcttattgaaggtgttgatgcttccattatgaaaactgctacactttgtgattcagaatatgatgatgatgtgtacatattcaggcctcttcagtttaacactcttcctgtggtaaaaacagcaactgaaccattaaatcctagcgagttaccgaaaatggttgagggtcttaggaagattagcaaaagttatcctttagcaatcactaaagttgaagagtctggagaacatactattttgggtactggtgaattgtatcttgattctataatgaaggatctcagggaactatattcagaagtcgaggttaaggtggcagacccagttgtttcattttgtgaaacggtggttgagtcttcatcaatgaaatgctttgctgaaacacctaacaagaagaataaaattaccatgattgctgaaccattggagagaggacttgcagaagatattgagaatggtgttgtaagtgtggactggcccagaaagaaactaggggacttctttcaaaaaagatatgattgggatctgcttgctgcaagatctatatgggcatttggaccagacaagcagggacctaacatattgttggatgacactctctcaagtgaagtcgacaaaagtttgttgaattcagtgaaggattcaattgttcaagggttccagtggggtgcacgtgagggtccgctttgtgacgagcccatccgtaacgtcaagttcaaaatagttgatgcgaaaattgcaccagagccactacatcgcggaaccggtcaaatcattccaacagctcgacgtgtggcctactcagcttttcttatggcaacaccacgtcttatggagccagtatattatgtggagatacaaacacccatcgattgtgtttctgctatatacacggtgttatctcgaagacgtgggcatataactgctgatgttcctcaacccggaacacccgcctacatagtcaaggcatttgttcctgtaatcgagtcgtttggttttgagacggacttacggtatcacacccaagggcaggcgtttgcggtctcaacttttgatcattgggctattgtacctggtgacccattggataaaagcattgtattacgcccacttgagcccgcgccaattcagtatcttgcacgtgaatttatggtgaaaacaaggcgtaggaagggaatgagtgaggatgtgaccatcaacaagttctttgatgaggctatggtggtggagcttgcccagcaggaagctgatctacaccaacagatgatttagccaccatgatgaatgacttgtagcagttacattgagttttggtaatttgtttttagctttaataccaaaagaatttagacttgtatttttaagcactttctgctacgtcgaagaaaatgataaacaaggttgcttcaaagattttaatttatcttttgaatttagtaccacctggccgtacatagcacgattatgtaatcgatcacttctctctttgtaactcctcatgtatttttttcaagcaccacgataaataaattatgtaacaactgccatacctaccacgccacttgaaacccctaggcattgccttgtcaaatccg

SEQ ID NO: 4893 - DNA, 3297 bp, Echinacea purpurea
cggccgggggagagtaaaagggcttgcaggctacacgaatctgaaaccttccacacaaaccttaaacccttcttctctgaaaccctaacgttccgtcatcaacctccattttttccggcgaagcttcaggatggatgacagtttatatgatgagtttggaaactacattggaccggaaatcgagtctgatcaggaaagtgacagagaggaggaagatgaggaacttccggagaagattgaagaaagtgttgattttgatgatgagaatgcagctgcggggccgaacgggtggttaactaatggtgaggatgttgatatggagaaccagattgttcttgcggaggataagaagtattatcctacggcagaagaggtttacggtgaggaggtggaaactctggtaatggatgaagatgaacagccgcttgagctaccaataattaagcctgttagggatattaagtttgaagtcggtgttaaggattcgtccacttatgtttcgactcagtttcttttgggtctttcttcaaatcctactttggttaggaatgttgctttggttgggcacttgcagcatgggaagacggtttttatggatatgttggttgagcaaactcatcatatttcgacttttgatcagaacagtgagaagcatatgaggtacactgatactagagtagatgagcaggagagaagaatatcgattaaagcggttcctatgtcgcttgttcttgaggatagcaattcgaagtcgtatatgtgtaatatcatggatacgccagggcatgttaatttctctgatgaaatgacggctgctctcaggcttgctgatggtgctgtattggttgttgatgccgctgaaggggtcatggtgaacactgaaagagcaattcggcatgcaatccaggagcgtctacctatagtcgttgtgataaacaaggttgacagattgattaccgagctcaaactacctccaaaagatgcgtatcataagctgagacatacaattgaagtcatcaataatcacatcactgcagtctcttcaactgctggcaatgtccaaatcattgatccagctgctggaaacctttgttttgctagtggtagtgccggatggtgcttcactttgcaatcatttgccaaattatatgttaagcttcatggaattccttttgatgccaacaagtttgcaactcggctttggggagattactattatgaccctgctactagaaccttcaaaaagaaacaacctgccagtggggcagaaaggtcatttgtacagttcatcctcgaacccctttacaagatttacagccaagttattggagaacataaaaagagcgtggagacaacactggcagaacttggggttactttaagcaatgctgcatacaagttgaatgtgagacctttgcttagattagcatgccgctcggtttttgggtcagccaccgggttcaccgacatgctggttcaccacatcccatctgcgaaagaggctgcatctaaaaaagttgagcatatatacactgggccaagaaattcaacaatctacactgccatgtcagattgtgacccgtctgggccacttatggtcaatattaccaaactgtatccaaagtcagattgttctgtttttgatgcatttggaagggtttatagtggagaaatccatacgggccagactgttcgtgttcttggagaaggttattctcctgatgacgaagaagatatgactgtaaaagaagtaacaaaactttgggtctatcaagcccgttacaggatacctatcaataaggcgccacctggctcttgggttcttattgaaggtgttgatgcttccattatgaaaaccgctacactttgtgattcagaatatgatgatgatgtgtacatattcaggcctcttcagtttaacactcttcccgtggtaaaaacagcaaccgaaccgttaaatcctagcgaattaccaaaaatggttgagggtcttaggaagattagcaaaagttatcctttagcaattactaaagttgaagagtccggagaacatactattttaggtactggagagttgtatcttgattctataatgaaggatctcagggaactatattcagaagtcgaagtcaaggtggcggaccctgttgtctcattttgtgaaacggtggtggagtcttcatcaatgaaatgctttgccgaaacgcctaacaagaaaaataaaattaccatgattgctgaaccattggagagaggacttgcagaggatatcgagaatggtgttgtaagtgtggactggcccaaaaagaagctaggggacttttttcaaaaaagatatgaatgggatctgcttgctgcaagatctatatgggcatttggaccagacaagcagggacctaacatattgttggatgacactctctcaagcgaagttgacaaaagtctgttgaattctgtgaaggattcaattgttcaagggttccagtggggtgcacgtgagggtccactttgtgacgagccgattcgcaacgtcaagttcaaaatagttgacgcgaaaattgcaccagagccactacatcgcggaacaggtcaaatcattccaacagctcgacgtgtcgcctactcagcttttcttatggcaaccccacgccttatggagccagtatattatgtggagatacagacacctatcgattgtgtttcggctatatacaccgtgttatctcgaagacgtgggcatataactgctgatgttcctcaaccaggaacccctgcttacatagtcaaggcgtttgttcctgtaatcgagtcgtttggttttgagacagacttacggtatcatacccaggggcaggcattcgcggtgtcaacttttgatcactgggccattgttcctggtgacccattggataaaagcattgtattacggccacttgagcccgcaccaattcagtatcttgcacgtgaattcatggtgaaaacgaggcgtaggaagggaatgtgcgaggatgtgagcataaacaagttcttcgatgaggctatgatggtggagcttgcccagcaggaagccgatctacaccagcagatgatgtaagccaccatgccgaacgacttgtagcagttacatttcagttttggtaatttgtttctttagctttttgataccaaaagaatttagacttgtatttttaagcactttctttgctacgacgacgaaaattgtactgttaaacaagcttgaaagatgtttattcaaataaagtaccaaccgccatacgtagaacggttatatgtagc

SEQ ID NO: 4894 - DNA, 3284 bp, Euphorbia peplus
ctactcttcttaaattcgacttcttcccttctctaagaggtctgagacaacatggatgataatctctatgatgagtttggaaactacataggtcctgaaatcgagtctgaccaagagagtgatagggacgaagaagatgaagaacttccagacaggacgcaacaagatgacgatgcatccgacggtgatgagggaattaatgcttccaacgggtggcttactacatcgaatgatgttgatatggataatcagattgtccttgctgaggacaagaaatattatccaactgcagaagaggtttatggtgaagatgtggaaacattagttatggatgaagatgaacagcctcttgagcagcctataattaaacctgttaggaacatcaagtttgaggttggggttaaggattcctcaacctatgtatccacacagtttcttgttggtctaatgtcaaatccctctttggttcgcaacgttgctcttgtaggccatcttcaacatgggaagacattattcatggatatgttggttgagcaaacgcatcatatgcccacatttgattcgaatagtgagaagcacgtgcgatacactgacactaggatcgatgagcaagagaggaggatatctattaaggcagttcctatgtcacttgttcttgaagatagcaactcgaagtcttacttatgtaacatcatggacacccctggtcatgtcaatttctcggatgaaatgactgctgctctccgaatatctgatggtgctgttttgatagtagatgctgcagaaggagtaatggttaacactgagagggccatacgccatgcaatccaggagcgactccctattgtagttgtgatcaataaggttgacaggctcataacagaacttaagttgcctccaaaggatgcttatcataagctcagacatactctggaagtcctcaatcaccacattactgctgcctcttcaactgctggaaatgtgcaaactattgacccagttgctggaaatgtttgttttgccagtggtacagcaggatggtcctttactttgcaatcctttgctaagctatatctcaaactccatggcatcccatttgatgctgacaagtttgcctctcgtttgtggggagatatgtattatcatccagatacgagggctttcaagaagaagccccctggaagtggaggggagagatcattcgtccaatttgtgctggagcccctctacaaaatatacagtcaagtgattggggagcataagaagagtgtggaggccactcttgctgaacttggtgtcactctcccaaatgtggcttataaattaaatgttaagcctttgctaaggttagcatgcagtagagtttttggttcagcttcaggcttcacggatatgctggttcagcatattccttctgctaagagtgctcaagctaagaaggctgatcatatatatacaggacccaaagattctataatatacaatgccatggtagattgcgatccttctggccccttaatggtaaatgtgaccaaactatatcctaagcccgattgcagctcgtttgatgcttttggtagggtctatagtggtcaaattatgacagggcaatctgtaagagtactgggagaaggctattcaccagatgatgaggaagacatgactgtaaaagaagtgacaaaactatgggtctatcaagctcggtatagattacctataagcatggctcctcctggctcttgggttctgattgaaggtgtggatgcttcaattatgaaaactgcaactctttgtaacgagaaatatgatcaagaagatgtatacatattcaggcctctccagtttaatactcttccagtggtgaaaactgctactgagcctctaaatccaagtgaactgccaaaaatggtggagggtcttaggaaaatcagtaaaagctatcctctagctattaccaaagttgaggagtcgggagagcatactattctgggtactggagagttatatttggattctataatgaaagatcttagagagttgtattctgaagtggaagtcaaggttgcagatcctgtagtctccttttgtgaaacagtggtggaatcctcgtcgatgaaatgttttgcagaaacgcccaacaagaaaaataaaataacaatgattgctgaaccattagagaaagggcttgctgaggacattgaaaatggtgtggtgagcatagattggaatagaaaaacacttggtgacttcttcaaaaccaagtatgactgggacttgctggctgcaagatctatatgggcatttggtcctgataagcagggacctaacatcttgctagatgacacccttcctactgaagttgataaaggactactaggtgccgtcaaagattctattgtccaagggttccagtggggtgcacgagaaggacccctttgtgatgaaccaatcagaaatgtgaagttcaaaatagtggatgctagaatcgcaccagaacctctgcatagaggttctggtcagattatccccactgctagacgtgtagcatattcagcctttctaatggcaacccctcgacttatggaaccagtttattatgtggagattcaaacaccaatagattgcctttctgcaatatatactgtgttatctcgtagacgtggacatgttacagcagatgttcctcaacccgggactccggcttacattgtgaaggcatttctaccagtgatagagtcatttgggtttgagacagacttgaggtaccatacccagggacaagcattttgcctctctgtgtttgatcattgggccatagtccctggagatcctcttgacaagagcatagttttgaggccacttgagcctgcaccaatccagcaccttgctcgtgagtttatggtgaaaactaggcgtcgcaagggtatgagcgaagatgtgagcataaacaaattctttgatgaagctatggtgatggagctagctcatcaggcagctgatatccatctgcaaatgatttaagttggtgtaatacaaggatgtcacaacaaaagatataactaggtttaatttgatcagaccagacttaatgctcggaagtctaatgtccttcaactatacaagacttaatgctcggaagtctaatgtccttcaactatacaagaaggtgcgaagagttggattttgtttttgtagttatgtaatagtgatagtctgaattataggaaaattcacatatttagatggttcatcgtttggcataatttttttacgaggtttagttc

SEQ ID NO: 4895 - DNA, 3669 bp, Pinus taeda
gacgttttgaaatttgatctcccaggtcctaggcacggtaattctataccggtccaactgtcagtggaatacaacacaggggtaccggaacatatgtagcagagatcctttgaaacagcggtaccgactaattgcgtccgctgttgtgttgccgaagatggacgatagtctgtatgacgaattcgggaactatattggtccagagatcgattccgacgaggagtcggagcaggatgaagaacaggacgatgttcgcatgcacgaccgcgacgaagaagacgcaaatgaggatggagacgccgcctggctcgctcgaacccacggccccctcgaccaccacaatcaacaaggccccgacgacgatgacgacgtcgacatggaaggccaagtggttcttgcagaggacaagaaatactatccaactgcagaggaagtctatggagagggcgtcgaaactctggtcatggaggaggacgcccagcctctggagcaacccatcgtcaagcccgtcagaaacattaaattcgaggtgggtgtcaaggactccaccacatatgtttccactgatttcttgctgggcttgatgtcaaaccctacgctggtcagaaatgtggcacttgtcgggcaccttcagcacggaaaaaccctgtttatggacatgctgattgagcaaacccatcatatcgcgacatttgatgttaacagcgagaagcacatgcggtataccgacaccagggttgatgagcaggagaggcagatttccatcaaggcagtgcccatgtctctcgtattggaggacggcaatgccaagtcttatctctgtaatattatggataccccaggccatgttaacttttccgacgagatgactgcagctctcagacttgcagacggggccgtcttggtcgttgacgctgccgacggcgtgatggtaaatacagagagggctattcgtcatgctatccaggaaaggcttccaatagttgttgttatcaacaaggtggacaggctgataacggagctaaaattgccaccgacagatgcttatcacaaattgaagcatacaatagaagaagtcaataacttgattactgcattttcaactggagcaggggggtctcagttggttgatccagctattgggaatgtctgttttgcaagtgcgtctgcagggtggtcttttactttacaatcatttgccaagatttatgtgaaactccatggaattccatttgattcagctcgttttgcatcccgcctttggggggacatgtattttcaaccagatactaggacttttaaaaagaggcctccgccaactggaggtgagaggtcatttgtgcagtttgttcttgaacctttatataaaatttacagccaagtcattggtgaacacaggaagagtgtcgaaactaccctagcagagttaggagtgacacttagcaatgctgcatataaacttaatgtaaggtccttgctgaggttatcttgcagctctatctttgggtctgcaactggcttcacggacatgctggtgcaacatattccctctgcaaaggatgctgcagctaagaaaatagagcatatatacacaggtccccaagacacaccgcttgtccaagctatgaaagattgtgctcctgaaggcccacttatggtgaatgtaactaaattatatccaaaatctgattgcagtgtttttgattcatttggtagagtctatagtggcacaatccaaacaggccaaactgttcgggtacttggagaaggatattctcctgatgatgaggaggacatggcagtcaaggaagtaactaaactgtgggtctaccaagctcgatatcgaattcctataagcaaagcacctgctggatcttgggttctaatagagggtgtagatgcttcaattatgaagacagcaacactgtgtccggagtatcttgatgaagatgtatttattttccgtcctttacgctttaacacactatcagttgtcaaaacagcaactgaacctttgaacccaagtgaattgccaaagatggtggaaggtcttcgtaaaattagtaagagttatccattggccattacaaaggttgaggagtcgggggaacacaccattctggggactggggagatctatttggactctattatgaaggaccttagagagctctattcagaagtagaagtgaaggtggcagatccagtagtttccttttgtgaaacagtagtggagtcatcctcgatgaaatgttttgctgaaactccaaataagaaaaataagattactatgcttgcagaaccactagagaagggtttggcagaggatatagagaatggtgtggtgagcatagattggccacgtaagaagttgggtgacttttttcagactagatatgattgggatttacttgcagctcgatcaatatgggcatttggaccagataagcagggtccaaacatacttctagatgatacacttcctagtgaagttgacaaaaacttgctgaattccgtaaaggattccattgtgcaaggatttcaatggggtgctcgagagggacctctttgtgatgaacctattcgcaatgtgaagttcaaaattctggatgcaacaatagcaccagagcccttgcaccgtggtggtggtcagataatacctactgcgagacgagttgcttattcagcttttctaatggcaaacccacatttaatggagccggtgtattatgtagagatccaaactcctgctgactgtatttctgcaatatatacagtgctgtctcgtagaagaggtcatgtcacagctgatatagcaaagcctgggacaccagcttatattgttaaggcttttttaccagtcattgaatcctttggttttgagacagaccttaggtaccatacacaggggcaagcattttgcctatctgtgtttgaccattggtctatagtgccaggagatccactggacaagtctgttgttttgcgaccattagagcctgcacctgttcagcatcttgcacgtgagttcatggtgaaaaccaggcgcagaaagggtatgagtgaggatgtgagtataaacaaatttttcgatgatcctatgttacttgagatggcaaggcaagacgccgatttccagcagatcttgtaggttgaactatatacctactctgctgcagaacttgggcagagtctctgtattggtaaacacatccactgtagatcatccataatactgataaactgctgctttgatcatctgtgatgaagagtgcgtgccataaaggatataatcattatgtgaaataagggtgaagtgcaatagagccaactgccctttgctgcttgatggtcctggtgaaattctcgacatgttcttgcacctaaagaatgaaatgaaaatatttttattaatcacaactagatttggcatttactgaaatgtgctaatggtttgccaattctgagagaataagaataaatgattagtttgaaatctgttttcacatgatgttaatgctttcattttatagtacttctactggaaaggaaccggaataagaggttgccatatggctttttaagttctccttcggtagagatgtaagaacctgtcaagattcataagattataatggtacaattgagaataagagagtttagacttta

SEQ ID NO: 4896 - DNA, 3523 bp, Daucus carota
acagtgttcaaaccccaaattcagcgtcgcttctgcagcttctcgacactccagatttacgaatacgatggatgatagtttatatgatgagtttggtaactacattgggcctgagattgagtctgaccaggagagtgatagagaggatgaagacgaggaacttcccgacaagactgatgaggagaatggtgatgcttctgatgaggagaatgcaggtcgtgccaatgggtggatgactaccacggatgatattgatattgacaatcagattgtgcttgcggaggacaagaagtattatccgaccgcggaggaggtttatggagaggaggttgagactttggttatggatgaagatgcacagcctcttgagcaaccaattattaaacctgtcaggaatgttaagtttgagctgggagttaaagattcttctacgtatgtatcaactgactttcttttgggtctttcgtcaaacccgtctctggttcggaatgttgcattggtgggacacttgcaacatgggaagactgttttcatggatatgttgattgagcaaacacaccatatatcaacatttgatcagaacagtgagaagcacatgagatatactgatacaaggatagacgagcaagagagaaggatatcaataaaggcagtgcccatgtctcttgttctggaggatagcaattcaaagtcctatctgtgcaacataatggacacgcctggtcatgtcaatttctcagacgagatgactgctgcccttagacttgctgatggtgcagttttggttgtggatgctgctgaaggagtaatggttaacactgagagagctattcgtcatgcaattcaagagcgtcttcctatagttgttgtgataaacaaggttgacaggttgataactgaactcaaattgcctccaaaagatgcttatcacaagcttcggcacaccattgaagtcatcaataactttataactgctgtttctgcaacagctggagatgttcaaattattgacccagtcgctggaaatgtttgttttgcaagtggaagtgcaggctggtgttttactttgcactcgtttgcgaaattatatgttaaacttcatggcattccatttgatgcttcaaagttcgcctcacgtctttggggagactattacttcgatcctgatactagaggtttcaagagaaaacaaccttcgggtggggtggaaaggtcatttgtccagtttgtgctggaacctctttacaaaatttacagccaagtagttggtgaacataaaaagagcgtggagacaactctagcagaacttggtgtaacccttagcaatgcagcgtacaaattaaatgttaagccattgctgagattggcatgtagctcagtgtttggttctgcaacaggtttcacagatatgcttgttcatcacattccatcggccaaagattctgcaccaaggaaggttgaacatacatataccggccctaatgactctgctatatacagagccatggtagactctgatccttctggccccttaatggttcatgtgaccaaattgtaccccaagtctgactgtagtgtttttgatgcatttggtcgggtttacagtggtgagctgcatacagggcagactgtccgtgttctgggagaaggatattcaccagatgatgaggaggatatgactgtaaaggaagttacgaaattatgggtttatcaagctcgatatagaatacctgttggtaaagctcctcctggttcgtgggttttgattgaaggcgtggatgcctcaattatgaagactgcaactctttgcagttcaaattatgatgaagatgtatacatattccggtctcttcagtttaacacacttcctgttgtgaaaacagcaaccgagcctctaaatccaagtgagctgccaaaaatggtggagggtcttaggaagattagcaagagttacccacttgcgattactaaagttgaggagtctggagagcacaccattttgggtaccggagagttgtacctagattctattatgaaggatctgagggagctttactctgaagtggaagtgaaggtggcagatcctgttgtctcattctgtgaaactgtagtggagtcttcatcaatgaaatgttttgctgaaactcccaacaagaaaaataagataacaatgattgcagagccattagagagaggtcttgctgaagacattgagaatggtgttgtcagcattgactggccgagaaagaaactgggtgatttctttaaatcaaaatatgactgggatttgcttgctgcacggtctatttgggcatttggtcctgataaacagggacctaacattctattggatgacacactttcgggtgaagtggacaaactcacattgaatgctgtgaaagattccattgttcaaggatttcaatggggtgcccgcgaaggacccttgtgtgatgagcccatcagaaatgttaaattcaaaattgttgatgcaaggattgcacctgaaccattgcatcgtggaactggtcagatcattccaactgctagacgagtggcttattcagcttttcttatggctactccacgacttatggagcctgtatattatgtggagatacaaacaccaatagattgtgtgtctgccatatacacggtgttgtcacgaaggaggggtcatgtgactgctgatgttcctcaaccagggacacctgcatatattgtcaaggcgttcctgcctgttatcgagtcgtttggatttgaaacagatctgaggtatcacactcaagggcaggcattttgtgtttctgtatttgatcattgggctatagttccgggggaccctctagacaaaaacattgtcttaagacctctggagcctgctcccatccagcacttggctcgggagtttatggtcaagaccagacgtagaaagggaatgagtgaggatgtcagcatcagcaagttttttgacgaagccatggttgtggagcttgctcagcaggatgccgatctccatctgcaaatgatctaagtctgggtattctcaccagtatgtaaaagaactgtttgtataatctgaaccgagcatttatcactttggaacccagttacatcttttgtattctgcttatcattgttaagatctggaaccatgaaaactgatttttccggttcattaaatggtactaccacactgctagaagaatgactactgaaggagaacatctctaaattgcttatgagttgatgatcctccctgcaataatatatcaacactctactcaaagacacatcaagttggcatagcaggcatttcagaatctaaattttattggaatggacaaaattagtaagtagtgaatttatattttttccatgtatttcagcatgtactactatatatatttacggggctgtgtttgcagtgttacacaaatcttggtcatctattaattgtgcttcgagtcggggcaattggcaggcaaacaagttatatcttttcattgtccagttgttatac

SEQ ID NO: 4897 - DNA, 3337 bp, Gossypium raimondii
acattacaattactacacaaaatcgtggttccctccctcgcccgcctttcgccttcattgagttgaagtatcgagaatatatcactactttggattttaagcaatggatgataacttgtatgatgaatttggtaactatattggacctgatatcgagtcagaccaagggagtgaaggtgaggaagaagaagatgaagaccttcctgacaggcatgtccaagaggagggacagcaatctgatggggaggctccagatggggtgtctaatggatggattacagctgctaatgatgttgatatggataatcagattgttcttgctgaggacaagaagtattacccaactgcggaagaggtttatggtgaggatgttgagaccttggttatggatgaagatgagcagcctcttgagcaacctattatcaagcctgttaagaatatcaagtttgaggtcggagttaaggattcttcgacttatgtgtcgacccagtttcttattggtttgatgtcaaacccgggtttgatccgcaatgttgccctcgttggacacttgcaacatgggaagacggtgtttatggacatgttggttgagcaaacccaccatatgaacacgtttgatcgaaatagtgagaagcacatgagatacactgatacaagaattgatgagcaagaaagaaggatatctattaaggcagtcccgatgtcacttgttcttgaggacagtaatgggaaatcctatctctgtaatatcatggacactcctggtcatgtgaatttttctgatgaaatgactgctgctcttaggcttgctgacggtgccgtgttgattgttgatgcagctgaaggagtgatggtaaatactgagagggctatacgccatgcaatacaggaacgcatacctattgtagttgttataaacaaggttgaccggctgataacagaacttaagttgccccccaaggatgcttatcataaactaaggcataccctggaagtaattaataaccatatatctgcagcctctacaaccgctggtaatgttccagttattgatcctgctgctggaaatgtttgttttgctagtgcaagtgcaggatggtccttcactttgcagtcatttgcaaaattatatgtaaaactacatggaattccatttgatgctgagaagtttgcatctcgtctttggggtgatatttattatcatcctgataccagggcttttaaaaggaaaccccctgctggcggaggagaacgatcatttgttgaatttgtgcttgaacccctttataagatatatagccaggtgattggtgaacataggaagagtgtagagtcgactctcgcagagttgggtgtcactcttagcaatgctgcttacaagttaaatgttaggcctttgctaaggctggcttgcagcacagtttttggttcagcctcaggcttcactgatttgctggttcaacacataccatctccaaaggatgctgcagctaagaaggttgatcacacttacacaggacctaaacattctatgatttacaaggccatggtagaatgtgatccatctggtccccttatggtcaatgtgaccaaactatatcccaagtccgattgtagtgttttcgatgcttttggtagggtttacagtggtagaattcaaactgggcagtctttgagagtactgggagaaggctattcaccagatgacgaggaggacatgacattaaaagaagtaaccaaattatggatctaccaagctcgatacagaatacctataagcagtgctcctcctggttcttgggttcttattgaaggtgttgatgcttcaattatgaaaactgccaccctctgtaatatggatcttgatgaagatgtatacattttccggccgttacagtttaatacccttcctgttgtaaaaactgctactgagcctttaaatcctagtgagttgcccaaaatggtggaggggcttcggaagatcagcaaaagctatcctctagcaattactaaagttgaggaatctggtgagcacactatattaggtactggagagttgtacttggactcaattatgaaggaccttagggagctttattcagaggtggaagttaaggtggcagatcctgttgtttcattctgtgaaacagtggtggagtcttcatccatgaaatgctttgctgaaacacccaacaagaagaataaaataaccatgattgcagagccattggagagaggtcttgcagaggacattgagaatggtgttgtaagtgttgactggagtcggaagcaacttggtgacttcttcaagacaaaatatgactgggatttgcttgctgcacgttccatctgggcatttggccctgataagcagggacctaatattttattagatgatacactccctactgaggttgacaagggattgttgggatctgtcagggattctattgtccaaggatttcagtggggtgctcgagaaggacctctctgtgatgaacctattagaaatgtgaagttcaaaatagttgatgcaaggattgcatctgaaccattgcatcgaggatctggacagatcatccccacagctcgacgtgtggcctattcagctttccttatggcgaccccacggcttatggaacctgtatattatgtggagatacaaacaccaattgactgtgtctctgctatctacacggtgttgtctcgtaggcgtggtcatgttacagctgatgtgccacagccaggaaccccggcctatattgtgaaggcatttttacctgtgatagagtcattcggatttgagacagacctgaggtaccacacacaaggtcaagccttttgtctctcagtattcgaccactgggccatagttcctggagaccctttggacaagagcattgttttgcgacctcttgaacccgcaccaatacagcaccttgctcgggagttcatggtaaagacaaggcgtagaaagggaatgagtgaagatgtgagcatcaacaagttcttcgacgaggctatggtggtggagctagctcagcaggctgccgatcttcatcagcagatgatataaaccaaaacacggtatatacaagtttgtcatgtttcgaggacttcaacgtacttactgccatccttcctcaccgctttcactgggctcaaacttggacaaggtaacagtgttgatgttaatttccagtgaccatagagttaagaatttggtttaggattgtatttgttccatttttgttcatgtcataggtgttgttgtaagttgtgaagagactgagctgagttattaatatatttgaagttaaatcaaaataatcattca

SEQ ID NO: 4898 - DNA, 2998 bp, Lotus japonicus
atctcactgcatcttccaaaatggacgatagcttgtacgacgagttcggcaactacatcggacccgaaatcgagtccgaccaagactccgacagagaaccttccgacgacgaacagccttccgacgccgacaccgcccaaccttccgacggcgaggctcccgccaccaatggctggatcaccgcatccggcgaccccaacgacgtcgacatggtcgacaaccaggtggtcctggcggaggacaagaagtactaccccaccgccgaagaagtcttcggcgaagatgtggaaaccctagtcatggatgaagatgaacagccactggagcaacccattatcaagcctgtgaggaagatgaagttcgaggttggcgtgaaggattcgtcaacctacgtttcgtcacaatttcttctgggtctcatgtcgaacccttcgttggctaggaatgtggctcttgtggggcacttgcagcatgggaagacggtgttcatggatatgctggtggagcagactcaccatatgtccacgtttgattcacagagtgagaagcatttgcggtatactgatacgaggattgatgaacaggagaggaggatttcgatcaaggctgtgcccatgacgatggtgctggaggatagtaactccaagtcgtatttgtgtaatattatggatactcctggccatgttaacttctccgatgaaatgaccgccgctttgaggctcgctgatggtgctgttttggtcgttgatgctgctgagggagtgatggtaaacactgagagagcaattcgccatgcgattcaggagcgactgcccattgttgttgtactcaataaggttgacaggatcataactgaacttaaactacccccaaaagatgcttatcataaaataaggcatactttggaagtcattaacactcacatatctgctgcctcctcgactgcgggtgatgtccaagttatagatccagttgctgggaatgtttgttttgcaagtggcactgctgggtggtcttttacattgcaatcatttgctaaattgtatgggaagctacatggagttcctttggagcctaataaatttgcttctcgcctttggggagactactattttcatcctgataccagaaccttcaaaaagaaaccccctgtcagtggaggagaacgatcttttgttgagtttgtactggagccgctttacaagatatatagccaagtaattggggagcataagaaaagtgtggagacaactctagcagaacttggagttactctaagtaatgcagcttatagattaaatgttagaccattgctaaggctggcttgtagctctgtttttggtcaagcttcaggtttcactgatatgcttgttcagcatataccttccccgagagatgccgcagtaaagaaagttgatcatatatataccggaccgaaagactcatccatctacaaagccatgacacagtgtgattcttcagggcccctaatggttaatgtgaccaagctgtatccaaagtctgattgtagtgtctttgatgcttttggtcgagtttatagtggcaagatacagactggacagacagtacgtgttctgggagaaggatactcaccggatgatgaggaggacatgactgtaaaagaagtaactaagttgtgggtatatcaagcccgtgataggatgccaatatcggaggctcctccaggttcttgggttcttattgaaggtgtggatgcttcaatcatgaaaaccgccactctatgtaatgtcgattatgatgaggatgtatacatattccgccctctcctgttcaatactctgtcagtggtgaaaacagcgactgagccattaaatccaagcgagttgcctaaaatggtggagggcctgaggaaaattagcaagagttatcctttagcggttactaaagttgaggagtctggggagcacactatactagggactggcgagctgtacttggattcaattatgaaggacctaagagagctctattctgaagtcgaagtcaaggtagcagatcctgtagtttcgttttgtgaaactgttgttgaatcttcatcaatgaaatgttttgctgaaacaccaaacaagaagaataaaataacaatgattgctgagccactagaaagaggtcttgctgaagacatagagaatggtgttgttagcactgactggaatagaaagaaactgggtgaatttttccagactaaatatgactgggatcttcttgctgcgcgatcaatctgggcatttggccctgataagcagggccccaatattctgttggacgacacccttccaactgaagttgacaagaacctgctaaatgctgttaaggactccattgttcagggatttcaatggggtgcacgagaaggacctctttgcgatgagcccatcagaaatgttaagtttaagattgttgatgcaaggattgccccagagccacttaatcggggatctggccaaatcattccaactgctcgacgagtggcttattcatctttccttatggctacccctaggttaatggaaccagtatattatgtagagattcaaactccaatagattgtgtatctgcgatctacactgtattgtctcgtaggcgtggacatgttactgctgatgttcctcaaccaggcacccctgcttatttagttaaggcatttttacccgtgatagaatcttttggttttgagactgacttgagataccatacacaaggtcaagcattttgcgtctcagtttttgatcattgggctattgttcctggtgatcctttggacaaaggcattgttttgcgtccccttgaaccggcaccaatccagcatcttgcccgtgagtttatggtaaagacaaggcgtagaaagggaatgagtgaggatgtgagcataagtaagttctttgatgaggctatgatggtggaactggcacagcaagaggcagatcttcatcaacagatgatgtgatcttcact

SEQ ID NO: 4899 - DNA, 3279 bp, Prunus persica
acaatatggatgacagtctgtacgacgagttcgggaactatatagggcctgaaattgagtctgaccaagaaagtgatagagaggatgaagatggagagcttccagataggcaagacgatggggctgcgtctgatggtgatgatgcagcagcggcttccaatgggtggctagctgctacctccaatgatgttgatatggacaatcaggttgttcttgctgaggacaaaaagtattatcctaccgcggaagaggtttttggggaagatgttgagactttggtcatggacgaagatgcacaacccctagaacagcccattatcaagcctgttaggaatgtcaagtttgaggttggcgtcaaggattcttccacctacgtgtctaaccaattccttttgggtctcatgtcaaacccttctcttgttcggaatgttgctcttgtggggcacttgcagcacggaaagacgatattcatggatatgttggtggagcagacacaccatatgtccactttcgatgcaaatagtgataagcacatgaggtacacggatacaaggattgatgagcaagagagaaggatatctattaaagcagttcctatgtcccttgtacttgaggatagcaagtctaaatcgtacctgtgcaacattatggatacacctggtcatgtcaatttctctgatgaaatgactgctgccctcaggcttgctgatggtgctgtcttaattgtggacgccgctgaaggaatgatggtaaataccgagagggctatacgccatgcaatccaagatcgcctaccaattgtggttgtaatcaacaaggttgacaggttgataacagaacttaagttgcccccaagggatgcttacttcaagctaaggcatactttggaagtcattaataaccacataactgctgcctcttcaactgctggcaatgtgcaaattattgatcctttggcagggaatgtttgctttgcaagtgctaccgcaggatggtcattcacgttgcaatcatttgcaaagctatatattaaacttcatggtgtcaaccttgatgcagataagcttgcttctcgtctctggggagatatgtactatcataggggtgacaggactttcaggagaaaaccccctgttgatggaggagaaagatcatttgtcgagtttgtgcttgaacccctgtataaaatttatagccaggtaattggagaacataaaaagagcgtggaggcaactcttgcagaatttggtgtcacccttagcaatgcagcttataaattgaatgttagacctctgctgaggttggcttgtagctcagttttcggatctgcctcaggcttcactgatatgctggttcaacatattccttcccctaaagatgccgcaactaggaaagttgaccacatatatactggaccaaaagactctttgatttacaaggccatgaaaaattgtgaacctgatggtcctttaatggtcaatgtaaccaaattgtatcccaagtccgactgtagtgtgtttgatgcatttggtagagtttatagtggcaagattcagacagggcagactgtacgtgtattgggagaaggctattcaccagaggatgaggaagacatgacagtcaaagaggtgacaaaattatggctttatcaagctcgagataggatacccatagccgaggctcctcctggtacttgggttcttattgaaggtgtagatgcttctattatgaaaactgccaccctttgtgatgagtattatgatgaggatgcttacatattccgtcctcttcagttcaatacgctgccagttgtgaagacggcaactgagcctctaaatccaagtgagttgccaaaaatggtggagggtcttagaaagatcagcaagagttatccacttgcaatcactaaagttgaggagtctggggagcacacaatcttaggtacaggagaactgtatttggattcaataatgaaggaccttagagagctctattctgaagtagaagttaaggttgcagatcctgttgtttcattttgtgaaacagtggtggagtcctcatcaatgaaatgttttgctgaaacacccaacaagaagaataaaataactatgattgcagagccattggagagaggacttgcggaggacattgagaatggtgttgtaagcattgattggtctcggaaggatataggcaatttcttccagactagatatgagtgggatgttctcgctgcacggtccatatgggcatttggccctgataagcagggacctaacattctgttagacgatacactttcaactgaagttgacaaaagcttgctgaatgcagtgaaggattcaattgttcaagggtttcagtggggtgctcgagaaggacccctttgtgatgaacccatcagaaatgtgaagttcaaaatagtggatgcaaggattgcacaagagccattgcatcgtggatctggtcagatcattcccacatctcgtcgtgtggcctattcatcattcttaatggcaaccccacggcttatggagccagtatattatgtggagatacaaacaccaatcgactgtatttctgcaatctacactgttctatctcgcaggcgtggacatgttacggctgatgttcctcaacctgggacccctgcttatattgttaaggcatttttaccagttatcgaatctttcgggtttgaaacagacttgaggtaccacacccaaggacaggctttttgcctatcagtctttgatcattgggctatagttccgggggatcctcttgacaagagtatcgttctgcgacccctggaacctgccccaattcaacacctagcccgtgagttcatggtgaaaaccaggcgcagaaagggaatgagtgaggatgtgagcatcaacaaatttttcgacgaggccatgatggtggaactggctcagcaagcagcggatcttcatcagcaaatgatatgatggcggcggcttcatagtatccaaagtttagggaggagattgtaggaaaatttagtatgtgatgaaaaccagtagaagtattgtgatgttgttgagcttagaattgaaattcacgtgacaaaaacgaaatggaaatgggtggacgctagagtaaattttttatgttgtaactttcgggtgtcctataaccgtgactgttgtatccaaataatttttggtatccttgttataattccgtacaaaaaccaaaaaaccagtaacattgcagtgagattgttcttctctgtaatccaagaggttttgatca

SEQ ID NO: 4900 - DNA, 3646 bp, Solanum lycopersicum
aaagaagctttgttccccaaacactgcaagcagtaagcttagagctccttgaaaactcgaaccaccgttgcgccgccgccctcctccgtcgctgttcccggcagttgttcgagttaacggtagtaaatagccatggatgatagtttatatgatgagtttgggaactatattggtcctgaaatagagtctgatcaggaaagtgatagggaagaggaagacgatgagctgcctgataggagtgatgatgagagagctgtatctgatgatgagcagcctggtgcgtcaaatggatggcttgccactcaagatgatattgacatggataaccaagttgttcttgctgaagacaagaaatactacccaacagctgaagaggtttatggtgaagaggttgaaacgttggtcatggatgaagatgaacagccacttgaaatgccaataattaaaccagtgaagaatctcaagtttgaacttggggtgaaggattcgtccacttatgtatcgactcagtttctcttaggtctgatgtcgaacccagcattggttagaaatgttgctctagtgggacacatacatcacgggaagactttgtttatggatatgctggtggaacaaacacaccatatatctacgtttgatcagaatagtgagaagcatatgaggtatacagacacaagaatagatgagcaagagaggaggatatcaattaagtctgtccctatgtcactagtcttggaagacagcaattcaaagtcttacctgtgtaacattatggatgctcctggccatgtcaacttctccgatgaaatgactgctgctttaagacttgctgatggggcagttttgattgttgatgcagttgaaggagtgatggtaaatacagaaagggccattaggcatgcgattctagaacgtattcccattgttcttgtaatcaacaaggttgatagattgataactgagcttaagttgcccccgaaggacgcctacttcaaactaaagcacatagttgaaactgtcaacagtcaaattacagctgcctcgtccacagctggaaatgcacaagtaattgatcctgcattagggaatgtctgctttgcaagtgcaacagcaggatggtcattcactctgcagtcatttgccaaactctatgttaagcttcacggaattgcatttgatgcaaacaagtttgcttcgcggctttggggggacttctactttgatcctgatacaagaagtttcaagaagaaaccgcctgcaagtggggttgaaagatcttttgttcagtttgttcttgaacctctttacaaaatttatagccaagtgattggagagcacaagaagagtgttgaagcaaccctagctgaactaggggtgacattaagcaatgcagcttatcgtctaaatgtaaggcctctgctgaggctggcctgcagtgctgtatttggaactgccactgggtttactgacatgttggttcatcacattccttctgctaaagctgctgcagctaggaaagtggaacacatatacacgggtccaaaggattcagcaatttacaaagcaatggaaaattgtgattctgctggcccgttgatggttaatgtgacgaagctgtatcccaaaccagattgtagtgtttttgatgcttttggtagggtttacagcggggaaataatgacagggcagactgtacgtgttcttggtgagggctattcacctgacgatgaagaggatatgactgtaaaagaagttacaaagctgtgggtatatcaagctagatacaggatccccataagtaaggctcctccaggtgcatgggttctgattgaaggagtggatgcttcaatcatgaaaactgctactctttgtaatctggaatttgatgaggatgtatacatatttcgccctcttcagtttaatactcttcctgtggtgaaaacagctactgaacctttgaatcctagtgaattacccaaaatggtggaggggcttaggaaaatcagcaagagttatcctcttgcaatcacaaaggttgaagagtccggtgaacacacgatattaggtactggtgaattgtacctagattctataatgaaggaccttagggagctttactccgaggtggaagtgaaggtggctgatccagttgtctcattctgtgaaactgtggtggagtcgtcttcaatgaaatgttttgctgaaacacctaacaagaaaaataaaatcactatgattgctgaacctctggagagagggcttgctgaggacatcgagaacggtgttgtgagcatcgattggcctagaaagaaactaggtgaatttttccaaaccaaatatgactgggatcttcttgctgcacggtctatttgggcatttggacccgataagcagggacctaatatcttattggatgatacactctcaagtgaagtggacaagagcttgttgaatgctgttaaagattctattgttcaggggttccaatggggagctcgggaaggacccctctgcgatgagcccattagaaatgttaaattcaagatcgttgatgcgaagattgcaccggaaccgttgcatcgtggaacgggtcagattattccaactgcacgacgtgtagcctactctgctttccttatggcaacacccagacttatggaacctgtgtattatgtggagatccaaacgcccatggattgtctctctgctatatacaccgtgttgtctcgtaggcgtggacacgttactgctgatgttcctcaacctggcacccctgcctacattgtcaaggcatttttacccgttatcgagtcctttggttttgaaacggacttgaggtatcacacccaagggcaggcgttttgtctttcagtatttgatcattgggctattgtccccggggatcctcttgacaagagcatcgttctacgaccactagagcctgctccaatccaacatctggctcgtgagttcatggtgaagacaaggcgtagaaagggaatgagtgaagatgtgagcatcaacaagttctttgatgaagctatgatggtggagcttgcgcagcaggatgctgatcttcatctgcagatgatgtagatatgtagttgtgatggttctgtatttgtgctttaggtgcattcctttgtatgtcgagttgcaaacagcctttcgaaaggtattagatcactgagctccctgaaccacaatatttcaacgtaaattagcccaggtttctgaatgctcaagtgtagtgaatgactggttagcagttcaaatttttactctatccttttttcgcatcttctttgtgtaaactacagattgagctcttgtccacgctaccagaacttccttttcttatatatctattttagtggaattgaaggcgcgcactgagcatcaatgttaaagtcatcttcctttgacgtgtaggtcatagttcgagctgtagaaccagttattgatgcttgcaagttagacaaccttttttttaaggggaattttgtaatatttgaacacgattgtggatgagagtgtcataccattgatttatttttggtttaaatgaacattgaaatatgtattctatagtaggtattcaactccaatagagaattgaatggaatgaaaggtaaaatagtcattt

SEQ ID NO: 4901 - DNA, 3473 bp, Citrullus lanatus
tttgcagctttgagaatactaagcatggatgatagcttgtatgatgaatttggaaactacatagggccagaaattgactctgataaggatagtgacatcgaagatgaagatgaagacctcatggagaagcctgacgaagatgaaggtgtatcagatggtgaagatgcaggtggtgcttcaaatggttggattacgacgtccaacgatgttgatatggacaaccagattgtccttgcagaggacaaaaaatattatccaactgcagaagaggtttatggtgaggatgttgaaacattggttatggatgaagatgagctaccgctagagcaaccaattattaagcctgttagaaatataaagtttgaggttggggtgaaagattctaggacttatgtttcaaatcaatttctggtgggtctcatgtccaatccaactttggtccgcaatgttgcacttgtaggccacttgcatcatggaaagacagtctttatggatatgttggttgagcaaacacatcacatgacaacatttgatattaaaggagagaaacatctgaggtacacagatacaaggattgacgagcaggagagaggaatatcaattaaggcagttcctatgtcactagtcctcgaggatggcaattcgaaatcatacctttgcaatataatggacacccctggccataccaatttttctgatgaaatgactgctgctcttagacttgctgatggtgcagtgttgatcgtagatgctgctgaaggagttatggtcaacacagagagggctatacgccatgcaattcaggagcgattgcccattgttgttgtaattaacaaggttgacaggctgattacagaacttaaattgcccccaagggatgcatactataaattaaggcatacattagaaattattaataaccacatatctgctgcctcatctactgctggaaatgtccaagtcattgacccagccgctggaaatgtgtgttttgctagtgctactgcaggatggtcgtttactttgcaatcgtttgcaaagttatatgtcaaacttcatggaatcgcttttgatgctgataagtttgcatctcgtctttggggagattattattatcattctgataccagaggatttaagaaaaaacaacctgcaagtggaggggaaaggtcatttgttcaatttgtacttgagccactctacaaaatatatagtcaagtcattggcgaacataggaaaagtgttgagactactcttgcagagtttggtgttactcttagcaatgcagcttacaagttgaacgttaggcctttgctgagactggcttgtagttcagtttttggtggagcttcaggatttactgacatgcttgttcaacatataccttctcccagggatttttcttctcagaaggtggatcatatttatactgggccaaaagactctgtgatttacaaagcaatgaaagaatgtgctccttctgggcctttaatggttaatgtcaccaaactataccccaagtcagactgcagtgtatttgatgcgtttggtagggtttatagtggtaagattcaaacagggcagactgtacgggtattgggtgagggctattcaccagaggatgaggaagatatgacaataaaggaagtaacgaaattatggctttatcaagctcgagacagggttcccattgccgaggctcctcctggatcttgggttctcattgaaggagtggatgcatctattatgaaaactgcaactctgtctaatgtagactatgatgaggatgtttacatattccgaccacttcaattcaatacccttcctgtggtgaaaacagccactgagcctctaaatccaagtgagttgccaaagatggtagagggtcttcgaaagatcagcaaaagttatcctctggcaatcactaaggttgaggaatcaggcgagcataccattctaggcacgggagagctgtacttggattcaattatgaaggatcttagagagctctactcagaagtagaagtcaaggtggccgatcctgttgtttcattttgtgaaacagttgtagagtcttcttcgatgaaatgttttgctgagactcccaacaagaagaacaaaataaccatgattgcagagccattggagagaggacttgcagaagacattgagaatggtgtagtaagccttgattggtcaagaaagaaactcggggatttcttccagacaaaatatgagtgggatttgctggctgcaaggtccatatgggcatttggcccagataagcagggacctaacattctattagatgatacactctcttctgaagtagacaagaatttgctgaatgccgtcaaggattccattgttcaagggtttcaatggggagctagagaaggaccactttgcgatgaacccattagaaatgtcaaattcaaaattgttgatgccaaaattgcacctgagccattacatcgtgggtctggccagatcattcccacagctcgacgagtggcctattcgtcatttcttatggcaaccccacgacttatggaacctgtatactacgtcgagatacaaacacccattgattgtgtctctgcaatctatactgtcctatcccgaaggcgtggacatgttacagctgatgttgctcaaccagggactccagcttacattgtcaaggcatttttacccgttatagaatcttttggctttgagacggacttgcggtatcatacgcaaggccaagctttttgtctctctgtgtttgaccattgggccattgttcctggcgatcctcttgataagagcattgttttacggcctcttgagccagcaccaatacaacaccttgcacgtgaattcatggtgaagacaaggcgtagaaagggaatgagcgaggatgtgagcataaacaagttctttgacgaggcaatgatggtcgagctggctcagcaagcagctgatcttcatcaacaaatgatataattgaagctcatccaagcaaggcttggcctgatttgttggtgaatccaagtgttgtaccatagttgtttctcttcagttcccccaacatcctgccttgagtcaacaaaccatcattcttatatattaggagagaggcaggcagcctgagatttgtcaatcttatctttagagaattttccttgtctgctaagtttgagggatattgaagctgaatacatattttaggaatttttactgtgatgtttagagtatgtatttaaccttgtaatgtgaaacaaggaaggcagatttggttgcatttacatgtttagagtgaaaatgaaagaattagaaccaatctccttgagattagctaatgatatattcgtgtcttgtaggtatgtattagaagaccaaattagaaatctgatatttgatttggagggacgacatttctcttgaaatcttgattcttaatagtggttttatttgggttttctttt

SEQ ID NO: 4902 - DNA, 3638 bp, Zea mays
cttcgctatacatgtcctaacggagacactaataacgttcaacaaatccggaaaaccgatgtgttcctagtttgcgataagcaaatttcgagagtaatacccggggcgacgcatggccggcccggcagtctcctatgcctcgcacgcaaggacggacgggcacgcgagaaggggatgggccgcgaccagtgaccgtgagcccattgaaacgtcacagccccggctctctgtccccgcttcgcatttcctttccacccaaagtctccctcacctgccagtctgccactcgctcgctctcttccacaacccgcttcccccaaaaaccagatctaccacctgctcggccttagggcgcttcttgggccgagccctagcagtccggaattccgatctcggccaccacctcctcttctctcctctcctctcctgaaagcagtaagctcctccgttgccatactcgtccgcccggtctccctcccctcccctgctccagctcgtctggtggcgttatgatttcctcgcgctcgcgagttcatcctagatctgcatggtctgggctagattccgccggatctgtggcggccgtttaaatctgtgggcttttattttgctgcgtttaagcgcgattttgaaaggttttcgcccgtcccgatttgggcctagtgggccatgctgggatttcttccgatttcctgaaattttaccggtcggtgtgcggtctacaagtccaggccatagaggagctcccgtggctgctgttcaatagtaggatttcgaatttggggcgcgaggttctgttccgcgggccagatgagatctgtagtctcctccatgcgccatggcaggaatttggggaaaactctgcggcgagcggacttttgattctcagtcagctgtgtcgactgggaaacgctcagatctcaaaagttcagcgggtagcctatcaagatggccgaggaaactgccaatgacgctcaggtggcacaagataacgagattgctctcagcaatgaggcaatccaaggtgatgagttggtccatgttgaagagctgtcccaaggtgatgatttggttcaaggaaatgagctagttgtttctgaggtgacaactcctactattggaaccagacgcaggagaaagaagtctttggtatgggagcacttcactattgaagccgtcgcaggtggggccactagggcatgctgcaagctctgcaagcaaacctttgcttacagctctggttcaaagattgctgggactagccatctcaagaggcacatcaccttgggctcttgtcctaagataaagaatcaagagcagaggctggcgctgccttcaactggagggactgacaatgatggcgagggaactatagagcggcgaaccaagagacgctacagatacactggttatgcaaatgctgcttttgatcaggaccgcagttgctcatacttggcaaagttgatcattcagcatgactacccacttcacattgttcaacagccgtcatttgccatttttattgaaagtctgcagccacgtttcaagattgtggatgttgaaacgatggaaggagaggtatatgctgtttatcagaaagaaaaggagaacctgcttcaagcattcaacagtatgcctggaaggatcagcctcactataggattgtggacaactagtcagactcttgggtacgtttcacttgcagggcagtttattgactctgagtggaaagtgcaccgaagaatgcttaacttcatgatggtgtcatctcctcattcagagaatgcacttagtgaggcaattagcatgagcctttctgactggaatatgaaggacaggctattcaccatcacattggataatgaatgctcctcacatgatatctacagtgcaaatctgagggaccatctctccaacaagaacaatctcatgcttaagggacagctctttgttgtgaggtgctatgcccatatccttaatgctgttgccctagatgtcattgcttcaattcatggtgttgtatacagcattcgtgaaagcataaagttcataaaagcttcttctgcccgcgaagagaagtttgctgagattgctctgcagctggagattcccagtaccaagaccctctgtctggatgttacaacccagtggaacaccacctatctgatgctgctggctgctttggattataagcagactttcactacactagaaacatgtgatgataactacaatgaagctccatcagcagaggattggaagaaagttgaggctgcctgtaattacctgaaactgctatacgattctgcacatagtatcatggcggcagcaaacccaactgcaaacatctttttccatgaagcctggaaacttcagctagagctggcaaatggcacaggccacgaagatcccactttcagtagcatcgccaaggatatgcatgagaggttcgacaagtactggaaagattgcagcctcgtgttagccattgctgttgtcatggatccacgtttcaagatgaagctcgttgagttcagttactcgaaaatctatggggctggggctgcaaagtatgttaaggtggtcgatgatgctgtacatgagctgtataaggagtatgtggctcagccactcccactgaccccagcctatgttgaccaaggcgaagggaataatggaccagccaatgcgaatagcagtcaaggggctcctgcttccactggtgatgggcttctagacttcgatatgtacctttctgagatccaaagtagccagccctcgaaatctgagctggagcagtacctagatgaatccctcactccacgtatccaggagtttgatatcctgaactggtggaagctaaacacggtcaagtttccaaccctctctaaaatggcccgtgatatcttggccattccagtgtccatggtaagcagtggcagctctatattctgtgctggaacaggaagtcacatgctcgatgactacagaagctctctgcggcctgagattgtggaagcacttgtttgcgcgaaagactggctccagtattcaccacctgccaccgaggcaccgagttctgcactggtgaaggctcaaggatcgtaggtttgtcgtggtcactgcctgccttgtggaagcaaagcaagaatccatttacccatctgtcgtatctctgagtgtagttaactgtaggtgtattgtaggctgagattgtgaaccgattttgatatattctggtatctatcacgtaaaggtgtaacatgtgttgaactctgctgaactcgtggctgttctgatgtcgtctgactttgcagtttgcacacttccctatgtgcttgtacaagccgtgggatgtatcttgtttttgtattaaatttgttttataccgtggattgatgtctcagtctatatataagcaggaacatcagtcgtccacaacataaaattttaaaattgtaaaaaaaattcaggtctatcgcttcgtccggccgaagcccaacccaagactcgatctgatccagcgccgtgctgcggccgtcatccaatccccacgaagccccacaccccgatccacattttgcgtgaacaaaccacagacaaggaaactcctcacgagacgaggaaaccgctcaaag

SEQ ID NO: 4903 - DNA, 3059 bp, Setaria italica
cgcagccaccagacctcctctctctttcaccgtcgcagcctctcaccccccactccctctctctctctcttcccgtctcctccagagcgagatctaggttcttcgtccttcttgggccgagccctaatcctgctgcaccgccagccagtccgccaagccgttggtgggtcgcctcgcctccgctgcgcctgctcctcctcctccttcctcctcctccacgccttcttgggttccatcgacaacaaacaagatctagcacactgctcggcctagctcgtacggattctggatcttggccaccacctcccgcactcctatttcacaagttcagctgctagcctataagcatggttgaggaaactgccaatgacactcaggtggcccaagataatgagattgcccccaatgatgaggcaattcaaggtgatgaaatggtgcaaggtgatgagttgacccaaggtgatgagttggcccaaggtgaagaattcgttcaaggtgatgagttggcccaaggtgatgatttggtgcaaggaaatgagctggttgttgctgaggaaacgacccctcggaccggaaccagacggaggagaaagaagtccttggtatgggagcacttcactattgaagaagtcgctggaggggccacacgggcatgctgcaatctctgcaagcaaacctttgcttacagctctggctcaaagattgctgggactagccatctcaagaggcacatcaccctgggttcttgtcctaagataaagagtcaagagcagaggctggcactgccctctacaggtggtactgacaatgatggtgagggaagtgtggagcggcgaaccaagagacgctacagatatactggttatgctaatgctgcttttgatcaagaccgcagttgctcatacctggcaaagatgatcattcagcatgactacccgcttcatattgttcaacagccgacattcgccacttttattgagagtctgcagccacgtttcaagattgtggatgttgatacaatggagggagaggtgtatgctgtttatcagaaagaaaaagataacctactgcaaacattcaacaccatgcccggaaggatcagcctcaccataggattgtggacaacgagtcagactcttggctatgtttcacttgctgggcagtttatcgactctgagtggaaagtacaccgaagaatgcttagcttcatgatggtgtcttctccccattcggagaatgcacttagtgaagcaattagcatgagcctttctgactggaacatgaaggacagactattcaccatcacattggataatgaatgctcctcacatgacatctacagtgcaaatctgagggatcatctctctaacaagaacaacctcatgcttaagggacagttgtttgttgtgaggtgctatgcccatatccttaatgctgttgcacaagatgtgattgcttcgattcacggtgttgtctacagtatccgtgaaagcataaagttcataaaagcttcttctgcccgtgaagagaggtttgctgagattgctctgcagctggagattcccagtaccaagaccctctgtctggatgttacaacgcagtggaacaccacttatctgatgttgctggctgccttagattataagcaggctttcactacactagagacatgtgatgataattacaatgaagctccttcagcagaggactggaagaaagttgaggctgcctgtacttacctgaaactgctatatgactctgcgcatagcatcatggcagcagcaaacccaacttcaaaccttttcttccatgaagcttggaaacttcagctagaactagcaaatggcacaggacatgaagatcccatttttagtagcatcgcgaaggatatgcatgagaggtttgacaagtactggaaagattgcagcctcgtgctagccattgctgttgtcatggatccacgtttcaagatgaagctggttgagttcagttactcaaaaatttatggggctgaggctgcaaagtatgttaaggtggtcaatgatgctgtgcatgaactgtacaaggagtatgtggctcagccactcccactgaccccagcctatgttgagcaaggtgaagcgaataatgggccagccaatgcgaataacagtcaaggagctccttccactggtgatgggcttctagactttgatatgtacctttctgagatccagagtagccagccctcgaaatccgaactggaacagtacctggatgaatccctcactccacgtatccaggagtttgatattctgaactggtggaagcttaacactgtcaagtttccaaccctctctaaaatggcccgtgatatcttggccattccaatgtccatggtaagcagtggcagctccatattcactgctggaacaggaagccgcatgctcgatgattacagaagctctcttcgtcccgagattgtggaggcacttgtctgtgcgaaagattggctccagtactcaccagctaccactgaggcaccaagttctgcactggtcaaggctgaagggtcttagattcacgttggctactgcgtccttgtcgaaccatgaatctatctgtttatcgtatctatgagtgtaggtaactgtagaggcatattgtaggctgagattgtgaactgattgttattctggtatttatctcgtagaggtgtaacttgtttgtgtcgaactctgttaactcgtccttgtcatgttataggttttgttgtaccatgttctggtgcaggatgtatcagctggttgtctgtactttataccctggttttgtattcaatttgttatgtactgtggatggatatggcatgtttgtgtatagctgtgtagaatgtctcattgtagtatatgtgtcatcagccagttgtactgaatcagtgctgtgtttgtgtttgaaatggttatcgtggcgtgatggcaccatgtgttcaactgttttgtgtatttatctgtttaactgttttgcgtagatacaatatgcctcttcatgtgtgatggcactcatagatacaatatgcc

SEQ ID NO: 4904 - DNA, 3213 bp, Setaria italica
tttgcatccaggtggaggtggtctgtggatcctgtcgtgtaaatttattgttggttactggcttactgctgctgtaaacgaccagaacctatcatttataaaattgtgcaaaatatctgctgtcttttctagtttgttatgacaactttggtgatttacccgacagattagttttgtttaattttatctatgaaactatcaagtgatctgatgtgattaaaatatacctcacatgattttatttattctgttcattttcacaggccttcttgggttccatcgacaacaaacaagatctagcacactgctcggcctagctcgtacggattctggatcttggccaccacctcccgcactcctatttcacaagttcagctgctagcctataagcatggttgaggaaactgccaatgacactcaggtggcccaagataatgagattgcccccaatgatgaggcaattcaaggtgatgaaatggtgcaaggtgatgagttgacccaaggtgatgagttggcccaaggtgaagaattcgttcaaggtgatgagttggcccaaggtgatgatttggtgcaaggaaatgagctggttgttgctgaggaaacgacccctcggaccggaaccagacggaggagaaagaagtccttggtatgggagcacttcactattgaagaagtcgctggaggggccacacgggcatgctgcaatctctgcaagcaaacctttgcttacagctctggctcaaagattgctgggactagccatctcaagaggcacatcaccctgggttcttgtcctaagataaagagtcaagagcagaggctggcactgccctctacaggtggtactgacaatgatggtgagggaagtgtggagcggcgaaccaagagacgctacagatatactggttatgctaatgctgcttttgatcaagaccgcagttgctcatacctggcaaagatgatcattcagcatgactacccgcttcatattgttcaacagccgacattcgccacttttattgagagtctgcagccacgtttcaagattgtggatgttgatacaatggagggagaggtgtatgctgtttatcagaaagaaaaagataacctactgcaaacattcaacaccatgcccggaaggatcagcctcaccataggattgtggacaacgagtcagactcttggctatgtttcacttgctgggcagtttatcgactctgagtggaaagtacaccgaagaatgcttagcttcatgatggtgtcttctccccattcggagaatgcacttagtgaagcaattagcatgagcctttctgactggaacatgaaggacagactattcaccatcacattggataatgaatgctcctcacatgacatctacagtgcaaatctgagggatcatctctctaacaagaacaacctcatgcttaagggacagttgtttgttgtgaggtgctatgcccatatccttaatgctgttgcacaagatgtgattgcttcgattcacggtgttgtctacagtatccgtgaaagcataaagttcataaaagcttcttctgcccgtgaagagaggtttgctgagattgctctgcagctggagattcccagtaccaagaccctctgtctggatgttacaacgcagtggaacaccacttatctgatgttgctggctgccttagattataagcaggctttcactacactagagacatgtgatgataattacaatgaagctccttcagcagaggactggaagaaagttgaggctgcctgtacttacctgaaactgctatatgactctgcgcatagcatcatggcagcagcaaacccaacttcaaaccttttcttccatgaagcttggaaacttcagctagaactagcaaatggcacaggacatgaagatcccatttttagtagcatcgcgaaggatatgcatgagaggtttgacaagtactggaaagattgcagcctcgtgctagccattgctgttgtcatggatccacgtttcaagatgaagctggttgagttcagttactcaaaaatttatggggctgaggctgcaaagtatgttaaggtggtcaatgatgctgtgcatgaactgtacaaggagtatgtggctcagccactcccactgaccccagcctatgttgagcaaggtgaagcgaataatgggccagccaatgcgaataacagtcaaggagctccttccactggtgatgggcttctagactttgatatgtacctttctgagatccagagtagccagccctcgaaatccgaactggaacagtacctggatgaatccctcactccacgtatccaggagtttgatattctgaactggtggaagcttaacactgtcaagtttccaaccctctctaaaatggcccgtgatatcttggccattccaatgtccatggtaagcagtggcagctccatattcactgctggaacaggaagccgcatgctcgatgattacagaagctctcttcgtcccgagattgtggaggcacttgtctgtgcgaaagattggctccagtactcaccagctaccactgaggcaccaagttctgcactggtcaaggctgaagggtcttagattcacgttggctactgcgtccttgtcgaaccatgaatctatctgtttatcgtatctatgagtgtaggtaactgtagaggcatattgtaggctgagattgtgaactgattgttattctggtatttatctcgtagaggtgtaacttgtttgtgtcgaactctgttaactcgtccttgtcatgttataggttttgttgtaccatgttctggtgcaggatgtatcagctggttgtctgtactttataccctggttttgtattcaatttgttatgtactgtggatggatatggcatgtttgtgtatagctgtgtagaatgtctcattgtagtatatgtgtcatcagccagttgtactgaatcagtgctgtgtttgtgtttgaaatggttatcgtggcgtgatggcaccatgtgttcaactgttttgtgtatttatctgtttaactgttttgcgtagatacaatatgcctcttcatgtgtgatggcactcatagatacaatatgcctcatggtcaatgcttctttgatgggtttctttatttatgctgtttcctacaacaatgacacatctttgcttcggtgaacaatcctatccttttgctctgctttttgtaca

SEQ ID NO: 4905 - DNA, 2923 bp, Setaria italica
cgtcggtcacaccacacagcccccttgtctctctcttccccagtcctcttctctccccccacgacaagatctaggatttgcgcgctcggccttcgtccttcttgggccgagccctaatcctgctgcacccgcctcgctcgctcctccgctgcgcgccagctcgctcgctcctccgcgcattcactggttcagctgctagcctatcagcatggctgaggaaaccgccaacgacactcaagtgccccaagataacgaggttgcccccaacgatgaggcagtccaaggtgatgagttggttcaaggtgatgatgagttggcccaaggtgacgatgagttggcccaaggtgaagaattggctcaaggtgatgagttgacccagggtgatgatttggtgcaaggaaatgagttggctgttgctgaggaaacgacccctgggaccagaaccaggaggaggaggagtaagaagtccttggtatgggagcacttcactattgaagaagtcgctggaggggtcacacgggcatgctgcaatctctgcaagcaaacctttgcttacagctctggctcgaagattgctgggactagccatctcaagaggcacatcaccctgggttcttgtcctaagataaagcgtcaagagcagaggctgctgctgccttcagcaggaggtactgacaatgatggtgagggaactgcggagcggccaaccaagagacgctacagatatactggttatgcaaatgctgcttttgatcaagatcgcagttactcgtacctggcaaagatgatcattcagcatgactacccgcttcacattgttcaacagccggcatttgccactttcattgagagtctgcagccacgtttcaagattgtggatgttgatacaatggagggagaggtgtatgctgtttatcagaaagaaaaagagaacctactgcaagcattcaacactatgcctggaaggatcagcctcactattggattgtggacaacgagccagactcttggctatgtttcacttgcagggcagtttattgactccgagtggaaagtgcaccgaagaatgcttaacttcatgatggtgtcttctcctcattcagagaatgcacttagtgaagcaattagcatgagcctttctgactggaacatgaaggacagattattcaccatcacattggataatgaatgttcctcacatgacatctacagtgcaaatctgagggatcatctctccaacaagaacaatctcatgctcaagggacagctgtttgttgtgaggtgctatgcccatgtacttaatgctgttgcactggatgtgattgcttcaattcatggtgtcatctacagtatccgtgaaagcataaaattcataaaagcttcctctgcccgtgaagagaagtttgctgagattgctctgcagctggagattcccagtaccaagaccctctgtttggatgttacaacccagtggaacaccacttatttgatgttgctggctgccttggattataagcaggctttcactacacttgagacatgtgatgataattacaatgaagctccttctgcagaggattggaagaaagttgaggctgcctgtaattacctgaaactgctatatgactctgcacatagcatcatggcagcaggaaacccaacttcaaaccttttcttccatgaagcttggaaacttcagctagaactatccaacggcacaggacatgaagatcccattttcagtggcatcgccaaggatatgcatgagaggtttgacaagtactggaaagattgcagcctcgtgctagccattgctgttgtcatggatccacgtttcaagatgaagcttgttgagtttagttactccaagatttatggggctgaggctgctaagtatgttaaggtggttgatgatgctgtgcatgatctgtacaaggagtatgtggctcagccactcccactgaccccagcctatgttgaacaaggtgaagcgaacaatgggccagccaatgcgaataacagtcaaggagctcctgcttccactggtgatgggcttctagactttgatatgtacctttctgagatccagagtagccagccctcgaaatccgaactggaacagtacctggatgaatccctcactccacgaatccaggagtttgatattctgaactggtggaagcttaacactgtcaagtttccaaccctctccaagatggcccgtgatatattggccattccaatgtctatggtaagcagtggcagctccatattctctgctggaacaggaagccacatgctggatgactacagaagctctctccgtcctgagattgtggaggcacttgtctgcacaaaagactggctccagtactcaccagctaccacggaggcaccaacttctgcactggtcaaggctgaagggtcttaggtttgcagtggctactgcttccttgtcgaaccatgaatctatctgtttatcgtatctatgagtgtaggtaaccgtagaggtgtattgtaggctgagattgtgaactgattgttattctggtatttatctcgtagaggtggaacttgtttgtatcgaactttgttaactcgtcagtgtcatgttatagcttttggtatcgtgttctggtactgtctggctttgcatgcgatgtgcatgtacaagcttcagggtgcaggatgtatcagctggttgtctgtactttgtaccctggttttgtattcaatttgatatgtaccgtgaattgatattcatgtttgtgtacttagctctagaatgtctaattgtaatgctattcatcacctctccagtgcttcatcagccagttcagttgtactgaatcactgctgtgtttctgtttgaaatggttaccctggcgtgatggcaccacgtgtgtgttcaactgtgccgtgc

SEQ ID NO: 4906 - DNA, 3108 bp, Setaria italica
cctatctggcccaccggcagcgtcacctcgcaccagctactagggccatcgacgtgggccgcgagcccattcgaaccccgcagccgagcccgagaggggttgtttgctttcccagctaacaacctctccccccatctcgggtttctctactgccccacgtcggtcacaccacacagcccccttgtctctctcttccccagtcctcttctctccccccacgacaagatctaggatttgcgcgctcggccttcgtccttcttgggccgagccctaatcctgctgcacccgcctcgctcgctcctccgctgcgcgccagctcgctcgctcctccgcgcattcactggttcagctgctagcctatcagcatggctgaggaaaccgccaacgacactcaagtgccccaagataacgaggttgcccccaacgatgaggcagtccaaggtgatgagttggttcaaggtgatgatgagttggcccaaggtgacgatgagttggcccaaggtgaagaattggctcaaggtgatgagttgacccagggtgatgatttggtgcaaggaaatgagttggctgttgctgaggaaacgacccctgggaccagaaccaggaggaggaggagtaagaagtccttggtatgggagcacttcactattgaagaagtcgctggaggggtcacacgggcatgctgcaatctctgcaagcaaacctttgcttacagctctggctcgaagattgctgggactagccatctcaagaggcacatcaccctgggttcttgtcctaagataaagcgtcaagagcagaggctgctgctgccttcagcaggaggtactgacaatgatggtgagggaactgcggagcggccaaccaagagacgctacagatatactggttatgcaaatgctgcttttgatcaagatcgcagttactcgtacctggcaaagatgatcattcagcatgactacccgcttcacattgttcaacagccggcatttgccactttcattgagagtctgcagccacgtttcaagattgtggatgttgatacaatggagggagaggtgtatgctgtttatcagaaagaaaaagagaacctactgcaagcattcaacactatgcctggaaggatcagcctcactattggattgtggacaacgagccagactcttggctatgtttcacttgcagggcagtttattgactccgagtggaaagtgcaccgaagaatgcttaacttcatgatggtgtcttctcctcattcagagaatgcacttagtgaagcaattagcatgagcctttctgactggaacatgaaggacagattattcaccatcacattggataatgaatgttcctcacatgacatctacagtgcaaatctgagggatcatctctccaacaagaacaatctcatgctcaagggacagctgtttgttgtgaggtgctatgcccatgtacttaatgctgttgcactggatgtgattgcttcaattcatggtgtcatctacagtatccgtgaaagcataaaattcataaaagcttcctctgcccgtgaagagaagtttgctgagattgctctgcagctggagattcccagtaccaagaccctctgtttggatgttacaacccagtggaacaccacttatttgatgttgctggctgccttggattataagcaggctttcactacacttgagacatgtgatgataattacaatgaagctccttctgcagaggattggaagaaagttgaggctgcctgtaattacctgaaactgctatatgactctgcacatagcatcatggcagcaggaaacccaacttcaaaccttttcttccatgaagcttggaaacttcagctagaactatccaacggcacaggacatgaagatcccattttcagtggcatcgccaaggatatgcatgagaggtttgacaagtactggaaagattgcagcctcgtgctagccattgctgttgtcatggatccacgtttcaagatgaagcttgttgagtttagttactccaagatttatggggctgaggctgctaagtatgttaaggtggttgatgatgctgtgcatgatctgtacaaggagtatgtggctcagccactcccactgaccccagcctatgttgaacaaggtgaagcgaacaatgggccagccaatgcgaataacagtcaaggagctcctgcttccactggtgatgggcttctagactttgatatgtacctttctgagatccagagtagccagccctcgaaatccgaactggaacagtacctggatgaatccctcactccacgaatccaggagtttgatattctgaactggtggaagcttaacactgtcaagtttccaaccctctccaagatggcccgtgatatattggccattccaatgtctatggtaagcagtggcagctccatattctctgctggaacaggaagccacatgctggatgactacagaagctctctccgtcctgagattgtggaggcacttgtctgcacaaaagactggctccagtactcaccagctaccacggaggcaccaacttctgcactggtcaaggctgaagggtcttaggtttgcagtggctactgcttccttgtcgaaccatgaatctatctgtttatcgtatctatgagtgtaggtaaccgtagaggtgtattgtaggctgagattgtgaactgattgttattctggtatttatctcgtagaggtggaacttgtttgtatcgaactttgttaactcgtcagtgtcatgttatagcttttggtatcgtgttctggtactgtctggctttgcatgcgatgtgcatgtacaagcttcagggtgcaggatgtatcagctggttgtctgtactttgtaccctggttttgtattcaatttgatatgtaccgtgaattgatattcatgtttgtgtacttagctctagaatgtctaattgtaatgctattcatcacctctccagtgcttcatcagccagttcagttgtactgaatcactgctgtgtttctgtttgaaatggttaccctggcgtgatggcaccacgtgtgtgttcaactgtgccgtgctatttttgggctacttatgtactgggac

SEQ ID NO: 4907 - DNA, 2865 bp, Pennisetum glaucum
ctcttccaccgtcgcagcctcctcctcgttgtcgtctctcccccacgctctctctttccgtctcctcctccaactaactgagcgagatccagggtcttcgtccttcttgggccgagccataatcctgctgcacaccgccaagccagtccgccaagccgttggtgggtcgcgcctcgccgcgcctgcttctcctcctcctcttcctccgcgtacgcgtcttagattccatagacaacaaacaagatctagcacactgctcggcctaactcgtacagattctggatcttggccaccacctcctgcactactgtttcacaagttcagctgctagcctgtaagcatggttgaggaaactttcaatgacacccaggtggcccaagataatgagattgcccccaatgatgaggcagttcaaggtgatgaaatggtgcaaggtcatgagttgacccaaggttatgagttggcccaaggtgaagaattcgctcaaggtgatgatttgttgcaaggaaatgagttggttgttgctgaggaaacaacccctcggaccggaatcagacggaggagaaagaagtccttggtatgggagcacttcactattgaagaagtcgctggaggggccacacgggcatgttgcaatctctgcaagcaaacctttgcttacagttctggctcaaagattgctgggactagccatctcaagaggcacatcacactgggttcttgtcctaagataaagagtcaagagcagaggctgggactgccctctgcaggtggtactgacaatgatggtgagggaagtgtggagcggcgaaccaagaggcgctatagatatactggttatgccaatgctgcttttgatcaagaccgcagttgctcatacctggcaaagatgatcattcagcatgactacccgcttcacattgttcaacagccgatattcgccacttttattgagagtttgcagccacgtttcaagattgtggatgttgatacgatggagggagaggtatatgctgtttatcagaaagaaaaggagaacctacagcaagcattcaacactatgcccggaagaatcagcctcaccataggattgtggacaacaagtcagactcttggctatgtttcacttgctgggcagtttatcgactctgagtggaaactacaccgaagaatgcttagcttcatgatggtgtcttctcctcattcagagaatgcacttagtgaagcaattagcatgagcctttctgactggaacatgaaggatagactgttcaccatcacattggataatgaatgctcctcacatgatatctacagtgcaaatctgagagatcatctctccaacaagaacaacctgatgcttaagggacagttgtttgttgtgaggtgctatgcacatatccttaatgctgttgcacaagatgttattgcttcgattcacggtgtcatctacagtatccgtgaaagcataaagttcataaaagcttcttctgcccgtgaagagaggtttgctgagattgctctgcagctggagattcccagtaccaagaccctctgtctggatgttacaacgcagtggaacacaacatatctcatgttgctggctgccttagattataagcaggctttcaccacactagagacatgtgatgataattacaatgaagctccttcagcggaggactggaagaaagttgaggctgcctgtacttacctgaaactgctatatgactctgcgcacagcatcatggcagcagcaaacccaacttcaaaccttttcttccatgaagcttggaaacttcagctagaactaacaaatggcacaggacatgaagatcccatttttagtagcgtcgcgaaggatatgcatgagaggtttgacaagtactggaaagattgcagccttgtgctagccattgctgttgtcatggatccacgtttcaagatgaagctgattgagttcagttactcaaaaatttatggggctgaggctgcaaagtatgttaaggtggtcaatgatgctgtgcatgaactgtacaaggagtatgtggctcagccactcccactgaccccagcctatcttgagcaaggtgaagcgaataatgggccagccaatgccagtcacggagctccttcaactggtgatgggcttctagactttgatatgtacctttctgagatccagagtagccagccctcaaaatccgaactggaacagtatttggacgaatccctcactccacgtatccaggacttcgatattctgaactggtggaagcttaacacagttaagtttccaacccttgctaaaatggcccgtgatatcttagctatcccaatgtccatggtaagcagtggcagctccatattcactgctggaacaggaagccacatgctcgatgattacagaagctctcttcgccccgagattgtggaagcacttgtctgtgcgaaagactggctccagtactcaccagctaccacagaggcaccaagttctgcaccggtcaaggctgaagggtcttagattcacggtggctactgcatcctcgtcgatcactgaatccatctgtttatcgtatttatgagtgtaggtaactgtagaggcatattgcaggctgagattgtgaactgattgttattccttgtatttatcttgtagaggtgtaacttgtttgtgtcgaactctgttaactggtcatgttataggttttgttgtaggtaccctttgttgtatcatgttctggtgctttctgactttgcatttgatgtgcgtgtacaagctgcgggtgcagtatgtatccgctggttatttgtactttgtaccctggttttgtactcaatttgctatgtatcgtgtattga

SEQ ID NO: 4908 - DNA, 2578 bp, Echinochloa colona
ctctctccccaaccgcgagcgagatctaggcttgcgcgctcggccttcgtccttcttgggccgagccctaatcctgctgcaatccgccaccaatccgagccccctcggctctctctgctcctcctccgcgcctttcttgggttccatcgacatcagtccagatctaccacacctgctcggcctagctagccactcctgatcttggtcaccacctccctcctcatatttaacaagttcagctgctaccctatcagcatggctgaggaaactgccaatgacactcaggtggcccaagataacgaggttgcccacatcgatgagccagtccaaggtgatgagctggttcaaggtgaagaattggctcaaggcgatgaattgatccaaggcgaagaattgactcaaggtgacgagttgacccaaggtgatgatttggtgcaaggaaatgagttagttgttgctgaggcaacaacccctcggaccggaatcagacggaggagaaagaagtccttggtatgggagcatttcactattgaagaagttgctggaggggccacccgggcatgctgcaatctctgcaagcaaacctttgcttacagctctggtgcaaagattgctgggactagccatctcaagaggcacatcaccttgggttcgtgtcctatgataaagagtcaagagcagagactggcactgccttcagctggtggtggtactgacaatgacggtgagggaagtgtggaacggcctaccaagagacgctacagatatactggttatgcaaatgctgcttttgatcaagaccgcagctgttcatacctggcaaagatgatcattcagcatgactacccgcttcacattgttcaacagccggcatttgccacttttattgagagtatgcagccacgtttcaagattgtggatgttgaaacaatggagggagaggtgtatgctgtttatcagaaagaaaaggagaacctgatgcaagcattcaacactatgcctggaaggatcagcctcactataggattgtggacaacgagtcagactcttggctatgtttcacttgcagggcagtttatcgactccgagtggaaagtacaccgaagaatgcttagcttcatgatggtgtcttcccctcattcagagaatgcacttagtgaagcaattagcatgagcctttctgactggaatatgaaggacaagctgttcaccatcacattggataatgaatgctcctcacatgacatctacagtgcaaatttgagggatcatctctccaacaagaacaatctcatgcttaagggacagctgtttgtggtgaggtgctatgcccatatccttaatgctgttgcacaagatgtcattgcttcaattcacggtgtggtctacaatatccgtgaaagcataaaattcataaaggcttcgtctgcccgtgaagagaagtttgctgagattgccctgcagctggagattcccagtaccaagacgctctgtctggatgtcacaacccggtggaacacaacttatctgatgttgctggctgccttggattataaggaagctttcactcaactggagacgtgtgatgataactacaatgaagctccttcagcagaggattggaagaaagttgaggctgcttgtacttacctgaaactgctatatgactctgcacatagcatcatggcagcagcaaacccaacatcaaaccttttcttccacgaagcctggaaacttcagctagaactaacaaatggcacaggacatgaagatcccattttcagtagcatggccaaggatatgcatgagaggtttgacaagtactggaaagattgcagccttgttctagccattgcagttgtcatggatccacgttttaagatgaagcttgtcgagtttagttactccaaaatctatggggctgaggctgctaagtatgttaaggtggtcaatgatgctgtgcatgagctgtataaggagtatgtggctcagccactcccactgaccccagcctacattgagcaaggtgaagggaataatgggccggccaatgagaataacggtcaaggagctcctgcttccactggtgatgggcttctagactttgacatgtacctttctgagatccagagtagccagccctcaaaatctgaactggaacagtacctggatgaatctctcactccacggatgcaggagtttgatattctgaactggtggaagcttaacacagtcaagtttcccaccctctctaaaatggcccgtgatattttggccattccaatgtccatggtaagcagtggcagctccatattctctgctggaactggaagtcgcatgctcgatgactacagaagctctcttcgtcctgagattgtggaggcacttgtctgtgcaaaagactggctccagtactcacctgctgccagcgaggcgccaagttctgcactggtcaaggctgaatgatcataggctcgctgacatgaatctattatctaccgtttctatgagtttattgaactgtaggtgtaatgtaggctgagattgtgaactgattgtgatctgttctggtatttat

SEQ ID NO: 4909 - DNA, 3618 bp, Panicum virgatum
gcgagaagccttcctggcgcgcgcttattagaaaggccccccgcttcatccttaaagctgtcacggcaccggcgcacgtcatgtgagctcattccctcgtatgccgccccgattcatctctccggtcgcgttgctatttgctttcatttatgggttcgtagatccacacgtttaggctaaattccgctaaatcaacaggggctcgagcgaagtttgaaatttctacgcgtctgatttcggtgagccatgcccgttatttttcttcttcttctttctattggcggaaatttgaagtttttatcagcagtgtcgggtgcggttcaggaccaaagtcccaagccgatccacgccgggaggcccccacctggcccaccatcagcgtcacagctcgcgacagctgggaggcccatcgacgtgggccgcgagcccattcgatccccgtgccccgcacagccagctaccaaccctccctttctcactctccctcgcccggccgtcacagcccccttctctctgtttcagtgtttcccctcccctcccctccccacgagatctacaactctagggtttgcccgctcggccttcgtccttcttgggccgagccctaatcctgccgcaccgcagtccgccaccaataatccgagttggtggatcgcctcgcctccgcgctgcgcctgcctgctcgctcctccgcgcattcttgggttccatcgacaccaaacaaaatctagcatacctacttgctgctcggcctagctagtccggactccagatctcagccaccagcccaccacctaccacatcctatttcacggttcagctgctagcctatcggcatggctgaggagactgccaatgatgcccaggtggcccaagaaaacgcggttgctcccaatgatgaggcggtccaaacagatgaattggtccaaggtgaagatatggctcaggctgatgagttgatacaaggtgaagaaatcaatcaaggtgatgagttggtccacggtgatgatttcgtgcaaggaaatgagttggtcgttgctgaggaaacgacccctcgtactggaaccagacggaggagaaagaagtccttggtatgggagcacttcactatcgaagaagtcgctggaggggtcacacgggcatgctgcaacctctgcaagcaaacctttgcttacagctcgggctcaaagattgctgggactagccatctcaagaggcacatcaccttgggttcttgtcctaagataaagaatcaagagcagaggctggcactgccatcagcaggaggtactgacaatgatggtgagggaactgtggagcggcgaactaagagacgatacagatatactggttatgcaaatgctgcttttgatcaagaccgcagttgctcatacctggcgaagatgatcattcagcatgactacccgcttcacattgttcaacagcaggcgtttggaacttttattgagagcctgcagccacgtttcaagattgtggatgttgatacgatggagggagaggtgtatgctgtttatcagaaagagaaagagaacctgcttcaagcattcaacactatgcctggaaggatcagcctcaccataggattgtggacaacgagtcagactcttggctacgtttcacttgcagggcagtttatcgactcagagtggaaagtacaccgaagaatgcttagcttcatgatggtgtcatctcctcactcagagaatgcacttagtgaagcaattagcatgaccctttctgactggaatatgaaggacaaactattcaccatcactttggataacgattgttcctcacatgacatctacagtgcaaatctgagggattatctatccaacaagaacaatctcatgcttaagggacagctgtttgttgtgaggtgctacgctcatatccttaatgttgtcgcccaagacgtcattgcttcaattcacggtgtcatctacaatatccgtgaaagcataaagttcataaaagcttcttcagcccgtgaagagaaatttgctgagattgctctgcagctggagattcccagtacgaagaccctctgtctagatgtcacgacccagtggaacaccacttatctgatgttactggccgccttggattataagcaggctttcactacacttgagacctgtgatgataactacaatgaagctccttcaggagaggattggaagaaagttgaggctgcctgtacttacctgaaactgctatatgactctgcacatagcatcatggcatcaacaaacccaacttcaaaccttttcttccatgaagcctggaaacttcagctagaactatcaaatggcacagggcatgaagatcccattttcagtagcatcgccaaagatatgcatgaaaggtttgacaagtactggaaagattgcagcctcgtgctagccattgctgtcgtcatggatccacgtttcaagatgaagcttgttgagttcagttactccaagatttatggggctgaggctgcgaagtatgttaaggtggtcaatgatgctgtgcatgagctgtataaggagtatgttgctcagccacttccactgaccccagcatatgccgagcacggcgaacctaataatgggcctgccaatgcgaataacagtcatggagctcctgctgccactggtgatgggcttctagactttgatatgtacctttccgagatccagagtagccagccctcaaaatctgaactggaacagtacctggatgaatcccttactccacgtatccaggagtttgatatcctggactggtggaagcttaacacagtcaagtttccaaccctctctaaaatggcccgtgatatcttggccattccaatgtctatggtaagcagcggtgcctccatattctctgcaggaacaggaagtcgcatgcttgatgactacagaagctctcttcgtcccgagattgtggaggcaattgtctgtgccaaagactggctccagtactcagcacctgccactgaggctccaagttctgcactggtcaaggctgaagggtcatagattcgatgtggtcccttcttatcaaagtattaatctatgtgtgtatcttatctatgagtgtagttaactgtaggcgtattgtaggctgaaattgcgaactgtttgtgatttattctggtatttatcttgctgaggtgtaacttgtttgtgtcgagctctatttaatttgctgctgttgtaatgtgcccgttgtcagaattggaattaggcagtgaatgaaatttcaaagaaagagcagcttagtaccttggcttggctacaagttattagagaatggttctcgtatgtatcaggctgtaacaacaaacttaagttttgtaaatttataagtgcaggagagatgtacctgtgctcttgagcagtgtagtatgtatcggtttgattggattctttgttggaaaatagttgtgctgtgatgggacactagtacttggaaaagataatatgttatgtctaccagtctatgtgcttttggtagcaaaaagtatcaacttggtatgtgtcaacaaacttcagttttattaatttcttccagcaatgagcatgtgtaaagtgcattttgggctca

SEQ ID NO: 4910 - DNA, 3124 bp, Zea mays
ggatgttgctcgccagttatgggccgttgcgattccctaactgcatggatgccgtgaacggggccacgcatggccgggccggcagcgcgagaaggggatggatgggccgcgggcccgcgacgcgtgacccatagaaacgtcacaagcgctggttctcctccgtccgccccgccccaccgcattctcgtttccttccctttccttcacctgccacccgcccccctcttccacatccccaccccgccttcccccaaaagagaaaccagatcacctgctcggggccttggggcgcttcttgggccgagccctaggtagcccggaactccgatctcggccaccaccaccctcgcctatcccagaagttcagctgctagtctatcaggatggccgtggaaactgccagtgacgctcaggtggcacaagataacgagatttcccccagcaatgaggcaatccaaggtgatgagttggctcatggcgaagagctgttccaaggtgatgatcttgttcaaggaaatgagttggttgtttctgaggtaacaacacctcctactactggaatcagacgtaggaggaagaagaagtccttggtatgggagcacttcactattgaagccgtcgcgggcggggccacaagggcctgctgcaatctctgcaagcaaacctttgcttacagctctggctcaaagattgctgggactagtcatctcaagaggcacatcaccttgggctcttgtcccaagataaaggaccaagatcagaggctggcactgccttcaactggtgggactgacaactatggcgaggcaacttcggagcggccaaccaagagacgctacagatataccggttatgcaaatgctgtttttgatcaggaccgcagttgctcatacttggcaaggatgatcattcagcatgactacccacttcacattgtccaacagcaggcattttccgtctttatcgaaagtctgcagccacgtttcaagattgtggatgttgatacgatggaaggagaggtgtatgctgtttatcagaaagaaaaggagaacctgcttcgatcattcaacactatgcctggaaggatcagtctcactataggactgtggacaactagtcagactctcgggtacgtttcacttgcagggcagtttatcgactctgagtggaaagtacgccgaagaatgcttaacttcatgatggtgtcatctcctcactcagagaatgcacttagtgaggcaattagcctgagcctctctgactggagtatgaaggacaagctattcaccatcacattggataatgaatgctcctcacacgatatctacagtgcaaatttgagggatcatctctccaacaagaacagtctcatgcttaagggacagctctttgttgtgaggtgctatgcccatatccttaatgctgttgcacaagatgtcattgcttcggttcatggtgttgtatacaatatccgtgaaagcataaagttcataaaagcttcttctgcccgtgaagagaagtttgccgagattgctctgcagctggagattcccagtaccaggaccctctgtctggatgttacaacccagtggaacaccacttatctgatgttgctagctgccttggattataagcaggctttcactgcactagaaacatgtgatgatagctacaatgaagctccatcatcagaggactggaggaaagttgaggccgcctgtaattacctgaaactgctctacgactccgcacatagcatcatggcagcagcaaacccaactgcaaacatctttttccacgaagcatggaaacttcagctagagctagcaaatggcacaggacatgaagaccccactttcagaagcatcgccaaggatatgcatgagaggtttgacaagtactggaaagattgcagcctcgtgttggccgttgccgttgtcatggatccacgtttcaagatgaagcttgttgagttcagttacacaaaaatttatggggctgaagcagcaaagcatgttaaggtggttaatgatgctgtacatgagctgtacgaggagtatgtggctcatccactcccactgaccccagcctatgtggagcaaggtgaaggggggaataatggagcagcaaatgcgaatagcagtcaagggcctcctgcttccgctggcgatgggcttctagacttcgatatgtacctttctgagatccagagtagccagccctcgaaacctgagctggaacagtacctggatgagtccctcaccccacgtacccaggagtttgatatcctgaactggtggaagctaaacagagtgaagtttccaaccctctctagaatggcctgtgatatcttggccattccgatgtccatggtaagcagtggcagctccatattcactgctggaacaggaagccgcatgctcgatgactacagaagctctctccgacctgagacggtggaagcacttgtctgtgcaaaagactggctgcagtactctacgaaggctgaaggatcgtaggtttatcgtcgtcgctggtcactgctcctgccttgtggaagcaagaatctgtgtatccatctgttgtacctataagtgtagtttaactgtaggctgagattgtgatctgttctggtgtttgtctcgtaaaggtgtgtagactctgatgtactcgttgttgtcatgtaatagcttatgtatcatgttctagtatcgtctgatgttggagtttgcatgcttgggctatgtgcatgtactggccgtgggatgcatcagctgcttgctgtaatgctgtttgaactccggttttgtatttaatttgttttgtaccgtggattggtgtccatgttcgtgtatagctgcacaaattgtgtaagggggtgtttggttagagggactaaagattagtctctagtttttagtcccttttttgccaaacactaggattaaaatgatttagtctttagtccttcacatatgtgctaaaagggactaaaccatattaattccacatttaccccttatttagtttaattgtactaatagcaggagaatattaaaggttattttagtcttcttatgagtcatttaatatactaggtgactacccgtgcgttacaacggga

SEQ ID NO: 4911 - DNA, 2551 bp, Pennisetum glaucum
gtttcacgggttcggctgctagcctatcagcaccatggctgaggaaactgccaatggcactcaggtgccccaggaaaatgaggtcgcccccaacgatgatgcagtccaaggagatgagttggttcaaggtgatgatgagttggcccaaggtgaagatgagttggcacaaggtgaagaactggctcatggtgatgagttgacccaggatttggtgcaaggacatgagttggctgttgctgaggaaacgacccctgggaccagaaccaggaggaggaggtgtaagaagtctttggtatgggagcacttcactatcgaagaagtcgccggaggggtcacacgggcgtgttgcaatctctgcaagcaatcctttgcttacagctctggctccaagattgctgggactagccatctcaagaggcacatcaccctgggttcctgtcctatgataaagcgtcaagaccagaggctgatgctgccttcggcaggaggtactgacaatgatggtgatggaactgtggagcggccaaccaagagacgctacagatatactggttatgcaaatgctacttttgatcaagatcgcagttactcatacctggcaaagatgatcattcagcatgactacccgcttcacattgttcaacagccggcattcgccatttttattgagagtctgcagccacgtttcaagattgtggatgttgaaacaatggagggagaggtgtatgctgtttatcagaaagaaaaagagaacctgctgcaagcattcaacactatgcctggaaggatcagcctcactattggattgtggacaacgagtcagactcttggctatgtttcacttgcagggcagtttattgactccgagtggaaagtgcaccgaagaatgcttaacttcatgatggtgtcttctcctcattcagagaatgcacttagtgaagcaattagctcgaccctttctgactggaacatgaaggacagactattcaccatcacattggataatgaatgctcctcacatgacatctacagtgcaaatctgagggatcatctctccaacaagaacaatctcatgctcaagggacagctgtttgttgtgaggtgctatgcccatatccttaatgctgttgcactggatgtgattgcatcaattcacggtgtcatctacagtatccgtgaaagcataaaattcataaaagcttcccctgcccgtgaagagaagtttgctgagattgctctgcagctggagattcccagtaccaagaccctctgtttggatgttacaacccagtggaacacgacttatttgatgttgctggctgccttggattataagcaggctttcactacacttgagacatgtgatgataattacaatgaagctccctctgcagatgattggaagaaagttgaggctgcctgtaattacctgaaactgctatatgactctgcacatagcatcatggcagcaggaaacccaacttcaaaccttttcttccatgaagcttggaaacttcagctagaactatccaacggcacaggacatgaagatcccattttcagtggtctcgccaaggatatgcatgagaggtttgacaagtactggaaagattgcagccttgtgctagccattgctgttgtcatggatccacgtttcaagatgaagcttgttgagttcagttactccaagatttacggggctgaggctgcaaagtatgttaaggtggttgatgatgctgtgcatgatctttacaaggagtatgtggctcagccaccagcctatgttgaacaaggtgaagcgaataatgggccagccaatgcaaataacagtcaaggagctcctgcttccactggtgatgggcttctagacttcgatatgtacctttctgagatccagagtagccagccctcaaaatctgaactggaacagtacctggatgagtccctaactccacgcatgcaggagtttgatattctgcactggtggaaactcaacactgtcaagtttccaaccctatccaggatggcccgtgatatattggccattccaatgtctatggtaagcagcggcagctccatattctctgccggaacagcaagccacatgctggatgactacaggagctctcttcgtcctgagattgtggaggcacttgtctgcggaaaagactggctccagtactcatcagctagtacggaggcgccgagttctgcgctggtcaagcctgaagggtcttaggctcgcagtggctactgcttgcttgtcgaaccatgaatctatctatttaccgtatctatgagtgtaggtaaccgtagaggtgtattgtaggctgagattgcgaactgattgctattctggtatttatctcatagaggtgtaacttgtctgtatcaaactttgttaactcgtcggcgtcatgttataacttttggtgtatcatgttctggtactgtctggcattgcatgcagggtgcaggatgtatcagcaggttgctggttgcctgtacttcgtactctgattttgtattcgatttgatatcttcaaaaaaa

SEQ ID NO: 4912 - DNA, 4250 bp, Panicum virgatum
ccccgtcttccccccaccaaccaaagatctagctagggtttgcgcgctcggccttcgtccttcttgggccgagccttaatcctgctgcaccgcccgccggtccgccaaaagcctccggtctggtggatcgcctcctcgcccgcccctccgctgcgcccgcgcccctctctctgctcctccgcgtacgtaagcccccaaactccaaatcccccctttcacctcctcccgctctcgtatcctctccttccaaatccggcccaaatctgctggttcccgttcgagctggtgcgtgttggcgcgcgcggttcgtcggatctgcaggggcgcgagggctccgctgagcgggttccggcgaaatgggtctagatctggcgcgaattttcgcggaggcttttttttttctctggccttttgagtgctccaattacttcgtcgtttccttcgggggaatctgggggacacgggagattcggtagccttttcgttgcgcaagggggatttcctcagggtttcgcgtggcttagattggcagtctgacttcgttgttgaggtgaagtgttaccttactctgtactatacggctgttgtcttagctcagatatcggggtagagagcaagtactactacactttatggcgctggaagcttaaattctgtcgagatatccataagttttgagtagagcagctggagttaatgataccgtgtatacagtatctttgtgaattttgtacctggcctagggtggtcatgcttgaatggttgagacgagtccactgctcgatagcccaggtaggttcgatgctaggaagttagtactagtaccaccaccgctggtttgtgcaaaggatgagatgagcatggttcttttttttttaaggctacagtacatgaggtggaggtattatgttcttcagctgcttgtgtgcaaaatccctgtcgttctactgaggtgctatcctttgggcttgtatttgctttctgttacaacatggggctcttgcgcatattcaatcatgtgcattaagccttttgctttgcctggttccttgacgttgtgtgtctgcttttccattgcatttctaatgctatattgatacatgtgtaaaatattgctgcagtgttccatatgtgcaacgtattctgattcttatatataccatcctatgttttagtgtattctgattcttatatataccatcctatgttttagtgattggaaaaaaccgccgtctttatattgtctatattactatatataataccattatcgtatagatacttgaaacaaaatcatccaggtggtctctgaatcctgtcttgtaaatttattgttggttactggcttactgctgctgtaaacaatgagaacctatcattatgaatatgcaaattatctgatattctgatgtcttgtgtaatttgtcatgaaaactatgagaatttacatgacagattagtttcatttaattttaaaatccttgaaactatcaaatgattttatttgttctgttcattttgaattgacaggcattcttgggttccattgacaacaaagaagatctaagacacctgctcgcagctcggcctagctagtccggactccggatctcaaccaccacctaccatatcctattttacgggttcagctgctagcttatcagcatggctgaggaaaccaccaatgacactcaggtggcccaagaaaatgaggttgctcccaatgatgaggcggtccaagcagatgaattggtccaagctgaagatatggctcaagctgatgagttgatacaaggcgaagaaatcaatcaaggtgatgagttgactcatggtgacgatttcatgcaaggaaatgagttggtcgttgctgaggaaacgacccctcggactggaaccagacggaggagaaagaagtccttggtatgggagcacttcactattgaggaagtctctggaggggccacacgggcatgctgcaatctctgtaagcaaacctttgcttacagctctggctcaaagattgctgggactagccatctcaagaggcacatcaccttgggttcttgtcctaagataaagaatcaagagcagaggctggcactgccttcagcaggaggtactgacaatgatggtgagggaactgtggagcggcgaactaagagacgatacagatatactggttatgcaaatgctgcttttgatcaagaccgcagttgctcatacctggcaaagatgatcattcagcatgactacccacttcacattgttcaacagccagccttcagcacttttattgagagtttgcaaccacgcttcaagattgtggatgttgatacgatggagggagaggtgtattctgtttatcagaaagaaaaagagaacctgcttcaagcattcagcactatgcctggaaggatcagcctcaccataggattgtggacaacgagtcagactcttggctatgtttcacttgcagggcagtttatcgactcagagtggaaagtacaccgaagaatgcttagcttcatgatggtttcatctcctcattcagagaatgcacttagtgaagcaattagtatgaccctttctgactggaatatgaaggacaaactattcaccatcacattggataatgaatgttcctcgcatgacatttacagtgcaaatctgagggattatctatccaacaagaacaatctcatgcttaagggacagctgtttgttgtgaggtgctacgcccatatccttaatgctattgcccaagatgtcattgcttcaattcacggtgtcatctacaatatccgtgagagcataaagttcataaaagcttcttctgcccgtgaagagaagtttgctgagattgctctgcagctggagattcccagtacaaagaccctctgtctagatgtcacaacccagtggaacaccacttatctgatgttactggccgcattggattataagcaggctttcactacacttgagacctgtgttgataactacaatgaagctccttcaggagaggattggaagaaagttgaggctgcctgtacttacctgaaactgctatatgactctgcgcatagcatcatggcatcaacaaacccaacttcaaaccttttcttccatgaagcctggaaacttcagctagaactatcaaatggcacaggacatgaagatcccattttcagtagcatcgccaaagatatgcatgagaagtttgacaagtactggaaagattgcagcctggtgctagccattgctgtcgtcatggatccacgtttcaagatgaagcttgttgagttcagttactccaagatttatggggctgaggctgcaaagtatgttaaggtggtcgatgatgctgtgcatgaactgtataaggaatatgttgctcagccactcccactgaccccagcctatgctgagcaaggtgaagcgaataatgggccagccaatgcaaataacagtcaaggagctcctgcttccactggtgatgggcttctagacttcgatatgtacctttctgagatccagagtagccaaccctcaaaatctgaactggaacagtacctggatgaatcactcactccccgaatgcaggagttcgatattctgaactggtggaagcttaacacagtcaagtttccaaccctctctaaaatggcccgtgatatcttggctattccaatgtccatggtaagcagtggcaattccatattcactgctggaacaggaagtcacatgctcgatgactatagaagctctcttcgtcctgagattgtggaggcacttttctgtgcgaaagactggctccagtactcagcagctgccaaggatgcaccaagttctgcacttgtcaaggctgaagggtcggaggttcgatgtggtcacttcttccttgttgaaccatgaatatgtctctatcgtgagtgtagtaattgtaggcgtattgtaggctgagattgtgaactggttattatttagatatttgtcttgtagaggtgtaacttatttgtgtcgaactctgtttaactcgctattgtcatgtaatagcttttgttatatcatgttctggtgttgactttgcatgtgatgtgcatgtacaagctgcaggatgcatcagctggttgcctgtactttgtacccttgttttgtattcaatttgttatgcaccgtgatgttcatgtttgtgtatagctgtagaatgtctaatttaagtatatgctatccatcactcttccagttag

SEQ ID NO: 4913 - DNA, 2846 bp, Panicum virgatum
ctgttcattttgaattgatgacaggcattcttgggttccatcgacaacaaacaagatctaacacacgttctcgcagctcggcctagctagtccggactccagatctcaaccaccacctaccatatatcctattttacgggttcagctgctagcctataagcatggctgaggaaaccgccaacaacactcaagtggcccaagaaaatgacgttgctcccaatgatgaggcagtccaagcagatgaattggtccaagctgaagatatggctcaagctgatgagttgatacaaggagaagaaatcaatcaaggtgatgagttggttcatggtgatgatttcatccaaggaaatgagttggtcgttgctgaggaaacgacccctcggaccggaaccagacggaggagaaaaaggtcctcggtatgggagcacttcactattgaagaagtcgctggaggcgccacacgggcatgctgcaatctctgtaagcaaacctttgcttacagctctggcccaaagattgctgggactagccatctcaagaggcacatcaccttgggttcttgtcctaagataaataatcaagagcagaggctggcactgccttcagcaggaggtactgacaatgatggtgagggaactgtggagcggcgaactaagagacgatacagatatactggttatgcaaatgctgcttttgatcaagactgcagttgctcatacctggcgaagatgatcattcagcatgactacccgcttcacattgttcaacagccggcattcagaactcttattgagagcctgcagccacgtttcaagattgtggatgttgatacgatggagggagaggtgcatgctgtttatcagaaagaaaaagagaacctgcatcaagcattcaacactatgcctggaaggatcagcctcaccataggattgtggacaacgagtcagactcttggctatgtttcacttgcagggcagtttattgactcagagtggaaagtacaccgaagaatgcttagcttcatgatggtgtcttctcctcactcagagaatgcacttagtaaagcaattagcatgaccctttctgactggaatacgaaggacaaactattcaccatcacattggataatgaatgttcctcacatgacatctacagtgcaaatctgagggattatctctccaacaagaacaatctcatgcttaagggacagctgtttgttgtgaggtgctacgcccatatccttaatgctgtcgcccaagacgtcattgcttcaattcacggtgtcatctacaatatccgtgaaagcataaagttcataaaagcttcttctgcccgtgaagagaagtttgctgagattgctctgcagctggagattcccagtacgaagaccctctgtctagatgtcacaacccagtggaacaccacttatctgatgttactggccgccttggattataagcaggctttcactacacttgagacctgtgatgataactacaatgaagctccttcaggaaaggattggaagaaagttgaggctgcctgttcttacctgagactgctatatgactcagcgcatagtatcatggcatcaacaaacccaacttcaaaccttttcttccatgaagcctggaaacttcagctagaactatcaaatggcacaggacatgaagatcccattttcagtagcgttgccaaagatatgcatgagaggtttgacaagtactggaaagattgcagcctcgtgctagccattgctgttgtcatggatccacgtttcaagatgaagcttgttgagttcagttactccaagatttatggggctgaggctgcgaagtatgttaaggtggtcaatgatgctatgcatgagctttataaggagtatgttgctcagccacttccactaaccccagcctatgccgagcacggcgaagctaataatgtcacagccaatgcgaataacagtcaaggagctcctgctgccactggtgatgggcttctagactttgatatgtacctttccgagatccagagtagccagccctcaaaatctgaactggaacaatacctggatgaatcactcactccacgtatgcagaagtttgatattctgaactggtggaagcttaacacagtcaagtttccaaccctctctaaaatggcccgtgatatcttggctattccaatgtccatggtaagcagtggcaactccatattcactgctggaacaggaaatcgcatgctcgatgactatagaagctctcttcgtcctgagattgtggaggcacttttctgtgcaaaagactggctccagtactcagcagctgccaaggatgcaccaagttctgcactggtcaaggctgaagggtcataggttcgatgtggtcacttattccttgtcgaaccatgaatctgtccatctatcgcgagtgtagtaactgtaggcgtattgtaggctgagattgtgaactgattgttattctaatatctgtcttgtagagttgcaagttatttgtgttgaactctgtttaacttgctgttgtcatgtaatagcttttgctgtatcatgttctggtgctgtctgactttgcatgtgatgtgcgtgtacaagctgcaggatgcatcagctggttgcctgtactttgtacccttgttttgtattcaattttttatgcactgtgatgttcttgtttgtgtatagctgtagaatgtctaatttaagtatatgctatccatcacttttccagttagtcatcagccagctgtacggaatcactgctgtgcgttatgtttaaaatgctctacgtggcgtgatggctccattgttcaactgtgcagtgctatt

SEQ ID NO: 4914 - DNA, 2797 bp, Oryza sativa
tactactcctaatccgccattccattcgcgcggctaatcccccaccctcccaggcggccaggccccatctcatttcctttcctttctttcccctctcctcctcctccccgcagaatactaccagatctgcttcgccgctctcccggccttggagcttcttgggccgagccctaccaagtccggatctgccaccaccaccaccatctctccccctcctcctcctcgtactttgtgagttctagctactagccaagaagcatggctgaggaaactggcaacgacaaccaggtggttcaaggtaatgagattgtcccaagcaatgaggaagctcaagctgaggaagttcagggtgatgaattggtccctgctgaggacttaactcaaggtgacgaggtccaaggaaatgaattggtcagtgctgagatcagtacccctccaacattaaggcgccgtaggaagaagtctctagtgtgggagcacttcactattgaagctgtctctggaggggctacacgggcgtgctgcaaactgtgcaagcaaacttttgcttacagctctggttcaaaaattgcgggtactagccatctcaagaggcacattacattgggttcatgccctaaaattaagaaccaagagcacaagctagcactgactccagctggagggactgacaatgatggtgagggtactgtggagcgcccatctaagaggcgttacagatatactggttatgcaaatgctgcttttgatcaagaccgcagttgctcatatctggcaaagatgataattttgcatgactacccacttcacattgttcaacagccagcgttcactacctttattgacagtctgcagccacgtttcagggttgtagatgttgagacaatggagggggaggtgtatgctgtttaccagaaagaaaaggaaaacctcacgcaagcattcagcactatgcctggaaggatcagcctcaccattggattgtggacaactagccaaactcttggctatgtttcactttctgggcagtttattgactctgagtggaagatacatcgaagaatgctaaacttcatgatggtgtcttctcctcattcagagaatgcacttagtgaagctattagtgcaagcctttcggactggaatatgaaggacaaactgttcaccatcacattggacaatgattgctcatcacatgatatatacagtgcaaatctgagggattatctctccaacaagaacaacctcatgctcaagggccaactgtttgttgtaaggtgttatgcccatatcctgaatgcagttgctcaggatgtcattgcttcaatccatggtgtcatctacaatatccgtgaaagcatcaagttcataaaagcttctcctacccgtgaggagaagtttgcagagattgctctgcagctagagatcccaagtaccaagaccctttgtctggatgttacgactcagtggaacactacctatctcatgctgctggctgccttggattataagcaggccttttctactctagagacaagtgatgacaactacaacgaggcaccgtccgctgaggactggaaaaaagttgaggctgcctgcaattacttgaagctattgtatgactcagcacatagcatcatggctgcagcaaatccaacttcaaatctctttttccatgaggcatggaaacttcaactagagctgtcaaatgctacagggcatgaagaccctgttttcagcagcattgccaaggatatgcacgagaggtttgacaagtactggaaagattgcaaccttgtgttagctattgctgttgtgatggatccacgcttcaagatgaagcttgttgagttcagctactcgaaaatttatggtgttgaagctgcgaagtatgttaaggtggtggatgacgctgttcatgagctttacaaggagtatgttgcacagcccctccccttgacgccggcctatgttgagcaaggggaaggtaataatgcacctgctagcgagaatagtactcaaacaactgctccttcgaccggcgatggacttgtggactttgatatgtacctttctgagatagctacaagccagccaacaaaatctgaactggaacagtaccttgatgagtccctcactccgcgcatccaggaattcgacattctgaactggtggaagctcaacactctcaagttccctactctctcaaagatggcccgggatatcttggccattccgatgtcgatggtgagcagcggcaactctattttctctgctggaacaggaactcgcatgcttgatgactacagaagctcattgcgtccagaaattgtggaggcgctcttctgcgccaaagactggcttcagtattcaccagctaccccggaggcgccgagtaccgcgctggtcaaggtggatgcaccataggatcgccgtgattcccccccttttgtgaagcaacagcatgtaccaatggtacctatttgtgaagttaactgctaggcgtattttaggcagggactatgaactgattgtgatctgagcttatcctcctagggtgtaatttgttgtatcgaactctgttaactcgttcatgttgttatgtacgctttgtctgtagtatgccatcagagttgtacctgatattgcatgtagtgtgcgcgctggctgcataatatttatcagctggtgccttatgtttgtacttcccctcattataatccattgtagcatgtgattgttctgtgcctttgtgatatgtcacatagctaaggcagcgtcgacacctgcgtgcggc

SEQ ID NO: 4915 - DNA, 2991 bp, Oryza sativa
atcgattcgcccacacgccgcggattcggcagcccaccctatccaccggaaaacccgcacccaaacgaggcaaattttcttccccccatctcgtcctcctctcccctgcacctactaccagatctgcttcgccgctcgccccggccttggagcttcttgggccgagccctagcgagcgagccccgcccgcgcgcggatctgccaccaccatccctctcctcctcctcgtattttgtgagttctagctactagccaagaagcatgactgaggaaactggcaacgacttccagatggttcaaggttatgagattgtcccaagcaatgaggaagctcatgctgaggaagttcagggtgatgaattggtccttgcggaggacttagctcaaggtgacgaggtccaagtaaatagattggtcagtgctgagatgagtacccctccaacatcaaggcgccgtaggaagaagtctctagtgtgggagcacttcactattgaagctgtctctggaggggctacacgggcgtgctgcaaactgtgtaagcaaacttttgcttacagctctggttcaaaaattgcgggtactagccatctcaagaggcacattaccttgggttcatgtcctaaaattaagaaccaagagcacaagctagcactgactccagctgtagggactgacaatgatggcgagggcactgtggagcgcccgtctaagaggcgttacagatatactggttatgcaaatgctgcttttgatcaagaccgcagttgttcatatctggcgaagatgatcattttgcatgactatccacttcacattgttcaacagccagccttcactacctttattgacagtctgcagccacgtttcagggttgtagatgttgagacaatggagggggaggtgtatgctgtttaccagaaagaaaaggaaaacctcatgcaagcattcagcactatgcctggaaggattagccttactattggactgtggacaactagccaaactcttggctatgtttcacttgctgggcagtttattgactctgagtggaagatacatcgaagaatgctaaacttcatgatggtgtcttctcctcattcagagaatgcacttagtgaagctattagtacaagcctttcagactggaatatgaaggacaaactattcaccatcacattggacaatgattgctcatcacatgatatatatagtgcgaatctgagggattatctctccaacaagaacaacctcatgctcaagggccaactgtttgttgtaaggtgttatgcccatatcctgaatgcagttgctcaggatgttattgcttcaattcatggtgtcatctataatatccgtgaaagcattaagttcataaaagcttctcctagccgtgaggagaagtttgcagagattgctctgcagctagagatcccaagtaccaagaccctttgtctggatgttacgacacagtggaacactacctatctcatgctgctggctgccttggattataagcaggccttttctactcttgagacaagtgatgataactacaatgaggcaccgtccgctgaggactggaaaaaagttgaggctgcctgcaattacttgaagctattgtatgactcagcacatagcatcatggctgcagcaaatccaacttcaaatctctttttccatgaggcatggaaacttcagctcgagctgtcaaatgccacagggcatgaagaccctgttttcagcagcattgccaaggatatgcacgagaggtttgacaagtactggaaagattgcaaccttgtgttagctattgctgttgtgatggatccgcgcttcaagatgaagcttgttgagttcagctactcgaaaatttatggtgttgaagctgcaaagtatgttaaggtggtggatgatgctgttcatgagctttacaaggagtatgttgcacaacccctccccttgacgccggcttatgttgagcaaggggacggtaataatgcacctgctagcgagaatggtactcaagcaactgctccttcgaccggcgatggacttgtggactttgatatgtacctttctgagatagctacaagccagccaacaaaatctgaactggaacagtacctggatgagtccctcactccgcgcatccaggaatttgacattctgaactggtggaagctcaacactctcaagttccctactctctcaaggatggcccgggatatcttggccattccgatgtcgatggtgagcagcggcaactctattttctctgctggaacaggaactcgcatgcttgatgactacagaagctcattgcgtccagaaattgtggaggcgctcgtctgcgccaaagactggcttcagtatttaccagctaccccggaggcgccgagtaccacgcttgtcaaggtggatgcaccataggctcgccgtgatcccccccccccccccccttcctcttgtgaagcaacagcatcctatccgtattttaggcagggactatgaactgattgagatccgagcttatcctcctagggtgtaatgtgctgtatcgtactctgttaactccttcatgttattatgtacgctgtcttgtagtatgccatcggagttacctgacattacgtgtagtgtgtgcgctggctgcataatgtgtatcagttgatgccttatgtctggacttcccttcattatcatccattgtagcatgtgattgttctgtgccgttgagatatgttcatttgattgtcaatcaatgcaacgtgtcaattttactcgtgtgtttgtcgttgagtaatgtgtttgggctatgtaaggatgccacagaacttcttgtttgcgattctgtccatttttttttaaatctgagcaggataagaaacattttttttgtctaagcatcctagaaattaaattataagtattaatagggtacgcctaatgcgcgggtgatcgcccgcccctcccctatatggtcgctccctc

SEQ ID NO: 4916 - DNA, 3144 bp, Brachypodium distachyon
ggcagcggcaccgcacaggtgcgccccccacggcgccctctatcagcgatgggccgcgacccgtgagcccattgaaacgtcattcttctctccacggggcatcccccaccaaagtcttcctcgctacctactgcgcctcccccccccccagcgtctccaaacctctctcccccttctccacccaccccgcagaaaccagatctacaacaaaccactctgcccgctcggccttggcgcttcttgggccgagccctagctactcccggactcccgatctccattctcagccatctcctctccttcctccccccccccccccccctatttgcacttctagctactagtctaccaggatggctgaggaaactggcaacgagactcaggtggttgtagctaatgaggttgttgaccccagtaatgagattgttgaccccagtaatgaggtagtccatgatgatgaattggtccaagctgatgagctgactcaaggcgaggagttaacacatggtgaagagttgctcgaaggacatgagatggtcgttgctgaggtgaccaccccaaaaaccgcgaggcgccggagaaaaaagtccctggtgtgggagcacttcacaattgaagatgctcctggaggggccacaagggcatgctgcaaactgtgcaagcaaacctttgcttacagctctggttctaaaattgcaggaactagtcatctcaagaggcacatcaccttaggttcatgtcctaagataaaaaaccaagagcataagctagcactggtttcagcagcagggactgacaatgatggtgagggtactgtggagcgacgggctaagaggcgttacagatatactggctatgcaaatgcgtcttttgatcaagatcgcagttgttcatacctggcgaagatgataattttgcatgactacccactccacattgttcagcagccagccttcactgttttcattgatagtctgcagcctcgtttcagggttgtagatgttgatgcaatggagggggaagtgtatgctgtatatcagaaagaaaaggagagccttctgcaagcattgagcagtatgcctggaaggataagcctcactattggattgtggacaactagtcaaactcttggttatgtttcacttgctgggcagtttattgactctgaatggaaattgcatcgaagaatgcttaacttcatgatggtttcttctcctcattcggagaatgcgcttagtgaagctattagcacaagccttactgactggagtatgaaggagaagctattcacgatcacattggataatgattgctcgtcgcatgatatctatagtgctaatctgagggattatctgtccaataagaatgacctcatgcttaagggccagctatttgttgtcaggtgctatgcccatattctgaatgcagttgcacaggatgtcattgcttcaatccatggtgtcatctacaatatccgtgaaagcataaaattcataaaagcttctcctagtcgtgaggaaaagtttgctgagattgctctgcagctggagatccctagtaccaagaccctttgtctggatgtcacaacccagtggaacaccacctacctgatgcttttggctgccttggattataagcaggctttcactacactagaaacatgtgatgataactacaatgaagcaccttcagctgaggactggaaaaaagttgaggctgcctgcaattacttgaagctgctgtatgactcagctcatagcatcatggcagcagcaaacccaacttcaaacatattcttccatgaagcttggaaacttcagctagagctggcaaattccataggacatgaagatccagttttcagtggcattgccaaagatatgcatgagaggtttgacaagtactggaaagattgcaacctcgtgttagcagttgctgttgtgatggatccacgtttcaagatgaagcttgttgagttcagttactcaaaaatttatggtattgaggctgcaaagtatgttaaggtggtaaatgattcggtgcatgagctgtataaggactatgtagcacagcctctccccttaacaccggcctatgttgaacaaggggagacgactaataatgcagctgccaatgggaacaaccctcgggcaactcagccatcaactggtgatggtcttctagacttcgatatgtatctttccgagattgctacaagccagccgtcaaaatctgaactagagcagtacctggatgaatccctcactccgcgtatccaagagtttgacattctgaactggtggaagcttaacacactcaagtttccaacactttcgaagatggctcgggacatcttggccattccaatgtccatggtaaccataggcagctctatattttctgcaggaacaggaagccatatgctagatgactacagaagctcacttcgtccggaaattgtggaggcgcttgtctgcacgaaagattggcttcagtatacaacaactgcatctgagacaccgagttctgcgattgtcaaggcggagtaggctcgcatgctgaagtatgcatatatttctggtacctgtgggtggtatttaactatagatgtatttgggcagagtttgtgaactgaccgtgatctgtttcagttattctgtcctagattgtaatttgctatgtagtagaactctgttaactcctcgtgctgttgtgtacccttttcctgtgatgtgtttgtaatctgtgattggagacattgtctgacgttgcttgggacgtggatgtacaagctgcgtaatgtaccagccggtgggcttatgtttgtttctccgtttctgtgtctgggtgttgttcttgtcagctgcttatgttcatgcgaatgtttattcatagaatggtttgcgttttaccttctgctcgtgcatacgagtgtcgtggtgtggctggttacaatgtaagcccacaacataactgaaactaacggctgggcacatctactttcgacgtgttagcatcctgtatacttccttccatggatttgcatgctagaccatgtgataatcttctgatgatacaaatcattcctcagttttcgcaggacccaatggcagccaccccgcacaatagcttatcgtataatac

SEQ ID NO: 4917 - DNA, 3180 bp, Brachypodium distachyon
ggcagcggcaccgcacaggtgcgccccccacggcgccctctatcagcgatgggccgcgacccgtgagcccattgaaacgtcattcttctctccacggggcatcccccaccaaagtcttcctcgctacctactgcgcctcccccccccccagcgtctccaaacctctctcccccttctccacccaccccgcagaaaccagatctacaacaaaccactctgcccgctcggccttggcgcttcttgggccgagccctagctactcccggactcccgatctccattctcagccatctcctctccttcctccccccccccccccccctatttgcacttctagctactagtctaccaggatggctgaggaaactggcaacgagactcaggtggttgtagctaatgaggttgttgaccccagtaatgagattgttgaccccagtaatgaggtagtccatgatgatgaattggtccaagctgatgagctgactcaaggcgaggagttaacacatggtgaagagttgctcgaaggacatgagatggtcgttgctgaggtgaccaccccaaaaaccgcgaggcgccggagaaaaaagtccctggtgtgggagcacttcacaattgaagatgctcctggaggggccacaagggcatgctgcaaactgtgcaagcaaacctttgcttacagctctggttctaaaattgcaggaactagtcatctcaagaggcacatcaccttaggttcatgtcctaagataaaaaaccaagagcataagctagcactggtttcagcagcagggactgacaatgatggtgagggtactgtggagcgacgggctaagaggcgttacagatatactggctatgcaaatgcgtcttttgatcaagatcgcagttgttcatacctggcgaagatgataattttgcatgactacccactccacattgttcagcagccagccttcactgttttcattgatagtctgcagcctcgtttcagggttgtagatgttgatgcaatggagggggaagtgtatgctgtatatcagaaagaaaaggagagccttctgcaagcattgagcagtatgcctggaaggataagcctcactattggattgtggacaactagtcaaactcttggttatgtttcacttgctgggcagtttattgactctgaatggaaattgcatcgaagaatgcttaacttcatgatggtttcttctcctcattcggagaatgcgcttagtgaagctattagcacaagccttactgactggagtatgaaggagaagctattcacgatcacattggataatgattgctcgtcgcatgatatctatagtgctaatctgagggattatctgtccaataagaatgacctcatgcttaagggccagctatttgttgtcaggtgctatgcccatattctgaatgcagttgcacaggatgtcattgcttcaatccatggtgtcatctacaatatccgtgaaagcataaaattcataaaagcttctcctagtcgtgaggaaaagtttgctgagattgctctgcagctggagatccctagtaccaagaccctttgtctggatgtcacaacccagtggaacaccacctacctgatgcttttggctgccttggattataagcaggctttcactacactagaaacatgtgatgataactacaatgaagcaccttcagctgaggactggaaaaaagttgaggctgcctgcaattacttgaagctgctgtatgactcagctcatagcatcatggcagcagcaaacccaacttcaaacatattcttccatgaagcttggaaacttcagctagagctggcaaattccataggacatgaagatccagttttcagtggcattgccaaagatatgcatgagaggtttgacaagtactggaaagattgcaacctcgtgttagcagttgctgttgtgatggatccacgtttcaagatgaagcttgttgagttcagttactcaaaaatttatggtattgaggctgcaaagtatgttaaggtggtaaatgattcggtgcatgagctgtataaggactatgtagcacagcctctccccttaacaccggcctatgttgaacaaggggagacgactaataatgcagctgccaatgggaacaaccctcgggcaactcagccatcaactggtgatggtcttctagacttcgatatgtatctttccgagattgctacaagccagccgtcaaaatctgaactagagcagtacctggatgaatccctcactccgcgtatccaagagtttgacattctgaactggtggaagcttaacacactcaagtttccaacactttcgaagatggctcgggacatcttggccattccaatgtccatggtaaccataggcagctctatattttctgcaggaacaggaagccatatgctagatgactacagaagctcacttcgtccggaaattgtggaggcgcttgtctgcacgaaagattggcttcagtatacaacaactgcatctgagacaccgagttctgcgattgtcaaggcggagtaggctcgcatgctgaagtatgcatatatttctggtacctgtgggtggtatttaactatagatgtatttgggcagagtttgtgaactgaccgtgatctgtttcagttattctgtcctagattgtaatttgctatgtagtagaactctgttaactcctcgtgctgttgtgtacccttttcctgtgatgtgtttgtaatctgtgattggagacattgtctgacgttgcttgggacgtggatgtacaagctgcgtaatgtaccagccggtgggcttatgtttgtttctccgtttctgtgtctgggtgttgttcttgtcagctgcttatgttcatgcgaatgtttattcatagaatggtttgcgttttaccttctgctcgtgcatacgagtgtcgtggtgtggctggttacaatgtaagcccacaacataactgaaactaacggctgggcacatctactttcgacgtgttagcatcctgtatacttccttccatggatttgcatgctagaccatgtgataatcttctgatgatacaaatcattcctcagttttcgcaggacccaatggcagccaccccgcacaatagcttatcgtataatacacggattgtaagaccttctgacagagagccacggcg

SEQ ID NO: 4918 - DNA, 3033 bp, Oryza sativa
ccggcccattacaccccaaaccctagagaaatccatccactaacttaaccggtggaaatccaccactccgggccgcctcccgtcttctcttctcgagcggctcccgcgccgcctctccttgttgtctcgtcgcgcgccggcgcctcctctcgtcgcgcaccggcggcggcgccagcgcctcccaccgcatccgcctgcttcccctaaggcaccgcatccccttccttcccagtgccggcgccgcctcccttccatcctcggtgcaggcgcctcctcccttcatccccgctgtacagtgctgcacagagtcgaaacagtcttcttcaagcccagatccacggcaccagattttgtgagttctagctactagccaagaagcatggctgaggaaaccagcaacgacaacctggtggttcaaggcaacgagattgttccaagcaatggggaagctctagctgaggaagttcagggtgatgaattggtccttgcggaggacttaattcaaggtgacgaggtccaaggaaatgaattggtcagtgctgagatgagtatccctccaacatcaaggcgccgtaggaagaagtctctagtgtgggagcacttcactattgaagctgtctctggaggggctacacgggcgtgctgcaaactgtgcaagcaaacttttgcttacagctctggttcaaaaattgcgggcactagccatctcaagaggcacattaccttgggttcatgtcctaaaattaagaaccaagagcacaagctattactgactccagctggagggactgacaatgatggtgagggtactgtggagcgcccgtctaagaggcgttacagatatactggttatgcaaatgctgcttttgatcaagaacgcagttgctcatatctggcgaagatgatcattttgcatgactatccacttcacattgttcaacagccagccttcactacctttattgacagtctgcagccacgtttcagggttgtagatgttgagacaatggagtgggaggtgtatgctgtttaccagaaagaaaaggaaaacctcatgcaagcattcaacactatgcctggaaggatcagcctcgctattggattgtggacaactagccaaactcttggctatgtttcacttgctgggcagtttattgactctgagtggaagatgcatcgaagaatgctaaacttcatgatggtgtcttctcctcattcagagaatgcacttagtgaagctattagtacaagcctttcagactggaatatgaaggacaaactattcaccatcacattggacaatgattgctcatcacatgatatatacagtgcgaatctgagggattatctctccaacaagaacaacctcatgctcaagggccaactatttgttgtaaggtgttatgcccatatcctgaatgcagttgctcaggatgtcattgcttcaattcatggtgtcatctataatatccgcgaaagcattaagttcataaaagcttctcctagctgtgaggagaagtttgcagagattgctctgcaactagagatcccaagtaccaagaccctttgtctggatgttacgacacagtggaacactacctatctcatgctgctggctgccttggattataagcaggccttttctactctagagacaagtgatgataactacaacgaggcaccgtccgctgaggactggaaaaaagttgaggctgcctgcaattacttgaagctattgtatgactcagcacatagcatcatggctgcagcaaatccaacttcaaatctctttttccatgaggcatggaaacttcagctcgagctgtcaaatgccacagggcgtgaagaccctgttttcagcagcattgccaaggatatgcacgagagatttgacaagtactggaaagattgcaaccttgtgttagctattgctgttgtgatggatccgcgcttcaagatgaagctcgttgagttcagctactcgaaaatttatggtgttgaagctgcgaaatatgttaaggtggtggatgatgctgttcatgagctctacaacgagtatgttgcacagcccctccccttaacgccggcttacgttgagcaagggggaggtaataatgcacctgctagcgagaatagtactcaagcaactgctccttcaaccggcgatggacttgtggacttcgatatgtacctttctgagatagctacaagccagccaacaaaatctgaactggaacagtacctggatgagtccctcactccgcgcatccaggaatttgacattctgaactggtggaagctcaacactctcaagtaccctactctctcaaagatggcccgggatatcttggccattccgatgtcgatggtgagcagcggcaactctattttctctgctggaactggaactcgcatgcttgatgactacagaagctcatcgcgtccagaaattgtggaggcgctcgtttgtgccaaagactggcttcagtatttaccagctaccccggaggcaccgagtacagcgctggtcaaggtggatgcagcataggctcgccgtgattccccctttttgtgaagcaacagcatcttatgtgtattttaggcagggattatgaactgattgtgatctgagcttatcctcctagggtgtaatttgttgtattgaactctgttaactctttcatgttgttatgtacgctttgtctgtagtatgccatcagagttgtacctgacattgcatgtagtgtgtgcgctggctgcgtaatgtgtatcagttggtgccttatgttcgtacttcccttaattatcatcctttgtaggcttgtagcatgcggtggtggtttgcggacggcttgccgtgcccgtcgacaaaagcatcgggcaacaggtgaagaagccgcagcagcaggcgttaactgtaagtacgtcctagcacggtgtatttttaatcctaaattgtttcaaattctaagtacatgtgttgaatatatgaaatgatctattgcttttgtttcgaataagacagaatttctg

SEQ ID NO: 4919 - DNA, 2812 bp, Hordeum vulgare
caaagctcgaggtttagcgtttgagctgtgtgcactttctagtccaattaaaccttgtatttctagtatttatctgtaatgtggtccgtattaattcctttcaagttgcgtgaatgactggatattaatcaaactttattttgcttctttttggtcaagtaagacatagccggggctctggcatctgactttaccatgttatgtatgccagattttgggacttccagcatggctgatgaaactggcaatgacagtcagatggtcgaaggtaatgagattgttgaccctggtaatgaggtagtccatggtggcgagttggtcgaagttgatgaattagctcaaggtgatgagttagctcaaggtgaggacttaacacaggttgatgaattgctccaagggaatgagatggccatcactgaggtggccactcctccaaccacgaggcgccggagaaagaagtccctggtgtgggagcacttcactatcgaagatgctgctggaggggccactcgggcttgctgcaaactttgcaagcaaacctttgcgtacagctctggttcaaaaattgctgggactagccatctcaagaggcacatcaccttgggttcctgtcctaagataaaaggccaagggcataagctagcaatcacaattgggactgacaatgatggtgatggtactgtggagaggcggtctaagaggcgttacagatatactggttatgcgaatgcgtctttcaatcaagaccgcagttgttcatacttggcaaagatgatcattttgcatgactacccgctccacattgttcagcaaccagccttcactgcttttattgatagtctgcagcctcgtttcagggttgctgatgttgatgcaatggaggtggaggtgtatgctgtttatcagaaagaaaaagagaaccttttgcaagcattcagcaccatgcctggaaggatcagcctcactattggattgtggacaactagtcaaactcttggctatgtttcagtttctgggcagttcattgactctgaatggaaattacatcgaagaatgcttagcttcatgatggtgtcttcgcctcattcggagaatgcacttagtgaagctattagctcaagccttactgactggagtatgaaggagaagctatttaccatcacgttggataatgattgctcatctcatgatatatacagtgcaaatcttagagattatctctccagtaagaataaccacatgcttaagggccagctgtttgttgtgaggtgctatgcccatatcctgaatgcagttgcagaagatgtcattgctttaatccacggtgtcatctacagtatccgtgaaagcataaagttcataaaagcttctcctagtcgcgaggaaaagttcgctgagattgctctgcagctggagatccccagtacgaagaccctttgtctggatgttacaacccagtggaacacaacctatctgatgctcttggccgccttggattataggcaggctttcattacactagaaacagttgatgataactacaatgaagcaccttcagctgaggactggaagaaaattgaggctgcctgcaattacttgaggctgctctatgactcggctcatagcatcatggcagcaggaaacccaacctcaaacattttcttccatgaagcttggaaactgcagctagagctggcaaatgcttcagcacacgaagatccaattttcagtagcgttgccaaagatatgtatgagaagtttgacaaatactggaaagattgcaaccttgtgttggctgttgctgttgtgatggatccacgttttaagatgaagcttgttgagttcagttactcaaagatttatggagttgaggctgcgaagtatgtcaaggtggtaaatgattctgtgcatgacctttttaaggattatgttgcacagccgctccccttaacaccggcctatgttgaacaagggaaaactgataatgttactgccaatgggaacaacacccaagcaactcaaccttcaactggtgatggtcttcaagactttgatatatatctttctgagattgctacaacccagccctcaaaatctgaactagagcagtacctggacgagtctctcactcctcgtatccaagagtttgacattcttaactggtggaagctcaacacgctcaagtatccgacgctctcaaagatggcgcgggatatcttgtccattccggtgtccatggtgaccggcggcagctctattttttctgcaggaacaggaggccacatgctcgatgactacagaagctcgctccgtccggagatcgtggaggcgcttgtctgtgcgaaagactggcttccgtattcgaccacagcaccagtggcgctgggctctgagcttctcaagatggactaggcgtgcttcctcgctgaagcatgcacatatcttctggtgcctgtgagtggtctctttaaccgtagtcgtattttaggcagagtttgtggactggctgcgatggatttcattggttctgtcctagaatataatttgatgtgtagaactctgttaactcctccatgccgctatgtgcccctctcttggtgttgtaatgtgtgatcagagatgttatctggcgttgtttgggattgtgtatttaccagcaacgtaatgtaccagccggtggtttatgtgtgtgcttccgtttttgtgtgtgattgtggtgactttgttggagttggccttggcccttttggtcatattgggcttcaaatcgatggccccagcattctttttgaaccaggcatcgtcccttttc

SEQ ID NO: 4920 - DNA, 2576 bp, Festuca arundinacea
ccccgagttggatctccgctccacctccgcccctcccctccattttgtgacccctggtactagtctaccagcatggctgatgaagctggcaatgacagtcaggtggtccaaggtaatgagactgttgacccaagtaacgaggcaggccatgaggatgcaatgatccatggaaatgagttggtccaagttgatgagatgactcaaggtgatgagatgggtcaaggtgaggagttgacacagggcgaagagttgcttgaagggcatgagttggccatcgctgaggtggccacccctccaactacgaggcgcaggaaaaagaagtccctagtgtgggagcacttcactattgaggatgctgctggaggagccactcgggcatgctgtaaactgtgcaagcaaacctttgcttacagctctggtccaaaaattgcaggtactagtcatctcaagagacacatcaccttgggttcctgtcctaagataaaaagccaagagcataagatagcactggcctcaacaattggaactgacaatgatggtgattgtactgtggagaggcggtctaagaggcgttacagatatactggttatgcaaatgcgtcttttgatcaagaccgcagttgttcgtacctggcaaagatgatcattttgcatgactacccactccacattgttcagcagccaaccttcactgctttcattgatagtctgcagccccgtttcagggttgctgatgttgacacaatggagggggaggtgtatgctgtttatcaaagagaaaaagagggtctcttgcaagcattcagcactatgcctggaaggatcagcctcactattggattgtggacaactagtcaaactcttggctatgtttcacttgctgggcagttcattgactctgattggaaattacatcgaagaatgcttaacttcatgatggtgtcttcgcctcattcagagaatgcactcagtgaagctattagtgcaagtcttactgactggagtatgaaggataagctatttaccatcacactggataatgattgcccatcgcatgatatctacagtgcaaatctgagagaccatctctccagtaagaacgacctctcgcttaagggccaactatttgttgtgaggtgctatgcccacatcctgaatgcagttgcacaagatgtcattgcttcaatccacggtgtcatctacaatatccgtgaaagcataaagttcataaaagcttctcctaatcgtgaggaaaagttcgctgagattgctctgcagctggagatccccagtaccaagaccctctgtctggatgttacaacccagtggaacaccacctatctgatgctcttggctgccttggattataaggaggctttcactcaactagaaacatgtgatgataactacaatgaagcaccttcgtttgaggactggaaaaaagttgaggcggcctgcaattacttgaggctgctgtatgactcggctcacagcataatggcagcgggaaacccaacctcaaacatctttttccatgaagcttggaaacttcagctggagctggcaaatgcttcaggacatgaagacccagttttcagtatcattgccaaagatatgcatgagaggtttgacaagtactggaaggattgcaacctcgtgctatctgttgctgttgtgatggatccacgttttaagatgaagcttgttgagttcagttactcgaagatttatggcgtcgaggctgcgaagtatgttaaggtggtaaatgattcagtgcatgagctttttaaggactatgtagcacagccactccctgagcaaggagcaactaatcatgcagctgccaatgggaataacacccatgcaaatcagccttcaactggtgatggtcttctagactttgatatgtatctttctgagattgccacaagccagccctcaaaatctgaactagagcagtacctggatgaatccctcactccgcgtatccaagagtttgacattctgaactggtggaagcttaacacactcaagttcccaacgctctcgaggatggcacgtgatatcttggcaattccaatgtccatggcgaccaatggcagctccatattttctgcaggaacaggaacccgcatgctcgatgattacagaagctcgctccggccggaaatcgtggaggcgcttgtctgcgcgaaggactggcttccgtattcgaccactgcaccggaggcgccgagttccgggctgcttggcaagatggagtaggctcgcttccttgctggggcatgcatatatttcaggtacctatgggcggtctttaactgtaggtgtatttgggccagagtttgtgaagtgactgatcaatgtcattggttctgtcctagaatgcaatttgctgtgtagaactctgttaactcctccatgctgttatgtaccctttcatgtgccgtgtaacctgtgtgttgtaatatgtgaccagagatatttatctgccgttgcttgtgactggtcgtgtacaagcaacgtaatgtattagcctgtggcataagattgtgctcaaaaaaaaaaaaaaaaaa

SEQ ID NO: 4921 - DNA, 2790 bp, Triticum aestivum
aaaaaccagatctacaatctcgcactgcgcctcgctcggccttgcgcttcttgggccgagccctagctggggcgcccccgatcatctcctcctcccatctcgctctcagttttgggacttccagcatggctgatgaaactggcaatgacagtcagatgttcgaaggtaatgagattgttgaccctggtaatgaggcagtccaaggtggcgagttggtcgaagttgatgaactagctcaaggtgatgagttggctcaaggcgaggacttaacacagggtgacgaattgctccaagggaatgagatggccatcactgaggtggccactcctccaaccacgaggcgccggagaaagaagtccctggtgtgggagcacttcactattgaagatgctgctggaggggccactcgggcttgctgcaaactttgcaagcaaacctttgcgtacagctctggttcaaaaattgctgggactagccatctcaagaggcacatcaccttgggttcctgtcctaagataaaaggccaagggcataagctagcaattacaattgggactgacaatgatggtgatggtactgtggagaggcggtctaagaggcgttacagatatactggttatgcgaatgcgtcttttgatcaagaccgcagttattcatacttggcaaagatgatcattttgcatgactatccgctccacattgttcaacaaccagccttcactgcttttattgatagtctgcagcctcgtttcagggttgttgatgttgatgcaatggaggtggaggtttatgctgtttatcagaaagaaaaagagaaccttttgcaagcattcagcgctatgcctggaaggatcagcctcaccattggattgtggacaactagtcaaactcttggctatgtttcagtttctgggcagttgattgactctgaatggaaattacatcgaagaatgcttagcttcatgatggtgtcttcgcctcattcggacaatgcacttagtgaagctattagctcaagccttactgactggggtatgaaggagaagctatttaccatcacgttggataatgattccttatctcatgacatctacagtgcaaatctgagagatcagctctccagtaagaataacctcatgcttaagggtcagctatttgttgtgaggtgctatgcccatatcctggatgcggctgcacaagatgtcattgctttaatccacggtgtcatctacagcatccgtgaaagcataaagttcataaaagcttctcctagtcgtgaggaaaagtttgctgagattgctctgcagctggagatccccagtacgaagaccctttgtctggatgttacaacccagtggaacacaacctatctgatgctcttggctgccttggattataggcaggctttcattacactagaaacagttgatgaaaactacaatgaagcaccttcagctgaggactggaaaaaattgaggctgcctgcaattacttgaggctgctctatgactcggctcatagcatcatggcagcaggaaacccaacctcaaacattttcttccatgaagcttggaaactgcagctagagctgggaaatggttcagcacacgaagatccaattttcagtagcatcgccaaagacatgtatgagaggtttgacaaatactggaaagattgcaaccttgtgttagctgttgctgttgtgatggatccacgttttaagatgaagcttgttgagttcagttactcaaagatttacggcgttgaggctgcaaagtatgttaaggtggtaaatgattcggtgcatgacctttttaaggattatgtggcacagccgctccccttaacaccggcctatgctgaacaagggaaaactgataatgctactgccaatgggaacaacacccaagcaactcaaccttcaactggtgatggccttcaagactttgatatatatctttctgagattgctacaacccagccctcaaaatctgagctagagcagtacctggacgagtctcttactcctcgcatccaagagttcgacattctcaattggtggaagctcaacatgcagaagtatccgacgctctcaaagatggcgcgggatatcttggccatcccagtgtccatggtgaccggcggcacctctatattttctgcaggaacagggtgccatgtgctcgacgactacagaagctcgctccgtccggaaatcgtggaggcgctcgtctgtgcaaaggactggcttccgaattcgaccgccgcaccggaggccgtgccgggctctgggcttctcaagatggactaggctcgcttcctttgctgaagcatgcatatatatcttctggtgcctgtgagtggtcctttaaccgtagtgtattttaggcagagtttgtggactggctgcgatcgatgatttcattggaatctgtcctagaatgtaatttgtcgtgtagaactctgttaactcctcatccatgctgttatgtccgccccttccttgtgttgtaatatgtgaccagagatgttatctcacgttgctagggatgtgtatggccctacaagcaacgtaatgtaccagccagtgggttgtgtttgtgcttcagttttttttttgtgtggttgtgatgactttggtggagttagctctagcatttggtttctctcactttctacccatgtaaattcttccacggatcccataattatcatccggttcgcctgttcttgctcgtcctgctccggctcttggagccaccggctatctcgttctcctccagagctacc

SEQ ID NO: 4922 - DNA, 2563 bp, Secale cereale
cggctcccccgtcccccacctcgctcgccccccgcgaaaaccagatctgcaatctcacaccgcgccccgctcggccttggtgcttcttgggccgagccccagccactcccgatcatctcctcctcccatctcgctctccgtaaattttgggacttccggcatggctgatgaaactggtaatgacagtcagatgttcgaaggtaatgagattgttgaccctggtaatgaggcagtccatggtgatgaggcagtccaaggtggcgagttggtcgaagttgatgaactagctcaaggtgatgagttggctcaaggcgaggacttaacacagggtgacgaattgctccaagggaatgagatggccatcactgaggtggccactcctccaaccacgaggcgccggagaaagaagtccctggtgtgggagcacttcactatcgaagatgctgctggaggggccactcgggcttgctgcaaactttgcaagcaaaccttcgcgtacagctctggttcaaaaattgctgggaccagccatctcaagaggcacatcaccttgggttcctgtcctaagataaaaggccaagggcataagctagcaattacaattgggactgacaatgatggtgatggtactgtggagaggcggtctaagaggcgttacagatatactggttatgcgaatgcgtcttttgatcaagaccgcagttattcatacttggcaaagatgatcattttgcatgactacccgctccacattgttcaacaaccagccttcactgcttttattgatagtctgcagcctcgtttcagggttgttgatgttgatgcaatggaggtcgaggtttatgctgtttatcagaaagaaaaagagaaccttttgcaagcattcagcgctatgcctggaaggatcagcctcaccattggattgtggacaactagtcaaactcttggctatgtttcagtttctgggcagttcattgactctgaatggaagttacatcgaagaatgcttagcttcatgatggtgtcttcgcctcattcggacaatgcacttagtgaagctattagctcaagccttactgactggggtatgaaggagaagctgtttaccatcacgttggataatgattccttatctcatgacatctacagtgcaaatctgagagatcagctctccagtaagaataacctcatgcttaagggtcagctatttgttgtgaggtgctatgcccacatcctggatgcggctgcacaagatgtcattgctttaatccacggtgtcatttacagcatccgtgaaagcataaagttcataaaagcttctcctagtcgtgaggaaaagtttgctgagattgctcttcagctggagatccccagtacgaagaccctttgtctggatgttacaacccagtggaacacaacctatctgatgctcttggctgccttggattataggcaggctttcattacactagaaacagttgatgataactacaatgaagcaccttcggccgaggactggaaaaaattgaggctgcctgcaattacttgaggctgctctatgactcggctcatagcatcatggcagcaggaaacccaacctcaaacattttcttccatgaagcttggaaactgcagctagagctgggaaatggttcagcacacgaagatccaattttcagtagcatcgccaaagacatgtatgagaggtttgacaaatactggaaagattgtaaccttgtgttagctgttgctgttgtgatggatccacgttttaagatgaagctagttgagttcagttactcaaagatttacggcgttgaggctgcgaagtatgttaaggtggtaaatgattcggtgcatgacctttttaaggattatgttgcacaaccgctccccttaacaccggtctatgctgaacaagggaaaactgataatgctactgccaatgggaacaacacccaagcaactcaaccttcaactggtgatggtcttcaagactttgatatatacctttctgagattgctacaacccagccttcaaaatctgaattagagcagtacctggacgagtctctcactccccgcatccaagagtttgacattcttaactggtggaagctcaacatgcaaaagtatccgacgctctcaaagatggcgcgggatatcttggcgatcccggtgtccatggtgaccggcggcagctctatattttccgcaggaacaggatgccacgtgctcgacgactacagaagctcgctgcgtccggaaatcgtggaggcgctcgtctgtgccaaggactggcttccgaattcgaccgccgcaccagaggcgccgggctctgggcttctcaagatggactaggctcgcttcctttgctggagcatgcatatatatcttctggtgcctgtgagtggtctctttaaccgtagtcgtattttaggcagagtttgtggactggctgtggtcgatttcattgaatctgtcctagaatgtaatttgtcgtgtagaactctgttaactcctccatgctgttatgtcccacccttccttatgttgtaatatg

SEQ ID NO: 4923 - DNA, 2609 bp, Secale cereale
agatctgcaatctcacaccgcgccccgctcggccttggtgcttcttgggccgagccccagccactcccgatcatctcctcctcccatctcgctctccgtaaattttggggcttccagcatggctgatgaaactggcaatgacagtcagatgttcgaaggtaatgagattgttgaccctggtaatgaggcagtccatggtgatgaggcagtccaaggtggcgagttggtcgaagttgatgaactagctcaaggtgatgagttggctcaaggcgaggacttaacgcagggtgacgaattgctccaagggaatgaaatggccatcactgaggtggccacgcctccaaccacgaggcgccggagaaagaagtccctggtgtgggagcacttcactatcgaagatgctgctggaggggccactcgggcttgctgcaaactttgcaagcaaaccttcgcgtacagctctggttcaaaaattgctgggactagccatctcaagaggcacatcaccttgggttcctgtcctaagataaaaggccaagggcataagctagcaattacaattgggactgacaatgatggtgatggtactgtggagaggcggtctaagaggcgttacagatatactggttatgcgaatgcgtcttttgatcaagaccgcagttattcatacttggcaaagatgatcattttgcatgactacccgctccacattgttcaacaaccagccttcactgcttttattgatagtctgcagcctcgtttcagggttgttgatgttgatgcaatggaggtcgaggtttatgctgtttatcagaaagaaaaagagaaccttttgcaagcattcagcgctatgcctggaaggatcagcctcaccattggattgtggacaactagtcaaactcttggctatgtttcagtttctgggcagttcattgactctgaatggaagttacatcgaagaatgcttagcttcatgatggtgtcttcgcctcattcggacaatgcacttagtgaagctattagctcaagccttactgactggggtatgaaggagaagctgtttaccatcacgttggataatgattccttatctcatgacatctacagtgcaaatctgagagatcagctctccagtaagaataacctcatgcttaagggtcagctatttgttgtgaggtgttatgcccacatcctggatgcggctgcacaagatgtcattgctttaatccacggtgtcatctacagcatccgtgaaagcataaagttcataaaagcttctcctagtcgcgaggaaaagtttgctgagattgctctgcagctggagatccccagtacgaagaccctttgtctggatgttacaacccagtggaacacaacctatctgatgctcttggctgccttggattataggcaggctttcattacactagaaacagttgatgataactacaatgaagcaccttcagctgaggactggaaaaaaattgaggctgcctgcaattacttgaggctgctctatgactcggctcatagcatcatggcagcaggaaacccaacctcaaacattttcttccatgaagcttggaaactgcagctagagctgggaaatggttcagcgcacgaagatccaattttcagtagcatcgccaaagacatgtatgagaggtttgacaaatactggaaagattgcaaccttgtgttagctgttgctgttgtgatggatccacgttttaagatgaagcttgttgagttcagttactcgaagatttacggcgttgaggctgcgaagtatgttaaggtggtaaatgattcggtgcatgacctttttaaggattatgttgcacagccgctccccttaacaccggtctatgctgaacaagggaaaagtgataatgctactgccaatgggaacaacacccaagcaactcaaccttcaactggtgatggtcttcaagacttcgatatatacctttctgagattgctacaacccagccttcaaaatctgaattagagcagtacctggacgagtctctcactccccgcatccaagagtttgacattcttaactggtggaagctcaacatgcaaaagtacccgacgctctcaaagatggcgcgggatatcttggccatcccggtgtccatggtgaccggcggcagctctatattttccgcaggaacaggatgccacgtgctcgacgactacagaagctcgctccgtccggaaatcgtggaggcgctcgtctgtgccaaggactggcttccgaattcgaccgccgcaccggaggcgccgggctctgggcttctcaagatggactaggctcgcttcctttgctggagcatgcatatatatcttctggtgcctgtgagtggtctctttaaccctagtcgtattttaggcagagtttgtggactggctgtggtcgatttcattgggtctgtcctagaatgtaatttgtcgtgtagaactctgttaactcctccatgctgttatgtcccaccccttccttatgttgtaatatgtgaccagagatgttatctgacgtttgcttgggatgtgtatggccctacaagcaacgtaatgtaccagccggtggcttatgtttgtg

SEQ ID NO: 4924 - DNA, 2802 bp, Secale cereale
gactcgctcgccccccgcaaaaaccagatctgcaatctcacaccgcgccccgctcggccttggtgcttcttgggccgagccccagccaatcccgatcatctcctcctcccatctcgctctccgtaaattttgggacttccagcatggctgatgaaactggcaatgacagtcagatgttcgaaggtaatgagattgttgaccctggtaatgaggcagtccatggtgatgaggcagtccaaggtggcgagttggtcgaagttgatgaactagctcaaggtgatgagttggctcaaggcgaggacttaacacagggtgacgaattgctccaagggaatgagatggccatcactgaggtggccactcctccaaccacgaggcgccggaggaagaagtccctggtgtgggagcacttcactatcgaagatgctgctggaggggccactcgggcttgctgcaaactttgcaagcaaaccttcgcgtacagctctggttcaaaaattgctgggactagccatctcaagaggcacatcaccttgggttcctgccccaagataaaaggccaagggcataagctagcaattacaattgggactgataatgatggtgatggtactgtggagaggcggtccaagaggcgttacagatatactggttatgcgaatgcgtcttttgatcaagaccgcagttattcatacttggcaaagatgatcattttgcatgactacccgctccacattgttcagcaaccagccttcactgcttttattgatagtctgcagcctcgtttcagggttgttgatgttgatgcaatggaggtggaggtttatgctgtttatcagaaagaaaaagagaaccttttgcaagcattcagcgctatgcctggaaggatcagcctcaccattggattgtggacaactagtcaaactcttggctatgtttcagtttctgggcagttcattgactctgaatggaaattacatcgaagaatgcttagcttcatgatggtgtcttcgcctcattcggacaatgcacttagtgaagctattagctcaagccttactgactggggtatgaaggagaagctgtttaccatcacgttggataatgattccttatctcatgacatctacagtgcaaatctgagagatcagctctccagtaagaataacctcatgcttaagggtcagctatttgttgtgaggtgctatgcccacatcctggatgcggctgcacaagatgtcattgctttaatccacggtgtcatttacagcatccgtgaaagcataaagttcataaaagcttctcctagtcgtgaggaaaagtttgctgagattgctcttcagctggagatccccagtacgaagaccctttgtctggatgttacaacccagtggaacacaacctatctgatgctcttggctgccttggattataggcaggctttcattacactagaaacagttgatgataactacaatgaagcaccttcagctgaggactggaaaaaaattgaggctgcctgcaattacttgaggctgctctatgactcggctcatagcatcatggcagcaggaaacccaacctcaaacattttcttccatgaagcttggaaactgcagctagagctgggaaatggttctgcacacgaagatccaattttcagtagcatcgccaaagacatgtatgagaggtttgacaaatactggaaagattgtaaccttgtgttagctgttgctgttgtgatggatccacgttttaagatgaagcttgttgagttcagttactcaaagatttacggcgttgaggctgcgaagtatgttaaggtggtaaatgattcggtgcatgacctttttaaggattatgttgcacagccgctccccttaacaccggtctatgctgaacaagggaaaactgataatgctactgccaatgggaacaacacccaagcaactcaaccttcaactggtgacggtcttcaagactttgatatatacctttctgagattgctacaacccagccctcaaaatctgaactagagcagtacctggacgagtctctcactcctcgcatccaagagtttgacattctgaactggtggaagctcaacatgcaaaagtacccgacgctctcaaagatggcgcgggatatcttggccatcccggtgtccatggtgaccggcggcagctctatattttccgcaggaacaggatgccacgtgctcgacgactacagaagctcgctccgtccggaaatcgtggaggcgctcgtctgtgccaaggactggcttccgaattcgaccgccgcaccggaggcgccgggctctgggcttctcaagatggactaaggctcgcttcctttgctggagcatgcatatatatcttctggtgcctgtgagtggtctttttaaccgtagtcgtactttaggcggagtttgtggactggctgtggtcgatttcattgggtctgtcctagaatgtaatttgtcgtgtagaactctgttaactcctccatgctgttatgtcccaccccttccttatgttgtaatatgtgaccagagatgttatctgacgtttgcttgggatgtgtatggccctacaagcaacgtaatgtaccagccggtggcttatgtttgtgcttccgtttttttgcgtaagaaaaaaaaaaaaaaaaaaacaaaaaaaaaaaaaacaaaaaaaaaaaaacaaaaaaaaacaaaaaaaaacaaaaacacacacacacacacacacacacatagacacgactacgacagtagacgacagtacgagacagaccgagcagcg

SEQ ID NO: 4925 - DNA, 2584 bp, Secale cereale
cccgcaaaaaccagatctgcaatctcacaccgcgccccgctcggccttggtgcttcttgggccgagccccagccactcccgatcatctcctcctcccatctcgctctccgtaaattttggggcttccagcatggctgatgaaactggcaatgacagtcagatgttcgaaggtaatgagattgttgaccctggtaatgaggcagtccatggtgatgaggcagtccaaggtggcgagttggtcgaagttgatgaactagctcaaggtgatgagttggctcaaggcgaggacttaacacagggtgacgaattgctccaagggaatgagatggccatcactgaggtggccacgcctccaaccacgaggcgccggagaaagaagtccctggtgtgggagcacttcactatcgaagatgctgctggaggggccactcgggcttgctgcaaactttgcaagcaaaccttcgcgtacagctctggttcaaaaattgctgggactagccatctcaagaggcacatcaccttgggttcctgtcccaagataaaaggccaagggcataagctagcaattacaattgggactgacaatgatggtgatggtactgtggagaggcggtctaagaggcgttacagatatactggttatgcgaatgcgtcttttgatcaagatcgcagttattcatacttggcaaagatgatcattttgcatgactacccgctccacattgttcaacaaccagccttcactgcttttattgatagtctgcagcctcgtttcagggttgttgatgttgatgcaatggaggtggaggtttatgctgtttatcagaaagaaaaggagaaccttttgcaagcattcagcgctatgcctggaaggatcagcctcaccattggattgtggacaactagtcaaactcttggctatgtttcagtttctgggcagttcattgactctgaatggaaattacatcgaagaatgcttagcttcatgatggtgtcttcgcctcattcggacaatgcacttagtgaagctattagctcaagccttactgactggggtatgaaggagaagctgtttaccatcacgttggataatgattccttatctcatgacatctacagtgcaaatctgagagatcagctctccagtaagaataacctcatgcttaagggtcagctatttgttgtgaggtgttatgcccacatcctggatgcggctgcacaagatgtcattgctttaatccacggtgtcatctacagcatccgtgaaagcataaagttcataaaagcttctcctagtcgtgaggaaaagtttgctgagattgctctgcagctggagatccccagtacgaagaccctttgtctggatgttacaacccagtggaacacaacctatctgatgctcttggctgccttggattataggcaggctttcattacactagaaacagttgatgataactacaatgaagcaccttcagctgaggactggaaaaaaattgaggctgcctgcaattacttgaggctgctctatgactcggctcatagcatcatggcagcaggaaacccaacctcaaacattttcttccatgaagcttggaaactgcagctagagctgggaaatggttctgcacacgaagatccaattttcagtagcatcgccaaagacatgtatgagaggtttgacaaatactggaaagattgcaaccttgtgttagctgttgctgttgtgatggatccacgttttaagatgaagcttgttgagttcagttactcgaagatttacggcgttgaggctgcgaagtatgttaaggtggtaaatgattcggtgcacgacctttttaaggattatgttgcacagccgctccccttaacaccggtctatgctgaacaagggaaaactgataatgctactgccaatgggaacaacacccaagcaactcagccttcaactggtgacggtcttcaagactttgatatatacctttctgagattgctacaacccagccctcaaaatctgagctagagcagtacctggacgagtctctcactccccgcatccaagagtttgacattcttaactggtggaagctcaacatgcaaaaatatccgacgctctcaaagatggcgcgggatatcttggccatcccggtgtccatggtgaccggcggcagctctatattttccgcaggaacaggatgccacgtgctcgacgactacagaagctcgctccgcccggaaatcgtggaggcgctcgtctgtgccaaggactggcttccgaattcgaccgccgcaccggaggcgccgggctctgggcttctcaagatggactaaggctcgcttcctttgctggagcatgcatatatatcttctggtgcctgtgagtggtctttttaaccgtagtcgtactttaggcggagtttgtggactggctgtggtcgatttcattggatctgtcctagaatgtaatttgtcgtgtagaactctgttaactcctccatgctgttatgtcccacccttccttatgttgtaatatgtgaccagagatgttatctgacgtttgcttgggatatgtatggccctaca

SEQ ID NO: 4926 - DNA, 2621 bp, Triticum aestivum
aaaaccagatctacaatctcacactgcgcctcgctcggccttggtgcttcttgggccgagccctagctagccactccgcgctccctcccgatcatcctccccctctcgctctccattttgggacttccagcatggctgatgaaactggcaatgacagtcagatgttcgaaggtaatgagattgttgaccctggtaatgaggcagtccatggtgatgaggcagtccaaggtggcgagttggtcgaagttgatgaactagctcaaggtgatgagttggctcaaggcgaggacttaacacagggtgacgaattgctccaagggaatgagatggccatcactgaggtggccactcctccaaccacgaggcgccggagaaagaagtccctggtgtgggagcacttcactatcgaagatgctgctggaggggccactcgggcttgctgcaaactttgcaagcaaaccttcgcgtacagctctggttcaaaaattgctgggactagccatctcaagaggcacatcaccttgggttcctgtcctaagataaaaggccaagggcataagctagcaattacaattgggactgacaatgatggtgatggtactgtggagaggcggtctaagaggcgttacagatatactggttatgcgaatgcggcttttgatcaagaccgcagttattcatacttggcaaagatgatcattttgcatgactacccgctccacattgttcaacaaccagccttcactgcttttattgatagtctgcagcctcgtttcagggttgttgatgttgatgcaatggaggtggaggtttatgctgtttatcagaaagaaaaagagaaccttttgcaagcattcagcgctatgcctggaaggatcagcctcaccattggattgtggacaactagtcaaactcttggctatgtttcagtttctgggcagttcattgactctgaatggaaattacatcgaagaatgcttagcttcatgatggtgtcttcgcctcattcggacaatgcacttagtgaagctattagctcaagccttactgactggggtatgaaggagaagctatttaccatcacgttggataatgattctttatctcatgacatctacagtgcaaatctgagagatcagctctccggtaagaataacctcatgcttaagggtcagctatttgttgtgaggtgctatgcccatatcctggatgcggctgcacaagatgtcattgctttaatccacggtgtcatctacagcatccgtgaaagcataaagttcataaaagcttctcctagtcgtgaggaaaagtttgctgagattgctctgcagctggagatccccagtacgaagaccctttgtctggatgttacaacccagtggaacacaacctatctgatgctcttggctgccttggattataggcaggctttcattacactagaaacagttgatgataactacaatgaagcaccttcagctgaggactggaaaaaaattgaggctgcctgcaattacttgaggctgctctatgactcggctcatagcatcatggcagcaggaaacccaacctcaaacattttcttccatgaagcctggaaactgcagctagagctgggaaatggttcagcacacgaagatccaattttcagtagcatcgccaaagacatgtatgagaggtttgacaaatactggaaagattgcaaccttgtgttagctgttgctgttgtgatggatccacgttttaagatgaagcttgtggagttcagttactcaaagatttacggcgttgaggctgcgaagtatgttaaggtggtaaatgattcggtgcatgaccttttcaaggattatgtcgcacagccgctccccttaacaccggcctatgctgaacaagggaaaactgataatgctactgccaatgggaacaacacccaagcaactcagccttcaactggtgacggccttcaagactttgatatatatctttctgagattgccacaacccagccctcaaaatctgaactagagcagtacctggacgagtctctcactcctcgcatccaagagtttgacattcttaactggtggaagctcaacatgcaaaagtatccgacgctctcaaagatggcgcgggacatcttggccatcccagtgtccatggtgaccggcggcacctctatattttctgcaggaacaggatgccacgtgctcgacgactacagaagctcgctccgtccggaaatcgtggaggcgctcgtctgtgcgaaggactggcttccgaattcgaccgccgcaccggaggcgctgggctctgggcttctcaagatggactaggctctcttcctttgctgaagcatgcatatatatcttctggtgccttggagtggtcctttaaccgtagtcgtattttaggcagagtttgtggactggctgcgatcgatcgatttcattggatctgtcctagaatgtaatttgtcgtgtagaactctgttaactccatgctgttatgtccaccaccccttccttatgttgtaatatgtgaccagagatgttatctgacgttgcttgggatgtgtatgtaccagcaacgtaatgtaccagccggtggattatgtttgtgct

SEQ ID NO: 4927 - DNA, 2628 bp, Secale cereale
ttgggggtcccccgcaaaaaccagatctgcaatctcacaccgcgccccgctcggccttggtgcttcttgggccgagccccagccactcccgatcatctcctcctcccatctcgctctccgtaaattttgggacttccggcatggctgatgaaactggcaatgacagtcagatgttcgaaggtaatgagattgttgaccctggtaatgaggcagtccatggtgatgaggcagtccaaggtggcgagttggtcgaagttgatgaactagctcaaggtgatgagttggctcaaggcgaggacttaacacagggtgacgaattgctccaagggaatgagatggccatcactgaggtggccactcctccaaccacgaggcgccggagaaagaagtccctggtgtgggagcacttcactatcgaagatgctgctggaggggccactcgggcttgctgcaaactttgcaagcaaaccttcgcgtacagctctggttcaaaaattgctgggactagccatctcaagaggcacatcaccttgggttcctgtcccaagataaaaggccaagggcataagctagcaattacaattgggactgacaatgatggtgatggtactgtggagaggcggtctaagaggcgttacagatatactggttatgcgaatgcgtcttttgatcaagaccgcagttattcatactcggcaaagatgatcattttgcatgactacccgctccacattgttcaacaaccagccttcactgcttttattgatagtctgcagcctcgtttcagggttgttgatgttgatgcaatggaggtggaggtttatgctgtttatcagaaagaaaaagagaaccttttgcaagcattcagcgctatgcctggaaggatcagcctcaccattggattgtggacaactagtcaaactcttggctatgtttcagtttctgggcagttcattgactctgaatggaaattacatcgaagaatgcttagcttcatgatggtgtcttcgcctcattcggacaatgcacttagtgaagctattagctcaagccttactgactggggtatgaaggagaagctatttaccatcacgttggataatgattccttgtctcatgacatctacagtgcaaatctgagagatcagctctccagtaagaataacctcatgcttaagggtcagctatttgttgtgaggtgctatgcccatattctggatgcggctgcacaagatgtcattgctttaatccacggtgtcatctacagcatccgtgaaagcataaagttcataaaagcttctcctagtcgtgaggaaaagtttgctgagattgctctgcagctggagatccccagtacgaagaccctttgtctggatgttacaacccagtggaacacgacctatctgatgctcttggctgccttggattataggcaggctttcattacactagaaacagttgatgataactacaatgaagcaccttcggccgaggactggaaaaaaattgaggctgcctgcaattacttgaggctgctctatgactcggctcatagcatcatggcagcaggaaacccaacctcaaacattttcttccatgaagcttggaaactgcagctagagctgggaaatggttcagcgcacgaagatccaattttcagtagcatcgccaaagacatgtatgagaggtttgacaaatactggaaagattgcaatcttgtgttagctgttgctgttgtgatggatccacgttttaagatgaagcttgttgagttcagttactcgaagatttacggcgttgaggctgcgaagtatgttaaggtggtaaatgattcggtgcacgacctttttaaggattatgttgcacagccgctccccttaacaccggtctatgctgaacaagggaaaactgataatgctactgccaatgggaacaacacccaagcaactcaaccttcaactggtgatggtcttcaagactttgacatatacctttctgagattgctacaacccagccctcaaaatctgagctagagcagtacctggacgagtctctcactcctcgcatccaagagtttgacattcttaactggtggaagctcaacatgcaaaagtatccgacgctctcaaagatggcgcgggatatcttggccatcccagtgtccatggtgaccggcggcagctctatattttccgcaggaacaggatgccacgtgctcgacgactacagaagctcgctgcgtccggaaatcgtggaggcgctcgtctgtgccaaggactggcttccgaattcgaccgccgcaccagaggcgccgggctctgggcttctcaagatggactaggctcgcttcctttgctggagcatgcatatatatcttctggtgcctgtgagtggtctctttaaccgtagtcgtattttaggcagagtttgtggactggctgtggtcgatttcattgaatctgtcctagaatgtaatttgtcgtgtagaactctgttaactcctccatgctgttatgtcccacccttccttatgttgtaatatgtgaccagagatgttatctgacgtttgcttgggatgtgtatggccctacaagcaacgtaatgtaccagccggtggcttatgtttg

SEQ ID NO: 4928 - DNA, 2451 bp, Secale cereale
ccccccacccaaacgaaactctctcccccatccacctgccacaaaccgcggctccccgtcccccacctcgctcgtcccccgcaaaaaccagatctgcaatctcacaccgcgccccgctcggccttggtgcttcttgggccgagccccagccactcccgatcatctcctcctcccatctcgctctccgtaaattttgggacttccggcatggctgatgaaactggcaatgacagtcagatgttcgaaggtaatgagattgttgaccctggtaatgaggcagtccatggtgatgaggcagtccaaggtggcgagttggtcgaagttgatgaactagctcaaggtgatgagttggctcaaggcgaggacttaacacagggtgatgaattgctccaagggaatgagatggccatcactgaggtggccactcctccaaccacgaggcgccggagaaagaagtccctggtgtgggagcacttcactatcgaagatgctgctggaggggccactcgggcttgctgcaaactttgcaagcaaaccttcgcgtacagctctggttcaaaaattgctgggaccagccatctcaagaggcacatcaccttgggttcctgtcctaagataaaaggccaagggcataagctagcaattacaattgggactgacaatgatggtgatggtactgtggagaggcggtctaagaggcgttacagatatactggttatgcgaatgcgtcttttgatcaggaccgcagttattcatacttggcaaagatgatcattttgcatgactacccgctccacattgttcaacaaccagccttcactgcttttattgatagtctgcagcctcgtttcagggttgttgatgttgatgcaatggaggtggaggtttatgctgtttatcagaaagaaaaagagaaccttttgcaagcattcagcgctatgcctggaaggatcagcctcaccattggattgtggacaactagtcaaactcttggctatgtttcagtttctgggcagttcattgactctgaatggaaattacatcgaagaatgcttagcttcatgatggtgtcttcgcctcattcggacaatgcacttagtgaagctattagctcaagccttactgactggggtatgaaggagaagctatttaccatcacgttggataatgattccttatcccatgacatctacagtgcaaatctgagagatcagctctccagtaagaataacctcatgcttaagggtcagctatttgttgtgaggtgctatgcccatatcctggatgcggctgcacaagatgtcattgctttaatccacggtgtcatctacagcatccgtgaaagcataaagttcataaaagcttctcctagtcgtgaggaaaagtttgctgagattgctctgcagctggagatccccagtacgaagaccctttgtctggatgttacaacccagtggaacacaacctatctgatgctcttggctgccttggattataggcaggctttcattacactagaaacagttgatgataactacaatgaagcaccttcagctgaggactaggaaaaaattgaggctgcctgcaattacttgaggctgctctatgactcggctcatagcatcatggcagcaggaaacccaacctcaaacattttcttccatgaagcttggaaactgcagctagagctgggaaatggttcagcgcacgaagatccaattttcagtagcatcgccaaagacatgtatgagaggtttgacaaatactggaaagattgcaaccttgtgttagctgttgctgttgtgatggatccacgttttaagatgaagcttgttgagttcagttactcgaagatttacggcgttgaggctgcgaagtatgttaaggtggtaaatgattcggtgcatgacctttttaaggattatgttgcacagccgctccccttaacaccggtctatgctgaacaagggaaaactgataatgctactgccaatgggaacaacacccaagcaactcaaccttcaactggtgacggtcttcaagactttgatatatacctttctgagattgctacaacccagccctcaaaatctgagctagagcagtacctggacgagtctctcactcctcgcatccaagagtttgacattcttaactggtggaagctcaacatgcaaaagtatccgacgctctcaaagatggcgcgggatatcttggccatcccggtgtccatggtgaccggcggcagctctatattttccgcaggaacaggatgccacgtgctcgacgactacagaagctcgctgcgtccggaaatcgtggaggcgctcgtctgtgccaaggactggcttccgaattcgaccgccgcaccggaggcgccgggctctgggcttctcaagatggactaaggctcgcttcctttgctggagcatgcatatatatcttctggt

SEQ ID NO: 4929 - DNA, 3426 bp, Panicum virgatum
cggcagcgtcacccatcgcgccaaccgccagctcacgaggcccatcgccgtgggccgcgagcccataaaaatccccgcacccgcggctcggctcgcccgcaaaccacaccagacgcctcccgtctctctctctctacccgctctcgtccagtccttcccccaagaggatctagggtttgcgcggtcggccttcgttcttcttgggccgagccctaatcctgctgcaccggcaccgagcccccggggtggttgttggatcacctccgctgcgccccctctgcatcctccccgtgttcttaggttccgttggcctgtttccccaacatgggtgacccgaacagcattgacaatgcaatggtgcatcacagtgagatggtcgatggcaacggggtgatcaatggcaatgagatggttcatggtagtgaaatgattcatagtaatgagatggtccatggggatgagatgatccatggggatgagatgattcaaggcactgagatgatccatggtaatgacatggttcaagttaatgatctcatccatggtaatgagttggttcaagttaacgacatggtcaatggtgatgagatgatccacagtaatgaattgatcaatgctgagatgaccccacaaaccacatcaagacgtcggaggaagaagtcgcttgtctgggagcacttcactatagaaaacatgccagggggaagctcaagagcatgctgcaatttatgcaagcaaacctttgcgtatagttctggttcaaaaattgcaggcactagccatctcaagaggcacatcacccttggttcctgtcctgttatgaaagaccaagacaggaagttggcactgccaccaccaggaggccctggcactgataatgatggtgagggtgctgtagaacgcccttctaagaggcgctacagatacactggttatgcaaatgctacttttgatcaggaaaggagcttctcttatctggcgaagatgattattttgcatgactacccacttcacattgttcaacagctacccttcactacttttattcagagtctgcaaccccgtttcagggttgtagatgtcgagacaatggagggagaggtgtatgctgtttttcagaaatcaaaggaaaacctgttgcaagcattcagcaccatgccaggaaggatcagcctcactataggactgtggacaaccagtcagactctaggctatgtttcgcttgctgggcagtttatcgactcagaatggaaggtgcaccgaagaatgctcaacttcatgatggtgtcttctcctcattcagagaatgcacttagtgaagctattatcgcaagcctttcagagtggaatatgaaggacatgctattcactatcactttggataatgattgctcttcccatgatatttacagtgcaaatctgagggatcacctctccaataagaacaacctcatgcttaagggacagctgtttgttgtgaggtgctatgcacatatcatgaatgtagttgctcaggatgttattgcttcgattcatggtgtgatttacaacatccgtgagagtatcaagttcataaaagcttctccaagccgtgaggagaggtttgctgagattgctctgaatctggagattcccagtaccaagacactctgtctagatgttacaacccagtggaacaccacttatctgatgctgctggctgccttggactataaacaggctttcgctacactagagacacgtgatgataattacaatgaagctccttcagcggaggattggaagaaagttgaggctgcctgtacttacctgaaactgctatatgactctgcacatagcatcatggcttcagcaaaccctaccgcaaacatctttttccatgaagcttggaaaattcagctagagctagcaaatggtacagaacatgaggatcccattttcagcagcattgccaaggatatgcatgagaggtttgacaaatactggaaagattgcagcctggtgctagcagttgctgttgtcatggatccacgtttcaagatgaagcttgttgagttcagttactcaaaaatttatggtgctgaggctgggaaatatgttaaggtggtaaatgactctctccatgagctgtataaggagtatgtggcacagccactcccattgacccctgcctatgctgagcaaggggaagctaataatgtgactgccagtgcgaatggtactcaaggaaatcctccttccactagtgatggtcttcttgacttcgatatgtacctttctgagattcaaagtagccagcctgcaaaatgtgaactggagcagtacctggaggaatccctcactccacgtatccaggagtttgatatccttaactggtggaaacttaacacgctcaagtttccaactctatcaaagatggcccgggatatcttggccatcccgatgtcgatggttagcagtgggagctctatattctctgctggaactgggaaccgcatgcttgatgactacagaagttctcttcgtccggagattgtggaggcacttgtatgcgcgaaagactggctccagtattcaccagctccaaccgaggtgccaagttctgcgatggtcaagacggaagcatcgtaggttcattgttgttaccgcttccctgttggagcaggcataagtttgtggtaactatgagtgctgtgaacggtaggcatattttaggcagcgattgcagacagattttgatactgttatttaatacctcctagagccctagtgtaatttgtccgtgtcgaactcagtttaacttgccagtgttctttaatgtattgagttgagctgtggtctgaatctgcacactttgtgcgtgtgtggtttgcggggtgtattaggtggtaatttataccagattttggcatctgttactctgccgttcttttcttgtctttaccttttcatactctattgtttgctgctgtccatggttggataaacagtccttttcttttttgctaattaatcataaatgcagataggtgtctacttggtttatatacttcgtaatgcacagaagcatcaacatggttctgtaccatcttctatgtacagctgttcgatatcaattttgaacatgcacctgtagaaatggctacattaatttttatatgctcaccatcggttttcaggtatgttgccctttgtgttcagatgactctcaaaccattggttcttgcatccgaccccagctaaggtgatgtcaggctgatctccttctatcgacaactccattgagtcatgaaatcctgctggggcgccgagcgctccatgcagatcatcgtctacgaggcgcgcaagcagttcctccccgaggagcgcatctggcttaccaatcaaatcatccacaaccccaccgtcaacaagataataacaccc

SEQ ID NO: 4930 - DNA, 2931 bp, Triticum aestivum
tctcacactgcgcctcgctcggccttggtgcttcttgggccgagccctagccactccgcgctccttcccgatcatctcctctcgctctccattttgggacttccagcatggctgatgaaactggcaatgacagtcagatgttcgaaggtaatgagattgttgaccctggtaatgaggcagtccatggtgatgaggcagtccaaggtggcgagctggtcgaagttgatgagctagctcaaggtgatgagttggctcaaggcgaggacttaacacagggtgacgaattgctccaagggaatgagatggccatcactgaggtggccactcctccaaccacgaggcgccggagaaagaagtccctggtgtgggagcacttcactatcgaagatgctgctggaggggccactcgggcttgctgcaaactttgcaagcaaaccttcgcgtacagctctggttcaaaaattgctgggactagccatctcaagaggcacatcaccttgggttcctgtcctaagataaaaggccaagggcataagctagcaattacaattgggactgacaatgatggtgatggtaccgtggagaggcggtcaaagaggcgttacagatatactggttatgcgaatgcggcttttgatcaagaccgcagttattcatacttggcaaagatgatcattttgcatgactacccgctccacattgttcaacaaccagccttcactgcttttattgatagtctgcagcctcgtttcagggtagttgatgttgatgcaatggaggtggaggtttatgctgtttaccagaaagaaaaagagaaccttttgcaagcattcagcgctatgcctggaaggatcagcctcaccattggattgtggacaactagtcaaactcttggctatgtttcagtttctgggcagttcattgactctgactggaaattacatcgaagaatgcttagcttcatgatggtgtcttcgcctcattcggacaatgcacttagtgaagctattagctcaagccttactgactggggtatgaaggagaagctatttaccatcacgttggataatgattccttatctcatgacatctacagtgcaaatctgagagatcagctctccagtaagaataacctcatgcttaagggtcagctatttgttgtgaggtgctatgcccatatcctggatgcggctgcacaagatgtcattgctttaatccatggtgtcatctacagcatccgtgaaagcataaagttcataaaagcttctcctagtcgtgaggaaaagtttgctgagattgctctgcagctggagatccccagtacgaagaccctttgtctggatgttacaacccagtggaacacaacctatctgatgctcttggctgccttggattataggcaggctttcattacactagaaacagttgatgacaactacaatgaagcaccatcagctgaggactggaaaaaattgaggctgcctgcaattacttgaggctgctctatgactcggctcatagcatcatggcagcaggaaacccaacctcaaacattttcttccatgaagcttggaaactgcagctagagctgggaaatggttcagcacacgaagatccaattttcagtagcatcgccaaagacatgtatgagaggtttgacaaatactggaaagattgcaaccttgtgttagctgttgctgttgtgatggatccacgttttaagatgaagcttgttgagttcagttactcaaagatttacggcgttgaggctgcgaagtatgttaaggtggtaaatgattcggtgcatgaccttttcaaggattatgtcgcacagccgctccccttaacaccgacctatgctgaacaagggaaaactgataatgctactgccaatgggaacaacacccaagcaactcaaccttcagctggtgatggccttcaagactttgatatatatctttccgagattgccacaacccagccctcaaaatctgagctagagcagtacctggacgagtctctcactcctcgcatccaagagtttgacattctcaactggtggaagctcaacatgcagaagtatccgacgctctcaaagatggcgcgggacatcttggccatcccggtgtccatggtgaccggcggaacctctatattttccgcaggaacagggtgccacgtgctcgacgactacagaagctcgctccgtccggagatcgtggaagcgctcgtctgtgcgaaggactggcttctgaattcgaccgccgcgccggaggcggcgccgggctctgggcttctcaagatggactaggctcgcttcctttgctgaagcatgcatatatgtcttctggcgcctgtgagtggtctttttaactgtagtcgtgttttaggcagagtttgtggactggctgcgatcgatgatttcattggatctgtcctagaatgtaatttgccgtgtagaactctgttaactcctccatgctgttatgtccaccccttccttgtgttgtaatatgtgaccagagatgttatctgacgttgtttgggatgtgtatgtgcaagcaacgtaatgtgccagccggtggattgtgtttgtgcttcagtttttatgccttcctttttgtgtgattgtgatgactggcggagttggccatgagccttggtcatcctctgcttcaaatccatggaagcagagagctttctgttgctgcatcgaaatggttgattttgaaaagacaggaagagcatgatatccagttgaaatggttaaacgtgttggagcggtgcttcgacgacgtgtgctggcccgatccggcccaagtctcagcattactcgacgtgtgtgacacccatatttcaacagtgtttgcgacagagggcgctcatgagtgctgtgtgctgattcactgaaatactttgagcaaagagttg

SEQ ID NO: 4931 - DNA, 3067 bp, Panicum virgatum
aaaccacaccagacgcctcccgtttctctctctctctacccccatctcttcccgtcctccccccaagaggatctagggtttgcgcgctcggccttcgttcttcttgggccgagccctaatcctgctgcaccgccaccgagcccccagggtggttgttggatcacctccgctgcgccccctctgcatcctctccgttttctcttgggttccgttggcctgtttccccaacatgggtgagctgaacagcaatgacaatgcaatggtgcataacagtgagatggtcgatggcaatggggtgatcaatggcaatgagatggttcatggtagtgaaatgattcatagtaatgagatggtccatggggatgagatgatccatggggatgagatgattcaaggcactgagatgatccatggtaatgagatggttcaagttaatgatctcatccatggtaatgagttggttcaagttaatgacatggtcaatggtgatgagatggtccacggtaatgaattgatcaatgctgagatgaccccacataccacaccaagacgtcggaggaagaagtcgctggtctgggagcacttcactatagaaaacatgccagggggaagctcaagagcatgctgcaatttatgcaagcaaacctttgcgtatagttctggttcaaaaattgcaggcactagccatctcaagaggcacatcacccttggttcctgtcctgttatgaaagaccaggacaggaagtttgcacttccaccaccaggaggccctggcacagataatgatggtgagggtgctgtagaacgcccttctaagaggcgctacagatacactggttatgcaaatgctacttttgatcaggaaaggagcttctcttatctggcgaagatgattattttgcatgactacccacttcacattgttcaacagccacccttcactacttttattgagagtctgcaaccccgtttcagggttgtagatgttgagacaatggagggagaggtgtatgctgtttttcagaaagcaaaggaaaacctgtttcaagcattcagcaccatgccaggaaggatcagcctcactataggactgtggacaaccagtcagactctaggctatgtttcgcttgctgggcagtttatcgactcagaatggaaggtgcaccgaaggatgctcaacttcatgatggtgtcttctcctcattcagagaatgcacttagtgaagctattagctcgagcctttcagagtggaatatgaaggacaggctattcactatcactttggataatgattgctcttcccatgatatttacagtgcaaatctgagggatcacctctccaataagaacaacctcatgcttaaggggcagctgtttgttgtgaggtgctatgcacatatcatgaatgtagttgctcaggatgttattgcttcgattcatggtgtgatttacaacattcgtgagagtatcaagttcataaaagcttctccaagccgcgaggagagatttgctgagattgctctgaatctggagattcccagtaccaagacactctgtctagatgttacaacccagtggaacaccacttatctgatgctgctggctgccttggactataagcaggctttcgctacactagagacatgtgatgataattacaatgaagctccttcagcagaggattggaagaaagttgaggctacctgtaattacctgaaactgctatatgactctgcacatagcatcatggctgcagcaaaccctaccgcaaacatctttttccatgaagcttggaaaattcagctagagctagcaaatggtacagaacatgaggatcccattttcagcagcattgccaaggatatgcatgagaggtttgacaaatactggaaagattgcagcctggtgctagccgttgctgttgtcatggatccacgtttcaagatgaagcttgttgagttcagttactctaaaatttatggtgctgaggctgggaaatatgttaaggtggtaaatgactctctgcatgagctgtataaggagtatgtggcacagccactcccattgacccctgcctatgttgaacaaagggaagctaataatgtggctgccaatgcgaatgctactcaaggaaatcctccttccactagtgatggtcttctcgacttcgatatgtacctttctgagattcaaagtagccagcctgcaaaatgtgaactggagcagtacctggaggaatccctcactccacgtatccaggagtttgatatccttaactggtggaaacttaacacgctcaagtttccaactctatcaaagatggcccgggatatcttagccatcccaatgtcgatagttagcagtggcagctctatattctctgctggaactgggaaccgcatgcttgatgactacagaagttctcttcgtccggagattgtggaggcacttgtatgcgcgaaagactggctccagtattcaccagctccaactgaggcgccaagttctgcggtggtgaaggcggaagcatcgtaggttcattgttgttactgcttccctgttggaggaggaataagtttgtggtatctatgagtgcagttaactgtaggcatattttaggcagcgatttcagacagattttgatattgttatttatctcctagaatcctagtgtaatttgctgtgtcgaactcagtttaacttaccgtagtgttctttaatgtattgagttaagctgtggtctgaatgtgcacactttgtgtgtgcgcgcagtttgcgggatgtatcaggtggtaacttatgccagattttggcatttgttgcgcagccgttcttttcttgtctttacctttgtattgtttgctgctgtcaatggttggataaacagtcctttttctttttggctaattaatcatccaagccgatgggcgtccatttggtttgtactttggtaaagcatagaagcatcaacatggtctctgttttgtaccgtcttctatgtacagcagctcgatatcaattttgaacatgcagctgtaaaaatggatacaatatttttatgttcac

SEQ ID NO: 4932 - DNA, 2938 bp, Panicum virgatum
aaacgtgtgctgctagaagaaggaaacaaatatcgtagcaacgaagagttttcgcagccacgccctcagaatacatcgtcgttgtcgtcatccgcctcggaaaaaattattccaggcttccagcgtgccgtgccattgcttcggcagtaagaagagttggttggggtggagcaaaacccaagatcgcacctccccgcgtggcgatgcgtggaggagacgcaggagcagcagcggaggcagggtccccgcgctcgccggacctctacgacctctccgacgactccgactacgccgcagccgcctccgaccacacggcgatgcggacggatttggtggacagaggctcggatgagacggcaaggattgacgtggtttatgagaaggagcgtgtgaccatccacccgacgcagtatggctctggccggatcagtgggaagctgcgcctgtttctgcagcaaggatcattgttcctgagctgggagccaaatgaaggagccgactctttgtcaaccagttcatttggtgttgaaatagaaaaatatagaaatctgtacactatcaaggccttgcccttaagtgatgtccgcttcatccgtaagcataccccaacatttggattggactacataataattgttctatcatcaggcctggcttttcctccattctatttctacaatggcggaattcgtgaattgtttgcgacattgaaacaacacgtcttcattatcaggtcggatgacgatcctaatgtttttcttgtcaacgactttcaagatcctcttcagaaaagcttgtcatccctggagcttccaggagtggccacagtggcaaatgccatgtcacgacaaaattcactcagtttcactgggtcagttgatgagaccaggcatggggctgatgaaagacttggggaagcttctagtatgtctcagtatggctcaaagcaaaagcacaaatcaaatgacccaggtcgtgatctttcaattcaagtcttggagaaattctcattggttacaaagtttgcacgtgatactacatcaagcctctttcgagacaatagtggtgcccatggttatggacggcaacaacatgaatatgtctttgataataaagcaagtgataagtacaaaaaccagtatgtagcaccagaaaaggcttctataccctcagctccacttgagtcagatccattgcctctggtatggggaaaacaaagagattgcccattaagtgtcgcagagtggacagctttcttagatcctgaaggtagagttatggattcgaaggcgctgaggaaaaaggtcttttatggcggagtcgaacatgttctgagaaaagaggtgtggaagttcttgttgggctatcatgaatatgattcaacatatgctgagagggaataccttgctgccatgaaacgagcagaatatgaagctataaaatctcagtggaagagtatctcagccacccaagctaaaagattcaccaagtttagggaaagaaaaggcctcattgacaaagatgtggtgagaactgataggtctgttccctattatgaaggagatgacaatcagaatgttgtagttctacgtgatattctgttaacatattccttctacaatttcgaccttggttactgccaaggaatgagtgactttttggctcccatactttatgtcatggaggatgagtccgaatcattttggtgctttgcttccttgatggaacgtttaggagccaattttaatcgtgaccagaatggcatgcatgctcaactacttgcattatccaagctcgtggagcttcttgatcctccattgcataactattttaggcagaacgactgcttgaactatttcttctgtttccgctgggttcttatacagttcaaaagggagttcagttttgaccaggtcatgctcttatgggaagttttgtggacccattatttgtcagaacacttccacttgtacttgtgcgtagcaatcttgaagagataccgtcagcgtataatcggggagcagatggactttgataccctcctcaagttcatcaacgagctcagtggtcagatcaatcttgaccgggctatccaggatgctgaggcattgtgtactattgcaggagaaaacggggcatcttgtattccacctggaaccccaccttcaatgcccattgagaccgatggtggcctctacgtgcaagaagatgaggttttatgagatttcaccggtcacattagaaaataagtgcacagaagcatctcatcagtgtctatccggtactggtttcatgtatgtcataaatttgatgagttgtaagtttataccaatggaggaattataaagtcttagcgttgtgtgtatataatccctcgaccctcgttaagcctgtaattgacacttgctttcgctgaatggatacaggttatctatgggaccctggttttgccgcatctaaattctgccagccaaccctaactggtgatgttggcaggcttgtgttgccagtccctttgttccagcttaattgctcctttttttacttcctactgtgtgctttaggctcttccaattgaagcgaagatgatattatagccagggtttgttacggtatctcccttggaactctacaagtggtggcacaccttggtataattatttcttaattttgttctgaaaagcaagattctgtacagaaaagggcaagtgcaatattcttgttgaactgttcgggtacagatgcctgactcaatcttcctcttgacgaacatgaaggctaggaatttgtattgaaagcctgccggtgttgccagctctagttctggacatcctggtgacgggagcttggatgcttacttccactagccccgtggcaaaataatttggtcgaggaatgcggcttgagagaacattttgcaatgatgattgctatcggg

SEQ ID NO: 4933 - DNA, 2344 bp, Saccharum officinarum
aaatattattccaggcttcggcagtaagaagagttggttgggattgagcaaaaacccgagatcgcacctctccgcgtggcgatgcgtggaggagacgtagcagcagcggaggcagggtccccacgctcgccggacctctacgacctctccgacgactccgactacgccgccgccgccgccgccgccgccgcttccgaccacacggcgatgcggaccgatccggcggacagaggctcagaggagacggcgagggtggacgtggtatatgagaaggagcgtgtgaccatccacccgtcgcagtatggctccggtcgtatcagcgggaagctgcgcctgtttctgcagcagggatcattgttcctgagttgggagccaaacgaaggagccgactctttgtcaaccagttcagtcggtgtggaaatagaaaaatatagaaatctgtacactatcaaggccttgcctttaagtgatgtacgcttcatccgtaggcacaccccaacatttggattggactacataataattgttctctcatcaggcctggcttttcctccattctatttctacaacggtggaattcgtgaattgtttgcaacactgaagcagcatgtcttcattatcaggtcggatgacgatcctaatgtttttctcgtcaacgactttcaagatccccttcagaaaagcttgtcatccttggagcttccaggagtagcctgtgtagcaaatgccatgtcaagacaaaattcactcagttttactgggtcaaatgatgagtccagacatggggcaacttctagcatgtctcagtatagctcaaagcaaaagcacaaatcaaatgacccaggtcgtgatctttcaattcaagtcttggagaaattctcattggttactaaatttgcacgagatactacatcaagcctctttcgagacaatagtggtgctcatgcttatggacggcaacaacatgaatacattttggacaataaagcaactgataaacataaaaatcagtatatgacaccagaaaaggcttctacacccttggcaacaatcgagtcagatccattacctctggtatggggaaaacaaagagatcacccgttaagtgtcgaagagtggacagctttcttagatcctgaaggtagagtcatggattcgaaggcactgaggaaaaaggttttctatgggggagttgatcatgctttgagaaaagaggtctggaaattcttgttggggtatcatgaatatgattcaacatatgctgagagggaataccttgctgccatgaaacgagcagaatatgaagccgtaaaatctcagtggaagagtatctcagccacccaagctaaaagattcaccaagtttagggaaagaaaaggcctaattgacaaagatgtggtgagaacagataggtccattccctattacgaaggagatgacaatcagaatgttgtagttctacgtgatattctgttaacatattccttctacaattttgatcttggttattgccaaggaatgagcgactttctggctcccatactttatgtcatggaggatgagtccgaatcattttggtgctttgcttccctgatggaacgtctgggcgccaattttaatcgtgaccagaatggcatgcatgctcaactacttgcattatccaagcttgtggagcttcttgatcctccattgcataactattttaggcagaatgactgcttgaactacttcttctgtttccgctgggttcttatacagttcaaaagggagttcagtttcgaccagatcatgcttttgtgggaagttctgtggacccattatttgtcagaacatttccacttgtacttgtgtgtagcaatcttgaaaaaatatcgtcagcggataattggggagcagatggactttgataccctccttaagttcatcaatgagctcagtggtcagctcaatcttgaccgggctatccaggacgcggaggcattgtgtactattgcaggagaaaacggggcctcctgcattccacctggaaccccaccttcaatgcccattgagaccgatggtggcctgtatgtgcaagaagacgaggtcttgtgagatgtcagcagtgaccctagaaaataattgcacagaagcatcacaagtttttatcctgtagtgctttcgtcgacgtcataaatgtgatccgttgtaaggttatatcaatggaagaatcatgaaatctagagttgtgtgtgtatatgctccctcgataaacctgtaattgatactttcacttaatagatatggattctgtatggaaccccacgttttacctcagcttacatctgttcttgcaccccaaaaa

SEQ ID NO: 4934 - DNA, 2223 bp, Brachypodium distachyon
gcccgagatcaggaaccgaatcccagcgagcaactctcccgatcgatgcgtggggaagcagcagcagacgccggggcgggctacccgcgctcgccggagccccacgacctctccgacgattcagactacgccgctgccgccgccgcctccgcttccatccacgcggcgataaggagcgatatggccgacatagggtctgaggagactgcgagggtggatgtggtgtacgagaaggagcgtgtgacgatccacccaacgcagtatggctccagccggatcagcgggaagctgcgcctctacttgcagctgggcgctctgttcctgagttgggagccaaatgagggagttgattctttctcaaccagttcagtcaccgcggaaatagaaaaatatagaaatttgtacaccatccaggctttgcctgtaagtgacatacgcttcatccgtcggtacaacccaacatttggattggagtacataatcattgttctctcatcaggcttggcttttcccccattctacttctacaacggtggaactcgtgaattgtttgcaacaatgaagcaacacgtcttcattatcaggtcggatgacgatcctactttatttcttgtcaatgactttgaagatcctcttcagaaaagcctgtcatctctggagcttccaggggttgccactgtggcaaatgccatgtcacgacagaattcgttcagcttcgctggttcagttaatgaagctaggcatggggatgatgccaaacatggggggccttctagcatatatgaatatggttcaaagcaaaagcacaaattgaatgatccaggtcgtgatctttcgcttcaagttttggagaaattctcactggttacaaagtttgctcgcgacacaacatcgagtctctttcgggaaaatcatagtagtggttctcatgcttatggacggcaaaaacaggaacatgtttgggacaacagaataagcgataaatacaaagatcagcaaataacacaagatgacacttctgtgctctcagattcgacagagtctgatgagttgctgctagtgtggggtaaaaagagaggcagcccattaaccgtcgatgagtggagagctttcttagatcctgaaggtagaattatggattcaaaggcactgaggaaaaaggttttctatggcggtgttgatcatgtccttagaaaggaggtctggaaattcttgttggggtatcatgaatatgattcaacacaagctgagagggaatatcttgctgccatgaaacgagaagaatacgaagccattaaatcccagtggaagagtatctcagccacgcaagctaaaaggttcaccaagtttagggaaagaaaaggccttattgacaaggacgtggtgagaacagatagggctgttccgttctatgaaggggatgacaatcggaatgttgtagttctacgtgacatcttgttgacatattccttctataattttgaccttggttattgtcaaggaatgagtgattttttggcacctatacttcatgtcatggaagatgagtcggaatcattttggtgctttgcttctctgatggaacgactaggaggaaattttaaccgtgaccagaatggcatgcatgctcaacttcttgcattgtcgaagcttgtggagcttctcgatcctccattgcataactattttaggcagaatgactgtttgaactacttcttctgtttccgttgggttcttatacaattcaaaagggagttcagttttgaccagatcatgcttttgtgggaagttttgtggactcaatatttgtcagaacatttccacctgtacttgtgcgtcgctatcttgaaaaggtaccgtcagcggataatcggggaagggatggacttcgacacccttctcaagttcataaatgagctcagtggtcagatcaatattgaccaggctattcaggatgcagaggcattatgtaccattgcaggtgataacggggccgcttgcattccacctggaaccccgccttctttgccggtcgagactgatggtggcctgtacttacaagaagatgacgtcttgtgagacataaaatgtgatcagttgcaagttcctatctgtggaagaattacgaaatcgcactgttgtatgtatatatgtaccttaatggatctctaggctctagctgacaatacactgcttttgcttaatgcgaatggattatctaga

SEQ ID NO: 4935 - DNA, 2285 bp, Brachypodium distachyon
gaccaaagcccgagatcaggaaccgaatcccagcgagcaactctcccgatcgatgcgtggggaagcagcagcagacgccggggcgggctacccgcgctcgccggagccccacgacctctccgacgattcagactacgccgctgccgccgccgcctccgcttccatccacgcggcgataaggagcgatatggccgacatagggtctgaggagactgcgagggtggatgtggtgtacgagaaggagcgtgtgacgatccacccaacgcagtatggctccagccggatcagcgggaagctgcgcctctacttgcagctgggcgctctgttcctgagttgggagccaaatgagggagttgattctttctcaaccagttcagtcaccgcggaaatagaaaaatatagaaatttgtacaccatccaggctttgcctgtaagtgacatacgcttcatccgtcggtacaacccaacatttggattggagtacataatcattgttctctcatcaggcttggcttttcccccattctacttctacaacggtggaactcgtgaattgtttgcaacaatgaagcaacacgtcttcattatcaggtcggatgacgatcctactttatttcttgtcaatgactttgaagatcctcttcagaaaagcctgtcatctctggagcttccaggggttgccactgtggcaaatgccatgtcacgacagaattcgttcagcttcgctggttcagttaatgaagctaggcatggggatgatgccaaacatggggggccttctagcatatatgaatatggttcaaagcaaaagcacaaattgaatgatccaggtcgtgatctttcgcttcaagttttggagaaattctcactggttacaaagtttgctcgcgacacaacatcgagtctctttcgggaaaatcatagtagtggttctcatgcttatggacggcaaaaacaggaacatgtttgggacaacagaataagcgataaatacaaagatcagcaaataacacaagatgacacttctgtgctctcagattcgacagagtctgatgagttgctgctagtgtggggtaaaaagagaggcagcccattaaccgtcgatgagtggagagctttcttagatcctgaaggtagaattatggattcaaaggcactgaggaaaaaggttttctatggcggtgttgatcatgtccttagaaaggaggtctggaaattcttgttggggtatcatgaatatgattcaacacaagctgagagggaatatcttgctgccatgaaacgagaagaatacgaagccattaaatcccagtggaagagtatctcagccacgcaagctaaaaggttcaccaagtttagggaaagaaaaggccttattgacaaggacgtggtgagaacagatagggctgttccgttctatgaaggggatgacaatcggaatgttgtagttctacgtgacatcttgttgacatattccttctataattttgaccttggttattgtcaaggaatgagtgattttttggcacctatacttcatgtcatggaagatgagtcggaatcattttggtgctttgcttctctgatggaacgactaggaggaaattttaaccgtgaccagaatggcatgcatgctcaacttcttgcattgtcgaagcttgtggagcttctcgatcctccattgcataactattttaggcagaatgactgtttgaactacttcttctgtttccgttgggttcttatacaattcaaaagggagttcagttttgaccagatcatgcttttgtgggaagttttgtggactcaatatttgtcagaacatttccacctgtacttgtgcgtcgctatcttgaaaaggtaccgtcagcggataatcggggaagggatggacttcgacacccttctcaagttcataaatgagctcagtggtcagatcaatattgaccaggctattcaggatgcagaggcattatgtaccattgcaggtgataacggggccgcttgcattccacctggaaccccgccttctttgccggtcgagactgatggtggcctgtacttacaagaagatgacgtcttgtgagacataaaatgtgatcagttgcaagttcctatctgtggaagaattacgaaatcgcactgttgtatgtatatatgtaccttaatggatctctaggctctagctgacaatacactgcttttgcttaatgcgaatggattatctagaagacgccttattttgctttactgccacctaaatcttcgctgatgatcaactggca

SEQ ID NO: 4936 - DNA, 2312 bp, Triticum aestivum
atatagccgatccccattattgcgactgacaaaaacccgagcgagatcagcagcaaacccaatcccagcgaccgactgcccacccctccctggatcgatgcgcggggaagcagagccagcagcgcgagcaggcgccgccgacgcgggccacccgcgctcgccggacccgcacgacctctccgacgaccccgactacgccgacgccgcctccgtccccgcctccatccacgcggcgatgcggaccgacatggcggacatagggtccgaggagacggcgaggatggacgtggtgtacgagaaggagcgcgtcaccatccaccctacgcagtacggctccggccggatcagcggcaagctgcgcctctacttgcagctcggctccctcttcctgagttgggagccaaatgagggagttaacagtttctcaacaagttcagtcagtgcagaaatagaaaaatatagaaatttgtacaccattcaggccttgcctctaagtgatgtgcgcttcatccgtaggcacaccccaacatttggattggagtacataattattgttctctcatcaggcttggcttttcctcctttctatttctacaatggtggaattcgtgaattgtttgcaacactgaaacagcatgtcttcattatcaggtcggatgacgatcctaatgtatttcttgtcaacgactttgaagatcctcttcagaaaagcctgtcatctctagagcttccaggggttgccactgtggctaatgccatgtcacgacagaattccttcagcttcactggttcagttagtgaagtacgacatggagatgatgccaaatatggggggccttcaaccatgtctgaatatgtctcaaagcaaaggcgcaaatcgaatgatccaggccgagacatttcgtttcaagttctggagaaattctcactggttacgaagtttgcgcgcgagacaacatcaagcctttttcgtgaaaatcacagtagtggttctcatgcttatggacggcaaaaacaagaatatgttttggacaacagagcaagtgacaagtacacagatcagctaataacgccgaatgatgcttctttgacctccgactcggtagagtctgacgagtcactgctggtttggggaaaaaagagaggcaaaccattaagtgttgaagagtggagagctttcttagatcctgaaggtagaattatggattcaaaggcactgaggaagaagattttctatgggggagtcgatcatgttctgagaaaagaggtctggaaattcttgttgggttatcatgaatatgattcaacacaagctgagagggaataccttgcagccatgaaacaagaagaatatgaagccataaaatcccagtggaagagtatctcaaccacacaagctaaaaggtttaccaagtttagggaaagaaaaggccttattgacaaagacgtggtgagaacagataggtctgttccttactatgaaggagatgacaatccaaatgttgtagttctacgcgacatcttgttgacatattccttctataattttgacctgggttattgtcaaggaatgagtgatttcttggcacctatcctttatgtcatggaggatgagtcagaagcattttggtgctttgcttctttgatggaacgactaggaggcaattttaatcgtgatcagaatggcatgcatgctcaactacttggattatccaagctggtggagcttctcgatccttcattgcataactattttaggcagaacgactgtctaaactacttcttctgtttccgctgggttcttatacaattcaaaagggagttcagttttgatcagatcatgctcttgtgggaagttttgtggactcactatttttcagaacactttcacctgtacttgtgcgtcggtatcttgaaaaggtaccgcctgcggataattggggaagggatggacttcgacacccttctcaagttcatcaatgagctaagtggtcaaatcaatattgaccgggctattcaggacgccgaggcattgtgtaccattgcaggtgaggccggggccgattgcattccacctggaactccgccttctatgcccattgagaccgatggtggtctgtacttgcaagaagatgatgtcttgtgagacggatggtggtctgtacttgcaagaagatgatgtcttgtgagatagtagcgtaatgacacttttcagaacctttggaagaactatgagatgttattgttgtatatatgtaccttgactcttgcttttcttactggagatggatcttgtatgagacttttttttc

SEQ ID NO: 4937 - DNA, 2396 bp, Triticum aestivum
acggggccaagcactccaacgcagcgctatatggtcgatccccattattgcgactggcaaaaacccgagcgagatcagcagcaaacccaatcccagcgaccgactccccacccctccctggatcgatgcgcggggaagcagagccagcagcgcgagcaggcgccgccgacgcgggccacccgcgctcgccggacccgcacgacctctccgacgaccccgactacgccgacgccgcctccgtccccgcctccatccacgcggcgatgcggaccgacatggcggacatagggtccgaggagacggcgaggatggacgtggtgtacgagaaggagcgcgtcaccatccaccccacgcagtacggctccggccggatcagcggcaagctgcgcctctacctgcagctcggctccctcttcctgagttgggagccaaatgagggagttaacagtttctcaaccagttcagtcactgcagaaatagaaaaatatagaagtttgtacaccattcaggccttgcctctaagtgacgtgcgcttcatccgtaggcacactccaacatttgggttggagtacataatcattgttctctcatcaggcttggcttttcctcctttctatttctacaatggtggaattcgtgaattgttcgcaacactgaaacagcatgtcttcattatcaggtcggatgacgatcctaatgtatttcttgtcaatgactttgaagatcctcttcagaagagcctgtcatctctagagcttccaggggttgccactgtggcaaatgccatgtcacgacagaattccttcagcttcactggttcagttagtgaagtacgacatggagatgatgccaaatatggggggccttcaaccatgtctgaatatggctcaaagcaaaggcgcaaatcgaatgatccaggtcgtgacatttcgtttcaagttctggagaaattctcactggttacgaagtttgcgcgcgaaacaacatcaagcctctttcgtgaaaatcacagtagtggttctcatgcttatggacggcaaaaacaagaatatgttttggacaacagagcaagtgacaagtacacagatcagctaataacgccgaatgatgcttctttgacctccgactcggtagagtctgacgagtcactgctggtttggggaaaaaagagaggcaaaccattaagtgttgaagagtggagagctttcttagatcctgaaggtagaattatggattcaaaggcactgaggaagaagattttctatgggggagttgatcatgttctgagaaaagaggtctggaaattcctgttgggttatcatgaatatgattcaacacaagctgagagggaataccttgcagccatgaaacaagaagaatatgaagccataaaatcccagtggaagagtatctcaaccacacaagctaaaaggtttaccaagtttagggaaagaaaaggccttattgacaaagacgtggtgagaacagataggtctgttccttactatgaaggagatgacaatccaaatgttgtagttctacgcgacatcttgttgacatattccttctataattttgacctgggttattgtcaaggaatgagtgatttcttggcacctatcctttatgtcatggaggatgagtcagaagcattttggtgctttgcttctttgatggaacgactaggaggcaattttaatcgtgatcagaatggcatgcatgctcaactgcttggattatccaagctggtggagcttctcgatccttcattacataactattttaggcagaacgactgtctaaactacttcttctgtttccgctgggttcttatacaattcaaaagggagttcagttttgatcaggtcatgctcttgtgggaagttttgtggactcactatttttcagaacactttcacctgtacttgtgcgttggtatcttgaaaaggtaccgcctgcggataattggggaaggaatggacttcgacacccttctcaagttcatcaatgagctaagtggtcaaatcaatattgaccgggctattcaggacgccgaggcattgtgtaccattgcaggtgaggccggggccgattgcattccacctggaactccgccttctatgcccattgagaccgatggtggtctgtatttgcaagaagatgatgtcttgtgagacggatggtggtctgtacttgcaagaagatgatgtcttgtgacttgtgagatagtagcgtaatgacactttacagaacctttggaagaactatgagatgttattgttgtatatatgtaccttgactcttgctttttcttactggagatggatcttgtatgagactcttttattttgcttcactgcccatttctctcacctaaatcttcagtgctgatcaac

SEQ ID NO: 4938 - DNA, 2655 bp, Triticum aestivum
tcgatccccattattgcgactggcaaaaacccgagcgagatcagcagcaaacccaatcccagcgaccgactccccacccctccctggatcgatgcgcggggaagcagagccagcagcgcggggagcaggcgccgccgacgcgggccacccgcgctcgcaggacccgcacgacctctccgacgaccccgactacgccgacgccgcctccgtccccgcctccatccacgcggcgatgcggaccgacatggtggacatagggtccgaggagacggcgaggatggacgtggtgtacgagaaggagcgcgtcaccatccaccccactcagtatggctccggccggatcagcggcaagctgcgcctctacttgcagctcggctccctcttcctgagctgggagccaaacgagggagttaacattttctcaaccagttcaatcactgcagaaatagaaaaatatagaaatttgtacaccattcaggccttgcctctaagtgacgtgcgcttcatccgtaggcacactccaacatttgggttggagtacataatcattgttctctcatcaggcttggcttttcctcctttctatttctacaatggcggaattcgtgaattgttcgcaacattgaaacagcatgtctttattatcaggtcggatgatgatcctaatgtatttcttgtcaacgactttgaagatcctcttcagaaaagcctgtcatctctagagcttccaggggttgccactgtggctaatgccatgtcacgacagaattccttcagcttcactggttcagttagtgaagtacgacatggagatgatgccaaatatggggggccttcaaccatgtctgaatatgtctcaaagcaaaggcgcaaatcgagtgatccaggccgagacatttcgtttcaagttctggagaaattctcactggttacgaagtttgcgcgcgagacaacatcaagcctctttcgtgaaaatcacagtagtggttctcatgcttatggacggacaaaaacaagaatatgttttggacaacaaagcaagtgacaagtacgcagatcagctaataacaccggatgatgcttctttgccctcggactcggtagagtctgacgagttactgctggtgtggggaaaaagagaggcaacccattaagtgttgaagagtggagagctttcttagatcctgaaggtagaattatggattcaaaggcactgaggaagaagattttctatgggggagtcgatcatgttctgagaaaagaggtctggaaattcttgttgagttatcatgaatatgattcaacacaagctgagagggaataccttgctgccatgaaacgagaagaatatgaagccataaaatcccagtggaagagtatctcaaccacacaagctaaaaggttcaccaagtttagggaaagaaaaggccttattgacaaagatgtggtgagaacagataggtctgttccttactatgaaggagatgacaatccaaatgttatagttctacgtgacatcttggtgacatattccttctataattttgacctgggttattgtcaaggaatgagtgatttcttggcacctatactttatgtcatggaggatgagtccgaagcattttggtgctttgcttctttgatggaacgactaggaggcaattttaatcgtgatcagaatggcatgcatgctcaactacttggattatccaagctggtggagcttctcgatccttcattgcataactattttaggcagaacgactgtctaaactacttcttctgtttccgctgggttcttatacaattcaaaagggagttcagttttgatcagatcatgctcttgtgggaagttttgtggactcactatttttcagaacactttcacctgtacttgtgcgtcggtatcttgaaaaggtaccgcctgcggataattggggaagggatggacttcgacacccttctcaagttcatcaatgagctaagtggtcaaatcaatattgaccgggctattcaggacgccgaggcattgtgtaccattgcaggtgaggccggggccgattgcattccacctggaactccgccttctatgcccattgagaccgatggtggtctgtatttgcaagaagatgatgtcttgtgagacggatggtggtctgtacttgcaagaagatgatgtcttgtgacttgtgagatagtagcgtaatgacactttacagaacctttggaagaactatgagatgttattgttgtatatatgtaccttgactcttgctttttcttactggagatggatcttgtatgagactcttttattttgcttcactgcccatttctctcacctaaatcttcagtgctgatcaactggcaggctccagagtccagagtctgatccccattcatgcggccctgcctatatgacttttcaagataaatttaaactgaagatagcatgtgggctatctcattgtattcctcaattcagtttgactgagaactatggaactgaaacatcaactatttaagccaaaatgattgtcggcatgaagaattgttgcgaaagattattgtaccgagtttattgtgaacaagccaatatccattagctatacagctaaccaaggatgagcatactaaattttgcgagactcggtt

SEQ ID NO: 4939 - DNA, 2495 bp, Setaria italica
cgagtagcaattaacagtacccccgcacatcaaagcaacaaagagttctcagccacgccatcaaaatccatcgtcgtcgtcatcagcctcgaaacattattctaggcttctcagcgtgccgtgccattgcccattgcttcggcagtaagaagagttggtggttggttgggattgagcaaaacccgagatcgcacctctccgcgtggcgatgcgtgggggagacgcgggagcagcagcagcggaggcagggtcgccccgctcgccggacctctacgacttctccgacgactccgactacgccgccgcctcccatcacacggcgatgcggacggattcggtggacagaggctcggatgagacggcgaggattgatgtggtttatgagaaggagcgtgtgacaatccacctgacgcagtatggctccggccggatcagtgggaagctgcgcctgtttctgcagcggggatcattattcctgagctgggagccaaatgaaggagccgactctttgtcaaccagttcaatcggcgtggaaatagaaaaatatagaaacctgtacactatcaaggccttgcccttaagtgatgtacgcttcatccgtaggcataccccaacatttcgattggactacataataattgttctatcatcaggcctggcttatcctccgttctatttctataatggtggaattcgtgaattgtttgcaacattgaaacagcatgtcttcattatcaggtcggatgatgatcctaatgtgtttcttgtcaacgactttcaagatcctcttcagaaaagcttgtcatccctggagcttccaggagtagcctctgtggcaaatgccatgtcaaggcaaaattcactcagtttcactggggcaaatgatgagtccaggcatgggactgatggaagacatggggaagcttctagcatttctcagtatggctcaaagcaaaagaacaaatcaaacgacccaggtcgtgatctttcaattcaagtcttggagaaattctcattggttacaaagtttgcacgtgatactacatcaagcctctttcaaaacaatagtggtgcccatgcttatggacgccaacaacatgaatatcttctggataatgaagcaagtgataagcaaaaaaatcagtatataacaccagaaaaggcttccatgccctcagctccaccggagccagatccattacctctagtatggggaaaacaaagagatcgtccattaagtgccgaagagtgggcagctttcttagatcccgaaggtagagttatggactcgaaggcgctgaggaaaaaagttttctatgggggagtcgatcatgttttgagagaaaaggtatggaaattcttgttggggtatcatgaatatgattcaacatatgctgagagggaataccatgctgccatgaaacgagcagaatatgaagccataaaatctcagtggaagagtatcacagccacccaagctaaaagattcaccaagtttagggaaagaaaaggccttattgacaaagatgtggtgagaacagataggtctgttccctattatgaaggagatgacaatcggaatgttgtagttctacgtgatattctgttaacatattcattctacaatttcgaccttggttactgccaaggaatgagtgactttttggctcccattctttatgtcatggaggatgagtctgaatcattttggtgctttgcttccttgatggaacgactaggagccaattttaatcgtgaccagaatggcatgcatgctcaactacttgcattatccaagcttgtggagctgcttgatcctccattgcataactattttaggcagaatgactgcttgaactatttcttctgtttccgctgggttctcatacagttcaaaagggagttcagtttcgaccagatcatgctcttgtgggaagttttgtggacccattatttgtcagaacatttccacttgtacttgtgtgtagcaatcttgaaaagataccgtcagcgtataattggggagcagatggactttgataccctcctcaagttcatcaatgagctcagtggtcagatcaatcttgaccgggctctccaggatgctgaggcattgtgtactattgcaggagaaaatggggcatcttgcattccacctggaaccccaccttcaatgcccatcgagaccgatggtggcctgtatgtgcaacaagatgatgtcttgtgagatatcaccaatcaccttagaaaataactgcacaggaccaccgcatcgggtttttttttcctgtaatggtttcgtcgatgttataaatgttaccagttgtaattttataccaatggaagaatcttgaaatcttagcgttgtgtgtatatactccattgaccctcaataaacctgtaatttgacacttgctttcacttaatggatacagattctctaaggaatccggggtttttgcctcagataatttctgcggcccaaccctaattgg

SEQ ID NO: 4940 - DNA, 2431 bp, Setaria italica
caaagagttctcagccacgccatcaaaatccatcgtcgtcgtcatcagcctcgaaacattattctaggcttctcagcgtgccgtgccattgcccattgcttcggcagtaagaagagttggtggttggttgggattgagcaaaacccgagatcgcacctctccgcgtggcgatgcgtgggggagacgcgggagcagcagcagcggaggcagggtcgccccgctcgccggacctctacgacttctccgacgactccgactacgccgccgcctcccatcacacggcgatgcggacggattcggtggacagaggctcggatgagacggcgaggattgatgtggtttatgagaaggagcgtgtgacaatccacctgacgcagtatggctccggccggatcagtgggaagctgcgcctgtttctgcagcggggatcattattcctgagctgggagccaaatgaaggagccgactctttgtcaaccagttcaatcggcgtggaaatagaaaaatatagaaacctgtacactatcaaggccttgcccttaagtgatgtacgcttcatccgtaggcataccccaacatttcgattggactacataataattgttctatcatcaggcctggcttatcctccgttctatttctataatggtggaattcgtgaattgtttgcaacattgaaacagcatgtcttcattatcaggtcggatgatgatcctaatgtgtttcttgtcaacgactttcaagatcctcttcagaaaagcttgtcatccctggagcttccaggagtagcctctgtggcaaatgccatgtcaaggcaaaattcactcagtttcactggggcaaatgatgagtccaggcatgggactgatggaagacatggggaagcttctagcatttctcagtatggctcaaagcaaaagaacaaatcaaacgacccaggtcgtgatctttcaattcaagtcttggagaaattctcattggttacaaagtttgcacgtgatactacatcaagcctctttcaaaacaatagtggtgcccatgcttatggacgccaacaacatgaatatcttctggataatgaagcaagtgataagcaaaaaaatcagtatataacaccagaaaaggcttccatgccctcagctccaccggagccagatccattacctctagtatggggaaaacaaagagatcgtccattaagtgccgaagagtgggcagctttcttagatcccgaaggtagagttatggactcgaaggcgctgaggaaaaaagttttctatgggggagtcgatcatgttttgagagaaaaggtatggaaattcttgttggggtatcatgaatatgattcaacatatgctgagagggaataccatgctgccatgaaacgagcagaatatgaagccataaaatctcagtggaagagtatcacagccacccaagctaaaagattcaccaagtttagggaaagaaaaggccttattgacaaagatgtggtgagaacagataggtctgttccctattatgaaggagatgacaatcggaatgttgtagttctacgtgatattctgttaacatattcattctacaatttcgaccttggttactgccaaggaatgagtgactttttggctcccattctttatgtcatggaggatgagtctgaatcattttggtgctttgcttccttgatggaacgactaggagccaattttaatcgtgaccagaatggcatgcatgctcaactacttgcattatccaagcttgtggagctgcttgatcctccattgcataactattttaggcagaatgactgcttgaactatttcttctgtttccgctgggttctcatacagttcaaaagggagttcagtttcgaccagatcatgctcttgtgggaagttttgtggacccattatttgtcagaacatttccacttgtacttgtgtgtagcaatcttgaaaagataccgtcagcgtataattggggagcagatggactttgataccctcctcaagttcatcaatgagctcagtggtcagatcaatcttgaccgggctctccaggatgctgaggcattgtgtactattgcaggagaaaatggggcatcttgcattccacctggaaccccaccttcaatgcccatcgagaccgatggtggcctgtatgtgcaacaagatgatgtcttgtgagatatcaccaatcaccttagaaaataactgcacaggaccaccgcatcgggtttttttttcctgtaatggtttcgtcgatgttataaatgttaccagttgtaattttataccaatggaagaatcttgaaatcttagcgttgtgtgtatatactccattgaccctcaataaacctgtaatttgacacttgctttcacttaatggatacagattctctaaggaatccggggtttttgcctcagat

SEQ ID NO: 4941 - DNA, 2348 bp, Secale cereale
ggcaagtgagaggcgcacgggcacgggggccaagcaacgcaacgctatataatcttcttcccatccccaattattacgactgcccaaaaacccgagcgagatcagcaaacaaacccaatcccacccagcgaccccgactgcccaccctcccctggatcgatgcgcggggaagcagcagcagcagcgcgcgcaggcgcaggcgccgccgacgcgccccacccgcgctcgccggacccccacgacctctccgacgaccccgactacgccgacgccgcctccgtcccctcctccatccacgcggcgatgcggaccgacatggcggacatagggtccgaggagacggcgaggatggatgtggtgtacgagaaggagcgcgtcaccatccaccccacgcagtacggctccggccggatcagcggcaagctgcgcctctacttgcagctcggctccctcttcctgagttgggagccaaatgagggagttaacagtttctcaaccagttcaatcactgcagaaatagaaaaatacagaaatttgtacaccattcaggccttgcctctaagtgatgtgcgcttcatccgtaggcacaccccgacatttggactagagtacataatcattgttctctcatcaggcttggcttttcctcctttctatttctacaatggtggaattcgtgaactgttcgcaacactgaaacagcatgtcttcattatcaggtcggatgacgatcctaatgtatttcttgtaaacgactttgaagatcctcttcagaaaagcctgtcatctctggagcttccaggggttgccactgtggcaaatgccatgtcacgacagaattccttcagcttcactggttcagttagtgaagtacgacatggagatgatgttaaatatggggggccttcaaccatgtcggaatatggctcaaagcaaaggcgtaaatcaaatgatccaggtcgtgacatttcgtttcaagttctggagaaattctcattggttacaaagtttgcgcgcgagacaacatcaagcctctttcgtgaaaatcaaagtggttctcatgcttatggacggcaaaaacaagaatatgttttggacaacagaacaagtgacaagtacacagatcagctaataacgccggatgatgcttctttgccctcagactcggtagagtctgacgagttactgctggtgtggggaaaaaagagaggcaacccattaagtgttgaagagtggagagctttcttagatcctgaaggtagaattatggattcaaaggcactgaggaagaagatattctatgggggagttgatcatgttctgagaaaagaggtctggaaattcttgctgggttttcatgaatatgattcaacacaagctgagagggaataccttgctgccatgaaacgagaagaatatgaagccataaaatcccagtggaagagtatctcaaccacacaagctaaaaggttcaccaagtttagggaaagaaaaggccttattgacaaagacgtggtgagaacagatagatctgttccttactatgaaggagatgacaacccaaatgttgtagttctacgtgacatcttgttgacatattccttctataattttgacctgggttattgtcaaggaatgagtgatttcttgtcacctatactttatgtcatggaggatgagtccgaagcattttggtgctttgcttctttgatggaacgactaggaggaaattttaatcgtgatcagaatggcatgcatgctcaactacttggattatccaagctggtggagcttctcgatccttcgttgcataactattttaggcagaacgactgtctaaactacttcttctgtttccgctgggttcttatacaattcaaaagggagttcagttttgatcaggtcatgctcttgtgggaagttttgtggactcactatttttcagaacactttcacctttacttgtgcgttggtatcttgaaaggtaccgcctgcgaataattggggaagggatggacttcgacacccttctcaagttcatcaatgagctaagtggtcaaatcaacatcgaccgggctattcaggacgccgaggcattgtgtaccgttgcaggtcaagcaggggccgattgcattccacctggaactccgccttcgatgcccattgagaccgatggcggtctgtacttgcaagaagatgatgtcttgtgagattgatggtggtctatacttgcaagaagatgatgtcttgtgagatgccgtagtaccgtaaatggcactttacagaacctttggaagaactatgaaatgttattgttgtatatatgtaccttgactcctagtgctttt

SEQ ID NO: 4942 - DNA, 2300 bp, Avena sativa
aaaacccgaatcaatccacagcgagcaacgccgtcgaccgatgggtggggaagcagcagcagacgccgccgaggcggcgtggcacccgcgctcgccggagccccacgacctctccgacgactccgactacgccgccgcagcatccgtctccgcctccgtccacgcggcgatgcgcaccgacatggggggcctagggtcggaggagtcggcgaggatggatgtgatgtacgagaaggagcgcgtcaccatccacccgacgcagtacggccccggccggatcagcgggaagctgcgcctctacttgcagctcggctccctcttcctgagttgggagcccaatgagggagttgacagcttctcaaccagttcaatcactgcagaaatcgagaaatatagaaacctgtacaccatccaggccttgcctctaagtgacgtgcgcttcatccgtaggcacacccctacgtttggactggagtacatcatcattgtcctctcatcaggcttggcttttcctcctttctatttctacaatggtggaattcgcgaattgttcgcaacactgaagcaacatgtctttattatcaggtcggacgacgatcctaatgtatttcttgtcaacgacttcgaagatcctcttcagaaaagcctgtcatctctggagcttccaggagttgcctctgtggcaaatgcaatgtcacgacagaattcgctcagcttcactggttcagttagtgaaactagacatggagatggtggtaaacatggggggccttcaagcatgtctgcatatggatcaaagcaaaagtacaaatcaaacgatccaggccgcgaaatttcgtttcaagttttggagaagttctcactggttacaaaatttgcccgcgagacaacatcaagcctcttccgtgaaaatcatagtagtggttctcctgcatatggacggcagaaacaacatgttttggacaatagagaaactgaaaagtacaaagatgagcaattaacgccagataatgcttctttgccctcaaactcagcagagtctgatgagttactgctagtgtggggaaaaaagagaggcagcccattaagtgttgaagagtggagagctttcttagatcctgaaggtagaattatggattcgaaggcactgaggaaaaagattttctatgggggagttgatcatgctctgagaaaagaggtctggaaattcttgttggggtatcatgaatatgattcaacacaagctgagagggaataccttgctgcaataaaacgagaagaatatgaagccataaaatcccagtggaagagtatctcagccacgcaagctaaaaggttcaccaagtttagggaaagaaaaggccttattgacaaagacgtggtgagaacagatcgatctgttccctactacgaaggagatgacaatcggaatgttgtagttctacgtgatatcttgttgacatattccttctataattttgacctcggttattgtcaaggaatgagcgattttttggcacctatactttatgtcatggaagatgagtccgaatcattttggtgctttgctacattgatggaacgactaggaggcaattttaatcgtgatcagaatggcatgcatgctcaactacttggattatccaagctagtggagcttctcgatccttcactgcataactattttaggcagaacgactgcctaaactacttcttctgtttccgctgggttcttatacaattcaaaagggagttcagttttgatcagatcatgctcctgtgggaagttttgtggactcattacatgtcagaacacttccacctgtacttgtgcgtcggtatcttaaagaggtaccgtctgcggataattggagaagagatggactttgacactcttctcaagttcatcaatgagctcagtggtcagatcaatatcgaccgtgctattcaggacgccgaggcactgtgtactattgcaggtgatgagggggccgcttgcattccagctggaacaccaccttctatgcccatcgagactgacgggggtctgtacttgcaagaagatgatgtcttgtgagatactggcataacgtcgccttgcaagaagcttcggaagtagtatggacaagttattgttgtatatatgtaccttggcttctatgaagatttagctggaactaaagtgcttttgcttatttgaaatgttctctttattgcttcaccgcctatgtctgtcatctaaatcttcagtgctgatcaactggcaggctttgtaggtttatcctcgtcatgtttttcct

SEQ ID NO: 4943 - DNA, 2251 bp, Avena sativa
gagagacggggcaaaacgccaagcctatatactcccaagagagatccccattattacgactgagcagaaaaacccgaatcaatccacagcgagcaacgccgtcgaccgatgggtggggaagcagcagcagacgccgccgaggcggcgtggcacccgcgctcgccggagccccacgacctctccgacgactccgactacgccgccgcagcatccgtctccgcatccgtccacgcggcgatgcgcaccgacatggggggcctagggtcggaggagtcggctaggatggatgtgatgtacgagaaggagcgcgtcaccatccacccgacgcagtacggccccggccggatcagcgggaagctgcgcctctacttgcagctcggctccctcttcctgagttgggagcccaatgagggagttgacagcttctcaaccagttcaatcactgcagaaatcgagaaatatagaaacctgtacaccatccaggccttgcctctaagtgacgtgcgcttcatccgtaggcacacccctacgtttggactggagtacatcatcattgtcctctcatcaggcttggcttttcctcctttctatttctacaatggtggaattcgcgaattgttcgcaacactgaagcaacatgtctttattatcaggtcggacgacgatcctaatgtatttcttgtcaacgactttgaagatcctcttcagaaaagcctgtcatctctggagcttccaggagttgcctctgtggcaaatgcaatgtcacgacagaattcgctcagcttcactggttcagttagtgaaactagacatggagatggtggtaaatatggggggccttcaagcatgtctgcatatggatcaaagcaaaagtacaaatcaaacgatccaggccgcgaaatttcgtttcaagttttggagaagttctcactggttacaaaatttgcccgcgagacaacatcaagcctcttccgtgaaaatcatagtagtggttctcctgcatatggacggcagaaacaacatgttttggacaatagagaaactgaaaagtacaaagatgagcaattaacgccagataatgcttctttgccctcaaactcagtagagtctgatgagttactgctagtgtggggaaaaaagagaggcagcccattaagtgttgaagagtggagagctttcttagatcctgaaggtagaattatggattcgaaggcactgaggaaaaagattttctatgggggagttgatcatgctctgagaaaagaggtctggaaattcttgttggggtatcatgaatatgattcaacacaagctgagagggaataccttgctgcaataaaacgagaagaatatgaagccataaaatcccagtggaagagtatctcagccacgcaagctaaaaggttcaccaaatttagggaaagaaaaggccttattgacaaagacgtggtgagaacagatcgatctgttccctactacgaaggagatgacaatcggaatgttgtagttctacgtgatatcttgttgacatattccttctataattttgacctcggttattgtcaaggaatgagcgattttttggcacctatactttatgtcatggaagatgagtccgaatcattttggtgctttgctacattgatggaacgactaggaggcaattttaatcgtgatcagaatggcatgcatgctcaactacttggattatccaagctagtggagcttctcgatccttcactgcataactattttaggcagaacgactgcctaaactacttcttctgtttccgctgggttcttatacaattcaaaagggagttcagttttgatcagatcatgctcctgtgggaagttttgtggactcattacatgtcagaacacttccacctgtacttgtgtgtcggtatcttaaagaggtaccgtctgcggataattggagaagagatggacttcgacactcttctcaagttcatcaatgagctcagtggtcagatcaatatcgaccgggctattcaggatgccgaggcactgtgtactattgcaggtgatgagggggccgcttgcattccagctggaacaccaccttctatgcccatcgagactgacgggggtctgtacttgcaagaagatgatgtcttgtgagatactggcataacgtcgccttgcaagaagcttcggaagtagtatggacaagttattgttgtatatatgtaccttggcttctatgaagatttagctggaactaaag

SEQ ID NO: 4944 - DNA, 2244 bp, Hordeum vulgare
acgctctcgcctggtggcagcaaggcgaagggagagggcaactgagagacggggccaagcactccaacgcaacgcagcgcagcgctatataatcatcaatcgatccccattattgctgctactgaccaaaaacccgagcgagatcagcaaacccaatccccccgaccgactccccctccctggatcgatgcgcggggaagcagcagcagcagcagcgcgggcagacgccgcggaggcgcgctcgccggacccccacgacctctccgacgaccccgactacgccgacgccgcctccgtccccgcctccatccacgcggcgatgcggaccgacatggcggacatagggtccgaggagatggcgaggatggacgtggtgtacgagaaggagcgcgtcaccatccaccccacgcagtacggctccggccggatcagcggcaagctgcgcctctacttgcagctcggctccctcttcctgagttgggagccaaatgagggagtcaacagtttctcaaccagttcaatcaacgcagaaatagaaaaatatagaagtttgtacaccattcaggccttgcctctaagtgatgtgcgcttcatccgtaggcacactccaacatttggattggagtacataattattgttctctcatcaggcctggcttttccccctttctatttctacaatggtggaattcgtgaattgttcgcaacactgaaacagcatgtcttcattatcaggtcggatgacgatcctagtgtatttcttgtcaacgactttgaagatcctcttcagaaaagcctgtcatctctagagcttccaggggttgccactgtggcaaatgccatgtcacgacagaattccttcagcttcactggctcagttagtgaagtacgacatggagatgatgccaaatatggggggccttcaaccatgtctgaatatggctcaaaacaaaggcggaaatcgaatgatccaggccgtgacatttcgcttcaagttctggagaaattctcacttgttacgaagtttgcacgcgagacaacatcaagcctcttccgtgaaaatcacaatagtggttctaatgcttatggacggcaaaaacaagaatatgttttggacaacagagcaagtgacaagtacactgatcagctaataacgccggatgatgcttctttgccctcagattcggtagagtctgacgagttactgctggtgtggggaaaaaagagaggcagcccattaagtgtcgaagagtggagagctttcttagatcctgaaggtagaattatggattcaaaggcactgaggaagaagattttctatgggggagtcgatcatgttctgagaaaagaggtctggaaattcttgttgggttatcatgaatatgattcaacacaagctgagagggaatatcttgctgccatgaaacgggaagaatatgaagccataaaatcccagtggaagagtatctcaaccacacaagctaaaaggttcaccaagtttagggaaagaaaaggccttattgacaaagacgtggtgagaacagacagatctgttccttactatgaaggagacgacaatccaaatgttgtagttctacgtgacatcttggtgacatattccttctataattttgacctgggttattgtcaaggaatgagtgatttcttggcacctatactttatgtcatggaggatgagtctgaagcattttggtgctttgcttctttgatggaacgactaggaggcaattttaatcgtgatcagaatggcatgcatgctcaactacttggattatccaagctggtggagcttctcgatccttcattgcataactattttaggcagaacgactgtctaaactacttcttctgtttccgctgggttcttatacaattcaaaagggagttcagttttgatcagatcatgctcttgtgggaagttttgtggactcactatttttcagaacacttccacctatacttgtgcgtcggtatcttgagaaggtaccgcctgcggataattggggaagggatggacttcgacacccttctcaagttcatcaacgaactaagtggtcaaatcaacattgaccgggctattcaggacgccgaggcattatgtaccattgcaggtgaacggggggccgattgcattccacctggaactccgccttctatgcccattgagaccgatggtggtctgtacttgcaagaagatgatgtcttgtacgattttcgacatgg

SEQ ID NO: 4945 - DNA, 2850 bp, Sorghum bicolor
aacaggcccttaatatcactttgcaaagtatatttatccgtgtgactaacttatattatttatactaatactccttcggcgagtaccaccgtattagcacacactttgcctgtaaaatcactgcgtaaaagtatatccacatccggtttcacggccaaagtgtgctggaacacggggataaaattatcgtctcattattcgttagtaattagtagcaaaataataatactcatcaaacacatcaaaggcaacacgccaacaaggcaacaacacggtgttctcggacacgccatatcagcccccaaaatattattccaggcttcggcagtaagaagagtaggttgggattgagcaaaaacccgagatcgcacctctccgcgtggcgatgcgtggaggagacgtagcagcagcggaggcagggtccccacgctcgccggacctctacgacctctccgacgactccgactacgccgccgctgccgccgcttccgaccacacggtgatgcggactgatccggcagacagaggctcagaggagacggcgagggtggacgtggtatatgagaaggagcgtgtgaccatccacccatcacagtatggctccggtcgtatcagtgggaagttgcgcttgtttctgcagcagggatcattgttcctgagttgggggccaaacgaaggagctgactctttgtcaaccagttcagtcggtgtggaaatagaaaaatatagaaatctgtacactatcaaggccctgcctttaagtgatgtacgcttcatccgtaggtacaccccaacatttggattggactacataataattgttctctcatcaggtctggcttttcctccattctatttctacaacggtggaattcgtgaattatttgcaacactgaaacagcatgtcttcattatcaggtccgacgatgatcctaatgtttttctcgtcaacgactttcaagatccccttcagaaaagcttgtcgtccttggagcttccaggagtagcctctgtagcaaatgccatgtcaagacaaaattcactcagttttactgggtcaaatgatgagtccagacatggggcaacatctagcatgtctcagtatagctcaaagcaaaagcacaaatcaaatgacccaggtcgtgatctttcaattcaagtcttggagaaattctcattagttactaaatttgcacgagatactacatcaagcctctttcgagacaatagtgctgctcatgcttatggacggcaacaacatgaatacattttggacaataaagcaactgataaacataaaaatcagtatataacaccagaaaaggcttctacaccctcggcaacaatcgagtcagatccattacctctggtatggggaaaacaaagagatcgcccattaagtgttgaagagtggacagctttcttagatcctgaaggtagagttatggattcaaaggcactgaggaaaaaggttttctatgggggagttgatcatgctttgagaaaagaggtctggaaattcttgttgggctatcatgaatatgattcaacatatgctgagagggaataccttgctgccatgaaacgagcagaatatgaagccgtaaaatctcagtggaagagtatctcagccacccaagctaaaagattcaccaagtttagggaaagaaaaggcctaattgacaaagatgtggtgagaacagataggtccattccctattacgaaggagatgataatcagaatgttgtagttctacgtgatattctgttaacatattctttctacaatttcgaccttggttattgtcaaggaatgagtgactttttggctcccatactttatgtcatggaggatgagtccgaatcattttggtgctttgcttccctgatggaacgtctaggcgccaattttaatcgtgaccagaatggcatgcatgctcaactacttgcattatccaagcttgtggagcttcttgatcctccattgcataactattttaggcagaatgactgcttgaactacttcttctgtttccgctgggttcttatacagttcaaaagggagttcagtttcgaccagatcatgcttttgtgggaagttctgtggacccattatttgtcagaacatttccacttgtacttgtgcgtagcaatcttgaaaaaatatcgtcagcggataattggggagcagatggactttgatacccttcttaagttcatcaatgagctcagtggtcagatcaatcttgaccgggctatccaggatgcggaggcattgtgtactattgcaggagaaaacggggcttcctgcattccacctggaaccccaccttcgatgcccattgagactgatggtggcctgtatgtgcaagaagacgaggtcttgtgagatatcagcggtgaccctagaaaataattgcacagaagcatcaggagttgttatcctgtagtgctttcatcaacgtcataaatgtgatccgttgtaaggttatacctatggaagaatcatgaaatctagggttgtgtgtgtatatactccctcgataaacctgtaattgatactttcacttaagagatatggattctgtatggaacgccaggttttatctcagctaacatctgttctgccacccaacacttgtttggccagttcctgtgttacaacttaattgctaaagggggttcattttaatactcctactttgttacttgttgtatttcaggatcctctaaattaacttaagatgaaattatagtttgtatttatcactataatatctcctttggaaccctgcaactgctgcaagtagtgagacctggatgtagtttatttcttcatttttgttctga

SEQ ID NO: 4946 - DNA, 2108 bp, Echinochloa colona
cggcgatgcggaccgattcggtgggcagaggctcggatgagacggcgaggattgatgtggtatatgagaaggatcgtgtgaccatccacccgacgcagtatggctcaggccggatcagtggaaagctgcgcctgtttctgcagcagggatcgttgttcctgagctgggagccaaatgaaggatctgactctttgtcaaccagctcagtcggtttggaaatagaaaaatatagaaatctgtacactatcaaggacttggccttaagtgatgtgcgtttcatccgtaggcataccccaacatttggatatgactacataataattgttctatcatcaggcctggcttttcctccattctatttctacactggtggaattcgtgaattgtttgcgacgttgaaacagcacgtcttcattatcaggtcggatgacgatcctaatgtttttcttgtcaacgactttcaagatcctcttcagaaaagcttgtcatcccttgagcttccaggagtagcctctgttgcaaatgccatggcacgacaaaattcactcagtttcactgggtcagttgatgaggccaggcttggggctgagggcagacatggggaaacttctagcatgtctcagtatggctcaaagcaaaagcacaaatcaaatgatccaggtcgtgatctttcaattcaagtcttggagaaattctcattggttacaaagtttgcacgtgatactacatcaagcctctttcgagacaatagtggtggccatgcttatggacggcaacaacatgaatatgtttttgataatgaagcaagtgataagcacaaaaatcagtatataacaccagaaaaggcttctataccctcggctccactgagtcagatccattactctggtatggggaaacaaagagatcgcccattaagtgtcgaagagtggacagctttcttagatcctgaaggtagagttatggattcaaaggcactgaggaaaaaggttttctatgggggagccgatcatgttttgagaaaagaggtctggaaattcttgttgggggtactatgaatatgattcaacatatgctgagaggggaataccttgatgccatgaaacgagcagaatatgaagccataaaaactcagtggaagagtatctcagccacccaagctaaaagattcaccaagtttagggaaagaaaaggccttattgacaaagatgtggtgagaacagataggtctgttccctattatgaaggagatgacaatcggaatgttgtagtctacgtgatattttgttgacatattccttctacaattttgaccttggttactgccaaggaatgagtgactttttggctcccatactttatgtcatggaggatgagtccgaatcattttggtgctttgcttccttgatggaacggctaggagccaattttaatcgcgaccagaatggcatgcatgctcagctacttgcattatccaagcttgtggagcttcttgatcctccgttgcataactattttaggcagaacgactgcctgaactatttcttctgcttccgctgggttcttatacagttcaaaagggagttcagttttgaccagatcatgctcttgtgggaagttttgtggacccattatttgtcagaacacttccacttgtacttgtgtgtagcaatcttgaaaagataccgccagcgtataattggggagcagatggactttgataccctcctcaagttcatcaatgagctcagtggtcagatcaatcttgaccgggctatccaagatgccgaggcattgtgtaccattgcaggagaaaacggggcatcttgcatcccacctggaaccccaccttcgatgcccatcgagaccgatggtggcctctacgtgcaagaagatgaggtattgtgagattttgccagtcaccttaaatgactgcacagaagcatctcgtcaatttttatgttcatggatgtcataaatgtgatctgtcgtaagtttatactaatgtaaggatcatgaaatcttagtgttgtgtgtatatacttcctcaaccgataaacctgtaattgacacttacattcacttaatggtacggattctctatggga

SEQ ID NO: 4947 - DNA, 1994 bp, Echinochloa colona
ggcgatgcggaccgattcagtggccagaggctcggatgagacggcgaggattgacgtggtttatgagaaggatcgtgtgaccatccacccgacgcagtatggctcaggccgaatcagtgggaagctgcgcctgtttctgcagcagggatcgttgttcctgagctgggagccaaatgaaggagctgactctttgtcaaccagctcagtcggtttggaaatagaaaaatatagaaatctgtacactatcaaggacttggccttaagtgatgtgcgtttcatccgtaggcataccccaacatttggatatgactacataataattgttctatcatcaggcctggcttttcctccattctatttctacactggtggaattcgtgaattgtttgcgacgttgaaacagcacgtcttcattatcaggtcggatgacgatcctaatgtttttcttgtcaacgactttcaagatcctcttcagaaaagcttatcatcccttgagcttccaggagtagcctctgttgcaaatgccatggcacgacaaaattcactcagtttcactgggtcagttgatgaggccaggcttggggctgaagacagacatggggaagcttctagcaagtctcagtatggctcaaagcaaaagcacaaatcaaatgatccaggtcgtgatctttcaattcaagtcttggagaaattctcattggttacaaagtttgcacgtgatactacatcaagcctctttcgagacaatagtggtgcccatgcttatggacagcaacaacatgaatatgtttttgatagtaaagcaagtgataagcacaaagatcagtatataacaccagaaaaggcttctataccctcggctccactggagtcagatccattacctctggtatggggaaaacaaagagatcgcccattaagtgtcgaagagtggacagctttcttagatcctgaaggtagagttatggattcaaaggcactgaggaaaaaggttttctatgggggagccgatcatgttttgagaaaagaggtctggaaattcttgttggggtactatgaatatgattcaacatatgctgagagggaataccttgatgccatgaaacgagcagaatatgaagccataaaaactcagtggaagagtatctcagccacccaagctaaaagattcaccaagtttagggaaagaaaaggccttattgacaaagatgtggtgagaacagataggtctgttccctattatgaaggagatgacaatcggaatgttgtagttctacgtgatattttgttgacatattccttctacaattttgaccttggttactgccaaggaatgagtgactttttggctcccatactttatgtcatggaggatgagtccgaatcattttggtgctttgcttccttgatggaacggttaggagccaattttaatcgcgaccagaatggcatgcatgctcagctacttgcgttatccaagcttgtggagcttcttgatcctccgttgcataactattttaggcagaacgactgcctgaactatttcttctgcttccgctgggttcttatacagttcaaaagggagttcagttttgaccagatcatgctcttgtgggaagttttgtggacccattatttgtcagaacacttccacttgtacttgtgtgtagcaatcttgaaaagataccgccagcgtataattggggagcagatggactttgataccctcctcaagttcatcaatgagctcagtggtcagatcaatcttgaccgggctatccaagatgccgaggcattgtgtaccattgcaggagaaaacggggcatcttgcatcccacctggaaccccaccttcaatgcccatcgagaccgatggtggactctacatgcaagaagatgaggtcttgtgagatttcgccggtcaccttagaaaataactgcacagaagcatcgcgtcaatttttatgtttcatggatgtcataaatgtgatctgt

SEQ ID NO: 4948 - DNA, 2197 bp, Avena sativa
cgccgccgccgcctccgtctccgcctccgtccacgcggcgatgcggaccgacatggggggcctagggtcggaggagtcggcgaggatggatgtggtgtacgagaaggagcgagttaccatccaccccacgcagtatggccccggcaggatcagcgggaagctgcgcctctacttgcagctcggttccctcttcctgagttgggagccaaatgagggagtcgacagcttctcaaccagttcaatcactgcagaaatcgagaaatatagaaacctgtacaccatccaggccttgcctctaagtgacgtgcgcttcatccgtaggcacacccctacgtttggactggagtacatcatcattgtcctctcatcaggcttggcttttcctcctttctatttctacaatggtggaattcgcgaattgttcgcaacactgaagcaacatgtctttattatcaggtcggacgacgatcctaatgtatttcttgtcaacgactttgaagatcctcttcagaaaagcctgtcatctctggagcttccaggagttgcctctgtggcaaatgcaatgtcacgacagaattcgctcagcttcactggttcagttagtgaaactagacatggagatggtggtaaatatggggggccttcaagcatgtctgcgtatggatcaaagcaaaagtacaaatcaaacgatccaggccgcgaaatttcgtttcaagttttggagaagttctcactggttacaaaatttgcccgcgagacaacatcaagcctcttccgtgaaaatcacagtagtggttctcctgcttatggacggcagaaacaacaacatgttttggacaacatagcaagtgaaaagtacaaagatcagcaattaacgccagataatgcttcttcgccctcaaactcagtagagtctgatgagttactgctagtgtggggaaaaaagagaggcagcccattaagtgttgaagagtggagagctttcttagatcctgaaggtagaattttggattcgaaggcactgaggaaaaaggttttctatgggggagttgatcatgctctgagaaaagaggtctggaaattcttgttggggtatcatgaatatgattcaacacaagctgagagggaataccttgctgcaataaaacgagaagaatatgaagccataaaatcccagtggaagagtatctcagccacgcaagctaaaaggttcaccaagtttagggaaagaaaaggccttattgacaaagacgtggtgagaacagatcgatctgttccctactacgaaggagatgacaatcggaatgttgtagttctacgtgatatcttgttgacatattccttctataattttgacctcggttattgtcaaggaatgagcgattttttggcacctatactttatgtcatggaagatgagtccgaatcattttggtgctttgctacattgatggaacgactaggaggcaattttaatcgtgatcagaatggcatgcatgctcaactacttggattatccaagctagtggagcttctcgatccttcactgcataactattttaggcagaacgactgcctaaactacttcttctgtttccgctgggttcttatacaattcaaaagggagttcagttttgatcagatcatgctcctgtgggaagttttgtggactcattacatgtcagaacacttccacctgtacttgtgcgtcggtatcttaaagaggtaccgtctgcggataattggagaagagatggacttcgacactcttctcaagttcatcaatgagctcagtggtcagatcaatatcgaccgggctattcaggatgccgaggcactgtgtactattgcaggtgatgagggggccgcttgcattccagctggaacaccaccttctatgcccatcgagactgacgggggtctgtacttgcaagaagatgatgtcttgtgagatactggcataacgtcgccttgcaagaagcttcggaagtagtatggacaagttattgttgtatatatgtaccttggcttctatgaagatttagctggaactaaagaacttttgcttatttgaaatgttctctttattgcttcactgcctatgtctgtcatctaaatcttcagtgctgatcaactggcaggctttgtaggtttatcctcgtcatgtttttctttatgggtttccaagataaactta

SEQ ID NO: 4949 - DNA, 2370 bp, Triticum aestivum
gggtccgaggagacggcgaggatggacgtggtgtacgagaaggagcgcgtcaccatccaccctacgcagtacggctccggccggatcagcggcaagctgcgcctctacttgcagctcggctccctcttcctgagttgggagccaaatgagggagttaacagtttctcaacaagttcagtcagtgcagaaatagaaaaatatagaaatttgtacaccattcaggccttgcctctaagtgatgtgcgcttcatccgtaggcacaccccaacatttggattggagtacataattattgttctctcatcaggcttggcttttcctcctttctatttctacaatggtggaattcgtgaattgtttgcaacactgaaacagcatgtcttcattatcaggtcggatgacgatcctaatgtatttcttgtcaacgactttgaagatcctcttcagaaaagcctgtcatctctagagcttccaggggttgccactgtggctaatgccatgtcacgacagaattccttcagcttcactggttcagttagtgaagtacgacatggagatgatgccaaatatggggggccttcaaccatgtctgaatatgtctcaaagcaaaggcgcaaatcgaatgatccaggccgagacatttcgtttcaagttctggagaaattctcactggttacgaagtttgcgcgcgagacaacatcaagcctttttcgtgaaaatcacagtagtggttctcatgcttatggacggcaaaaacaagaatatgttttggacaacaaagcaagtgacaagtacgcagatcagctaataacaccggatgatgcttctttgtcctcggactcggtagagtctgacgagttactgctggtgtggggaaaaaagagaggcaacccattaagtgttgaagagtggagatctttcttagatcctgaaggtagaattatggattcaaaggcactgaggaagaagattttctatgggggagtcgatcatgttctgagaaaagaggtctggaaattcttgttgggttatcatgaatatgattcaacacaagctgagagggaataccttgctgccatgaaacgagaagaatatgaagccataaaatcccagtggaagagtatctcaaccacacaagctaaaaggttcaccaagtttagggaaagaaaaggtcttattgacaaagacgtggtgagaacagacagatctgttccttactatgaaggagatgacaatccaaatgttgtagttctacgtgacatcttggtgacatattccttctataattttgacctgggttattgtcaaggaatgagtgatttcttggcacctatactttatgtcatggaggatgagtccgaagcattttggtgctttgcttctttgatggaacgactaggaggcaattttaatcgtgatcagaatggcatgcatgctcaactacttggattatccaagctggtggagcttctcgatccttcattgcataactattttaggcagaacgactgtctaaactacttcttctgtttccgctgggttcttatacaattcaaaagggagttcagttttgatcagatcatgctcttgtgggaagttttgtggactcactatttttcagaacactttcacctgtacttgtgcgtcggtatcttgaaaaggtaccgcctgcggataattggggaagggatggacttcgacacccttctcaagttcatcaatgagctaagtggtcaaatcaatattgatcgggctattcaggacgccgaggcattgtgtagcattgcaggtgaggccggggccgattgcattccacctggaactccgccttctatgcccattgagaccgatggtggtctgtacgtgcaagaaaatgatgtcttgtgagacggatggtggtctgtacttgcaagaagatgatgtcttgtgagatagtagcgtaatgacactttacagaacctttggaagaactatgagatgttattgttgtatatatgtaccttgactcttgctttttcttactggagatggatcttgtatgagactttttttttgcttcactgcctatttctctcacctaaatcttcagtgctgatcaactggcaggctccagagtccagagtctgatcaccattcatgtggccctacctatatggcttttcaagataaatttaaactgaagatagcatgtgggctatctcattgtattcctcaattcagtttgactgagaactatggaactgaaacatcaactatttaagccaaaatgattgtcggcatgaagaattgttgcgaaagattattgtaccgagtttattgtgaacaagccaatatccattagctatacagctaaccaaggatgagcatacc

SEQ ID NO: 4950 - DNA, 2200 bp, Pennisetum glaucum
ccgccgaccacacgacgatgcggacggatttggtggacagaggctcggatgagacggtgaggattgatgtcgtttacgagaaggagcgtgtgacaatccacccgacgcagtatggctccggtcggatcagtgggaagctgcgcctgtttctgcagcagggatcattgttcctgagctgggagccaaatgaaggagccgactctttgtcaaccagttcattcggtgtggaaatagaaaaatatagaaatctgtacactatcaaggccttacccttaagtgatgtacgcttcatccgtaggcatacctcaacatttgcatatgactacattataattgttctatcatcaggcctggcttttcctccattctatttctataatggtggaattcgagagttgtttgcgacattgaaacagcatgtcttcattatcaggtcggatgatgatcctaatgtgtttctcgtcaacgactttcaagatcctcttcagaaaagcttgtcatccctggagctttctggagtagcctctgtggcaaatgcaatgtcaaggcaaaattcactcagttttactggggcaactgatgagcccaggcatgggactgatggaagacatggggaagcttctagtgtttctcagtatggctcaaagcaaaagaccaaatcaaacgacccaggtcgtgatctttcaattcaagtcttggagaaattctcattggttactaagtttgcacgtgatactacatcaagcctctttcaaaacaacagtggtgcccatggttatggacgccaacaatatgaatatcttctggataataaagcaagtgagaagcaaaaaaatcagtatataacacctgaaaaggcttctatgccctcagctccaccggagccagatccattacctctagtatggggaaaacaaagagatcatccattaagtgctgaagagtggacagctttcttagatcccgaaggtagagttatggactcgaaggcgctgaggaaaaaggttttctatgggggagtcgatcatgttttgaggaaaaaggtctggaaattcttgttggggtatcatgaatatgattcaacatatgctgagagggaataccatgctgccatgaaacgtgcagaatatgaagccataaaatctcagtggaagagtatcacagccacccaagctaaaagattcaccaagtttagggaaagaaaaggccttattgacaaagatgtggtgagaacagatagatctgttccctattatgaaggagatgacaatcagaatgttgtagttctacgtgatattctgttgacatattcattctacaatttcgaccttggttactgccaaggaatgagtgactttctggctccaattctttatgtcatgggggatgagtctgaatcattttggtgctttgcttccttgatggaacgactaggagccaattttaatcgcgaccaaaatggcatgcatgctcaactacttgcattatccaagcttgtagagctgcttgatcctccattgcataactattttaggcagaatgactgcttgaactatttcttctgtttccgatgggttctcatacagttcaaaagggagttcagtttcgaccagatcatgctcttgtgggaagttttgtggacccattatttgtcagaacacttccacttgtacttgtgtgtagcaatcttgaaaagataccgccagcgtataattggggagcagatggacttcgataccctcctcaagttcatcaatgagctcagtggtcagatcaatcttgaccgggctattcaggatgctgaggcattgtgtactattgcaggagaaaatggggcatcttgcattccacctggaaccccaccttcaatgcccatcgagactgatagtggcctgtatgtgcaagaagatgatgtcttgtgagatatcaccaatcaccttagaaaataactgcacaggaccacctcatcgggttttcttcccccccttgtagcatcgatgttataaatgtgaccagttgtaattttataccaatggaagaatcttgaaatcctagcattatgtgtatatactccatctaccatagatcgtgatttgtcacttgctttcacttaatggacagagattctctatggtacctggggttttgcctcagctagaaaaaaaaaaagaaaaaaagtaactactagcgttgataccac

SEQ ID NO: 4951 - DNA, 4231 bp, Oryza sativa
gccgcattcacgctgacccgacgcaccgccgccgcggcgcacccagaccactccttgtctaggagctcgccggattcttggaacgccgccggccatcatggacaagggcgcgctggtggtgcaggtgatggacgactcgtcgaacggcggcgtcggcgccgccgccgccggcggctcgttctcgagcctgcgcgcctacggccgcgcgctggcgcagacgccgcggcggctggcgcggcgcgcgtgcgccgcgacgtcgccgggggaggagatgagccgggtgcgcgcgcgctccggcgcgcgcatggcgcggaggctgcggtggcacgacctcgtcgggctcgggctcggcggcatggtgggcgccggggtgttcgtcaccacggggcgcgccacgcgcctctacgccgggcccggcgtcgtcgtgtcgtacgccattgccggcctctgcgcgctcctctccgccttctgctacaccgagttcgccgtcgacatgcccgtcgccggcggcgccttcagctacctccgcgtcaccttcggggagttggcggcgttcttgaccggggcgaacctgatcatggagtatgtcttctccaacgccgccgtggcgaggagcttcacggcgtacctcggcacggcggtgggcgtcgacgcgccgagcaagtggcggattgccgtgccgggcctccccaagggcttcaacgaggttgaccttatcgctgtcggcgtcatcctcctcatctccgtctgcatctgctacagcaccaaggagagctcggtggtgaacatggtgctaacggcggtgcacgtggcgttcatcctgttcatcatagtgatggggttctggcgcggcgacacccggaacctgacgcggcccgtcgacctggcgcacaacccgggcgggttctttcctcacggcgcagccggcgtgttcaacggagccgccatggtgtacctgagctacatcgggtacgacgccgtgtccaccatggccgaggaggtggagcggccgtcacgcgacattcccgtcggcgtctccggctccgtcgtgctcgtcacactcctctactgcctcatggccgcctccatgtccatgctcctcccctacgacgcgatagacacggaggcgccattctcaggggcgttcaaggggagctccggatgggggtgggtgtcgaacgtgatcggcgccggcgccagcctcggcatcctgacgtcactcatggtggcgatgctaggtcaggccaggtacctctgcgtcatcggccgctccggcgtcatgccagcgtggctcgccaaggtgcacccctgcaccgccacccccgtcaacgcctccgccttcctcggtgtgttcacggcggcgctggcgctgttcacggagctcgacgtgctgctcaacctcgtctccatcggcacgctcttcgtcttctacatggtcgccaacgccgtcgtctaccgccgctacgtcgccgccgacgacgacgacgccgaccaccgccgcgcgtggccgacgctcgtgttcctcgccgccttctcgctcgtggcgctctgcttcacgctgctgtggcagttcgcgccggcggggcgcgccaggacggggctcctcgcggcgtgcggcgcggccgccgtggcgacggtcggcgcgttccgggcgctggtggcggaggcgcggcggccggagctgtggggcgtcccggccatgccgtgggtgcccgcggcgtcggtgttcctcaacgtcttcctcctcggctccctcgaccgcccctcctacgtccgcttcggcttcttcaccgccgccgccgtgctcgtctacgtgctctacagcgtgcacgccagctacgacgccgaggagggcggtggcgccggcgccggcgccgccgcgctcgacggcgccaaggtgcaggacgaggctgcagacttcaaggtgtagcagggtgtgtggttgaccgttgacttatgcacagctcaatctcgacctacctttttctttttcttttttgtttgttgaatttttttttttgtgttgcctcaatcattaggagattaggggtatgatgactatcacgttaattagtagagaagaatctaacatggttacatggggaagaaaaacacgagagaaaaaacaagggaaactttacttgtaagtgcaagatgaaatgtacatgcattttgccaatttttctctgccaaaattaattactggatagtattgtttttctcttattttttatatatgatctgtttatataggtacaatttcatcttctgttcttgtactcttgttaaattcattagtttctcggaaagcaccagtggtatggtgtggtggtggaatcgtagatacatgactaaaaaacaagttaattaatactagagcacatgacatcgctatcttccgatcctaagtcgatatttccatttctatcatgtaagaaatctcttgggctttcttttatataaagttggatcgaataatcttttcatcgagaaaactgtaaaacaccgaagaaaaatttcacggccgcgccggtgaagggaatcttgacctggaatttcactgaacaatgtcaatgtccagattcccctcaaacagcccaacacctaatccgaatcttaatgctgttatgcagaggagacgacagagacctccatttccaagagaccttttggcaatgcaatgtctctctcctctgacttgtgaaatggttgttgccgtgtgacattttttctgctgctaatttgcatcggaaagtgcagaagaaaaatggatgaatgaatcatatctgaatcatggtctttttctccttatgcttatctcgtaaagatggcacgattagtagaactgtaggagatgtggtgaactggtgatctgaaagcttctgatgcatgcatggatccactagcttttctctgtaaaatggatgaacactgaaatatatatatatgctcgtggaaaaatttggtggattgcaacgagcatatgaaatcactcacgcatgcttgctgctcgcgtctctgtctgaaaatggcgcacattgcgcgtgcagaaatgtgcaacgacggcatgaaattgtgagtggtcaggaagagagaagagaagcgaatgatcaccaatttcatcctcctttctcctgaaaagagaagagtgatggatggattcagacaaaaatcgaagttctttttcttcttcagacttttttcagaatgttgcaaactaatgacaattattcagtgatatgattgacactgtgttcaatgtgcaccaacagttgctagatcctgtcgtggcggaaacactgtgttcgatcctgtttctgagaaatgatgagaatcaaatccagcgtccactgacactgaggagaaggcggctgaagaaatcttctttctttcatccgaattccaatcgcattaatcaaatcctcccttcacctaattaaatctctgaaagtgcagcgtgacaactacggcgcacaaagctctctgctccattttgctgaaattttttttggctcgttttattccatttgccgacactccgtttcgaggtgaatctactgtataggctttggaaaattggtgattggtgagtgtaggttccatttctagcaagcgacctcatggtaatcacctttttctattttctacatttcttttttgtgagtgcatatctgatctcagtgtgctagaatgctttgcaccttaagaaaaggtggcaggtgtcggatacgcaaactcctgatcaaaatgcagtttgcatttttatgactcctttggagcacaagaattttactggatttcggcaaaattactttgtaattaatgagtttgtactagctaattttacatgaagaagggcactagctaaagtttacagagcaattcaaaggtttacaagagcactagctaactgctgaaactacttttttttgctacatcgtgaacaccttttaacttgatgatcattatgttgtcatgatactgtaatactttgtaccagtaacctttaccagctcatgtcagttgacaacatctgatctctccttttctgcagttgagaagcccaaatggccactgctcactaactgttaaacattacctcggcaggcagaaattcagatctcacctacgtcttcttcaaaccttttctcatcatttgacttgcactgaagataagattttgggggcaatgcagtggagtggacttcactttcagagctcaaaacaataa

SEQ ID NO: 4952 - DNA, 2205 bp, Triticum aestivum
gacgcctcatcttccgtttcttctccagcccccctcacgaaagccacaccccgccgccccggcgcagtttctggagcggcactcggatcctgacggccatggacaagggcgcactgatgacgccggactccgatcagggcggccccgacgggggctcgttctcgagcctgcgctcgtacgggcgggccctgtcgcagacgccgcggcggctggcacggcgcgcgtgcgcggcgacggcgccgggagaagagatgagccgcgtgcgcgcgcggtcgggggctccgatggcgcgtgcgctgcggtggccggacctcgtggggcttggtctcggcggcatggtgggcgccggggtgttcgtcaccaccgggcgcgccacgaggctccacgccggccccggcgtcgtcgtctcctacgccattgccggcctctgcgccctgctctccgccttctgctacacggagttcgccgtggacatgcccgtcgccggcggcgccttcagctacctccgcgtcaccttcggggaattcgctgcgttcctgacgggggcgaacctcatcatggagtacgtcttctccaacgccgccgtggcgcgcagcttcacggcctacatgggcacggcggtcggcgtggacgcgcccagcaagtggcggatcgccgtgccgggcctccccaacggcttcaaccaggtcgacctcgtcgccgtcggggtcatcctcctcatctccgtctgcatctgctacagcaccaaagagagctccaaggtgaacatggtcctcacggccgtgcacgtggccttcatcctcttcatcatcgtcatgggcttctggcgtggcgacgcgcgcaacctgacccaccccgccgacccggcccacccgggcggtttcttccccaacggcgtcggcggcgtcttcagcggcgcggccatggtgtacctgagctacatcggctacgacgccgtgtccaccatggctgaagaggtggagcggcccgcgcgcgacatccccatcggcgtctcggggtccgtcatcatcgtcaccgtgctctactgcctcatggccgcctccatgtccatgctcctcccatacgacgcgatcgacacggaggcgcccttctcgggggccttcagggggagcgacggatggggctgggtgtccaacgtgatcggggccggtgccagcctcggcatcttgacgtcgctcatggtggccatgctggggcaggccaggtacctgtgcgtcatcggccgctccggcgtcatgcccgcctggctagccaaggtgcaccccaagaccgccacccccgtcaacgcctcagccttcctcggactcttgacggctgccctggcgctcttcacggagctggacatcctcctcaacctcgtctgcatcggcacgctcttcgtcttctacatggtgtccaacgccgtcgtataccgccgctacgtcgtgggcccaaccggcagcggcaccgaatccggggaccggcagcccagcgcatggccgaccctcgcgtttctccttgccttctccctcatcgcgctctccttcacgctggtgtggaagctggcgccggagggcggccgcaccagggtcgggctcctgtcggcgtgcggcgcggcggcggtggccatggtcggcgcgttccaggcgctggtgccccaggcgcacacgcccgagctttggggcgtgccgggcatgccgtgggtgcccgcagcgtccgtgttcctcaacgtcttcctgctcggctccctggaccgcccgtcctacgtccggttcggcttcttctccgcggccgccgtgctcgtctacgtgctctacagcgtgcacgccagctatgacgccgaggagagcgccacgctcgacggcgccaaggtgcaggacgaagcttgcagggtgtagctactagctagggtggagagaatgagcttgttaactgctgctctagagcgtctaggtttttcttcttcttgacaattttctgtcatgttctagatttcgagtagctgttgggagtacaacaaaggagctaacaaggtaatgaaatgtgaaaactgagagaggatcggggcaaaggagattttacctggaacttgcatatgcgagcacaagttcttctaaaatgtacatgctctaatttcctggaagatacttcagggcaactgcttgtctccttcatttgttttctttacccaaaaaaggcttcccc

SEQ ID NO: 4953 - DNA, 2191 bp, Setaria italica
cgccccgcgccgcctgtccccaatacggccatggacaagggcgcgctggcatcgtctgcctccgaccagggggctctgaccgccgccgccggcggcggatcgttcgcgagcctgcgcgcgtacggccgcgcgctggcgcagacgccgcgtcgcctggcgcggcgggcgtgcgcggcgacggcgccgggggaggagatgagccgcgtgcgggcgcgatccggcccccgcatggcgcgcgcgctgcggtggtgggacctcgtcggcctcggcctcgggggcatggtcggcgccggcgtcttcgtcaccacgggccgcgccacgcgcctctacgcggggcccggcgtcgtcgtgtcctacgccattgcgggcctctgcgcgctgctctccgccttctgctacaccgagttcgccgtcgacatgcccgttgccggcggagccttcagctacctccgcgtcaccttcggtgagttcgcggcgttcctgacaggggcgaaccttatcatggagtacgtcttctccaacgcggcggtggcgcggagcttcacggcgtacctgggcacggccgtgggcgtggacgcgcccagcaagtggcggatccccgtgcccggcctgcccgagggcttcaaccaggtggacctcgtcgccgtcggcgtcatcctcctcatcaccgtctgcatctgctacagcaccaaggagagctcggtggtgaacatggtgctgacggcggtgcacgtggcgttcatcctgttcatcatcgtgatcgggttcgtgcacggcgacgcgcggaacctgacgcgccccgccgacccgtcccgcaaccccggcggcttcttcccgcacggcgccatgggcgtgttcaacggcgcggccatggtgtacctgagctacatcgggtacgacgccgtctccaccatggccgaggaggtggagcggcccgcgcgcgacatccccatcggcgtctcgggctccgtcgtcgtcgtcaccgtgctctactgcctcatggccgcctccatgtccatgctcctcccttacgacgcgattgacccggaggcgccgttctcggggccgttcaggggccggaaggggatggcgtgggtgtccaacgtcatcggcgccggcgcgagcctcggcatcctgacgtcgctcatggtggcgatgcttgggcaggcccggtacctgtgcgtcatcggccgctccggcgtcatgcccgcctggctcgccagggtcaacccccgcaccgccacacccgtcaacgcctccgccttcctcgggctcttcacggcggcgctggcgctgttcacggagctggacatcctgctcaacctcgtctgcatcggcacgctcttcgtcttctacatggtggccaacgccgtcgtgtaccgccgctacgtcggcgacgccgagctcggtcgcacccgcagagcctggccgacgctggcgttcctcgccgccttctccctcctcgcgctcgccttcgcgctggtttggaagctggcgccgcccgagcgcggcgtgcggacgggcctcctcgccgcgtgcgcggcgctcgccgtcgccacggtcgccgcgttccaggcgctggtgccgcaggcgcacgcgcccgagctgtggggcgtgcccgggatgccttgggtgcccgcggcgtccgtgttcctcaacgtcttcctcctgggctcgctggaccggccctcctacgtccgcttcggcttcttctcggtcgccgcgttgctcgtgtacgtgctctacagcgtgcacgccagctacgacgccgaggagagcggcctcgacggcggcggggcaaaggtgcaggacgaagcgtgcacggtgtagcagggcacgtctggctgacgtcatagagagaactaactaatcctaattcagcattactcacgggctccagtatttttttttcttcttcctatgtttttgacctgttctgtgctgacgcgagcaaaagggtaaaaaaggggaaaaatctaacaagggtgggtaaaacaacacaaaggaaatggagagaaatgaagggtctgtgcatcctgtaatgtaactcgcaaagatgataagtgtatatgctcaaggaaggattcatgtcatcataattcgaaaatgattggctatgcacccctctgtgacgtccgcttctcatgtacgtatctataaaagtttataaaatgaatagtaatttgggccg

SEQ ID NO: 4954 - DNA, 2144 bp, Panicum virgatum
cgccacgccacgcttcttgcgttccttctccgtccaaacccctccatctccttcatccccgcggcaccgcctgtcccccaatcggccgggccatggacaagggcgcgctgccaccgtctggcaccgaccatggcgccggcggatcgttcgcgagcctccgcgcgtacggccgcgcgctggcgcagacgcctcggcgcgtggcgcagcgggcgtgcgcggcgacggcgcccggggaggagatgagccgggtgcgggcgcggtcgggcgcgcacatggcgcgcgcgctgcggtggtgggacctcgtcgggctgggcctgggcggcatggtgggggccggggtcttcgtcaccacaggccgcgccaccaggctctacgcggggcctggggtcgtcgtgtcctacgccattgccggcctctgcgcgctcctctccgccttctgctacaccgagttcgccgtcgacatgcccgtcgccggcggagccttcagctacctccgcgtcaccttcggggagttcgcggcgttcctgacgggggcgaacctgatcatggagtacgtcttctccaacgccgccgtggcgcgaagcttcacggcgtacctgggcacggcggtcggcgtggacgcgcccagcaagtggcggatccccgtgccggggctgccggaggggttcaaccaggtggacctcgtcgccgtcggcgtcatcctcctcatctccgtatgcatctgctacagcaccaaggagagctcgttggtgaacatggtcctgacggcggtgcacgtggcgttcatcctgttcatcatagtgatcgggttcgtgcacggcgacgcgcggaacctgacccgtcctgccgacccgtcccagaaccccggcggcttcttcccgcatggcgccatgggcgtgttcaacggcgcggccatggtgtacctgagctacatcgggtacgacgccgtgtccaccatggccgaggaggtggagcggcccgcgcgcgacatccccatcggcgtctcgggctccgtcgtcgtcgtcaccgtgctctactgcctcatggccgcctccatgtccatgctcctcccctacgacgcgatcgacccggaggcgccgttctcgggggcgttcaaggggaaggcggggatggcgtgggtgtccaacgtgatcggcgccggcgcgagcctcggcatcctgacgtcgctcatggtggcgatgctcgggcaggcgcggtacctctgcgtcatcggccgctccggcgtcatgccggcctggctcgccagggtgaacccccgcaccgccacccccgtcaacgcctccgccttcctcggcctcttcacggcggcgctggcgctgttcacggagctggacatcctgctcaacctcgtctgcatcggcacgctcttcgtcttctacatggtggccaacgccgtcgtgtaccgccgctatgccggcgccttgctcggccgcagcgcctggccgacgctcgcgttcctcggcaccttctccctcgtggcgctctccttcacgctggtctggaagctggcgccgcccgagcgcggcgtgcgggcgggcctcctcgccgcgtgcgcggcggtcgcggtggccacggtcgccgcgttccaggcgctggtgccgcaggcgcacgcgcccgagctgtggggcgtgcccgggatgccgtgggtgcccgcggcgtccgtgttcctcaacgtcttcctgctgggctcgctggaccgcccctcctacgtccgcttcggcttcttctcggccgccgccgtgctggtgtacgtgctctacagcgtgcacgcaagctacgacgccgaggagagcggtctcgacgacggcggggcaaaggtgcaggacgaagcatgcacggtgtagcaggacgcctggctgacgtcatacagtacagagagaactaatcctaattcctcagtgctgctcacgtgctgtagtgtgccttttcccttcctatttttgacctgttctgtgctgacgagtgacgagagcaaagaaaaaagaagaatctaacaagggtgggtaaaacaacccaatggaaatagagagaaacaaagggatatgcatcctgtaacgtacaaagatgaaaagtgtatatgctcaaggagtcgaggaaggtttcatctgatcttgcatcgacaa

SEQ ID NO: 4955 - DNA, 2233 bp, Hordeum vulgare
ctccacgcctcatcttgcgtttcttgtccagcccccctcaggaaagacgcaccccgccgcccaggcgcaatttctggagcggcacttggatccttcacggccatggacaagggcgcactgatgacgcctgagtcggatcagagcggccgggacgtcgggggctcgttctcgagcctgcgctcgtacgggcgggccctgtcgcagacgccgcggcggttggcacggcgcgcgtgcgcggcgacggcgccggaagaagagatgagccgcgtccgcgcgcggtcgggggctccgatggcgcgcgcgctgcggtggccggacctcgtggggctcggcctcggcggcatggtgggcgccggggtgttcgtcaccaccgggcgcgctacgaggctctacgcgggccccggcgtcgtcgtgtcctacgccattgccggcctctgcgcgctgctctccgccttctgctacacggagttcgccgtggacatgcccgtcgccggcggcgccttcagctacctccgcgtcaccttcggggaattcgctgcgttcctcacgggagcgaacctgatcatggagtacgtcttctccaacgccgccgtggcgcgcagcttcacggcgtacatgggcacggcggtcggcgtggacgcgccaagcaagtggcggatcgccgtgccgggcctccccaacggcttcaacgaggtcgacctcgtcgccgtcggggtcatccttctcatctccgtctgcatctgctacagcaccaaagagagctccaaggtgaacatggtcctcacggccgtgcatgtggccttcatcctgttcatcatcgtcatgggcttctggcgtggagacgtgcgcaacctgacccacccggccgaccccgcccacccaggcggtttcttccccaacggcgtcggtggcgtcttcagcggcgcggccatggtgtacctgagctacatcggctacgacgcggtgtccaccatggcagaagaagtggagcggccagcgcgcgacatccccatcggcgtctcggggtccgtcgtcatcgtcaccgtgctctactgcctcatggccgcctccatgtccatgctcctcccatacgacgcgatcgacaaggaggcgcccttctcaggggccttcagggggagcgacggatggggctgggtgtccaacgtgatcggggccggtgccagcctaggcatcttgacgtcgctaatggtggccatgctggggcaggccaggtacctgtgcgtcatcggccgctctggtgtcatgcccgcctggctcgccaaggtgcaccccaagactgccacccccgtcaacgcctccgccttcctcggactcttgacggctgcgctggcgctcttcacggagcttgacatcctcctcaacctcgtctgcatcggcacgctcttcgtcttctacatggtgtccaacgccgtcgtgtaccgccgctacgtcgtcggcccaaccggcagcagcaccgccacctccgaagccagggaccggcagcccggcgcatggccgaccctcgcgtttctccttgccttctccctcattgcgctctccttcacgctggtgtggaagctggcgccggagggcggtcgcaccagggttgggctcctgtcggcgtgtggcgcggcggcggtggccacggtcggtgcgttccaggcgctggtgccccaggtgcacacgcccgagctttggggcgtgccggggatgccgtgggtgcccgcggcctccgtgttcctcaacgtcttcctgctcggttccctcgaccgcccgtcatacgtccggttcggcttcttctccgcggcggccgtgctcgtgtacgtactctacagcgtgcacgccagctatgacgccgaggagagctccacgctcgacggcgccaaggtgcaggacgaagcttgcagggtgtagctactagggtggagagaatgagcttgttaactgctgctctagagcgtctaggtttttcttctttctaacaattttctgtcatgatctaagatttcgagtagccgttgggagtaaaaaaaaacagctaacatggtgatgaaatatgaaaaccgagataagattggggaaaggagattttacctggaacttgcatatgcgaatgcacaagttcttctaaaatgtacatgtctaatttcctggaagatacttcagcccaaatgcttgtatttcaactttttttttcttagataaaaagcgcccgattttaaattaataatgc

SEQ ID NO: 4956 - DNA, 2217 bp, Setaria italica
cgcctcctaccgtctccactctctctgttcgccactctccagcccgccgcccgatccccgcgaaaccaccgcaccacgccccccccgccccttccacctgccccgcgccgccatggacaaggccgcgctggtggccgattccgacggcgccgcgaccgccggtggctcgttcgccagcctgcgcgcgtacggccgcgcgctggcgcagacgccgcggcgcctggcgcgtcgcgcgtgcgcggcgtcggcgcccggcgaggagatgagccgcgtccgggcgcgctccggcccccgcatggcgcgcgcgctgcggtggtgggacctcgtcgggctcggcctcggcggcatggtcggcgccggcgtgttcgtaaccacgggccgcgccacgcgcctctacgcggggcccggcgtcgtcgtctcctacgccattgccgggctctgcgcgctgctctccgccttctgctacaccgagttcgccgtcgacatgcccgtcgccggcggcgccttcagctacctccgtgtcaccttcggggagttggcggcgttcctgacgggggcgaacctgatcatggagtacgtcttctcgaacgcggcggtggcgcggagcttgacggcgtacctgggcacggcggtcggcgtggacgcgcccagcaagtggcggatcgccgtgccaggcctgccggaggggttcaaccaggtggacctcatcgccgtcggcgtcatcctccttatttccgtctgcatctgctacagcaccaaggagagctcggtggtgaacctggtcctgacgggcgtgcacgtggcgttcatcctcttcgtcatcgtgatgggcttcaagcacggcgacaagcgcaacctgacccaccccgcggacccatcccgcaaccccggcggcttcttcccgcacggcgcagccggggtgttcaacggcgcggcggcggtgtacttgagctacatcggctacgacgccgtgtccaccatggccgaggaggtggagcggcccgcgcgcgacatccctgccggcgtctccggctccgtcgtcgtcgtcaccgcgctctactgcctcatggccgcatccatgtccatgctcctcccctacgacgcgatcgacccggaggcgccgttctcgggggcgttcaagcggatgaaagggaaggcgtgggtgtccaacgtcatcggcgccggcgcgagcctcggcatcctgacgtcgctgatggtggcgatgctggggcaggcccgttacctctgcgtcatcggccgctccggcgtcatgccggcctggctcgccagggtgcacccccgcacagccacccccgtcaacgcctccgccttcctcggactgttcacggcggcgctggcgctgttcacggagctggacgtgctcctgaacctcgtctccatcggcacgctcttcgtcttctacatggtggccaacgccgtcgtgtaccgccgctacgtcggcgactcggacaactccgatagcagcaggagggcgtggccggcgctggcgttcctgggcgccttctccctgatcgcgctctccttcacgctgctgtggcagttcgtccccgccggcggcgcgagggcggggctcctggcggcgtgcgcggcggcggccgtggccgcggtggcggcgttccatgcgctggtgccgcaggcccgcgcccccgagctgtggggcgtgcccgggatgccgtgggtgcccgcggcgtccgtgttcctcaacgtcttcctcctggggtcgctggaccggccctcctacgtccgcttcgggttcttctcggccgccgccgtgctcgtgtacgtgctctacagcgtgcacgccagccacgacgccgaggagggcggcggcggcggcgccaaggtgctggacgaagggtgcaaggtctagcagtagcagaacgggtggcataggcagagtgctcactctgctctctactgatgtagtagcaccttttctagattttctttattacgttattatgctaatggccatcaagtcattgcatcaggcaaaaaaaaaaactaacagcggaagaaattaaaatagagagagagagtatcgggtgtcactgtaatttgcaagatgaaatgtacatattctgtttctcctcttgctaagacactgttgagactcctcttgacgcatgtcaacgtcatgggtctgttcgcttcagcttatttagctggtcaccaaacagtatttttctctcacaa

SEQ ID NO: 4957 - DNA, 2210 bp, Setaria italica
cacgccgcctgcccgcctcctaccgtctccactctctctgttcgccactctccagcccgccgcccgatccccgcgaaaccaccgcaccacgccccccccgccccttccacctgccccgcgccgccatggacaaggccgcgctggtggccgattccgacggcgccgcgaccgccggtggctcgttcgccagcctgcgcgcgtacggccgcgcgctggcgcagacgccgcggcgcctggcgcgtcgcgcgtgcgcggcgtcggcgcccggcgaggagatgagccgcgtccgggcgcgctccggcccccgcatggcgcgcgcgctgcggtggtgggacctcgtcgggctcggcctcggcggcatggtcggcgccggcgtgttcgtaaccacgggccgcgccacgcgcctctacgcggggcccggcgtcgtcgtctcctacgccattgccgggctctgcgcgctgctctccgccttctgctacaccgagttcgccgtcgacatgcccgtcgccggcggcgccttcagctacctccgtgtcaccttcggggagttggcggcgttcctgacgggggcgaacctgatcatggagtacgtcttctcgaacgcggcggtggcgcggagcttgacggcgtacctgggcacggcggtcggcgtggacgcgcccagcaagtggcggatcgccgtgccaggcctgccggaggggttcaaccaggtggacctcatcgccgtcggcgtcatcctccttatttccgtctgcatctgctacagcaccaaggagagctcggtggtgaacctggtcctgacgggcgtgcacgtggcgttcatcctcttcgtcatcgtgatgggcttcaagcacggcgacaagcgcaacctgacccaccccgcggacccatcccgcaaccccggcggcttcttcccgcacggcgcagccggggtgttcaacggcgcggcggcggtgtacttgagctacatcggctacgacgccgtgtccaccatggccgaggaggtggagcggcccgcgcgcgacatccctgccggcgtctccggctccgtcgtcgtcgtcaccgcgctctactgcctcatggccgcatccatgtccatgctcctcccctacgacgcgatcgacccggaggcgccgttctcgggggcgttcaagcggatgaaagggaaggcgtgggtgtccaacgtcatcggcgccggcgcgagcctcggcatcctgacgtcgctgatggtggcgatgctggggcaggcccgttacctctgcgtcatcggccgctccggcgtcatgccggcctggctcgccagggtgcacccccgcacagccacccccgtcaacgcctccgccttcctcggactgttcacggcggcgctggcgctgttcacggagctggacgtgctcctgaacctcgtctccatcggcacgctcttcgtcttctacatggtggccaacgccgtcgtgtaccgccgctacgtcggcgactcggacaactccgatagcagcaggagggcgtggccggcgctggcgttcctgggcgccttctccctgatcgcgctctccttcacgctgctgtggcagttcgtccccgccggcggcgcgagggcggggctcctggcggcgtgcgcggcggcggccgtggccgcggtggcggcgttccatgcgctggtgccgcaggcccgcgcccccgagctgtggggcgtgcccgggatgccgtgggtgcccgcggcgtccgtgttcctcaacgtcttcctcctggggtcgctggaccggccctcctacgtccgcttcgggttcttctcggccgccgccgtgctcgtgtacgtgctctacagcgtgcacgccagccacgacgccgaggagggcggcggcggcggcgccaaggtgctggacgaagggtgcaaggtctagcagtagcagaacgggtggcataggcagagtgctcactctgctctctactgatgtagtagcaccttttctagattttctttattacgttattatgctaatggccatcaagtcattgcatcaggcaaaaaaaaaaactaacagcggaagaaattaaaatagagagagagagtatcgggtgtcactgtaatttgcaagatgaaatgtacatattctgtttctcctcttgctaagacactgttgagactcctcttgacgcatgtcaacgtcatgggtctgttcgcttcagcttatttagctggtcaccaa

SEQ ID NO: 4958 - DNA, 2207 bp, Brachypodium distachyon
gctcactcctctcttctcctcctctgccgtttcttcttcttcttctacctctgtctctccagtctccagttagctgtacccacactagcccgcacgccgccccccgatttcgatccttgacgacgccatggacaagggcgcgctgatgtcgtcctccccggcgccggccacggactcttcgaccaccggcggatcgttctcgagcctgcgcgcgtacgggcgcgcgctgacgcagacgccgcgccgggtggcgctccgggcgtgcgcggccacgacgcccggcgaggagatgagccgcgtgcgcgcgcggtccggcgcgcccatggcgcgcgcgctgcgttggccagacctcgtggggctcggtctcggcggcatggtgggggccggggtcttcgtcaccacgggccgcgccacgcggctgtacgccggtcccggcgtggtcgtgtcctacgccattgccggcctctgcgcgctgctctccgccttctgctacaccgagttcgccgtcgacatgcccgtcgccggcggcgccttcagctacctccgcgtcaccttcggggagtttgcggcgttcctgacgggggcgaacttgatcatggagtacgtcttctccaacgccgccgtggcgcgcagcttcacggcgtacctgggcacggctgtcggcgtggacgcgcccagcaagtggcgcatcgccgtgccgggcctcccggagggcttcaaccaggtcgacctcgtcgccgtcggcgtcatcctcctcatctccgtctgcatctgttacagcaccaaggatagctcgatggtgaacatggtcctgacggcggtgcacgtggtgttcatcctgttcatcatcgtgatggggttctggcgcggcgacgcccggaacctgacccgcccctccgacccggcgcaccctggcggcttcttccccaacggcgtcggcggcgtgttcagcggcgccgccatggtgtacctgagctacatcggctacgacgccgtgtccaccatggccgaggaggtggagaagccggcccgggatatcccgatcggcgtctcgggctccgtcgtcatcgtcaccgtgctctactgcctcatggccgcgtccatgtccatgctcctcccctacgacgcgattgacacggaggcgcccttctccggcgcgttcaggggcagcgagggctggggctgggtgtccaacgtgatcggcgccggcgccagcctcggcatcctgacgtcgctcatggtggccatgcttggccaggccaggtacatgtgcgtcatcggccgctccggcgtcatgccggcatggctcgccaaggtgcaccccaacactgccacccccgtcaacgcctccgccttcctcgggctgttcacggcggcgctggcgctgttcacggagctggacatcctgctgaacctcgtctgcatcggcacgctcttcgtcttctacatggtgtccaacgccgtcgtgtaccgccgctacgtcctcgcagcctcctccagctcctccatccccaatggcggcagcgatcgccgcggcgctagcgcgtggccgacgctggcattcctgctagccttctcgctgctggccatcgccttcacgctgtcgtggaagctggcgcccgaggggcgcgcccggatcgcgctcctggcgtgcatcggcatcgcggcggtggccaccgtcggcgcgttccagctcctggtgccgcaggcgcacacgccgcagctctggggcgtgccggggatgccgtgggtgcccgcggcgtctgtcttcctcaacgtgtttctcctggggtcactggaccggccgtcctatgtccggttcgcgttcttctccgccgccaccgtgctggtctacgcgctctatagcgtgcacgccagcttcgacgccgaggagaccggcagcggcgacgacggcggcgccaaggtgcaggacgaagactgcaaggtgtagcgagcgatgatcgagctagatgtagttaacggctgcagtaggtttttctttcttcttcttgattttaggctagttcttggagactttggagtaaagcaaacaagctaacatggtgatcaaaccagaaaaattgggagagaattggggggagttaaaaaaaatgtagatttaccctggaacttgcaactgccatgttcaagttcttttcaaaatgtgcatgttctgatttcccgggagaaacttcagcacaaaacgc

SEQ ID NO: 4959 - DNA, 2192 bp, Brachypodium distachyon
cttctcctcctctgccgtttcttcttcttcttctacctctgtctctccagtctccagttagctgtacccacactagcccgcacgccgccccccgatttcgatccttgacgacgccatggacaagggcgcgctgatgtcgtcctccccggcgccggccacggactcttcgaccaccggcggatcgttctcgagcctgcgcgcgtacgggcgcgcgctgacgcagacgccgcgccgggtggcgctccgggcgtgcgcggccacgacgcccggcgaggagatgagccgcgtgcgcgcgcggtccggcgcgcccatggcgcgcgcgctgcgttggccagacctcgtggggctcggtctcggcggcatggtgggggccggggtcttcgtcaccacgggccgcgccacgcggctgtacgccggtcccggcgtggtcgtgtcctacgccattgccggcctctgcgcgctgctctccgccttctgctacaccgagttcgccgtcgacatgcccgtcgccggcggcgccttcagctacctccgcgtcaccttcggggagtttgcggcgttcctgacgggggcgaacttgatcatggagtacgtcttctccaacgccgccgtggcgcgcagcttcacggcgtacctgggcacggctgtcggcgtggacgcgcccagcaagtggcgcatcgccgtgccgggcctcccggagggcttcaaccaggtcgacctcgtcgccgtcggcgtcatcctcctcatctccgtctgcatctgttacagcaccaaggatagctcgatggtgaacatggtcctgacggcggtgcacgtggtgttcatcctgttcatcatcgtgatggggttctggcgcggcgacgcccggaacctgacccgcccctccgacccggcgcaccctggcggcttcttccccaacggcgtcggcggcgtgttcagcggcgccgccatggtgtacctgagctacatcggctacgacgccgtgtccaccatggccgaggaggtggagaagccggcccgggatatcccgatcggcgtctcgggctccgtcgtcatcgtcaccgtgctctactgcctcatggccgcgtccatgtccatgctcctcccctacgacgcgattgacacggaggcgcccttctccggcgcgttcaggggcagcgagggctggggctgggtgtccaacgtgatcggcgccggcgccagcctcggcatcctgacgtcgctcatggtggccatgcttggccaggccaggtacatgtgcgtcatcggccgctccggcgtcatgccggcatggctcgccaaggtgcaccccaacactgccacccccgtcaacgcctccgccttcctcgggctgttcacggcggcgctggcgctgttcacggagctggacatcctgctgaacctcgtctgcatcggcacgctcttcgtcttctacatggtgtccaacgccgtcgtgtaccgccgctacgtcctcgcagcctcctccagctcctccatccccaatggcggcagcgatcgccgcggcgctagcgcgtggccgacgctggcattcctgctagccttctcgctgctggccatcgccttcacgctgtcgtggaagctggcgcccgaggggcgcgcccggatcgcgctcctggcgtgcatcggcatcgcggcggtggccaccgtcggcgcgttccagctcctggtgccgcaggcgcacacgccgcagctctggggcgtgccggggatgccgtgggtgcccgcggcgtctgtcttcctcaacgtgtttctcctggggtcactggaccggccgtcctatgtccggttcgcgttcttctccgccgccaccgtgctggtctacgcgctctatagcgtgcacgccagcttcgacgccgaggagaccggcagcggcgacgacggcggcgccaaggtgcaggacgaagactgcaaggtgtagcgagcgatgatcgagctagatgtagttaacggctgcagtaggtttttctttcttcttcttgattttaggctagttcttggagactttggagtaaagcaaacaagctaacatggtgatcaaaccagaaaaattgggagagaattggggggagttaaaaaaaatgtagatttaccctggaacttgcaactgccatgttcaagttcttttcaaaatgtgcatgttctgatttcccgggagaaacttcagcacaaaa

SEQ ID NO: 4960 - DNA, 1987 bp, Panicum virgatum
gctggcgcagacaccccggcgcgtggcgcggcgggcgtgcgcggcgacggcgcccggggaggagatgagccgggtgcgggcgcggtcgggcgcgcacatggcgcgcgcgctgcggtggtgggacctcgtcgggctgggcctgggcggcatggtgggggccggggtcttcgtcaccacgggccgcgccaccaggctctacgcggggcccggggtcgtcgtgtcctacgccattgccggcctctgcgcgctgctctccgccttctgctacaccgagttcgccgtcgacatgcccgtcgccggcggagccttcagctacctccgcgtcaccttcggggagttcgcggcgttcctgacgggggcgaacctgatcatggagtacgtcttctccaacgccgccgtggcgcgaagcttcacggcgtacctgggcacggcggtcggcgtcgacgcgcccagcaagtggcggatccccgtgccgggcctgccggaggggttcaaccaggtggacctcgtcgccgtcggcgtcatcctcctcatctccgtatgcatctgctacagcaccaaggagagctcgttggtgaacatggtcctgacggcggtgcacgtggcgttcatcctgttcatcatcgtcatcgggttcgtgcacggcgacgcgcggaacctgacgcaccccgccgacccgtcccagaaccccggcggcttcttcccgcacggcgccatgggcgtgttcaacggcgcggccatggtgtacctgagctacatcgggtacgacgccgtgtccaccatggcggaggaggtggagcggcccgcacgcgacatccccatcggcgtctcgggctccgtcgtcgtcgtcaccgtgctctactgcctcatggccgcctccatgtccatgctccttccctacgacgcgattgacccggaggcgccgttctcgggagcgttcagggggcggaaggggatggcgtgggtgtccaacgtgatcggcgccggcgctagcctcggcatcctgacgtcgctgatggtggcgatgctcgggcaggcgcggtacctctgcgtcatcggccgctccggcgtcatgccggcctggctcgccagggtgaacccccgcaccgccacccccgtcaacgcctccgccttcctcggcctcttcacggcggccctggcgctgttcacggagctggacatcctgctcaacctcgtctgcatcggcacgctcttcgtcttctacatggtggccaacgccgtcgtgtaccgccgctacgtcggcgccggcgagtttgggcgcgcctggccgacgctcgcgttcctcgccgctttgtccctcgtcgcgctctccttcacgctggtctggaagctggccccggccgagcgcggcgtgcggacgggcctcctcgccgcgtgcgcggcgctcgcggtcgccacggtcgccgcgttccaggcgctggtgccgcaggcgcacgcgcccgagctgtggggcgtgcccgggatgccgtgggtgcccgcggcgtccgtgtttctcaacgtcttcctgctgggctcgctggaccggccctcctacgtccggttcggcttcttctcggccgccgcgttgctggtgtacgtgctctacagcgtgcacgccagctacgacgccgaggagagcggtctcgacggcgccggggcaaaggtgcaggacgaagcgtgcacggtgtagcaggatgcctggctgacgtcatacagaggcagctaatcctaattcagtgctgctcacaggctctagtatgcttttttctcttcctatttttgacttgttctgtgctgacgagaacaaaggaaaaaaaagaatctaacaagggtgggtaaaacaacccaatggaaatagagagaaacaaagggatatgcatcctgtaatttgcaaagatgaaaagtgtatatgctaaaggagtcaatgaaggattcctccgatcttgcttcgaaaatgttatgctaattcatgagttataaaaagaca

SEQ ID NO: 4961 - DNA, 3034 bp, Zea mays
ccgcactctccacccgtgagccgctcccccttccgtcccggccctcccgcttccccgaatcccggagaaaccgccgccatggacaaggccgcgctggtggctgagaacagcacggacgccggcgggtcgtcgtcgtcgttctcgggcctgcgcgcgtacgggcgcgcgctggcgcagacgccgcggcgcctggcgcggcgcgcgtgcgccgccacggcgccccgcgaggagatgagccgcgtgcgcgcgcggtcgggcgcggacatggcgcgcgcgctgcggtggtgggacctggtggggctggggctcggcggcatggtgggcgccggcgtgttcgtgaccacggggcgcgccgccaggctctacgcggggcccggcgtcgtcgcgtcctacgccattgcgggcctctgcgcgctgctctccgccttctgctacaccgagttcgccgtcgacatgcccgtcgccggcggcgccttcagctacctccgcgtcacgttcggggagctggcggcgttcctgacgggggcgaacctgatcatggagtacgtgttctccaacgccgccgtggcgcgcagcttcacggcgtacctcggcacggcggtgggcgtggacgcgcccagcaagtggaggattcctgtgccgggcctgccccaggggttcaaccaggtggacctcgtcgccgtcggcgtcatcctcctgctctctgtctgcatctgctacagcacaaaggagagctcggtggtgaacctggtgctgacgggcgtgcacgtggtgttcatcctcttcatcatcgtcatggggttcgcgcacggcgacgcgcgcaacctgagcaggcccgccgacccggcccacagccccggcggcttcttcccgcacggcgccgcgggcgtgttcaacggcgcggccgcggtgtacctgagctacatcggctacgacgccgtgtccaccatggccgaggaggtggagcggcctgaccgcgacatccccgccggcgtctccggctccgtcgtcctcgtcaccgtgctctactgcctcatggccacctccatgtccatgctcctcccgtacgacgcgatcgacccggaggcgccgttctcgggggcgttcaaggggcgggacgggatggcgtgggtgtccaacgtcatcggcgccggcgcgagcctcggcatcctcacgtcactgatggtggccatgctggggcaggcccggtacctgtgcgtcatcggccgctccggcgtcgtgcccgcctggctcgccagggtcgacccccgcaccgccacccccatcaacgcctccgccttcctcggcctgctgacggcggcgctggcgctgttcacggagctggacgtgctcctgaacctcgtctccatcggcacgctcttcgttttctacatggtggccaacgccgtcgtgtaccgccgctacgtgggcgacccgtgccccggctccggccagaagaggagggcctggccggcgctggccttcatcgcggccttctccctcattgcgatctccttcacgctgctgtggcagttcgcgccggggggcgccgccaaggtcgggctcctgtccgggaccgcggcggtcgcagtcgccgcggttgtcgcgttccaggcgctggtgccgcaggcgcgcgagcccgagctgtggggcgtgcccgggatgccctgggtgcccgccgcgtccgtcttcctcaacgtattcctgctcggctcgcttgaccgcccgtcgtacgtccggttcggcttcttctcggccttcgcagtgctgttctacgtgttctacagcgtgcacgccagctacgacgccgaggagggcggcgcggtggacggaggcggcggcggcgacaagctgcaggaccaaggatgcgatgtgtaggcgtgtagcagagtggctgacgtaggcagacagctcagccttccttgatctaccttttgctttgtttttttgttatgtttagatgtttttagtaggttcttagaactaattgtcattgagttagtgctgatgcatgtccgtgacaccctcgagggaaaaacaacctgaaggaaatagagagagaaatgacaggcagatgcaagatgaaatgcgactacatatatccttcacatttttttggttattattggccttgtttggattggagaaatgcaacagaggaaaggaagaagacaagaaatgtgtacatgtagaaaaccgaaaacagacagattgaaaaacactaaaaaatttataggaacaggagtttggaacacagtaatataaaacgtgttatcatctattttagtgaataaagacttgctcatccctctattaacatgtaggaaaatttataaggactagtttgaaaactcaaatcccctcccgaattagaggggattgagggaaaaattagttcatttccacctcaatctcctctaagccggaagggatttaaatttctaaactagtgtaacagtttgaagtaattgttttattcctctatttctttaataaaacgaatccccccccccccccccccccccccccccccccccccccccccccccccccccccccccccccccccccccccccccccccccccccccccccccccccccaataatattaaagccttttactctttttcattagtttttcttattttgtctagcagatgaatgatcatacttcgcaaaaagtagctacctcaggtaggcaacctgctgattttgctcgtgttgtcgttcggtttcccccgacgcacttgcgaccttccgttctctgctagcaaccttgttgattctgttttgtgcgctcggttctagtcttcccggcgcacttcccataggcaagctgtcaagaggattatagggtacctttgtttcactcctgagtttggtttgtggtactccttgtcttctgccatgtctttgtctgggtattcagatgttgattttgcggcatgtcctttggatcgcaaatctacttttaggacttgttagtttttggggactttgttggtggtcttcacgcaaatagtatagcgttg

SEQ ID NO: 4962 - DNA, 2201 bp, Sorghum bicolor
ccccactatcctcgcctcctcccgtcccgtgatcccgtccgtccctcccgctccccgaatcccggagcaaccgccgcccgccgccatggacaaggccgcgctggtgtccgagagcaccgacgacgtcggtcccgcgggcggcggctcgtcgtcgtcgttctcggggctgcgcgcgtacgggcgggcgctggcgcagacgccgcgtcggctggcgcggcgcgcgtgcgcggccacggcgccgcacgaggagatgagccgcgtgcgggcgcggtcgggcacccggatggcgcgcgctctgcggtggtgggacctcgtcgggctggggctcggcggcatggtcggcgccggggtgttcgtcaccacgggccgcgccgcgcggctctacgcggggccagggctcgtcgtgtcctacgccattgcggggctctgcgcgctgctctccgccttctgctacaccgaattcgccgtcgacatgcccgtcgccggcggcgccttcagctacctccgcgtcaccttcggggagttcgcggcgttcctgacgggggcgaacctgatcatggagtacgtcttctccaacgccgccgtggcgcgcagcttcacggcgtacctgggcacggcggtcggcgtggacgcgcccagcaagtggcggatcccagtgccgggcctgcccgaagggttcaaccaggtggaccttgtcgccgtcggcgtcatcctcctgctctccgtctgcatctgctacagcaccaaggagagctcggtggtgaacctggtgctgacgggggtgcacgtggcgttcatcctcttcatcatcgtgatggggttcgtgcacggcgacgcgcggaacctgtcccgccccgccgaccccgtccacaaccccggcggcttcttcccgcacggcgcggcgggggtgttcaacggcgccgccgcggtgtacctgagctacatcggctacgacgccgtgtccaccatggccgaggaagtggagcggcccgaccgcgacatccccgccggcgtctccggctccgtcgtcctcgtcaccgcgctctactgcctcatggctgcctccatgtccatgctcctcccctacgacgcgatcgacccggaggcgccgttctcgggggcgttcaaggggcgggacgggatggcgtgggtgtcgaacgtcatcggcgccggcgccagcctcggcatcctcacgtcgctcatggtggccatgctggggcaggcccggtacctgtgcgtcatcggccgctccggcgtcgtgcccgcctggctcgcccgggtcgaccgccgcaccgccacccccgtcaatgcctccgccttcctcggcctgctgacggcggcgctggcgctgttcacggagctggacgtgctcctgaacctcgtctccatcggcacgctcttcgtcttctacatggtggcaaacgccgtcgtgtaccgccgctacgtcggcgacccctgcccggccggcaccggcaccgcacacgagacgagggcgtggccgacgctggcgttcatcggggccttctccctgatcgcgctctccttcacgctgctgtggcagttcgcgccggggggcgccgccaaggccgtgatgctgtcggcgaccgcggcggccgccgtggccgtggtcgccgcgttccaggcgctggtgccgcaggcgcgggagcccgaggtgtggggcgtgcccgggatgccatgggtgcccgccgcgtccgtcttcctcaacgtcttcctgctcggctcgctggaccgcccgtcgtacgcccggttcggcttcttctccgccgccgtcgtgctggtctacgtgctctacagcgtgcacgccagctacgacgccgaggagggcggcgccgcggcggacggaggcgccggcgccggcgacaagctgcaggaccatgggtgcgaggtgtagcagagtcgttgacgtaggcagaggcagacagcgcagacttccttgatctatctttagctttgtttttgttattagattattattagatgttttaactaattattatcatcgagttagtgctgatgaatgtctgacatccttgagaaagaaaaacatacaaatagagacagaaatgacaagcagatgcagatgtagtttgcaagatggaatgtgattacataaattcttcatcttttctataattacgggtggactgaaaaataaaaatcgcgcaatcctgctggtgcca

SEQ ID NO: 4963 - DNA, 2125 bp, Secale cereale
aagccccctcacgaaagccgccccggcgcaatttctggagcggcacttgaatcctcacggccatggacaagggcgcacttatgacgccgggctcggatcagagcggccccgacggcggaacaggcgtgggctcgttctcgagcctgcgctcctacgggcgggccctgtcgcagacgccgcggcggctggcacggcgcgcgtgcgcggcgacggcgcctgaggaagagatgagccgcgtgcgcgcgcggtccggggctccgatgtcgcgcgcgctgcggtggccggacctcgtggggcttggcctcggcggcatggtgggcgccggggtgttcgtcaccaccgggcgcgccacgaggctccacgcgggcccaggcgtcgtcgtctcctacgccattgcaggcctctgcgcgctgctctccgccttctgctacacggagttcgccgtggacatgcccgtcgccggcggcgccttcagctacctccgcgtcaccttcggggaattcgctgcgttcctgacgggggcgaacctcatcatggagtacgttttctccaacgctgccgtggcgcgcagcttcacggcctacatgggcactgcggtcggcgtggacgcgcccagcaagtggcgcatcgccgtgccgggcctccccaacggcttcaaccaggtcgacctcgtcgccgtaggggtcatcctcctcatctccgtctgcatctgctacagcaccaaggagagctccaaggtgaatatggtcctcacggctgtgcacgtggcgttcatcctcttcatcatcgtcatgggcttctggcgtggcgatgtgggcaacctgacccaccccgctgacccggcccacccgggcggtttcttccccaacggcgtcggcggcgtcttcagcggcgccgccatggtgtacctgagctacatcggctacgacgccgtgtccaccatggctggaggaggtggagcggccggcgcgcgacatccccatcggcgtctcggggtccgtcatcatcgtcaccgtgctctactgcctcatggccgctccatgtccatgctcctcccatacgacgcgatcgacacggaggcgcccttctcgggggccttcagggggagcgacggatggggctgggtgtccaacgtgatcggggccggtgcgagcctcggcatcttgacgtcgctcatggtggccatgctggggcaggccaggtacctgtgcgtcatcggccgctcaggcgtcatgcccgcctggctcgccaaggtgcaccccaagaccgccacccccgtcaacgcctccgccttcctcggactcttgacggctgcgctggcgctcttcacggagctggacatccttctcaacctcgtctgcatcggcacgctcttcgtcttctacatggtgtccaacgccgtcgtataccgccgctacgtcgtcggcccaaccggcagcagcaccgaatccggggaccggcagccgagcgcatggccgaccctcgcgtttctcctcgccttctccctcatcgcgctctccttcacgctggtgtggaagctggcgccagagggcggtcgcaccagggtcgggctcctgtccgcgtgcggcgcggcggcggtggccacagtcggcgcgttccaggcactggtgccccaggcgcacacgcctgagctttggggcgtgccgggcatgccgtgggtgcccgcagcgtccgtgttcctcaacgtcttcctgctcggctccctggaccggccgtcctacgtccggttcggcttcttctctgcggccgccgtgctcgtgtacgtgctgtacagcgtgcatgccagctatgacgccgaggagagcgccacgctcgacggcgccaaggtgcaggacgaagcttgcagggtgtagctactagctaggctggagaggatgagcttgttaactgctgctctagagcgtctagttttttcttcttcttgacaagtttctgtcatgttctagatttcgagtagctgttgcgagtacaacaaaggagctaacaaggtgatgaaatgtgaaaactgagagaagattgggggaaaggggacgttacctggaacttgcatgcgaatgcacaaattctttgaaagtgtacatgctctaatttcctggaagatact

SEQ ID NO: 4964 - DNA, 2746 bp, Sorghum bicolor
ttgccctccaattccactatttgtattcgatatgcatgcatgtacgtatgctctacacaatacacggttgcgcaatcagcttcactacagcctttgcagatactaccatgactgtgctcttcaccaatcacccgggcctgccccgccggcccagcctctttatataccgcacgcccgccctcgccctcggccctcgccaacccctcgtcacgcggctcacgcctctccgtcccagctcctgctcctcctccccccaaaacggccaaatccccctgatcactcccgccaccaccaccgctccaccagcaaccaacccaacccaacccaacacctgtgcgtgggagcgcgtgcgtgtgctttgcggcggcggcggcagcggcagccatggacaataagtgcttggcgctggcgtcctccgatgccgtccaccaccacccggcaggggtcacagcgaacgccgccatcggcggcacgggtacctcctcctcctcctcctcctcgttcgcgagctggcgcgcgtacgggcgcgcgctagcgcagacgccacgccggctgtcgcgccgcgcgttcgccgcgacggcggccggggaggagatgagccgggtgcgggcgcggtcgggcgccgacatggcgcgcgcgctgcggtggtgggacctcgtcgggctgggcctgggcggcatggtgggcgcgggcgtcttcgtcaccacgggccgcgccgcgcggctgcacgcggggcctggcgtcgtggtgtcctacgccattgccgggctctgcgcgctgctctccgccttctgctacaccgagttcgccgtcgacttgcccgtcgccggcggcgccttcagctacctccgcgtcaccttcggggagctggcggcgttcctgacgggggcgaacctgatcatggagtacgtcttctccaacgccgccgtggcgcgcagcttcacggcgtacctgggcacggcggtgggcgtggacgcgcccagccagtggcggatcaccgtgcacggcctgcccgacggcttcaaccaggtggacctcctcgccgtcgccgtcatcctcctcatcaccgtctgcatctgctacagcaccaaggagagctcggtggtgaacatggtgctgacggcggtgcacgtggcgttcatcctgttcatcatcggcatggggttccggcacggcgacgcgcgcaacctgacgcgccccgcggacccgtcgcgcagccccggcgggttcttcccgcacggcgccgtgggcgtcttcaacggcgccgccatggtgtacctgagctacatcggctacgacgccgtgtccaccatggccgaggaggtgcagcggcccgcgcgcgacatccccgtcggcgtctccggatccgtcgtcgtcgtcaccgtgctctactgcctcatggccgcctccatgtccatgctcctcccctacgacgcgattgacccggaggcgccgttctcgggggcgttcaaggggcgggagcggtgcgcctgggtgtccaacgtcatcggcgccggcgccagcctcggcatcctcacctcgctcatggtggccatgctgggccaggcgcggtacctgtgcgtcatcggccgctccggcgtcatgccggcgtggctcgcccgggtcaacccgcgcaccgccacccccgtcaacgcatccgccttcctcggcgtcttcacggcggcgctggcgctgttcacggagctggacatcctgctcaacctcgtctgcatcggcacgctcttcgtcttctacatggtggccaacgccgtcgtgtaccgccgctacgtcggcggcggcggcgcgagatggccgacgctcgcgttcctcctcgtcttctccctgtccgcgctcgccttcacgctggcgtggaagctggcgccacccgagcggcggggcgtgcgcgcgggcctgctggcggcgtgcgcggcgctggcggtgaccgcggtcgccgcgttccaggcgctggtgccgcaggcgcgcgtccccgagctgtggggcgtccccgggatgccctgggtgcccgccgcgtccgtcttcctcaacgtcttcctgctcgggtcgctcgaccgcccctcgtacgtccgcttcgccatcttttcggccgccgcgctcctcgtgtacgtgctctacagcgtgcacgccagctacgacgccgaggagagcggccggctcgacgtcgacggcggcggcggcggcaaggtgcaggacgaagcgtgcacggtggtgtagttcgttacattgggggtgtctggctggctgacgtcatagagaggactaatcctaatccagtgtggctcacttgtcacttgctatttttgacacgtacgttgtagtacgttcgtatgctgacgagagcacagaaaaagaatctaacaagggggggtgatgatatatattaaaaaaaagatggaaggaaatagtagacaagaacaaagggtgagacatgtattctgctctaacttagcaaagatgaaaaatgtatacgctcaaggaaggatagatgcatataatcctctagacttccttcgaaatttttgtgatgttgtgggaaattcaaagcgggatcgatcgattgacttaagctcactgaattattgcaagggaaaaatattgtttaatggctagcagatttcgcaaataagctcaatagactgttatgggcacaacctcgcaaaaaccacagtcatgcctttaagttagttgatgatgtggctgagaaaaaacaatgaatcccttgtttgct

SEQ ID NO: 4965 - DNA, 2216 bp, Panicum virgatum
actaaacacaccctgagagctgcgcggtaggttccggctcgggacgtttttttttttgaaaacttgggctccggacgttggatacttggatttccagcgacgccaccgcgtggtccggcgagggccggggccctgagccatcgccctcctcgcttcctcccaccttcctcccgcgttgccatttcagagcaggtcgcgggcggcgcgctcacacggtcacggtctcctcagtcctcaccctcacgcgcagcccgtcacaccgcatcacatcgatccctccttccccgctccccaacccagacgccgactccttcaactccgcgtctacgtcttcgtcccctgcctgcacgattgattgaatcttctccctccccatttgccagccacccactagtatttcttctcccgatccaagaagaaacctgccgccggagcgaatcccaagaaacgatcttgatctcgatccgcgaggaagctagtcggccacccagccagagccagagcagcggcgcgatccaggagagccagccagccgacatgaacaacctgttctcgagctcgtggaagcgcgtcggcggcggcggtggggacggggacatcgagtccggcggcgtggagctgtccgcgccgccgggtgccgcggcgggggcgagcctggacaagttcttcgaggacgtggagtccatcaaggacgagctccgcgacctggagcgcatccagcgctccctccacgacgccaacgagggcggcaagtcgctgcacgacgcggcggccgtgcgcgagctccggtcccggatggacgccgacgtcgccgcggcgatcaagaaggccaaggtggtgaagctccggctcgagtccctggaccgcgccaacgccgcgaaccggtcggtgcccgggtgcggcccggggtcctccaccgaccgcacccggacgtccgtggtggccgggctccgcaagaagctccgggactcgatggaggccttctcctccctccggtctcgcatcgcgtccgagtaccgcgacacggtggcgcggcggtacttcacggtgacggggtcgcagccggacgaggcgaccctggacgcgctggcggagtccggcgagggagagcggttcctgcagcgcgcgatcgcggagcaggggcgcggggaggtgctgggcgtggtggcggagatccaggagcggcacggcgcggtggcggagctggagcgcagcctgcgggagctgcagcaggtgttcaacgacatggcggtgctggtggcggcgcagggggagcagctggacgacatcgagggcaacgtggggcgcgcccgctccttcgtcgaccgcggccgggagcagctgcaggtggcgcggaagcaccagaggagcacgcgcaagtggacgtgcatcggcatcctcatcctcctcgtcatcatcctcgtcatcgtcctccccatcgtgctcaagaccgtcaacaacaacaagagcaactagcagcagcctggccatcgttgttcatggcgatccggcggtgctcttgtggatacgatacaccgggagagattgttatttcttgtttccaattcgttatagttgtttgttcgtggcgtttgtatctatatggctagctgatccgatcgagctgactacatatatcggtgattttgtttatgatgatgacatttgggttggaatctcgagccgggtcatttctctgttcttgatgcgtgggggcagcttggatcggatcgagcaggcaggcgagactcgcgtcgcgagtcaaacctgctctaaagtggttgcagagtacgcaggacgccgcttcagcgttgacgcccagggaggagcggagagctccagtcccgagcttcgtgaccgaccgcaccggcgccggcgccgccgtgcccgttggctcaccgacagggacggccccgtcctcctcgccgtctcccttgccgccgcgccttcctcctctgctcttgggctcccgctgcctgccccaccgcacgacgtggccaccgccgcgcggccccgagccacgtcttccaccacctcgcgcaaggggaaaagcacgcgccggccgcggcacgtgcctgtgtacagtgtacccgcctgcgcagacccgttttctccgtcaacacattacacatgggaggggcaaacaaaacctcaggacagcacaggagccatctctgcaaggcatctcatcatgcaaaggggcaaactaaatggag

SEQ ID NO: 4966 - DNA, 1196 bp, Panicum virgatum
tagtatttcttctcccgatccaagaagaaacctgccgccggagcgaatcccaagaaacgatcttgatctcgatccgcgaggaagctagtcggccacccagccagagccagagcagcggcgcgatccaggagagccagccagccgacatgaacaacctgttctcgagctcgtggaagcgcgtcggcggcggcggtggggacggggacatcgagtccggcggcgtggagctgtccgcgccgccgggtgccgcggcgggggcgagcctggacaagttcttcgaggacgtggagtccatcaaggacgagctccgcgacctggagcgcatccagcgctccctccacgacgccaacgagggcggcaagtcgctgcacgacgcggcggccgtgcgcgagctccggtcccggatggacgccgacgtcgccgcggcgatcaagaaggccaaggtggtgaagctccggctcgagtccctggaccgcgccaacgccgcgaaccggtcggtgcccgggtgcggcccggggtcctccaccgaccgcacccggacgtccgtggtggccgggctccgcaagaagctccgggactcgatggaggccttctcctccctccggtctcgcatcgcgtccgagtaccgcgacacggtggcgcggcggtacttcacggtgacggggtcgcagccggacgaggcgaccctggacgcgctggcggagtccggcgagggagagcggttcctgcagcgcgcgatcgcggagcaggggcgcggggaggtgctgggcgtggtggcggagatccaggagcggcacggcgcggtggcggagctggagcgcagcctgcgggagctgcagcaggtgttcaacgacatggcggtgctggtggcggcgcagggggagcagctggacgacatcgagggcaacgtggggcgcgcccgctccttcgtcgaccgcggccgggagcagctgcaggtggcgcggaagcaccagaggagcacgcgcaagtggacgtgcatcggcatcctcatcctcctcgtcatcatcctcgtcatcgtcctccccatcgtgctcaagaccgtcaacaacaacaagagcaactagcagcagcctggccatcgttgttcatggcgatccggcggtgctcttgtggatacgatacaccgggagagattgttatttcttgtttccaattcgttatagttgtttgttcgt

SEQ ID NO: 4967 - DNA, 1352 bp, Sorghum bicolor
ccaacgcacatcgatagcaaaagaaaatgagccggctccagactccaatccatatgtgttattgttgatgcaaaagggcgtcaacagttataaacaaaaccaccggtaataaataactataatcaagtcgaccagatcaatcaactaaccgtatcatacaaaggccacgaacaaaaagaactagaacgaatctggggttgtggaaaaacccaacgataatcatctctcccggtgtatacgtatccaccacaagacggcagcaacctgatcagtgatcaccatgcatgaacaaacgcaggcagagcacagcgcggcgggctagttcttcttggtgttttggagcacgatggggaggacgatgacgaggatgatgacgaggaggatgaggatggcgatgcaggtccacttgcgcgtgctcttctggtgcttcctcgccacctgcagctgctcgcgcccgcgatcgacgaacgaccttgcccgccccacgttcccctcgatgtcgtccagctgctccccctgcgcggccacgagcacggccatgtcgttgaacacctgctgcagctcaagcagggaccgctccagctccgccacggcgccgtgccgctcctggatctccgccaccacgcccagcacctgccctctcccttgctccgcgatggcgcgctgcaggaaccgctccccttccccggactccgccagcgcgtccagcgtcgcctcgtcgggctgcgtccccgtcaccgtgaagtaccgccgcgccaccgtgtccctgtactcggacgccacgcgggaccgcagcgacgagaaggactccatcgagtcgcggagcttcttgcgcagcccggccacgacggaggtccgggtgcggtcggtggaggaaccgggcccgcacccgggcaccgagcggttggcggcgttggcgcggtccagcgactcgagacggagcttcaccactttcgccttcttgatcgccgcggagacgtccgcgtccatccgcgcgcggaggtcgcgcaccgcggacgcgtcgtggagagacttgcccgcctcgttgccgtcgtggagcgagcgctggatccgctccaggtcacggagctcgtccttgatcgactccacgtcctcgaagaaccggtccaggctcgcacccgccgcggcacccggcggcgcagacatctccacgctgccggactcgatgtccccgtcgtctcccccgccgcgcttccatgagctcgagaacaagctgttcatggctgctggctttgctgtatcgcctcgcctgggtgatcagctggatcgctggcgcccgctgctctgtatcacctggctgattggcttcctcacggatcaaggtcgtttct

SEQ ID NO: 4968 - DNA, 1595 bp, Panicum virgatum
ctgagccatcgtccggtcgtcgtctccgactcgtgtacgtgcccgtcctcgccttcctcccaccttcctcccgcgttggcattacagagcaggtcgcgggcggcgcgctcacacagtcacacggtctcctcagtcctcaccctcacgcgcagcccgtcacatcgcatcgcatcgttccctccttccccgttccgctccccaacccagacgccgactccttcaactccgcgtcctcgtcccctgcttgcacgattgattgattgaatcttctccctctccatttgccagccaccactagtatttcttctcccgatccaagaaacctgccgccggagcgaatcccaagaaacgatcttgatcccgatccgccaggagactagccggacacccagccagagccagagcagcggcgcgattcaggagacagccagccagccgccatgaacaacctgttctcgagctcgtggaagcgcggcggcggcggggacggagacatcgagtccggcggcgtggagctgtccgcgccgccgggtgccgcggcgggcgcgagcctggacaagttcttcgaggacgtggagtccatcaaggacgagctccgcggcctggagcgcatccagcgctccctccacgacgccaacgaggggggcaagtcgctgcacgacgcggcggccgtgcgcgagctccggtcccggatggacgccgacgtcgccgcggcgatcaagaaggccaaggtggtgaagctccggctcgagtccctggaccgcgccaacgccgccaaccggtcggtgcccgggtgcggcccggggtcgtccaccgaccgcacgcgcacgtccgtggtggccgggctccgcaagaagctccgggactcgatggaggccttctcctccctccggtcccgcatcgcagccgagtaccgcgacacggtggcgcggcgctacttcacggtgacgggggcgcagccggacgaggcgacgctggacgcgctggcggagtccggcgagggggagcggatcctgcagcgcgcggtggcggagcaggggcgcggggaggtgctgggcgtggtggcggagatccaggagcggcacggcgcggtggcggagctggagcgcagcctgcgggagctgcagcaggtgttcaacgacatggcggtgctggtggcggcgcagggggagcagctggacgacatcgagggcaacgtggggcgcgccaggtccttcgtcgaccgcggccgggagcagctgcaggtggcgcggaagcaccagaggagcacgcgcaagtggacgtgcatcgccatcctcatcctcctcgtcatcgtgctcgtcatcgtcctccctatcgtgctcaagaacgtcaacaagagcaactagcagcagcagcagcctggctgattggccatggcgatccggcggtgctcttgtggacgcaatacaatacgccgggagagattattattgtttcttgtttcgaattcgttatagctgtttgttcgtggcgtttgtatcatactccgtatatggctagctgattacattatcggtgatttttgtttcacgtcatctgggttggattctcgagccgagccatttctctgttct

SEQ ID NO: 4969 - DNA, 1676 bp, Zea mays
cctcgctcgtacgtgtccgtgcccccctctgccctctccttcgtcccaccttcctcccgcgttgccatttcagagcaaggtggcgcgcgccgcctcctcatcacacggtctcctcgcccgccacggcgtcacatcacatggatgcctcggcacggccgactccttcaactccgcgtccgtcgtcttgttccatctcgcatgattgattgaatctccacgccccccttgtccaactacccctcccactatttcatttcatttcatccccccgatccaagaaaccggccaccgggccggagcgaacccttagaagcgaccttggcccgtgaggaagccaatcagccagagacagaacaatccatccaccatgaacagcctgttctcgagctcatggaagcgcgacggcggggacatcgagtccggcggcgtggagatgtctgcgccgccgggcgccgcggcgggcgcgagcctggacaggttcttcgaggacgtggagtccatcaaggacgagctccgcgacctggagcgcatccagcggtcgctccacgacgccaacgaggggggaaagtcgatgcacgacgcggcggccgtgcgcggcctccgcgcgcggatggacgcggacgtggccgcggcgatcaagaaggccaaggtggtgaagctgcgcctcgagtcgctggaccgcgccaacgccgccaaccggtccgtgcccgggtgcgggccgggctcctccaccgaccgcacccggacgtccgtcgtggccgggctgcgcaagaagctccgggactcgatggagtccttctcgtcgctgcggtcccgcgtcgcggccgagtaccgggacacggtggcgcggcggtacttcacggtcacgggggcgcagcccgacgaggcgaccctggacgcgctggcggagtccggggaaggggagcggttcctgcagcgcgccatcgcggagcagggccaggggcgcggggaggtgctgggcgtggtggcggagatccaggagcggcacggcgccgtggcggggctggagcgcagcctgctggagctgcagcaggtgttcaacgacatggccgtgctggtggccgcgcagggggagcagctggacgacatcgagggcaacgtcggccgcgccaggtccttcgtcgaccgcggacgcgagcagctgcaggtggcgcggaagcaccagaagagcacccgcaagtggacctgcatcgccatcctcatcctcctcgtcatcatcctcgtcatcgtcctccccatcgtgctcaagggcgtcaataagaactaggccgcctggcctgcgtaattcgttctagttttttttttcgtggcctttgtatcatacatacggttcgttgatacggtcgtcttgattatattttcttctattgcctcaaccttcgattacatggttttgtttataacacatgattcattttcttttgctgtcgatgtgccttggggaaagatgaacgagcttaggtcggaacttgcgggtcaaaacctgcttttgcggtggttattgactttactcgtacgcagcacgcacgcctgtgacctgacgcactcccggtcttcctcctagtcgggctcgggcatataccgggccagtcgccagggccggctggtgcgccagcgcctcgcatataccgggtcaacaatcttttgctattctc

SEQ ID NO: 4970 - DNA, 2022 bp, Sorghum bicolor
tggaaatcctctgctctcaattgtacggcagctgttccggtcagggtggttggttccgggcgttggatttccagcgacgccaccgcgtgatccggcgaccgactcgccaaattgtaccacatatcggcgtctcaagaacccttcgctcgtacgtgtccgtgccccctctccttcgtcccaccttcctcccgcgctggcgttgccatttcagagcaaggaggcgcgcgcacacggtctcctctcctcggcctcacgcgcagcccaagcccgccacggggtcacatcacatggatggatgtctgcctcggcacggccgactccttcaactccgcgtccgtcgtcttccctttcgcttcgcatgattgatgattgaaatctcctcgcgcccttgcccaactacccctcccactatttcatctcccgatccaagaaaccggccaccggagcgaaccccgagaaacgaccttgatccgtgaggaagccaatcagccaggtgatacagagcagcgggcgccagcgatccagctgatcacccaggcgaggcgatacagcaaagccagcagccatgaacagcttgttctcgagctcatggaagcgcggcgggggagacgacggggacatcgagtccggcagcgtggagatgtctgcgccgccgggtgccgcggcgggtgcgagcctggaccggttcttcgaggacgtggagtcgatcaaggacgagctccgtgacctggagcggatccagcgctcgctccacgacggcaacgaggcgggcaagtctctccacgacgcgtccgcggtgcgcgacctccgcgcgcggatggacgcggacgtctccgcggcgatcaagaaggcgaaagtggtgaagctccgtctcgagtcgctggaccgcgccaacgccgccaaccgctcggtgcccgggtgcgggcccggttcctccaccgaccgcacccggacctccgtcgtggccgggctgcgcaagaagctccgcgactcgatggagtccttctcgtcgctgcggtcccgcgtggcgtccgagtacagggacacggtggcgcggcggtacttcacggtgacggggacgcagcccgacgaggcgacgctggacgcgctggcggagtccggggaaggggagcggttcctgcagcgcgccatcgcggagcaagggagagggcaggtgctgggcgtggtggcggagatccaggagcggcacggcgccgtggcggagctggagcggtccctgcttgagctgcagcaggtgttcaacgacatggccgtgctcgtggccgcgcagggggagcagctggacgacatcgaggggaacgtggggcgggcaaggtcgttcgtcgatcgcgggcgcgagcagctgcaggtggcgaggaagcaccagaagagcacgcgcaagtggacctgcatcgccatcctcatcctcctcgtcatcatcctcgtcatcgtcctccccatcgtgctccaaaacaccaagaagaactagcccgccgcgctgtgctctgcctgcgtttgttcatgcatggtgatcactgatcaggttgctgccgtcttgtggtggatacgtatacaccgggagagatgattatcgttgggtttttccacaaccccagattcgttctagttctttttgttcgtggcctttgtatgatacggttagttgattgatctggtcgacttgattatagttatttattaccggtggttttgtttataactgttgacgcccttttgcatcaacaataacacatatggattggagtctggagccggctcattttcttttgctatcgatgtgcgttgggggaagaagatgaacgatcttggaatgggatccgaacttgcgggtcaaacctgcttttgcggtggttgttgagtagtccatactcccacccacgcagcatgcacgcctgagacttacgctatacttggccaaaccggcggcccggacatggcactatcccactgtatctatcgtgccgtgccgtcttgagtcatcatgctaaactttcggtccag

SEQ ID NO: 4971 - DNA, 1413 bp, Secale cereale
agccatcggtgtagtaccattctactacttgcgccatagtgaaggctcgccgtctcctccttcctcccaccttcccctcgcacgagacggcagaccccttcaaccccgcaactccgcgtccccgatctcaccttccttgctctgctcgctactactatagtaacctctcttgtccactctgcttctccccatccaagaaaccgcgccaggacctccacccatcgaggagaatccacaagccggcgtggtaatcgaagaaatcgatcgggtagcctgagccggcggaagccatgaacaacctcttctcgagctcgtggaagcgcgcgggcgcggggggcggcgacggggacctcgagtccggcggcggcggcggggtggagatgacggcgccgccgggcgccgcggcgggggcgagcctggaccgcttcttcgaggacgtggagtccatcaaggacgacctgcgggagctggagcggatccagcgctcgctccacgacggcaacgagtcgggcaagtcgctccacgacgcctccgccgtgcgcgcgctccgctcccgcatggacgccgacgtcgccgccgccatcaagaaggccaaggtggtgaagctccgcctcgagtcgctcgaccgggccaacgccgccaaccgctccgtggccgggtgcgggccggggtcgtccacggaccgcacgcggacctccgtcgtggccgggctgcgcaagaagctgcgggacgccatggagtccttctcgtcgctccgctcccgcatcacctccgagtaccgggacacggtggcgcggcgctacttcaccgtcaccgggtcccagcccgacgaggcgacgctggacacgctggcggagacgggggagggggagcggttcctgcagcgggccatcgcggagcagcaggggcgcggggaggtgcagggcgtggtggcggagatccaggagcggcacggcgccgtggcggacctggagcggagcctgctggagctgcagcaggtgttcaacgacatggccgtgctggtggcggcgcagggggagcagctggacgacatcgagggccacgtcgggcgcgcgcggtcgttcgtcgaccgcggccgcgagcagctccaggtcgcccgcaagcaccagaagagctcccgcaagtggacgtgcatcggcatcggcatcctgctcgtcgtcatcctcatcatcgtcatccccatcgtgctcaagaacaccaacaagagcaacaacaacaacggccagcagtaggcagtagcctgtggatctgcccgtgacgatgatcctggcttgcttcttgctgggtgttgctgattgttttttgtggaatttttggcgattgtaattactccatccatgtggttcgttgagccactcgattatattatatgactatatatacttttcggtg

SEQ ID NO: 4972 - DNA, 1537 bp, Hordeum vulgare
gtctccttcctcccaccttcccctcccacgagtctagacggcacggcagaccccttcaacgtcccaactccgcgtccccgccccgatcccactggctccgctcgccacaatactagcggttaagtaactaaccccttcttcctcccttgtccactccgcttctccccatccaagaaacagcgccaacagctccacccatcgaggagaatcaagaaaccgcgccggcgtggtgatcaaggacatccatcgatcgatcgaccgaccctgccttgcctgagtcaacccggcggcagccatgaacaacctcttctcgagctcgtggaagcgggcgggcgcggggggcgacggggacctggagtcgggcggcggcggcgtggagatgacggcgccgccgggcgccgcggcgggggcgagcctggaccgcttcttcgaggacgtggagtcgatcaaggacgacctgcgggagctggagcggatccagcgctccctccacgacggcaacgagtcgggcaagtcgctccacgacgcgtcggcggtgcgcgcgctccgctcccgcatggacgccgacgtggccgccgccatcaagaaggccaaggtggtgaagttgcggctcgagtcgctcgaccgcgccaacgccgccaaccggtccgtggccgggtgcgggccggggtcgtccacggaccgcacccgcacctccgtcgtggccgggctgcgcaagaagctgcgggatgccatggagtccttctcctccctccgctcccgcatcacctccgagtaccgggaaaccgtggcccgccgctacttcacggtgacggggtcccagcccgacgaggccacgctggacacgctggcggagacgggggagggggagcggctcctgcagcgcgccatcgcggagcagcaggggagaggggaggtgctgggcgtggtggcggagatccaggagcggcacggcgccgtggcggacctggagcggtccctgctggagctgcagcaggtgttcaacgacatggccgtgctggtggcggcgcagggggagcagctggacgacatcgagggccacgtcgggcgggcgaggtcgttcgtcgaccgcgggcgcgagcagctgcaggtggcacgcaagcaccagaagagctcccgcaagtggaccttcatcggcatcggcatcctgctcgtcgtcatcctcatcatcgtcatccccatcgtgctcaagaacaccaacaagagcaacaacaacaacagccagcagtagtggtaggaacagcctgtggatctgttgtctgtctctgatgatcctggtcctggattgcttcctggttgttgttgttgattgtcttttgtggaattttttgcgattgtaattactccatccatgtggttcgttgagccactcgattattatttcatgactatatacttttcggtgattttctttactgtagtagtagtactccctctgtaaaaataatactagaaatgtttagatcagttacgtactgtagtgatctaaaaagttcttatatttctttacggagaa

SEQ ID NO: 4973 - DNA, 1534 bp, Triticum aestivum
agccatcggatcggatcggatccacttgccgcagggagaagaagggtctctgggtcgccgtccccttcctcccaccttccccgagccccgcacgagacgagacggcagaccccttcaaccccccactccgcgtccccgccccgatcagtaccggttaagtaactaacctcttcttcctcccttgtccactccgcttctccccatccaagaaaccgcgccaggacctccaccgatcaaggagaatcaagaagccggcgtacagaccgatccatcgacccttgcctgagccggcagcagcagccatgaacaacctcttctccagctcgtggaagcgcgcgggcgcggggggcgacggcggggacctggagtccggcggcggcggcggcggcgtggagatgacggcgccgccgggcgccgcggcgggggcgagcctggaccgcttcttcgaggacgtggagtccatcaaggacgacctgcgggagctggagcggatccagcgctccctccacgacggcaacgagtcgggcaagtcgctccacgacgcctccgccgtgcgcgcgctccgctcccgcatggacgccgacgtcgccgccgccatcaagaaggccaaggtcgtcaagctccgcctcgagtcgctcgaccgggccaacgccgccaaccgctccgtggccgggtgcgggccgggctcctccacggaccgcacccgcacctccgtcgtggccggcctgcgcaagaagctgcgggacgccatggagtccttctcctccctccgctcccgcatcacctccgagtaccgggacacggtggcgcggcgctacttcacggtgacgggggcccagcccgacgaggcgacgctggacacgctggcggagacgggcgagggggagcggttcctgcagcgggccatcgcggagcagcagggccgcggggaggtgctgggcgtggtggcggagatccaggagcggcacggcgccgtggcggacctggagcggagcctgctggagctgcagcaggtgttcaacgacatggccgtgctggtggcggcgcagggggagcagctggacgacatcgagggccacgtcgggcgggcgcggtcgttcgtcgaccgggggcgcgagcagctccaggtcgcccgcaagcaccagaagagctcccgcaagtggacctgcatcggcatcggcatcctgctcgtcgttatacttatcatcgtcatccccatcgtgctcaagaacaccaacaagagcaacaacaacaacaaccagcagtagtaggaatagcttgtgatgatatgatcctggcttgcttgcatgcttgctgggtgttgttgattgttttttgtggaattttttgcgattgtaattactccatccgtgcggttcgttgagccaatcgattatgttatataactatatacttttcggcgatttatgagtggtaattatgcggttgattgagtttgggttggagtgtggagccaagcttgtgtgacaggtgagccaactttgacttggtcggagtccatgtgccggcgcgg

SEQ ID NO: 4974 - DNA, 1535 bp, Brachypodium distachyon
tttctttccacttctacttctacttggtggcgtctcggtcgtcgtctccttcctcccaccttcctctaaatcctctcgtacaagagaaagagagtagtcacgaccacttcaactccgcgtcccgatcccacttaactactgctgccacccccgcctttctcccgatccaagaaacagagcagaagccgccaccggtttaattttagttgattcagcgaggagatcgaggaggaagaaggagccgtgttgcgatcctgctgcggggccggccatgaacaacctcttctcgagctcgtggaagcgcgcgggcgacggggacctggagtccggcggggtggagatgtcggcgccgccgggcgcggcggcgggggcgagcctggacaagttcttcgaggacgtggagtccatcaaggacgacctccgcgacctggaccggatccagcgctccctccacgacggcaacgagtcggggaaatccctccacgacgcctccgccgtgcgcgcgctccgggcgcgcatggacgccgacgccgccgccgccatcaagaaggccaaggtcgtcaagctacgcctcgagtccctcgaccgcgccaacgccgccaaccgctccgtccccggctgcgggcccggaacctccaccgaccgcacccgcacctccgtcgtcgccggcctccgcaagaagctccgcgactccatggagtccttctcggcgctccgcgcccgcgtcagctccgagtaccgcgacaccgtggcccgccgctacttcaccgtcacgggcgcccagccggacgaggcgacgctggacacgctggcggagacgggcgaaggggagcggttcctgcagcgcgccatcgcggagcaggggcaagggcgcggcgaggtcatgggcgtggtggccgagatccaggagcggcacggcgccgtggccgacctggagcgcagcctgctggagctccaccaggtgttcaacgacatggccgtgctcgtggcggcgcagggggagcagctcgacgacatcgagggacacgtcggccgggcaaggtccttcgtcgaccgcggccgcgagcagctgcaggtggcgcgcaagcaccagaagagctcccggaagtggaagttcatcgccatcggcatcctgttagtcatcatcctcgtcatcgtcatccccatcgtgctcaagaacaccaagaacagcagcagcagcaacaacagcaaccagccgcagcagtagcagccgcgtcggccgtgatccgtgatcgattctggttgtccgtgttcgattttttttttgctccgtctccgtcgctgttgtaaagattagtaatatacatggttcgttgatccacctgattatacttttcggcgattcttgttgtaattatgcagttgggttagattgggattgggatggactttgaaaggtgtgtgacgggtgagcaaacttggacctggtcgaaactgatgtaccggcgcggttcgtccagcctgcaaatgcacaccttcctttgccgttcgttatgatgtttcttttcccgaag

SEQ ID NO: 4975 - DNA, 1509 bp, Brachypodium distachyon
ctggaggcgaagccattccacatttctttccacttctacttctacttggtggcgtctcggtcgtcgtctccttcctcccaccttcctctaaatcctctcgtacaagagaaagagagtagtcacgaccacttcaactccgcgtcccgatcccacttaactactgctgccacccccgcctttctcccgatccaagaaacagagcagaagccgccaccggtttaattttagttgattcagcgaggagatcgaggaggaagaaggagccgtgttgcgatcctgctgcggggccggccatgaacaacctcttctcgagctcgtggaagcgcgcgggcgacggggacctggagtccggcggggtggagatgtcggcgccgccgggcgcggcggcgggggcgagcctggacaagttcttcgaggacgtggagtccatcaaggacgacctccgcgacctggaccggatccagcgctccctccacgacggcaacgagtcggggaaatccctccacgacgcctccgccgtgcgcgcgctccgggcgcgcatggacgccgacgccgccgccgccatcaagaaggccaaggtcgtcaagctacgcctcgagtccctcgaccgcgccaacgccgccaaccgctccgtccccggctgcgggcccggaacctccaccgaccgcacccgcacctccgtcgtcgccggcctccgcaagaagctccgcgactccatggagtccttctcggcgctccgcgcccgcgtcagctccgagtaccgcgacaccgtggcccgccgctacttcaccgtcacgggcgcccagccggacgaggcgacgctggacacgctggcggagacgggcgaaggggagcggttcctgcagcgcgccatcgcggagcaggggcaagggcgcggcgaggtcatgggcgtggtggccgagatccaggagcggcacggcgccgtggccgacctggagcgcagcctgctggagctccaccaggtgttcaacgacatggccgtgctcgtggcggcgcagggggagcagctcgacgacatcgagggacacgtcggccgggcaaggtccttcgtcgaccgcggccgcgagcagctgcaggtggcgcgcaagcaccagaagagctcccggaagtggaagttcatcgccatcggcatcctgttagtcatcatcctcgtcatcgtcatccccatcgtgctcaagaacaccaagaacagcagcagcagcaacaacagcaaccagccgcagcagtagcagccgcgtcggccgtgatccgtgatcgattctggttgtccgtgttcgattttttttttgctccgtctccgtcgctgttgtaaagattagtaatatacatggttcgttgatccacctgattatacttttcggcgattcttgttgtaattatgcagttgggttagattgggattgggatggactttgaaaggtgtgtgacgggtgagcaaacttggacctggtcgaaactgatgtaccggcgcggttcgtccagcctgca

SEQ ID NO: 4976 - DNA, 1479 bp, Setaria italica
cccaactcccgtacgtgtccaccctcctgcctcgccttcctcccaccttcctccctcgttgccatttcagacggtctcctcagtccagacgccgactccttcaactccgcgtcttcttcgtcccccttccacgattgattgaatcttctccttcccccttgtccaaccaactacttctatttcttctcccgatccaagaaacctgccaccgaagcgagctccaagaaacgatcttgatctcgatccgggaggaagtcgcccggccacccgagcagagccagagccagagcagcggcgcgatccaggagacagccacagccagccagccgccatgaacagcctgttctcgagctcgtggaagcgcggcggcgggggagatggcggggacatcgagtccggcgctgacggtgtggagatgtccgcgccgccgggtgccgcggcgggcgcgagcctggacaagttcttcgaggacgtggagtcgatcaaggatgagctccgggacctggagcgcatccagcggtccctccacgaggccaacgaggggagcaagtcgctgcacgacgccgccgccgtgcgcgagctccggtcccggatggacggcgacgtcgcgtcggcgatcaagaaggccaaggtcgtgaagctccggctcgagtccctggaccgcgccaacgccgccaaccgctcggtgcccgggtgcgggccggggtcctccaccgaccggacgcgcacttccgtcgtcgccgggctccgcaagaagctccgcgactcgatggaggccttctcctccctccggtcccgcatcgccgccgagtaccgggacacggtggcgcggcggtacttcacggtgacggggtcgcagcccgacgaggcgacgctggacgcgctggcggagtccggggaaggggagcggttcctgcagcgggcgatcgcggagcaagggcgcggagaggtgctgggcgtggtggcggagatccaggagcggcacggcgccgtggcggagctggagcgcagcctgctggagctgcagcaggtgttcaacgacatggcggtgctggtggcggcgcagggggagcagctcgacgacatcgagggcaacgtgggaagggcgaggtcgttcgtcgaccgcggccgggagcagctgcaggtggcaaggaagcaccagaagagcacccggaagtggacgttcatcgccatcctcatcgtcctcgtcatcgtcctcgtcatcgtcctgcccatcgtgctcaacaacaccaagaagtagcagcctggctgcggttggcctcaggcgccatggcgatcaggttgccgaacgttttgttgatacttgatagttgatactgccccaggagaaattctttttcccctatctcgttttgttgcgattcgtggcgtttatggttggttgatccgatcgggttgattatatttatcagtgattttgttcctaacacatggattggtatttgggttggattctgg

SEQ ID NO: 4977 - DNA, 1830 bp, Setaria italica
cgccatcgtcgtctcccaactcccgtacgtgtccaccctcctgcctcgccttcctcccaccttcctccctcgttgccatttcagacggtctcctcagtccagacgccgactccttcaactccgcgtcttcttcgtcccccttccacgattgattgaatcttctccttcccccttgtccaaccaactacttctatttcttctcccgatccaagaaacctgccaccgaagcgagctccaagaaacgatcttgatctcgatccgggaggaagtcgcccggccacccgagcagagccagagccagagcagcggcgcgatccaggagacagccacagccagccagccgccatgaacagcctgttctcgagctcgtggaagcgcggcggcgggggagatggcggggacatcgagtccggcgctgacggtgtggagatgtccgcgccgccgggtgccgcggcgggcgcgagcctggacaagttcttcgaggacgtggagtcgatcaaggatgagctccgggacctggagcgcatccagcggtccctccacgaggccaacgaggggagcaagtcgctgcacgacgccgccgccgtgcgcgagctccggtcccggatggacggcgacgtcgcgtcggcgatcaagaaggccaaggtcgtgaagctccggctcgagtccctggaccgcgccaacgccgccaaccgctcggtgcccgggtgcgggccggggtcctccaccgaccggacgcgcacttccgtcgtcgccgggctccgcaagaagctccgcgactcgatggaggccttctcctccctccggtcccgcatcgccgccgagtaccgggacacggtggcgcggcggtacttcacggtgacggggtcgcagcccgacgaggcgacgctggacgcgctggcggagtccggggaaggggagcggttcctgcagcgggcgatcgcggagcaagggcgcggagaggtgctgggcgtggtggcggagatccaggagcggcacggcgccgtggcggagctggagcgcagcctgctggagctgcagcaggtgttcaacgacatggcggtgctggtggcggcgcagggggagcagctcgacgacatcgagggcaacgtgggaagggcgaggtcgttcgtcgaccgcggccgggagcagctgcaggtggcaaggaagcaccagaagagcacccggaagtggacgttcatcgccatcctcatcgtcctcgtcatcgtcctcgtcatcgtcctgcccatcgtgctcaacaacaccaagaagtagcagcctggctgcggttggcctcaggcgccatggcgatcaggttgccgaacgttttgttgatacttgatagttgatactgccccaggagaaattctttttcccctatctcgttttgttgcgattcgtggcgtttatggttggttgatccgatcgggttgattatatttatcagtgattttgttcctaacacatggattggtatttgggttggattctggcgacgagccatttttctgctcttgctgggcagatgaacgaacttggactctttggatcgagcagacgagactcgcgggtcaaacctgcttgaggcttgacgcagtctcaccagtcttgcagtgttcctagccccctaccctaacataccggccagggctggctggaatacatggcccgcccaggcaggagcagaatactctgtaccacaccacttggttcgccgcgggggacgacgccctcgccctggcccttacgctgctgccgctccgcgtttcagcctgattgcttcagcttatcagccagcaaacaatgtttttctttcacaataaatgagcc

SEQ ID NO: 4978 - DNA, 1458 bp, Avena sativa
ctcaccttccctcccactagacgagcgagagactccttcaactccaattccgcgtccccgatctcctcggccccctcgcttaactatactaaccactccgaagtaccctcttcttgtctagtaccctgcttctcccgatccaagaaaccagaggagctcgatccaggagaatcaagaagccggcgctgtggtaatcaagcacaccgatcgagctaggtacacgctcgacccttgccaagccagccgccatgaacaacctcttctcgagctcgtggaagcgcgcgagcgaggacatcgagtccgggggcggcggcgtggagatgtccgcgccgccgggcgccgcggcgggggcgagcctggaccggttcttcgaggacgtggagtccatcaaggacgagctgcgggacctggagcggctccagcgctcgctccacgacggcaacgaggcgggcaagtcgctccacgacgcgtccgcggtgcgcgcgctccggtcgcgcatggacgccgacgcctcgggcgccatcaagaaggccaaggtggtcaagctccggctcgagtccctggaccgcgccaacgccgccaaccgctctctccccgggtgcggtcccggcacctccacggaccgcacccgcacctccgtggtggcggggctccgcaagaagctcagggactcaatggagtccttctcctccctcagggaacggatcagctccgagtaccgcgacaccgtggcgcggcgctacttcaccgtgaccggggcgcagccggacgaggctacgctggacaccctggcggagaccggggaaggggagcggttcctgcagcgggccatcgcggagcagcaagggcgcggggaggtgctgggcgtggtggcggagatccaggagcggcacggcgccgtggcgcagctggagcgcagcctgctggagctgcagcaggtgttcaacgacatggcggtgctggtggaggcgcagggggagcagctgaacgacatcgagggcaacgtggggcgggccaggtccttcgtcgaccggggacgggagcagctgcaggtggcaaggaagcaccagaagagctcccgcaagtggatgtgcatcggcatcgccgtcctcctcgtcgtcatcctcgtcatcgtcgtccccatcgtcgtcaagaacagccaaagcaacagcagcagcaccaccgcagctccaccggcgccatcgcccctgcgttccaggccacccaggagggagcagcagagcatcatcgtcaaggaggcgaccatggccgacgagcaccaggaactcaccaaggccttctcaggtctgggcggtctgggcgtggaggagacggcgctggtgtcggctctggggcgatggaggaagcagccggagaagcgctcgcagttccgccagggcttcccgggcttcttcaccccggccgggaccatggagcgctgctccgacgagtacgtgc

SEQ ID NO: 4979 - DNA, 1267 bp, Setaria italica
cctggacctggcggcgccatcgtcgtctcccaactcccgtacgtgtccaccctcctgcctcgccttcctcccaccttcctccctcgttgccatttcagacggtctcctcagtccagacgccgactccttcaactccgcgtcttcttcgtcccccttccacgattgattgaatcttctccttcccccttgtccaaccaactacttctatttcttctcccgatccaagaaacctgccaccgaagcgagctccaagaaacgatcttgatctcgatccgggaggaagtcgcccggccacccgagcagagccagagccagagcagcggcgcgatccaggagacagccacagccagccagccgccatgaacagcctgttctcgagctcgtggaagcgcggcggcgggggagatggcggggacatcgagtccggcgctgacggtgtggagatgtccgcgccgccgggtgccgcggcgggcgcgagcctggacaagttcttcgaggacgtggagtcgatcaaggatgagctccgggacctggagcgcatccagcggtccctccacgaggccaacgaggggagcaagtcgctgcacgacgccgccgccgtgcgcgagctccggtcccggatggacggcgacgtcgcgtcggcgatcaagaaggccaaggtcgtgaagctccggctcgagtccctggaccgcgccaacgccgccaaccgctcggtgcccgggtgcgggccggggtcctccaccgaccggacgcgcacttccgtcgtcgccgggctccgcaagaagctccgcgactcgatggaggccttctcctccctccggtcccgcatcgccgccgagtaccgggacacggtggcgcggcggtacttcacggtgacggggtcgcagcccgacgaggcgacgctggacgcgctggcggagtccggggaaggggagcggttcctgcagcgggcgatcgcggagcaagggcgcggagaggtgctgggcgtggtggcggagatccaggagcggcacggcgccgtggcggagctggagcgcagcctgctggagctgcagcaggtgttcaacgacatggcggtgctggtggcggcgcagggggagcagctcgacgacatcgagggcaacgtgggaagggcgaggtcgttcgtcgaccgcggccgggagcagctgcaggtggcaaggaagcaccagaagagcacccggaagtggacgttcatcgccatcctcatcgtcctcgtcatcgtcctcgtcatcgtcctgcccatcgt

SEQ ID NO: 4980 - DNA, 2473 bp, Sorghum bicolor
cggcctgcagcaaaattgggcctttgatcatagttccgtgcgtcgagttcttttaacacgggccatgcacataatttcgtacttcctgggcctgtggcccatatgcaatttcgtacttcctgcgcctgtggcccatatgctctgtcttagtgtattgactgtccactacgagtcaaccccatcctggcggtcctggtccggtccacagcacttcaagtcggctgaccgcggcgcgcccagcagcaggagagatacgatacgattgccgacctaatccagcggcagccaggcactcaccaagcaaacgtctttaaatctggccccttgacgcgcagccggagaggggcatcacccctcgtgcgtgtgccctcgcctctcccagcgccgcccgccccaatcccctccatctcaaaaaatgggaattgccgccgccgccgccaccaccaccacgtcccgactcctccactaccacgcagccgctggcacggaccgccatcaccggcaccagctcaggtactccgcgagtccgtttcctctctcgctgcgctgcggctccggccggcgtgaggcggcggcggcccgggcgctcctgcccgaccgcgtcaccccgttctcctacggcgtggatgaggacgcggatgaccacccgcgcgaggagtgcggtctagtcggggtcgtgggcgacccggacgcggcgtcgctctgctatctgggcctgcagaagctgcagcaccgcggggaggagggggccgggatcgtcgccgtgggcggggacggcaagctcaagtccgtcaccgggctgggcctcgtggccgacgtgttcggggacccgtccaggctcgcctcgcttccgggccccgccgccatcgggcacgtgcgctactccacggccggcgccgccgcgtcgctgcgcaacgtgcagccgttcctggccgggtaccggttcgggcaggtcgccgtggcgcataacggcaacctcgtcaactaccaggcgctgcggaacaagctcgaggccaggggatccatcttcaacacgtcctcggacacggaggtcatcctccacctcatcgcgacgtcgctgtcgcggcccctgctcgcccgcgtctgcgacgcctgcgagcgcctcgcgggggcctactcgctcctgttcctcacggccgacaagctcttcgccgtgcgcgacccgcacgggttccgcccgctggtgatgggccgccgccggaacggcgccgtcgtcttcgcgtcggagacctgcgcgctggacctcatcgacgccacctacgagcgcgaggtccagcccggggaggtggtcgtggtcgaccgccgcgacatgtcggtggcctcggcctgcctcgtcccgcaccgcccgcgccgctcctgcgtcttcgagcacatctacttcgcgctgcccaactcggtggtgttctcccacgccgtccacgagcgccgcaccgccttcgggcaggcgctggccgaggagtcccccgccccgggcgccgacgtcgtcatcccggtgcctgactcgggcttctacgccgcgctcgggttcgcgcgcgcgtcggggctcgagttccagcagggtctcatccgctggcactacagcggccgcagcttcatccagccgacacaggcgatccgggacctcgccgtgaagctgaagctcgcccccgtgcgcggcgtcatcacgggaaagagcgtcgtggtggtggacgactccctggtgcgcggcaccacctcgagcaagatcgtgcggctgctccgcgacgccggcgcgcgggaggtgcacatgcggatcgcgagcccgcccgtcgtgggctcctgcctctacggcatcgacacgccgagcgagggcgagctcatctccaaccggatggacctggatggcgtgcgcagggagatcggcagcgactccctcgccttcctgtcgctggacaagctgcacagcatctacggcgaagagtcgggggactactgcgacgcgtgcttctcgcgcaagtaccctgtgctgcccacgctggccgacccggccgtcgagccggacgagtgagccgggagcagccgagcagtcacaggctctcaggctccactgaaggatacaaggcatttctgctgaagtggacacactgaaaacgactgagcgaaccaaagacgtctccaagatacgcgcatgcgcaacacaatcagttgaaaacgggggcagttgcacagacgtacggagtacgtaacgaggaggtcgcgtagttctcttgaattcagtttcagacgtctccaagggcatcgaggatgatggttctatcttctaggccttgtttacttacaaaagtttttgcaaaatatgaatagtacaattttcgtttgtatttgacaaatattatccaattatggattaactaggctcaaaagattcatctcatcaattccgaccaaactgtgcaattagtttttatttttatctatatttaatactccatgc

SEQ ID NO: 4981 - DNA, 2447 bp, Zea mays
gccagagagaggcatcactccgcgtgcccggctcgccccgccgcccgccccaaatcccctcgatctctcaaataagcgggaatgggaattgtcgccgccgccgccgccacgacgtgcacgtcccgtatcctctaccgctacgcagccgctggcagcgaccgccataaccggcaccacctcaggtactacgcgagtccgtatcctctctcgctgcgctgcggctccggccggcgtgaggcggcggcccgggcgctcctgcccgaccgcgttaccccgttctcatacggcgtggatgaggacgcggatgaccacccgcgcgaggagtgcggtgtaatcggggtcgtgggcgacccagacgcgtcgtcgctgtgctatctggggctgcagaagctacagcaccgcggggaggagggggccgggatcgtcgccgtgggcggggacggcaagctcaagtccgtgaccgggctggggctcgtggccgacgtgttcgcggacccgtcccggctcgcctcgctcccgggccccgctgccatcgggcacgtgcgctactccacggccggcgccgccgcgtcgctgcgcaacgtgcagccgttcctggccgggtaccggttcgggcaggtcgccgtggcgcataacggaaacctcgtcaactaccaagctctgcggaacaaactcgaggccaggggatccatcttcaacacgtcctcggatacggaggtcattctccacctgattgcgacgtcgctgtcgcggcccctcctcgcccgggtctgcgatgcctgcgagcgccttgcgggggcctactcgctcctgttcctcacggccgacaagctcttcgccgtgcgcgacccacacgggttccgcccgctggtgatgggccgccgccggaacggcgccgtcgtcttcgcgtcggagacgtgcgcgctggacctcatcgacgccacctacgagcgcgaggtggagcctggggaggtggtcgtggtcgaccgccgcgacatgtcggtggcctcggcctgcctcgtcccgcaccgcccccgccgcgcctgcgtgttcgagcacatctacttctcgctgcccaactcggtggtgttctcgcacgccgtccacgagcgccgtaccgccttcgggcaggcgctggccgaggagtcccctgccccgggcgccgacgtcgtcatcccggtgcccgactcgggtttctacgccgcgctcgggttcgcacgcgcgtcggggctcgagttccagcagggtctcatccggtggcactacagcggccgcagcttcatccagccgacgcaggcgatccgggacctcgccgtgaagctgaagctcgcccccgtgcgcggcgtcatcaccggcaagagcgtcgtggtcgtggacgactccctggtgcgcggcaccacctcgagcaagatcgtgcggctgctccgcgacgccggcgcgcgggaggtgcacatgcggatcgcgagcccgcccgttgtgggctcctgcctctacggcatcgacactccgagcgagggcgagctcatctccaaccggatggaccttgatggcgtgcgccgggagatcggcagcgactccctcgccttcctatcgctggacaagctgcacagcatctacggcgaggagtcggggaactactgcgacgcgtgcttctcgcgcaagtaccctgtgctgcccacgctggccgatccggccgccgagccggaggattgagccaggagccagccaggtgacctactgacctctgctctgcttcgtctgccagtacgtctaggtcgttggattcagctctgattcagctctgttcggagtgttggacaattttgcgcgcctcaacctcaaggctgtagctttataatatggtgaagaagctctttatcatggtactgaaggattaccaataagaaaatgacaagaaaagccaaagtctagtaattgtgtccgcccttgctgtgccgttgtgaacttgtgatcttcatcacgttactgctgatgatcaaattatcatccacggcattgctatgttttggactaattctgaacataaaattttgctttgcgcgcgggggtcaggctgctagctaaacgcaccctaaaaaatcttgttttgcacaattttatgctttgtgaagcacgtaacttcattattattgtgccccacttgtgaccgtagtacacctccattttacaatttcccgatggcctctagtactttgctgtctgcgcgctaaacgcagcccattttagtttgcaaggacactgaagaacgctgccatgcaatccttctatctaaaataaacatacatatgctgacatgcatgcctctgtccacggagattagagattgcctgcctttgtcttgtaaacgtaagacgttgagaagtaagcgaaagcgagaagctccagcgcggcgagcgctgcaaggagcaggtagaagtagtctaggt

SEQ ID NO: 4982 - DNA, 2322 bp, Setaria italica
gccgaccgagctcagcacctcgcttcccaatccaacggcagccaggcgcccaccagccaaaaccctttaaatcccgccccttgacgcgcaccagagaggggcatcgcccgtgtgccctcgccccgctccaatcccctcctcgctccaatggggatggtcgccgccgccgccgccgccgcgtccacgtctcgcctcctcctcctccaccaccgcgccgccgctggctccgaccgtcaccaccagcaccagctcaggtacgccgcgatccagtaccctctctcgctgcgctgcggctccggccggcgtggggcggcggccggggcgctcctgcccgaccgtgtcaccccgttctcctacggcgtggacgaggacgcggatgaccacccgcgcgaggagtgcggcctggtgggggtcgtcggcgacccggacgcgtcgtcgctgtgctacctggggctgcagaagctgcagcaccgcggggaggagggggctggcatcgtcgccgtgggcggcgacggcaagctcaagtccgtgacggggctgggcctcgtggccgacgtgttcggggacccgtcccgcctcgcctcgctcccgggccccgccgccatcgggcacgtgcgctactccacggccggcgccgctgcgtcgctgcggaacgtgcagccgttcctggcgggataccggttcgggcaggtcgccgtcgcgcacaacggcaacctcgtcaactaccaagcactccggaacaagctcgaggcccggggttccatcttcaacacctcctcggacacagaggtcatcctccacctcatcgcgacgtcgctgtcgcggcccctgctcgcgcgcgtctgtgacgcgtgcgagcgcctcgcgggggcctactcgctcctgttcctcacggccgacaagatgttcgccgtgcgcgacccgcacgggttccgcccgctggtgatgggccgccgccggaacggcgccgtcgtgttcgcgtcggagacctgcgcgctggacctcatcgacgccacctacgagcgcgaggtgcagcccggggaggtggtcgtggtcgaccgccgcgacatgtcggtggcctcggcctgcctcgtcccgcaacgcccgcgccgcgcctgcgtcttcgagcacatctacttctcgctccccaactcggtcgtcttctcccacgccgtccacgagcgccgcaccgcattcggccgcgccctcgccgaggagtccccggccccgggcgccgacgtggtcatcccggtgcccgattctggcttctacgccgcgctcgggttcgcgcgcgcgtcggggctcgagttccagcagggcctgatccggtggcactacagcggccgcagcttcatccagcccacgcaggcgatccgcgacctcgccgtgaagctcaagctcgcccccgtgcgcggcgtcatcgccggcaagagcgtggtggtcgtggacgactcgctggtgcgcggcaccacctcgagcaagatcgtgcggctgctgcgcgacgccggcgcgcgcgaggtgcacatgaggatcgcgagcccgcccgtggtggggtcctgcctctacggcatcgacacgccgagcgagggcgagctcatctccaaccggatggacctggagggcgtgcgcagggagatcggcagtgactcgctcgccttcctgtcgctcggcaagctgcacggcatctacggcgaagaagcgggggactactgcgacgcgtgcttctcgcgcaagtaccccgtgttgcccacgctggccgacccggccgctgagctcgaggagtgaggcggtgagcaggtgagctctgctgctcctctgctctgcatcgcctgtacttgtaggttgttagattcagttctggttggataattttgtgcgcctcaaggctgtagcttaatttggtgaagcattctagtatcatgttgccgaaggaatactcatctttctgttccattaagctgagtaccaataagatcagatgatgaagtgctaacatcttgtctgtgtaaattagctatgccaaaacctgggtaattccaaattcagttcaaagaaaatggcaaaaatcacaaggccaccagggttgtgcatagattactgccggtcaaatttttccatggcattgcaaaatttgggcttcaaaccaaatggatgccgagtttcccgggcaggacctaattttggcttggcacaatggggctgtgaaccaaacaccggtctaaagattctcttctgctcaattttattatgtaatcaagcagttagcaatttttcacctagaagaatcaacagtgaaatcattattgcgccctatgatcttac

SEQ ID NO: 4983 - DNA, 2585 bp, Panicum virgatum
aatccaacggcagccaggcgcccaccacccaaaaccctttaaatcccgccccttgacgcgcacccagagaggggcatcgcccgtgccctcgaccccgctccaatcccctcctctcccgactccaatgggaatcaccgccgccgccgccgccccgtccccgtctcgcctcctcctccaccaccacgccgccgttggctccgaccgccgccaccagcaccagctcaggtaccccgcaacccagcacgctctcccgctgcgctgcggctccggccggcgcgaggcggcggccggggcgctgctgcccgaccgcgtcacccccttctcctacggcgtggacgaggacgccgatgaccacccgcgcgaggagtgcggcctggtgggggtcgccggcgacccggacgcgtcgtcgctgtgctacctcggcctgcagaagctgcagcaccgcggggaggagggcgccggcatcgtcgccgtgggcggggacggcaagctgaagtccgtgaccgggctgggcctcgtggccgacgtgttcggggacccctccaggctcgcctcgctcccgggccccgccgccatcgggcacgtgcgctactccaccgccggcgccgccgcgtcgctgcgtaacgtgcagccgttcctggcgggctaccgcttcgggcaggtcgccgtcgcgcacaacggcaacctcgtcaactaccaggcgctgcggaacaagctcgaggcccggggctccatcttcaacacctcctcggacaccgaggtcatcctccacctcatcgccacgtcgctgtcgcggcccctgctcgcgcgcgtctgcgacgcgtgcgagcgcctcgcgggggcctactcgctcctcttcctcacggccgacaagatgttcgccgtgcgcgacccgcacgggttccgcccgcttgtcatgggccgccgccggaacggcgccgtcgtgttcgcgtcggagacctgtgcgctggacctcatcgacgccacctacgagagggaggtgcagcccggggaggtggtcgtggtcgaccgccgcgacatgtcggtggcctcggcctgccttgtcccgcaccgcccgcgccgcgcctgtgtcttcgagcacatctacttctcgctccccaactcggtcgtcttctcccacgccgtccacgagcgccgcaccgcgttcggccgcgctctcgccgaggagtccccggccccgggcgccgacgtggtcatcccggtgccggactcgggcttctacgccgcgctcgggttcgcgcgcgcgtcggggctcgagttccagcagggcctcatccggtggcactacagcggccgcagcttcatccagccgacgcaggcgatccgcgacctcgccgtgaagctcaagctcgcccccgtgcgcggcgtcatcgccggcaagagcgtggtggtcgtggacgactcgttggtgcgtggcactacctcgagcaagatcgtgcggctgctccgcgacgccggcgcgcgcgaggtgcacatgcggatcgcgagcccgcccgtggtggggtcctgcctctacggcatcgacacgccgagcgagggcgagctcatctccaaccggatggacctggagggcgtgcgcagggagatcggcagcgactcgctcgccttcctctctctcggcaagctgcacggcatctacggcgacgaggctggggactactgcgacgcgtgcttctcgcgcaagtaccccgtgcttccaactctggccgacccggccaccgagcccgaggagtgagacggtcagcaggtgagctctgctgcttccctgctctgcaccggctgtacttgtagttttgttagattcagttgtggtaggacaattttgtctgcctcaagggttgagcattctatcatgttgctgaaggaatacttatggatttgttcccttaagctgagtaccaaattaccaataagatcagaagttgaagtgctaaacatcttgtttgtgaccccaactagcgtcaacgtttagctattccaaaacctgggtgattccaaattcagtgcaaaggaaatggcaaaacccataaccttgtaaaattttggcattgcaaaattttggcttcaaaccaagtggatgctaaatttcgtgggcaggacctaaatatggcttggcaatttggcatattgggaaccaagcacaccctaaaaagtttcttctgcacatttttattcttcgtgaagcagctatggcctgctttacaatgaatcaacagtgaaatcgttatgtgccctatggccttactggtgccgtcattgactcactgtaatgcgtacttgttcaccgtctttaccatttcccaaaggttgagagttctttcactgtagcctgtaggattgtgctgtttgtgattgttttattctactttttgctcttgccttctgatgggcatatgcatgtgtaacagtctaaactcaaatctgaactccatagacatatgcatcatgtgtaacagtcaaaaatctcacacaaataaaaaccgtataaattcaaaattcattctcgaaatttattttcaaaaatataattttaagattgttgagctcatctacctttgcatgaa

SEQ ID NO: 4984 - DNA, 2372 bp, Setaria italica
atcgcccgtgtgccctcgccccgctccaatcccctcctcgctccaatggggatggtcgccgccgccgccgccgccgcgtccacgtctcgcctcctcctcctccaccaccgcgccgccgctggctccgaccgtcaccaccagcaccagctcaggtacgccgcgatccagtaccctctctcgctgcgctgcggctccggccggcgtggggcggcggccggggcgctcctgcccgaccgtgtcaccccgttctcctacggcgtggacgaggacgcggatgaccacccgcgcgaggagtgcggcctggtgggggtcgtcggcgacccggacgcgtcgtcgctgtgctacctggggctgcagaagctgcagcaccgcggggaggagggggctggcatcgtcgccgtgggcggcgacggcaagctcaagtccgtgacggggctgggcctcgtggccgacgtgttcggggacccgtcccgcctcgcctcgctcccgggccccgccgccatcgggcacgtgcgctactccacggccggcgccgctgcgtcgctgcggaacgtgcagccgttcctggcgggataccggttcgggcaggtcgccgtcgcgcacaacggcaacctcgtcaactaccaagcactccggaacaagctcgaggcccggggttccatcttcaacacctcctcggacacagaggtcatcctccacctcatcgcgacgtcgctgtcgcggcccctgctcgcgcgcgtctgtgacgcgtgcgagcgcctcgcgggggcctactcgctcctgttcctcacggccgacaagatgttcgccgtgcgcgacccgcacgggttccgcccgctggtgatgggccgccgccggaacggcgccgtcgtgttcgcgtcggagacctgcgcgctggacctcatcgacgccacctacgagcgcgaggtgcagcccggggaggtggtcgtggtcgaccgccgcgacatgtcggtggcctcggcctgcctcgtcccgcaacgcccgcgccgcgcctgcgtcttcgagcacatctacttctcgctccccaactcggtcgtcttctcccacgccgtccacgagcgccgcaccgcattcggccgcgccctcgccgaggagtccccggccccgggcgccgacgtggtcatcccggtgcccgattctggcttctacgccgcgctcgggttcgcgcgcgcgtcggggctcgagttccagcagggcctgatccggtggcactacagcggccgcagcttcatccagcccacgcaggcgatccgcgacctcgccgtgaagctcaagctcgcccccgtgcgcggcgtcatcgccggcaagagcgtggtggtcgtggacgactcgctggtgcgcggcaccacctcgagcaagatcgtgcggctgctgcgcgacgccggcgcgcgcgaggtgcacatgaggatcgcgagcccgcccgtggtggggtcctgcctctacggcatcgacacgccgagcgagggcgagctcatctccaaccggatggacctggagggcgtgcgcagggagatcggcagtgactcgctcgccttcctgtcgctcggcaagctgcacggcatctacggcgaagaagcgggggactactgcgacgcgtgcttctcgcgcaagtaccccgtgttgcccacgctggccgacccggccgctgagctcgaggagtgaggcggtgagcaggtgagctctgctgctcctctgctctgcatcgcctgtacttgtaggttgttagattcagttctggttggataattttgtgcgcctcaaggctgtagcttaatttggtgaagcattctagtatcatgttgccgaaggaatactcatctttctgttccattaagctgagtaccaataagatcagatgatgaagtgctaacatcttgtctgtgtaaattagctatgccaaaacctgggtaattccaaattcagttcaaagaaaatggcaaaaatcacaaggccaccagggttgtgcatagattactgccggtcaaatttttccatggcattgcaaaatttgggcttcaaaccaaatggatgccgagtttcccgggcaggacctaattttggcttggcacaatggggctgtgaaccaaacaccggtctaaagattctcttctgctcaattttattatgtaatcaagcagttagcaatttttcacctagaagaatcaacagtgaaatcattattgcgccctatgatcttactggtgctgtcattgcaagtttgtaacgcatacctgggccatagttcaccttcttaaccatttccgaaggttgggagttctttcactatagcctgcaggattgtgctgtttgtgtgctaaaaacagcccattatgatttcaccagaacactga

SEQ ID NO: 4985 - DNA, 2135 bp, Panicum virgatum
ccgaccgtcgccaccagcaccaactcaggtactccgcgacccagtacgctctctcgctgcgctgcggctccggccggcgtgcggcagcggccggggcgctgctgcccgaccgcgtcaccccgttctcctacggcgtcgacgaggacgccgatgaccacccgcacgaggagtgcggcctggtcggggtcgccggcgacccggacgcgtcgtcgctgtgctacctcggcctgcagaagctgcagcaccgcggggaggagggggccggcatcgtcgccgtgggcggggacggcaagctcaagtccgtgaccgggctgggcctcgtggccgacgcgttcggggacccgtccaggctcgcctcgctcccgggccccgccgccatcgggcacgtgcgctactccaccgccggcgccgccgcgtcgctgcggaacgtgcagccgttcctggcgggctaccggctcgggcaggtcgccgtcgcccacaacggcaatctcgtcaactaccaggcgctgcggaacaagctcgaggcccgcggctccatcttcaacacctcctcggacacggaggtcatcctccacctcatcgcgacgtcgctgtcgcggcccctgctcgcgcgcgtctgcgacgcgtgcgagcgcctcgcgggggcctactcgctcctgttcctcacggccgacaagatgttcgccgtgcgcgacccgcacggcttccgcccgctcgtgatgggccgccgccggaacggcgccgtcgtgttcgcgtcggagacctgcgcgctggacctcatcgacgccacctacgagcgggaggtgcagcccggggaagtggtcgtggtcgaccgccgcgacatgtcggtggcctcggcctgcctcgtcccgcaccgcccgcgccgcgcctgcgtcttcgagcacatctacttctcgctccccaactcggtcgtcttctcccatgccgtacacgagcgccgcaccgcgttcggccgcactctcgccgaggagtccccggccccgggcgccgacgtggtcatcccggtgcccgactcgggcttctacgcagcgctcgggttcgcgcgcgcgtcggggctcgagttccagcagggcctgatccggtggcactacagcggccgcagcttcatccagccgacgcaggcgatccgcgacctcgccgtgaagctcaagctcgcccccgtgcgcggcgtcatcgccggcaagagcgtggtggtggtggacgactcgctggtgcgcggcaccacctcgagcaagatcgtgcggctgctccgcgacgccggcgcgcgcgaggtgcacatgcgaatcgcgagcccgcccgtggtgggatcctgcctctacggcatcgacacgccgagcgagggcgagctcatctccaaccggatggacctggagggcgtgcgcagggagatcggcagcgactcgcttgccttcctctctctcggcaagctgcacggcatctacggcgacgaggctggggactactgcgacgcgtgcttctcgcgcaagtaccccgtgcttccaactctggccgacccggccgccgagcccgaggagtgaggcggtcagcaggtgagctctgctgctcccctgctctgcaccggctgtacttgtaggtttgttagattttgttgtggtcgaacaattttgtctgcctcaagggtgttgctgaaaggttacttatcgatttgttcccttaagctgaagtaccaaattaccaataagatcagaagattaatacttatcttgtttgtgaccccaactagcgacaacgtttagctatgccaaaacctgggtaattccaaattgagtgcaaagaaaatggcaaaagtccagactttgtgtttttccatggcattgcaaaattttggcttcaaacccagcggatgcgagtttcctgggcaggacccgccggttttaaatatggcttggcaatttggcatattgggaaccaaacacaccctataaagtttcctctgcacatttttattcttcgtgaagcagctagcaactatagcctgcttcacaatgaatcaacattgacttcgttattgagccctatggccatactgttgctgtcattgactcactgtaatgcgtacttgttcactgtctttaccatctcccaaaggttga

SEQ ID NO: 4986 - DNA, 2469 bp, Oryza sativa
ctcctcgagcctcgagctcggccactacgcactcagaattccttttttttttctaacgcaacagcagccggtacacgtacgagatacgatacggataccgatggtatgtattcagcaccgtacatcgcatcctacggcggagagacggcgacgagcaaaaccctctttaaatcccgccccttgacctcgccctcggaggggaaacccatccattcccccccaatccctcgcgccgctccccttcccccactcaccaatggccgccgccgccgccgccgcgtcaacgtcgcgcctcctcctcctccgccaccaccaccacgccgccgccgacgggtcgaagcagcagcagcagctcaggtattcctccaagccgtcttctctcgctctgccccggctgcgccttttgccggcggccggggcgctgctgcccgaccgggtcaccccgttctcctacgaggaggacgacgagtccgacgaccacccgcgcgaggagtgcgggctggtcggggtcgtgggggaccccgacgcgtcgtcgctctgctacctcgggctgcagaagctgcagcaccgcggggaggagggtgccgggattgtcgccgtcgggggtgacgggaagctcaagtcggtcaccgggctcggcctcgtcgccgacgtgttcggtgaccccgcacggctggcatcgctccccgggccagccgccatcgggcacgtgaggtactccaccgccggcgccgccgcgtcgctgcggaacgtgcagccgttcctggccgggtacaggttcgggcaggtcgccgtcgcgcacaacggcaacctcgtcaactaccaggcgctgcggaacaagctggaggcgaggggctccatcttcaacacctcgtcggacacggaggtcatcctccacctcatcgcgacgtcgctgtcgcggccgctgctgtcccgcatctgcgacgcgtgcgagcgcctcgcgggggcctactcgctgctgttcctgacggccgataagatgttcgccgtgcgcgacccgcacgggttccgcccgctggtgctcggccgccgccgcaacggcgccgtcgcgttcgcgtcggagacctgcgcgctggacctcatcgaggcgacctacgagcgcgaggtggagcccggggaggtggtcgtcgtcgaccgccgcgacatgtccgtctcctcagcgtgcctcgtcccgcaccgcccccgccgctcctgcgtcttcgagcacatctacttcgccctcccaaactccgtcgtcttctcgcacgccgtccacgagcgccgcaccgccttcggccgcgcgctcgcggaggagtcccccgccgcgggcgccgacgtggtcatcccggttcccgactcggggttctacgccgcgctcgggttcgcgcgcgcgtcggggctggagttccagcagggcctcatccggtggcactacagcggccgcagcttcatccagccgacgcaggcgatccgcgacctcgccgtgaagctcaagctggcaccggtccacggcgtgatccgcgggaagagcgtggtggtggtggacgactccctggtgcgcggcaccacctcgagcaagatcgtgcggctgctccgcgacgccggcgcgcgcgaggtgcacatgcggatcgcgagcccgccggtggtgggctcgtgcctgtacggcatcgacacgcccagcgagggggagctcatctccaaccggatggacctcgagggcgtccgccgcgagatcggcagcgactcgctcgccttcctctcgctcggcaagctccacagcatctacggcgccgaggcggagggctactgcgacgcctgcttctcgcgcaactaccccgtgctgcccacgctgcccgagccggtcgtagagctcgaggagtgaactggtcacactggtgagtgagtgagtgatcgagtaggtcagctctgctctgctatgctctacggcttctctgcatccgtcgtaatgttaggcaatggatcagaatttgtatggacatggaattttggtgctactactacttcagtatatttgatcagggcaatttttatccggtgttgaattactatttcgagaggggataaagggataaagctccagtgtctgtttgagggatccggctcctctgcctttgtaggcatcagaggatccaaatccctgtttgagtgtatgtttagctccagtgctttacacgttttatgctgtggtggcttgagagtcgagaacatcagatgcttgtgtgccttgagctactggcagttattatcccatcaatttctgagactttgccatgattgaaggagtctccacgcgatttttaaaatcttactaatgctgaactttccacgatttaagacttcttttgacccatgaacaatttgtttgggacacagctttcagccaaaagagttcttttcgtgctttatgcttcctgccggatcctgttctctcagttgagagaggcagag

SEQ ID NO: 4987 - DNA, 2325 bp, Brachypodium distachyon
gttgcctttgtataccgacccgcgtaggtatacacgataccgaccgcaccggatactgcttgactgcttcgcatcctgcggtgggcacgaaccgacagaccaaaacctctttaaaatccgggcccttgaccagcactcggaggggcatcgccccccattccccaagccctcgccgccgccgccgccgccgccagctatcccctccccgcctcggctcagcccctcatcaatcggaatggccgccgccgccccgtccacttcgcgcctcctccatcaccaccagactaccacgggctacaagcgtcagcagcagcgactgaggtactccgccaatccgtctcatttggctctgcgccgccactccagctgccgcctgtccccggccggggcgctcctgcccgaccgcgtgaccccgttctcttacggaggggacgacgaatctgacgaccacccgcgggaggagtgcggcctggtggggatcgtgggcgacccggacgccgcgtcgctctgctacctgggcctgcagaagctgcagcaccgcggggaggaaggcgccgggatcgtcgccgtggggggagacggcaagctcaagtccgtgaccggcctggggctcgtcgccgatgtcttcggcgacccgtccaggctcgcgtcgctccccggccccgccgcaatcgggcacgtgcgctactccaccgccggcgccgctgcgtccctgcggaacgtgcagccgttcctggccggctaccgcttcgggcaggtcgccgtggcgcacaacggcaacctcgtcaactaccaggcgctgcgcaacaagctggaggcgcggggctccatcttcaacacgacctcggacacggaggtcatcctccacctcatcgcgacgtcgctctcgcggccgctgctcgctcgcatctgcgacgcctgcgagcgccttgccggggcctactcgctcctgttcctcacggccgacaagctgttcgccgtgcgcgacccgcacgggttccgcccgctggtgctcggccgccgccccaacggcgccgtcgccttcgcgtccgagacctgcgcgctggacctcatcgacgcgacctacgagcgcgaggtggagcccggggaggtggtcatggtcgaccgccgcgacatgtccgtgtcctcggcctgcctcgtgccgcgcctcccacgccgggcctgcgtcttcgagcacatctacttctcgctccccaactccgtcgtgttctcgcacgacgtccacgagcgccgcaccgccttcggccgcgccctcgcggaggagtcccccgtaccggacgcggacgtggttatcccggtgcccgactccggcttctacgctgcgctcgggttctcccgcgagtcagggctggagttccagcagggcctgatccggtggcactacagcggccgcagcttcatccagccgacgcaggccatccgcgacctcgctgtgaagctcaagctggcccccgtgcacggcgtgatccggggcaagagcgtggtggtggtggacgactccctggtgcgcggcaccacgtcgagcaagatcgtgcggctgctccgcgaagccggcgcgcgcgaggtgcacatgcgcatcgcgagcccgccggtggtggggtcgtgcctgtacggcatcgacacgcccagcgacggcgagctgatctcgaaccggatggacctggagggtgtgcgccaggagatcggcagcgactccctcgccttcctctcgctcgacaagctgcacggcatctacggcgccgaggcgggtgactactgcgacgcgtgcttctcgcgcaagtaccccgtgctgcccacgctgccggagccgacctccgaattcgaggaggaagagtgactggtggcgagcaggtgagctctgctttacccagctcctctgcatctgttgttgtaacgttaggctgctatcagtatcaagttttggatgtgcttggaaactttgtgtgcctgcaaggctgcaacttttattttgtcacgtgttccgtccctggttttcgtactgatacagtacaggttactccagttttagacatgataaaaagcgtcatcttctttgtgtcaccactgttcattctcgcacgtttatgctgaatgctgcaccaaacaacagggaaagcttgccaagtttgcaatgactgaaacaagccagtacagttgaatccatttgtaaaacttttccacccatttcccccgtaaaaaattgtaatcaggcaagtgcgacgaacattttctaacgctgctaaccaggaatttcaagctttcggctaccacttccaagtggaaagcttccatcaaaaacccaag

SEQ ID NO: 4988 - DNA, 2728 bp, Brachypodium distachyon
tttttacttcacctcagccaaaaagcaaaaagcaagagagaatataatttaccattatttacgctttgacggagatgccttcatagctcagcgctaatgacaacaacactgaccacggaaaaaatatggttttgctcggggaatcactgttttttcttgacgtcaaggtctatgatgctggctgatagctataacctcagcgttcgaatgggtactgccgaccaaacgaaccagatttggttacaaatttgaacttttcaactcactactgaatttagaaatggaccatacggcgccatcttgacctgcaggtcccaccactcgtggactgcgactgacttgtgtgccctccgttgcctttgtataccgacccgcgtaggtatacacgataccgaccgcaccggatactgcttgactgcttcgcatcctgcggtgggcacgaaccgacagaccaaaacctctttaaaatccgggcccttgaccagcactcggaggggcatcgccccccattccccaagccctcgccgccgccgccgccgccgccagctatcccctccccgcctcggctcagcccctcatcaatcggaatggccgccgccgccccgtccacttcgcgcctcctccatcaccaccagactaccacgggctacaagcgtcagcagcagcgactgaggtactccgccaatccgtctcatttggctctgcgccgccactccagctgccgcctgtccccggccggggcgctcctgcccgaccgcgtgaccccgttctcttacggaggggacgacgaatctgacgaccacccgcgggaggagtgcggcctggtggggatcgtgggcgacccggacgccgcgtcgctctgctacctgggcctgcagaagctgcagcaccgcggggaggaaggcgccgggatcgtcgccgtggggggagacggcaagctcaagtccgtgaccggcctggggctcgtcgccgatgtcttcggcgacccgtccaggctcgcgtcgctccccggccccgccgcaatcgggcacgtgcgctactccaccgccggcgccgctgcgtccctgcggaacgtgcagccgttcctggccggctaccgcttcgggcaggtcgccgtggcgcacaacggcaacctcgtcaactaccaggcgctgcgcaacaagctggaggcgcggggctccatcttcaacacgacctcggacacggaggtcatcctccacctcatcgcgacgtcgctctcgcggccgctgctcgctcgcatctgcgacgcctgcgagcgccttgccggggcctactcgctcctgttcctcacggccgacaagctgttcgccgtgcgcgacccgcacgggttccgcccgctggtgctcggccgccgccccaacggcgccgtcgccttcgcgtccgagacctgcgcgctggacctcatcgacgcgacctacgagcgcgaggtggagcccggggaggtggtcatggtcgaccgccgcgacatgtccgtgtcctcggcctgcctcgtgccgcgcctcccacgccgggcctgcgtcttcgagcacatctacttctcgctccccaactccgtcgtgttctcgcacgacgtccacgagcgccgcaccgccttcggccgcgccctcgcggaggagtcccccgtaccggacgcggacgtggttatcccggtgcccgactccggcttctacgctgcgctcgggttctcccgcgagtcagggctggagttccagcagggcctgatccggtggcactacagcggccgcagcttcatccagccgacgcaggccatccgcgacctcgctgtgaagctcaagctggcccccgtgcacggcgtgatccggggcaagagcgtggtggtggtggacgactccctggtgcgcggcaccacgtcgagcaagatcgtgcggctgctccgcgaagccggcgcgcgcgaggtgcacatgcgcatcgcgagcccgccggtggtggggtcgtgcctgtacggcatcgacacgcccagcgacggcgagctgatctcgaaccggatggacctggagggtgtgcgccaggagatcggcagcgactccctcgccttcctctcgctcgacaagctgcacggcatctacggcgccgaggcgggtgactactgcgacgcgtgcttctcgcgcaagtaccccgtgctgcccacgctgccggagccgacctccgaattcgaggaggaagagtgactggtggcgagcaggtgagctctgctttacccagctcctctgcatctgttgttgtaacgttaggctgctatcagtatcaagttttggatgtgcttggaaactttgtgtgcctgcaaggctgcaacttttattttgtcacgtgttccgtccctggttttcgtactgatacagtacaggttactccagttttagacatgataaaaagcgtcatcttctttgtgtcaccactgttcattctcgcacgtttatgctgaatgctgcaccaaacaacagggaaagcttgccaagtttgcaatgactgaaacaagccagtacagttgaatccatttgtaaaacttttccacccatttcccccgtaaaaaattgtaatcaggcaagtgcgacgaacattttctaacgctgctaaccaggaatttcaagctttcggctaccacttccaagtggaaagcttccatcaaaaacccaagaatcaagctttcagtcaagtttatatgcttgcgattacccttatgtgccca

SEQ ID NO: 4989 - DNA, 2779 bp, Hordeum vulgare
gggcatctccccaaacccctcgccgccgccgcagccgccgcctgcaatccccccctcccccccaccagcacaagaatgggaatggccgccaccgccccgtccacgtcgcgcctcctccatcaccaccagaccacccccgtcgtctccaagcaccaccaccagcagcagctgaggcagcgactcaggtacgcccccaacccgtcccctctcgccctgcgcggccgcctttcgccgccggccggggcgctcctgccggaccgcgtgaccccgttctcctacggggcggacgacgaatctgacgaccacccgcgcgaggagtgcggcctggtgggggtcgtgggccacccggacgcggcctcgctctgctacctgggcctgcagaagctgcagcaccgcggggaggagggcgccgggatcgtcgccgccgggggcgacggcaagctcaagtccgtcaccgggctggggctcgtcgccgacgtgttcggcgacccgtccaggctcgcctcgctgcccggtcccgccgccatcggccacgtgcgctactccaccgccggcgccgccgcgtccctgcggaacgtgcagccgttcctggcgggctacaggttcggccaggtcgccgtggcgcacaacggcaacctcgtcaactaccaggcgctgcggagcaagctggaggcgcggggctccatcttcaataccacctccgacacggaggtcatcctccacctcatctccacctcgctctcgcgcccgctgctcgcgcgcatctgcgacgcctgcgagcgcctcgcgggcgcctactcgctcctcttcctcaccgccgacaagctgttcgccgtgcgcgacccgcacgggttccgcccgctggtactgggccgcctcgccaacggcgccgttgccttcgcgtccgagacctgcgcgctggacctcatcgacgccacctacgagcgcgaggtggagcccggggaggtggtgatggtcgaccgccgcgacatgtccgtgtcctcggcctgcctcgtcccgcgccttccccgccgggcctgcgtcttcgagcacatctacttctcgctccccaactcggttgtcttctcgcacgacgtccacgagcgtcgcaccgccttcgggcgcgctctggcggaggagtcccccgcggcgggcgcggacgtggtgatcccggtgccggactcggggttctacgcggcgctcgggttctcgcgcgagtcggggctggagttccagcagggcctgatccggtggcactacagcgggcgcagcttcatccagccgacgcaggcgatccgcgacctggccgtgaagctgaagctggcgcccgtgcgcggcgtgatccgcggcaagagcgtggtggtggtggacgactccctggtccgcggcaccacgtcgagcaagatcgtgcggttgctccgcgacgccggcgcgcgggaggtgcacatgcgcatcgccagcccgccggtggtggggtcgtgcctgtacggcatcgacacgcccagcgacggggagctcatctccaaccggatggacctggagggcgtgcggcgggagatcggcagcgactccctcgccttcctctcgctcgacaagctgcacggcatctacggcgacgaggccggggactactgcgacgcctgcttctcccgcaagtaccccgtgctgcccacgctgccggagccggccgccgaattcgacgacgaagactagtgatctgctctgcccagctcctctgcttcagtcagctcattatgctcccaggttcagttacgggtaggggcttgcgaatttttctttagagaagatcatcagggagccggagcctcccagttccattagttgaatgaaacctctgggcaggcttgcgaaatttgtatgcctgcaacatcatttggtcatgaattctatccctgatgtaaaagttactctaagttgttgcaatggttgacaccgaactggcgaagatgaccgatgtttgccatcgctgatactatcttcagctaccactttcaagtgcaaagttggtgctgaaatcccagaatcaagaattcgggatggacgaatctactatcgtctttagtcaagtttattatatgcctgggtacttgtgagttgtgagtatcgtcatgcgcccatgtcttcaggctggctcgtctgaataatagagtgccgcgttcaagtgtgtctgtgcttcagtaataagctcatagcaatagtaacagtaaatgtaaagctgaaatattgctgcccggaaggatctcagcacatgaatagtggaattgtcggtatacacaattcgccgcccggtcaatgtgtcaatgaacattgccggcctttctcttgtaaacgtaagaagctgcgaagtaaaggaaagcgagaagctccagcgcggtgagcgcagcaaggaggaggtagaagtagtcgaggtgaccccggttgaggttgtcggcgaaccagctcgtccctccgccactcctcgtcacgccgtcgatgaccgagatgaggaagctgctgatgaagcttccgacgccgaggacgctcaggtagagcgccagcccgaggctcttgagcgcgccgggcatctggtcgtagaagaactcctgcatgcccaccatggtgaacacgtccgccgcgcccaggagcacgtactgcggcacgatccaccacaggctcatgggcaccgccgcgtccggctggtccaccacgccggcgtccaccgcggcgctcagccgcctcatctccaccagcgcggctgccaccagtgcggccacggcca

SEQ ID NO: 4990 - DNA, 1690 bp, Hordeum vulgare
tggccgccaccgccccgtccacgtcgcgcctcctccatcaccaccagaccacccccgtcgtctccaagcaccaccaccagcagcagctgaggcagcgactcaggtacgcccccaacccgtcccctctcgccctgcgcggccgcctttcgccgccggccggggcgctcctgccggaccgcgtgaccccgttctcctacggggcggacgacgaatctgacgaccacccgcgcgaggagtgcggcctggtgggggtcgtgggccacccggacgcggcctcgctctgctacctgggcctgcagaagctgcagcaccgcggggaggagggcgccgggatcgtcgccgccgggggcgacggcaagctcaagtccgtcaccgggctggggctcgtcgccgacgtgttcggcgacccgtccaggctcgcctcgctgcccggtcccgccgccatcggccacgtgcgctactccaccgccggcgccgccgcgtccctgcggaacgtgcagccgttcctggcgggctacaggttcggccaggtcgccgtggcgcacaacggcaacctcgtcaactaccaggcgctgcggagcaagctggaggcgcggggctccatcttcaataccacctccgacacggaggtcatcctccacctcatctccacctcgctctcgcgcccgctgctcgcgcgcatctgcgacgcctgcgagcgcctcgcgggcgcctactcgctcctcttcctcaccgccgacaagctgttcgccgtgcgcgacccgcacgggttccgcccgctggtactgggccgcctcgccaacggcgccgttgccttcgcgtccgagacctgcgcgctggacctcatcgacgccacctacgagcgcgaggtggagcccggggaggtggtgatggtcgaccgccgcgacatgtccgtgtcctcggcctgcctcgtcccgcgccttccccgccgggcctgcgtcttcgagcacatctacttctcgctccccaactcggttgtcttctcgcacgacgtccacgagcgtcgcaccgccttcgggcgcgctctggcggaggagtcccccgcggcgggcgcggacgtggtgatcccggtgccggactcggggttctacgcggcgctcgggttctcgcgcgagtcggggctggagttccagcagggcctgatccggtggcactacagcgggcgcagcttcatccagccgacgcaggcgatccgcgacctggccgtgaagctgaagctggcgcccgtgcgcggcgtgatccgcggcaagagcgtggtggtggtggacgactccctggtccgcggcaccacgtcgagcaagatcgtgcggttgctccgcgacgccggcgcgcgggaggtgcacatgcgcatcgccagcccgccggtggtggggtcgtgcctgtacggcatcgacacgcccagcgacggggagctcatctccaaccggatggacctggagggcgtgcggcgggagatcggcagcgactccctcgccttcctctcgctcgacaagctgcacggcatctacggcgacgaggccggggactactgcgacgcctgcttctcccgcaagtaccccgtgctgcccacgctgccggagccggccgccgaattcgacgacgaagactagtgatctgctctgcccagctcctctgcttcagtcagctcattatgctcccaggttcagtt

SEQ ID NO: 4991 - DNA, 3945 bp, Setaria italica
actatattttaaaccaaacaccatgctgtacccactacattttaaaccaaacgccatgcaaattggatctgacctaacccaacccactacattttaaaccaaacatcatgcaaattggatccaacctaacctaaccgaaccgacttgaaccctcgaacaaacgcacccttaaatcccggtcattcacgtgggttcgggagggtgtcgatagccccacctcccccaaactcccataccaccgcgcgcgcgcacgcatggccgccaccgccgctgccgccgccaccacaccctcctcacctctcctccgccgcgccgctgcggcgccgaccaccggccaccactaccagctcaggtgctctgccaagccgtccccgctcgagctgcggcactacgccgcgcgcctcgccccggcgcgggccctgttcccggaccgcgtcacgccgttctccttcgacgcggacggcgatgaccacccccgcgaggagtgcggcgtgttcggtgtcatcggcgacccggacgcgtcgtcgctgtgctacctcggcctgcagaagctgcagcaccgcggggaggagggcgcgggcatcgccgcctcggacgccgatggcaagctcaaatcggtgacggggctcgggctcgtcggggacgtcttcggcgacccgacgcgcctcgccaagctccccggcaacgccgccatcgggcacgtgcgctactccacggccggcgcctcctcgatgcgcaacgtgcagccgttcctcgccgcgtacaggttcgggcagctcgccgtggcgcacaacggcaacctcgtgaactaccaggcgctgcgcaacaagctggaggcgcagggctccatcttcaacacctcgtcggacacggaggtcatcctgcacctcatcgccacctcgctctcccgcccgctgctctcgcgcatctgcgacgcctgcgagcgcctcgccggcgcgtactcgctgctgttcctgacggccgacaagctcttcgccgtgcgcgacccgttcggcttccgccccctggtgatggggcgccgccccaacggcgccatcgtgttcgcgtcggagacctgcgcgctcgacctcatcgacgccgcctacgagcgcgaggtggcgcccggggaggtggtggtcgtggaccgccgcgacatgtcagtgtcctatgcctgcctcgtcccgcaccgcccccgcaagtcgtgcgtcttcgagcacatctacttcgcccttcccaactccgtcgtgtttgggcacgccgtccacgagcgccgcagcgcatacggccgcgcgctcgccgaggagtccccggctccgaccgcggacgtcgtcatccctgtgccggactcggggttctacgccgcgctcggcttcgcgcaggcgtcgggtctcgaattccagcagggccttatccgttggcactacagcggccgcagctttatccaaccgtcgcaagcaatccgcgacctcgcggtcaagctcaagctcgcgcccgtgcgcggcgtcattaccggcaagagcgtggtcgttgtcgacgattcgctcgtgcgcggtaccacctcgagcaagattgtgcgcctgctccgcgacgccggcgcgcgcgaggtgcacatgcgcatcgccagccccccggtcatcggctcctgcctgtacggcatcgacacgccgagcgagggcgagctgatatccaacaggatggacctcgagggcgtgcggaggacgattggctgcgactcgctcgccttcctctctctcgacaagctccacagcatctacggtgatgaagcgcatgagctttgtgacgcctgcttctctaggaactacccagtgctgcccactgtgccagagccggtgccggagctggtgtcagccttcgaagactaacaagaaagggagtggttctatactctgcatgcttactatagaatgtagactcaattttgggcctggcattttttacctttgcaaattgcaattgcattcatccatctgaattttgaggttaaaagctttagacattgatcaaaccgctactacgagtttgatccactcttattgtattgctatgatgatgacgatggataacaagaaaattgtctcagtggcatagggttaaagaactacctttttggcaattcaggtttaatatgatgctattttgggttcgcttcagagtcagctctcaccttgctgcttcttgacgtagttgcataaagtttcatctgttgttgaatactaacaattgacatgttatgcttgtggaattcaattttgatcatcagttttacagcataatacctatcatctattttacttatgctcagtagctagatgaatcctttgactgtgatgtaagcgatacttctccaggtacaaaaattgaaatatttggggggagttcttctactttccttgtcttggtatctgatgttctgttgctctagattggctaacagattatttttcagaatgttggtatgaattagttgcaagctttgcaatgcttctctagaatcaaaggtttaactgacctgtccataaaaaatgttgaccgcgtacgtccttgctgaattggagatcgaatagtatctgctaattacttatttgacaactttgttaatgtgccaagtcaagcatgaaagttccgggaatcttactgctctagcactagaagcatgatagcctgcagattgcagtcaagcctgtgactgtaaatgtcatactagctgcctgtctttcgacaacagtttgtttagattttgatttgcattcaagaaggcagtcaaagcctcagaggtaagccgaacatcacgacgttgacaggattcttgttttatggttattaatcatgtccaaaacaaacgctctttcgacaggggttgctgcttgagctcatctgtagcatatatgttgactcaaatccacttttctgttggagtgcttgcatttgacatcttcaaatttggtccttgaaatctttgccttactctgatatcatcctctgttttgatcgagacgtgtgctgctttcctgatgatggtcatctttctatggtttctctgaatcagtcttatttatgtgaaggtgtaacccatgtctagtgaacttgagctatcagtagcagtgtgatgttatcgatgatgttcttgtgaagtactctttccgaggccatggctaaaggctaacatccaggtctggtcttgtggatatgctctgatcccggtctctatttcaatcgagacatttgctgctttccggataattgtcatattcgcagcgtttcactgaatggctgaatcggtctggttttatgtgaacgtgagctatcagcttctgtgaggtgattttatccacggtctcctttctgaagtactcttccaaaggtcaactggccaaagctgagctaaactgcaggacacaagttttttaaatggtcaggagagactcgcctgttccagtcttccagaggatgagatatggatgatggcatcgggtgacctgtgaggcttcgttcgccttctttcggcagagaatatatcttgttttttccagttacaggaaagacataaaagtacgtaaccagcaggatagagaagcatttgtaccttcgcattgcactgagcataatctttctgtgatcccggtttatctgtcaactgtacttgtacggttgtaccacgcatttttgtattgcgctttgtatgggagaactctgagctgagacctacttcttcttggcttcttgctgcgctttggctcatagtatgtgtgacgccgctagagctgatggtcagataacaacatccatgatccatggcaccatgctcgtcctgactcctagattacgcctgcgagttattggcaacctaaatcgcggtttgttacgggtgccaatatcttctatggttttccttgaccatgcggagcagctgaagttagttgccgc

SEQ ID NO: 4992 - DNA, 3559 bp, Setaria italica
ctcgaacaaacgcacccttaaatcccggtcattcacgtgggttcgggagggtgtcgatagccccacctcccccaaactcccataccaccgcgcgcgcgcacgcatggccgccaccgccgctgccgccgccaccacaccctcctcacctctcctccgccgcgccgctgcggcgccgaccaccggccaccactaccagctcaggtgctctgccaagccgtccccgctcgagctgcggcactacgccgcgcgcctcgccccggcgcgggccctgttcccggaccgcgtcacgccgttctccttcgacgcggacggcgatgaccacccccgcgaggagtgcggcgtgttcggtgtcatcggcgacccggacgcgtcgtcgctgtgctacctcggcctgcagaagctgcagcaccgcggggaggagggcgcgggcatcgccgcctcggacgccgatggcaagctcaaatcggtgacggggctcgggctcgtcggggacgtcttcggcgacccgacgcgcctcgccaagctccccggcaacgccgccatcgggcacgtgcgctactccacggccggcgcctcctcgatgcgcaacgtgcagccgttcctcgccgcgtacaggttcgggcagctcgccgtggcgcacaacggcaacctcgtgaactaccaggcgctgcgcaacaagctggaggcgcagggctccatcttcaacacctcgtcggacacggaggtcatcctgcacctcatcgccacctcgctctcccgcccgctgctctcgcgcatctgcgacgcctgcgagcgcctcgccggcgcgtactcgctgctgttcctgacggccgacaagctcttcgccgtgcgcgacccgttcggcttccgccccctggtgatggggcgccgccccaacggcgccatcgtgttcgcgtcggagacctgcgcgctcgacctcatcgacgccgcctacgagcgcgaggtggcgcccggggaggtggtggtcgtggaccgccgcgacatgtcagtgtcctatgcctgcctcgtcccgcaccgcccccgcaagtcgtgcgtcttcgagcacatctacttcgcccttcccaactccgtcgtgtttgggcacgccgtccacgagcgccgcagcgcatacggccgcgcgctcgccgaggagtccccggctccgaccgcggacgtcgtcatccctgtgccggactcggggttctacgccgcgctcggcttcgcgcaggcgtcgggtctcgaattccagcagggccttatccgttggcactacagcggccgcagctttatccaaccgtcgcaagcaatccgcgacctcgcggtcaagctcaagctcgcgcccgtgcgcggcgtcattaccggcaagagcgtggtcgttgtcgacgattcgctcgtgcgcggtaccacctcgagcaagattgtgcgcctgctccgcgacgccggcgcgcgcgaggtgcacatgcgcatcgccagccccccggtcatcggctcctgcctgtacggcatcgacacgccgagcgagggcgagctgatatccaacaggatggacctcgagggcgtgcggaggacgattggctgcgactcgctcgccttcctctctctcgacaagctccacagcatctacggtgatgaagcgcatgagctttgtgacgcctgcttctctaggaactacccagtgctgcccactgtgccagagccggtgccggagctggtgtcagccttcgaagactaacaagaaagggagtggttctatactctgcatgcttactatagaatgtagactcaattttgggcctggcattttttacctttgcaaattgcaattgcattcatccatctgaattttgaggttaaaagctttagacattgatcaaaccgctactacgagtttgatccactcttattgtattgctatgatgatgacgatggataacaagaaaattgtctcagtggcatagggttaaagaactacctttttggcaattcaggtttaatatgatgctattttgggttcgcttcagagtcagctctcaccttgctgcttcttgacgtagttgcataaagtttcatctgttgttgaatactaacaattgacatgttatgcttgtggaattcaattttgatcatcagttttacagcataatacctatcatctattttacttatgctcagtagctagatgaatcctttgactgtgatgtaagcgatacttctccaggtacaaaaattgaaatatttggggggagttcttctactttccttgtcttggtatctgatgttctgttgctctagattggctaacagattatttttcagaatgttggtatgaattagttgcaagctttgcaatgcttctctagaatcaaaggtttaactgacctgtccataaaaaatgttgaccgcgtacgtccttgctgaattggagatcgaatagtatctgctaattacttatttgacaactttgttaatgtgccaagtcaagcatgaaagttccgggaatcttactgctctagcactagaagcatgatagcctgcagattgcagtcaagcctgtgactgtaaatgtcatactagctgcctgtctttcgacaacagtttgtttagattttgatttgcattcaagaaggcagtcaaagcctcagaggtaagccgaacatcacgacgttgacaggattcttgttttatggttattaatcatgtccaaaacaaacgctctttcgacaggggttgctgcttgagctcatctgtagcatatatgttgactcaaatccacttttctgttggagtgcttgcatttgacatcttcaaatttggtccttgaaatctttgccttactctgatatcatcctctgttttgatcgagacgtgtgctgctttcctgatgatggtcatctttctatggtttctctgaatcagtcttatttatgtgaaggtgtaacccatgtctagtgaacttgagctatcagtagcagtgtgatgttatcgatgatgttcttgtgaagtactctttccgaggccatggctaaaggctaacatccaggtctggtcttgtggatatgctctgatcccggtctctatttcaatcgagacatttgctgctttccggataattgtcatattcgcagcgtttcactgaatggctgaatcggtctggttttatgtgaacgtgagctatcagcttctgtgaggtgattttatccacggtctcctttctgaagtactcttccaaaggtcaactggccaaagctgagctaaactgcaggacacaagttttttaaatggtcaggagagactcgcctgttccagtcttccagaggatgagatatggatgatggcatcgggtgacctgtgaggcttcgttcgccttctttcggcagagaatatatcttgttttttccagttacaggaaagacataaaagtacgtaaccagcaggatagagaagcatttgtaccttcgcattgcactgagcataatctttctgtgatcccggtttatctgtcaactgtacttgtacggttgtaccacgcatttttgtattgcgctttgtatgggagaac

SEQ ID NO: 4993 - DNA, 2228 bp, Brachypodium distachyon
cctccggaagccctcgccctcccacactcccgcacccccacgaatggccgccgccgccgccgccgccaccgcggccccgaccaccacagcatcctcccgcctcctcctcccccgcaccgcccccgttccatcccccatccactaccagctcaggtgctccgccggcccctcgctcctcgcgcggcgccaccgcgcgcctgcgccggcgcgggcctcgcccgaccgcctcacgcccttcaattacgacgacgacagcgacgaccacccccgcgaggagtgcggcgtgttcggcgtcgtcggcgacccggacgcctcgtcgctctgctacctcggcctgcagaagctgcagcaccgcggggaggagggcgccggcatctccgcctctggggacgatggcgatatcaagacggtgacggggctggggctcgtgggcgacgtgttcggggacccggcccgcctcgccggcctccccggccggtccgccatcggccacgtgcgctactccacctccggcgccgccgcctcgctgcgcaacgtgcagcccttccatgctgggtaccggttcggtcagctcgccgtggcgcacaacgggaacctcgtcaactaccagtcgctgcgcaacaagctggaggcgcagggctccatcttcaacacttcctccgacacggaggtcatcctgcacctcatcgccacgtcgctctcgcgcccgctgcttgcccgaatctgcgacgcctgcgagcgcctcgccggcgcctactccctgttgttcctgactgcggacaagctcttcgccgtgcgcgacccgttcggcttccggccgctggtcatgggccgccgtccaaacggcgccgtcgtgttcgcgtcagagacctgcgcgctcgacctcatcgacgccgtgtacgagcgagaggtggagccaggggaggtcgtcgtcgtcgaccgccgcgacatgtcgatgtcctcggcctgcctcgtcccgcaccgcccacgcaagtcctgcgtcttcgagcacatctacttcgccttgcccaactctatcgtcttcggccacgctgtccacgagcgacgcaccgcctacggccgcgctctcgccgaggagtcccctgcccccactgcggacgtcgtcatcccagtgccagattcggggttctacgcggcgctcggcttcgcacaggcttcggggctcgagttccagcagggcctcatccggtggcactacagcggccgcagcttcatccagccgacgcaggcgatccgcgacctcgccgtcaagcttaagctcgctccagtgcgtggcgtcatcgcgggcaagagcgtggtcgtcgtcgacgactcgattgtgcgtggcaccacctcgagcaagattgtccgcctgctccgggacgccggagcacgcgaggtgcacatgcgcatctctagtcccccggtcatcggctcatgcctttatggcatcgacacgccaagcgagggcgagctgatatcgaacaggatggacattgagggcgtgcgcagggcgatcggttgcgactcactcggcttcctctcgcttgacaagctccacagcatctacggagatgaggcgggtgagctctgcgacgcctgcttctcacggaactacccggtgcttcccacagtgcctgagccggtgccggaactggtgtcggcctttgatgattaaccggaatgtgcaactagggaagtggctatataccactctgcatgcttactacaggattttttggtcaattttgggcatgacgaattttgtcattgcaattgcattcatcatctgaatttttgcaggtcttaagtttgtatcagtgagccgttagccttccatgtctctaggctcaagttttccaaacccttttcatgagttaatcaatttataaagaaaggttgacgactcaggacttcctatcttcaatgtaaagagttgtagacctgaattgcttaatcgagtgcatttgttcaagctcccattgattggtgaagcatgtcatttgtaaatatattttcttagtatttacagctgcgaaagcaagcaagaaatgtcatgtacttgttcgcaaaaaagaaaaagaaaagtcatgtactagagtcatgtcagtatactgatgacatggacttgcacacttcagtcagaccatgtatacttcatgtaagttgtcatcagataacaattcttgctttgatattgactacgaatgcaaaacagcatgacattg

SEQ ID NO: 4994 - DNA, 2229 bp, Brachypodium distachyon
tcctccggaagccctcgccctcccacactcccgcacccccacgaatggccgccgccgccgccgccgccaccgcggccccgaccaccacagcatcctcccgcctcctcctcccccgcaccgcccccgttccatcccccatccactaccagctcaggtgctccgccggcccctcgctcctcgcgcggcgccaccgcgcgcctgcgccggcgcgggcctcgcccgaccgcctcacgcccttcaattacgacgacgacagcgacgaccacccccgcgaggagtgcggcgtgttcggcgtcgtcggcgacccggacgcctcgtcgctctgctacctcggcctgcagaagctgcagcaccgcggggaggagggcgccggcatctccgcctctggggacgatggcgatatcaagacggtgacggggctggggctcgtgggcgacgtgttcggggacccggcccgcctcgccggcctccccggccggtccgccatcggccacgtgcgctactccacctccggcgccgccgcctcgctgcgcaacgtgcagcccttccatgctgggtaccggttcggtcagctcgccgtggcgcacaacgggaacctcgtcaactaccagtcgctgcgcaacaagctggaggcgcagggctccatcttcaacacttcctccgacacggaggtcatcctgcacctcatcgccacgtcgctctcgcgcccgctgcttgcccgaatctgcgacgcctgcgagcgcctcgccggcgcctactccctgttgttcctgactgcggacaagctcttcgccgtgcgcgacccgttcggcttccggccgctggtcatgggccgccgtccaaacggcgccgtcgtgttcgcgtcagagacctgcgcgctcgacctcatcgacgccgtgtacgagcgagaggtggagccaggggaggtcgtcgtcgtcgaccgccgcgacatgtcgatgtcctcggcctgcctcgtcccgcaccgcccacgcaagtcctgcgtcttcgagcacatctacttcgccttgcccaactctatcgtcttcggccacgctgtccacgagcgacgcaccgcctacggccgcgctctcgccgaggagtcccctgcccccactgcggacgtcgtcatcccagtgccagattcggggttctacgcggcgctcggcttcgcacaggcttcggggctcgagttccagcagggcctcatccggtggcactacagcggccgcagcttcatccagccgacgcaggcgatccgcgacctcgccgtcaagcttaagctcgctccagtgcgtggcgtcatcgcgggcaagagcgtggtcgtcgtcgacgactcgattgtgcgtggcaccacctcgagcaagattgtccgcctgctccgggacgccggagcacgcgaggtgcacatgcgcatctctagtcccccggtcatcggctcatgcctttatggcatcgacacgccaagcgagggcgagctgatatcgaacaggatggacattgagggcgtgcgcagggcgatcggttgcgactcactcggcttcctctcgcttgacaagctccacagcatctacggagatgaggcgggtgagctctgcgacgcctgcttctcacggaactacccggtgcttcccacagtgcctgagccggtgccggaactggtgtcggcctttgatgattaaccggaatgtgcaactagggaagtggctatataccactctgcatgcttactacaggattttttggtcaattttgggcatgacgaattttgtcattgcaattgcattcatcatctgaatttttgcaggtcttaagtttgtatcagtgagccgttagccttccatgtctctaggctcaagttttccaaacccttttcatgagttaatcaatttataaagaaaggttgacgactcaggacttcctatcttcaatgtaaagagttgtagacctgaattgcttaatcgagtgcatttgttcaagctcccattgattggtgaagcatgtcatttgtaaatatattttcttagtatttacagctgcgaaagcaagcaagaaatgtcatgtacttgttcgcaaaaaagaaaaagaaaagtcatgtactagagtcatgtcagtatactgatgacatggacttgcacacttcagtcagaccatgtatacttcatgtaagttgtcatcagataacaattcttgctttgatattgactacgaatgcaaaacagcatgacattg

SEQ ID NO: 4995 - DNA, 3025 bp, Sorghum bicolor
cacggaatccacggtccacacgcccgcccgcctgcttaaatcctgccccttcacgtgcgttcgggagggcatcctcgaaagccctcacctgccccaaaggcccaaactcccacaccgccgcgaaccacgcatggccgccacagccgccgccacggccgccgccgcgacgacctccacgccatccacccccctcctccgccgcgccgctgcggcgccgaccacaagccaccactaccagctcaggtgctccaccaagccctcgcagttcgtgctgcggcaccgcgccgcgcgagtcgctcccgcgcgagctctgctccctgaccgcgtcacgccgttttccttcgacgcggacggcgacgaccatccccgagaggagtgcggcgtgttcggagtcattggcgacccggacgcgtcgtcgctgtgctacctcggcctgcagaagctgcagcaccgcggggaggagggcgctggcatcgttgcgtcggacgccgacggcaagctcaattcagtgacggacctgggtctcgtcggggacgttttccgcgacccggcgcgcctcgccaagctccccggaaacgccgccatcgggcacgtgcgctactcaacggccggcgcctcttccaggcgcaacgtgcagccgttcctcgccgcgtacaggttcgggcagctggctgtggcgcacaacggcaacctcgtgaactaccaggcgctgcgcaacaagctggaggcgcagggttccatcttcaatacctcgtctgacacggaggtcatccttcacctcatctcaacctcactctcgcgcccgctgctctcgcgcatctgcgacgcctgcgagcgcctcgccggcgcgtactcgctgctgttcctgacggccgacaagctctttgcggtgcgcgaccccttcggcttccggcccctggtgatgggccgccgccccaacggcgccgtggtgttctcgtcagagacctgcgcgctcgacctcatcgacgccacctatgagcgtgaggtggagcccggggaggtggtagtcgtggaccgccgcgacatgtcggtgtcctacgcctgcctcgtcccgcaccgcccgcgcaagtcatgcgtgttcgagcacatctacttcgcccttccaaactccgtcgtgtttgggcatgccgtccacgagcgccgcagcgcatacggccgcgcgctcgccgaggagtcccccgccccgaccgcagacgtcgtcatccccgtgcctgactcggggttctatgccgcgctcggcttcgcgcaggcgtcggggctcgagttccagcaaggccttatccggtggcactacagcggccgcagcttcatccagccatcgcaggcaatccgtgacctcgccgtcaagctcaaactcgcgcccgtacacggcgtcattaccggcaagagcgtggtcgtcgtcgatgactccctcgtgcgcggcaccacctcgagcaagattgtgcgcctgctccgcgatgccggcgcgcgtgaggtgcacatgcgcatctccagccccccggtcgtcgggtcctgcctctacggcatcgacacgccgagcgaaggcgagctgatatccaacaggatggacctcgagggtgtgaggaggaccattggctgcgactcgctcgccttcctctcgctcgagaagctccacagcatctacggcaatgaagcacatgagttctgtgatgcctgcttctcacggaactacccggtgctgccaaccgtgccggagctggtcccagagctggtgtctgccttcgaagactaaccagaaagggggtggctttatactctgcatgctttactattactatagaatctggactaaattttgggcatagcattttcgtctttgcaattgcattcatccatctgaattttgaggttacaaggtttagacactgatcgaactgctattgtgagtttgatctaatctattgtattgctatatgatgacgatgacaatgaataacaagaaaattatctcagcggttaccttttcacaaattcaggtttaatgtgctactgttttgagtttcttcagaggccgttctcaccttcctggatactgcttagcattcaggtttaccttttcacaaattcaggtttaatgtgctgttgttttgagtttcttcagaggccgttctcaccatcctggatcctgcttagcattcttgcataagttccgtatttcgttgagtgtctatctctaacattgggccagttttggatgtgccaactgtgcattcagagtttaagtttgacccatattagtggcgttgtagctgatagtatagtcctaggctgatgtgtaaaagtgagtgaaagtttatgaatgcaatttcctagcatttttacttttcatccgatgttccttttgttctagactgggtacagagataatttaaaattcttagttggtacgaattagttccaaactttgcatcacttctttagaatcagggtttctgaacctttttctggagttgggctgtccataaaattttttgaccaggacttcctctttcatggtaaatggacatgccaacctcaatcactagtgaagtgccttctccaaggtcttgttgaattacagtgcctagtatctgctacatatattctcaaaaccaagtcaagcaagaaagttcctaggaccttactgcattagcactagtggtatgataccctacacattgtaatcaagcctgtgactacatgcttcataccaattgcctgtcttcccagtcccacgatagtccttttagatgttctttttgacaacagtcctttttagatgttgatttgcattcaagaagaaggtaatcaaaggtaagcagaatgtcatgatgttgacatgatccttgttttttatttaatactggccaaacaaaacacggttttggcagggttgtttctcatcttatgttggtgcttgcggtcttctgtctagtataatatgttggctcaagctggtaacatgtgcagatttgatccttgaaatatttgcccctccttatcg

SEQ ID NO: 4996 - DNA, 3336 bp, Zea mays
actcgaaagtcgaaatacagatcccacggtccacacgcccgcccgcatgcttaaatcctgccccttcacgtgcgttcgggagggcatccttggaagttggaagcaggcctcacctgcccccaaaggcccaaactcccgaaccgccccgcaccacgcatggccgccacagccgccgccgccgcgacggcctccacgccttcctctcccctccgccgccgagcctctgcggcgcctaccacaagacacaactcccagctcaaatgctccatcaagccctcgcagttcgagctgcggcaccgcgccgcgggtctcgctccggcgcgagctctgctccctgaccgcgtcacgccgttttccttcgacgcggacggcgacgaccatccccgagaggagtgcggcgtgttcggagtcattggcgacccagacgcgtcgtcgctctgctacctcggcctgcagaagctgcagcaccgcggggaggagggcgcgggcatcgttgcgtcggacgccgacggcaagctcaattcagtgacggacctgggtcttgtcggggacgttttccgcgatccggcgcgcctcgccaagctccccggaaacgccgccatcggccacgtgcgctactcaaccgccggcgcctcttcgaggcgcaacgtacaaccgttcctcgccgcgtaccgattcgggcagttggctgtggcacacaacggcaacctcgtgaactaccaggcgctgcgcaacaaactcgaggcgcagggttccatcttcaacacctcgtcggacacggaggtcatcctgcacctcatctcaacctcgctctcgcgcccgctgctctcgcgcatctgcgacgcctgcgagcgcctcgccggtgcgtactcgctgttgttcatgactgccgacaagctttttgccgtgcgcgatccgttcggcttccggcccctggtgatgggccgacgccccaacggcgccgtggtgttctcgtcagagacctgcgcgctcgacctcatcgacgccacctatgagcgcgaggtggagcccggggaggtggtggtcgtggaccgccgcgacatgtcggtgtcctacgcctgcctcgtcccacatcgcccgcgcaagtcatgcgtgttcgagcacatctacttcgcccttcccaactccgtcgtgtttgggcacgccgtccacgagcgccgcaccgcgtacggccgcgcgctcgccgaggagtcgcccgccccgaccgcggacgtcgtcatccccgtgcctgactcggggttctatgcggcgctcggcttcgcgcaggcgtcgggactcgagttccagcaaggtcttatccggtggcactacagcggccgcagcttcatacagccatcgcaggcaatccgtgaccttgccgtcaagctcaaactcgcgcccgtgcgcggcgtcattaccggcaagagcgtggtcgtcgtcgacgactcgctcgtgcgcggcaccacctctagcaagattgtgcgcctgctccgcgatgccggcgcgcgcgaggtgcacatgcgcatctccagccccccagtcgtcgggtcctgcctctacggcatcgacacgccgagcgaaggcgagctgatatccaacaggatggacctcgagggtgtgaggaggaccattggctgcgactcgctcgccttcctctctctcgacaagctccacagcatctacggcaatgaagcacatgagttctgtgacgcctgcttctcacggaactacccggtgctgcccacagtgccggagccagtcccggagctggtgtctgccttcgaagactaacaagaaggggagtggatctatactctgcatgcttactattaccatagaatctagactcaattttgggcatagcatttttgcctttgcaaatgcattcatccatctgaattttgaggttacaaagtttagacactgatcgaactgctattgtgggttcgatctaatctattgtattgctatatgatgatgacgacgacaatgaatgatagaaaaattatttcaatggtacatgtttaccttttcactatatcaggtttagggtctgtttagtttgtggctaattgtattgaataactaaccttagacagaaaagttaggcaaaatataaagttaggcagcaaaccaaacatgccttaatctgctgctgttttgagtttcttcagaggtcgtcctcaccttcttggatcctgcttaacgttcttgcataacttccatatttggctgagtgtctatcgctaacaatgggccagtttaggatatggcaaatatgcattcagagttagtttgtgctagctgaaggctgatgtgtataagcgagtcaaagttaaggaatgcaattgtctagcttttcaaaattcttagcttctacgaattcgttgcaaagtttgcatcaccagagttcgtgatcctttttctagagttgggttgggctgtccataaaatgcgccaacctgaatcactagtgaagtgccttttcctaggtattgttgcattggaccgcgaatagtatatgctacatatattttctaaattttcttaatgtcccaaggcaagcaaggaattcctaggaccttgctgcactagactagcactagtggtatgataccctacacattgtaatcaggactgactacaatactactcccatagttctgaattttaagtgatttcaactcttttggagagtgaaaacaccttaatttagccgaagttaagagaattacaaagattcacgacatcaaggctgtttgagatgcatatattatatgatccaacttattttgaactaacacttagttcaaaataagttagattatataatctgggcaaattataatctcaaacaaataggcatactatgaaaatatgattaaaaaaggatctaataatacttatttaatatcgtaaatgttattgttttattatataaattcggtcaacattaagatgctttgactctccctcaaagttggaaaaaacttataatttaggacggagtgagggcatacttcatgccaattgcctgtcttccgatgagtctttgtttacatgttgatttgcattcaagaaggcattcaatggtaagcagaatgacatgatgttgacatggtccgtttatgatttaatagtagccaaaacaaacacggatttggcagtgttgctgctcatctgatgtagctgcttgtggtcttctttgtattataatacattgactcaaagctggttttctgttggggtacaagcatttgacatgttcagatttggtccttgaaatctttgccctacttcttacggatgccctgatcctaccttctgtttcggtcg

SEQ ID NO: 4997 - DNA, 768 bp, Sorghum bicolor
ctgaaatttgagccagcacttatttgctggtgacgaagccgtttccttttttgcgtcgtcctctgactccggaataagattagtctccagccagcaggcggcagcacagcagccagcggcttcctttcctccggcgatggcgaagaatcccagagatgccgccgctccggaggaggaggagatgcccgttgcagccgagggacaggcagcgccagccgcggcgacggtgaaggtgctcttcttcgcccgcgcgcgggacctgacgggcgtggcggattcggcggtggaggtaccgccggggagcaccgcgggcgagtgcctcgcccgggtcctggcgcagttccccaagctggaggagatccggggctccgtcgtgctcgcgctcaacgaggagtacgcggccgactccaccccggtcgctgacggcgacgagctcgctgtcataccgcccatcagtggcggctgacgttaatcacgaccgacttgtgtggaggtgaaaagatatgaacacataaatcattgagaaaaaaaaagagagagaaaatgctccttttccttgttgtcccaaatgattgaagttataactcgataaaataatctcttgttcttgattacaattttgttcacattgatcagtaatatttgttgtcaaagaatggatgaattgaatgctactaccttgtatgttgataaatgtcatcactgaagatatatagcatctgaaaattctccttgcaaatggttgacaatgaaaaaactcgttcgcta

SEQ ID NO: 4998 - DNA, 525 bp, Saccharum officinarum
cggacgcgtgggcggcgatggcggagaatcccaaagatgccgctccggaggaggaggaggagatgcccaccgccgcggccgaagaacaggcagcagcgccagccgcgacggtgaaggtgctcttcttcgcccgcgcacgggacctgacgggcgtggcggattcgacggtggaggtgccgccggggagcaccgcgggggagtgcctcgcccgggtcctggcccagttccccaagctggaggagatccggggctccgtcgtgctcgcgcttaacgaggagtacgcggccgagtccaccgccgtcgccgacggcgacgagctcgctgtcataccgcccatcagtggcggctgacgttaacctcgaccgacttgtgtggaggtgaaaaagatataaacacataaatcattggaaaaagagagagagagagagagaaaaagttcctcttccttgttaccccaaatatttgaatttatatgctcgataaaataatctcttgttcttgattacgattttgttcacattgatc

SEQ ID NO: 4999 - DNA, 1074 bp, Zea mays
attaacgtggatacctaactactactttgaaactaacggacgcgagagtttgtatacatgtggcgtgcgtgaaccagaatgccaaaaaatgaaatggccacacaagaaaatgcatcaaaatcaaaaaacgtggtcggcaggattcgaacctgcgcgggcaaagcccacatgatttctagtcatgcccgataaccactccggcacgaccacttgcgtgctaattttttatcctacatttacttgtcgtaaataaacttcactaacagcaaagccgttttgctttttgtatcgtcttctgacaacagaagaaagactagagttggccgcttcctttcctccggcgatggcgacgaatcccaaaggtaagaacaggcagcgccagccgcgacggtgaaggtgctcttcttcgcccgcgcgcgagacctgacgggcgtggcggattcggcggtggaggtgccgccggggagcaccgcgggggagtgcctcgcccgggtcctggcccagttccccaatctggaggagatccggggctccgtcgtgctcgcgctcaacgaggagtacgcggccgactccaccgcggtcgccgacggcgacgagctcgctgtcataccgcccatcagtggcggctgacgttaaccacgaccggctaaccacataaatcattgaaaaaagagagaatgctgttcctctaccttaccccaaatgattgaaaattatatgctcgataaaataatctcttattcttgactacaagtttgtttacattgatcagtagtatttgttgtcaaagaatggatgaaactaaagctactatcttgtatgctgatacatgtgttactcgctcatccctcatcgctgacaaacaccaatgtagcatgtaaatactgaaattcctttattttacttaatttattatataaaatataaaaatagacagagcagacgagagaatctttacatatagaggaggatggagaagtgttctctgtgtttagacgaggctccgttcaatgttatatgttggattaatgtgggcttggcccaaattaatattcaataatagtcaatgctaat

SEQ ID NO: 5000 - DNA, 623 bp, Setaria italica
ctccaaccctccagccaggttgaccacggcagcaaataagcaccggacgaggcggcgatcagcttcctttcctccggcgatggcgacgcaggatcccaaagatgctgctcccacggaggaggagggccccgccgcggccgacccggctgcgccagccgcgaggttgaaggtgctctacttcgcccgcgcgcgggacctgacgggcgtggcggagtcgtcggtggaggtgccggcggggggcaccgcgggggagtgcctcgcccgggtgctggcgcagttccccaagctggaggagatccgcggctccatggtgctcgcgctcaacgaggagtacgcgcccgactccgccaaggttgccgacggcgacgagctcgccgtcataccgcccatcagcggcggctgatgttaccaagaacgagttggagatggggaaaaagaaacagaaataaaagaaaaataaaggttcattgtgcctacattcttgctcttgttttcccataagatgtgcatgctggataagcaatctcctgttcttgttcttgacacacatttttgttctcaaaatcacgttggtagatgatactttgatctgaaagagtgaccgaaagaatacccatctgata

SEQ ID NO: 5001 - DNA, 3240 bp, Sorghum bicolor
actgcgtttgcggctctccaacgggtttccatgccgccgttggcttcatgcgtttgcaactctgccttgccggcccgcggtttccgttgtactagtactaccataccacgcgaacgaacgggtttccttccccccttcgtccccgtaggtagccgtgagcctaccccaatcaggccgggactccgtcccgcgtcagacggtccagccgccctgcaatcacactccgacgcaccccaacaacctgctaggatacaacccccacgcccgtgcaccgtctgatccacatcgtccggccgagatccctcacgagaacgtcgtgtggccaccgcctacggctctatacaccctcggccctagtaggcggtaggcccctgtgccgccgccctagcccaccacccattataagccgggcggggcgccgcggagctgagccattcccacacggaggtcgacttcccctcgccacgcaaaagccaccgcggccccgcccgtgcttccgtctcgcacctgccgatctactccccggcgagacgagcgccccggcgcgcccccagggaatgcggagcgatgaggcggcgctcaggcactgacgtcgccggcctgcgcaagctgcgcggcgaccgaacctgccaccgcaagcacgttgaggacgggtagacccatccatccatccatccttccttccatcttctagtcgtcatcgtcgtagggtagtttgcagatagctagctcggtcgtttctagtaagggatcgatccatcgatcgatcaggcggcatgggtgagggggaggcggcggaggtgaagggcggggtgctgcagggccgctacgagctgggccgcgtgctggggcacggcaacttcgggcgcgtccacgcggcgcgggacctgcgcacagggcgcggcgtggcggtcaaggtgctcgtcaaggacaaggtgctgcgcgcgggcatgatggagcagatcaagcgcgagatcgccgtcatgaagcgcgtgtcccaccccaacatcgtggagctccacgaggtgatggccacgcgctccaagatctacctcgcgctcgagctcgtccgcggcggggagctcttcgcgcggatcgtgcgcgccggccgggtcaaggaggacgtcgcgaggcgctacttccgccagctcatctccgccgtcgacttctgccacgcgcgcggcgtgtaccaccgcgacctcaagccggagaacctcctcatcgacgaagcggggaacctcaaggtcgtcgacttcggcctcagcgcgctcgccgaccacgcgcgcagcgatggattgctgcacacgctctgcgggacgccggggtacgtcgcgccggaggtgttccggaacaagggctacgacggcgccaaggccgacatctggtcgtgcggcgtcatcctctacgttctcctcgccgggtcgctgccgttcccggaggacaacatcgccgccatgttcaggaagatgagccgcggcgactaccggtgcccgccgtggctgtccaccgaggcgcgcaggctcatccccaagctgctcgaccccaaccccgacacccgcatcaccatcgcccagatcgtcgagacgccatggttcaacaagccatccatcgccaagcccgtcaaagcctccgccgccgccgccgccgagccgccggccgagcctgtctgctccgtaaaggacggcggcgacaaggacgagccgccggagacgctgaacgcgttccacctgatttccctctccgcggggttcgacctctcgccgctgttcgatgtggaaggcggtcccgcgaggtgccataaccgggagggcggtatgcggttcgcgacgcgggagtccgcgagcggcgtcgtctcccgtctcgaggaggtggcggcccgcggcggcgggcggatgcgggtgaccaagagcggcgcccgcggcgtgcggctcgagggcgcggagcgcgggggccgcaagggccgcctagccgtggcggccgacatcttcagcttatcgccgtccgtgctcgtggtggacgtcaagaaggacggcggcgacacgctcgagtaccgctccttctgcagcgaggagctccggccagcgctcaaggacatcgtctgggcggccgacccgcagcccgccgccaccgccaccgccgtcgtcgtgtgacgccgtgcgaccgcctgtgccgctcgttcgtagtgccattgtttgtttagtcagtgtcaattccatttccaagtgattgcgtcactgttctcgattcgataatgacgtgagatctactgtttgtggggcgacaagaatctgtatctcaatcgcagccgagcggcggcgctctcggcataatcgagtttgtttttgtgattgctatgcctgatctgaatattccttgtcaatctagtccattatccctgcattattggtgatgtttgtatgtgccagtacaagtttgttgaagtttgaataggctaaaagatgcgtcaatttccttcttcattgctccagaggcaatggctttgcatgtttgcactcaacaaacggttagatttttttgcttgcatgtttgcactcagtggtttgaaatgttaaatgtaaagttgtgggacagagtgaatgagtgatacacggtcattggagtggtgtgagctgtaagcttgttttgacagcgggttcttagtaattcatcgttcgttttgacagcgggttttcagtaattgagtggtgtgaactgtaagcttgttttgacagcggggttttccagtaattcatcgtttgttttgacagcaggttttcattaattcatcgttcaaaatcaaagtgaggacctgctgacaaaagctgtaccactatgcattatgcaaacaagtgtatcgagacacctctgtcaggaatcaagatcgatggcgtcgcgctgatagcagccgacgacggcgcgggagaggagagatctcctccctcggcagcctgtgatctggcgcagagaggaccattgggacctgaccggctgacctccatctgctcgtctccgtctcataacgtgtggcgctagcgcgcggcggggccgctggatggataccgtatcgccggtggcgggccgtctcgtgtctggtctctttcccagccctccagcctcggcgtctgcaccgccgctctcgccgtctcgccgagaaaggcatcgccttggcggagattttttttttttcacccgagaggacggcaaaagctttggcacaattttgtattaggaagagaaaat

SEQ ID NO: 5002 - DNA, 2049 bp, Setaria italica
acacggactcaccactcatcccactatcccaggctcccaccctccctcctcgcaagagccaccgcgtcgcccttgtccctgcttctcgcgcctgccccgatctaccgccgtcgaggcgagcgcccccgcgccccagggaatgcggagcgatgaggcggcgctcaggcactgacgtcgccggccagcgcgagctgcgcggcggccgcacctgccaccgcaagcacgtcgaggacgggtagacccatcccaccctcccttccccggcgctagtcgtagggtacagtttgttcgtttttctctctttggaattttggatcggaagaagaaattagtggatcgatcgattcgattcgatcgagcattcgaccctcatgggtgagggggacggggatgtgaaggcgggcggggtgctgcagggccgctacgagctcggccgcgtcctgggccacggcaacttcgggcgcgtccacacggcccgtgacctgcgcaccgggcgcagcgtggcggtgaaggtgctgtccaaggacaaggttgtgcgcgcgggcatgatggagcagatcaagcgcgagatcgccgtcatgaagcgggtgtcccacccaaacatcgtcgagctccacgaggtgatggccacgcgctccaggatctacctcgcgctcgagctcgtccgcggcggggagctcttcgcccggatcgtgcgggccgggcgggtgagggaggacgttgcgcggcgatacttcaggcagctcgtctccgccgtcgacttctgccacgcgcgcggcgtgttccaccgcgacctcaagccggagaacctcctcatcgacgaggcggggaacctcaaggttgtcgacttcggactcagcgcgctcgccgaccacacccgcagcgacggcctgctgcacacgctctgcggcacgccggggtacgtcgcgccggaggtgttcaggaacaaggggtacgacggcgccaaggcagacatctggtcgtgcggggtcatcctctacgtgctcctcgccggctcgctcccgttcccggaggacaacatcgcctccatgttcaagaagatgagccgcggcgactaccggtgcccgccgtggctgtccacggaggcgcgcaggctcatccccaggctgctcgaccccaaccccgacacccgcatcaccatcgcccagatggtcgagacgccgtggttcaaaaagtcgtcgtccgtcccgaggcccgtcaatgcggccgccgagccgccggccgagcctgcctgcgccgggaaggacggcggcgacaaggacgagccgccggagacgctgaacgcgttccacctgatctccctctccgcgggtttcgacctctcgcccctgttcgacgtcgagggtggctccgcaagggggcaccgggagggcggcatgcggttcgcgacgcgggagtcggcgagcggcgtcgtctcccggctcgaggaggtggccgcccgcggcggtgggcggatgcgggtgaccaagagcggcgcacgcggcgtgcggttcgagggcgcggagcgcggggggcccaagggccgcctcgccgtggccgccgacatcttcagcgtggcaccgtccgttctcgtggtcgacgttaagaaggacggcggcgacacgctcgagtaccggtccttctgcagcgacgagctccggccggcgctcaaggacatcgtctgggccgctgccgacccggcgcctgccgccgccgccgtcgtgtgacgccgcaccgccgcgcgctcattgctctgtatcgtagtgccatgatgccattgtttagtcagtgtcagttccatttttcactcaagtgattgcttcgccgttcttgattcgataatgacgtgaggttgctgtttgtgggggcagtagcgagaggaatctgtatctcgatcgctgcctagagcggcgcctctgcataattgagttgtttttgtgattgtttatgctctgcctgcacctgaacattccatgtcttaatctagaacagcatcccttcatcattgatgtcttttttatgtgccagcattgtttgtttaagccaaaa

SEQ ID NO: 5003 - DNA, 2065 bp, Setaria italica
acacggactcaccactcatcccactatcccaggctcccaccctccctcctcgcaagagccaccgcgtcgcccttgtccctgcttctcgcgcctgccccgatctaccgccgtcgaggcgagcgcccccgcgccccagggaatgcggagcgatgaggcggcgctcaggcactgacgtcgccggccagcgcgagctgcgcggcggccgcacctgccaccgcaagcacgtcgaggacgggtagacccatcccaccctcccttccccggcgctagtcgtagggtacagtttgttcgtttttctctctttggaattttggatcggaagaagaaattagtggatcgatcgattcgattcgatcgagcattcgaccctcatgggtgagggggacggggatgtgaaggcgggcggggtgctgcagggccgctacgagctcggccgcgtcctgggccacggcaacttcgggcgcgtccacacggcccgtgacctgcgcaccgggcgcagcgtggcggtgaaggtgctgtccaaggacaaggttgtgcgcgcgggcatgatggagcagatcaagcgcgagatcgccgtcatgaagcgggtgtcccacccaaacatcgtcgagctccacgaggtgatggccacgcgctccaggatctacctcgcgctcgagctcgtccgcggcggggagctcttcgcccggatcgtgcgggccgggcgggtgagggaggacgttgcgcggcgatacttcaggcagctcgtctccgccgtcgacttctgccacgcgcgcggcgtgttccaccgcgacctcaagccggagaacctcctcatcgacgaggcggggaacctcaaggttgtcgacttcggactcagcgcgctcgccgaccacacccgcagcgacggcctgctgcacacgctctgcggcacgccggggtacgtcgcgccggaggtgttcaggaacaaggggtacgacggcgccaaggcagacatctggtcgtgcggggtcatcctctacgtgctcctcgccggctcgctcccgttcccggaggacaacatcgcctccatgttcaagaagatgagccgcggcgactaccggtgcccgccgtggctgtccacggaggcgcgcaggctcatccccaggctgctcgaccccaaccccgacacccgcatcaccatcgcccagatggtcgagacgccgtggttcaaaaagtcgtcgtccgtcccgaggcccgtcaatgcggccgccgagccgccggccgagcctgcctgcgccgggaaggacggcggcgacaaggacgagccgccggagacgctgaacgcgttccacctgatctccctctccgcgggtttcgacctctcgcccctgttcgacgtcgagggtggctccgcaagggggcaccgggagggcggcatgcggttcgcgacgcgggagtcggcgagcggcgtcgtctcccggctcgaggaggtggccgcccgcggcggtgggcggatgcgggtgaccaagagcggcgcacgcggcgtgcggttcgagggcgcggagcgcggggggcccaagggccgcctcgccgtggccgccgacatcttcagcgtggcaccgtccgttctcgtggtcgacgttaagaaggacggcggcgacacgctcgagtaccggtccttctgcagcgacgagctccggccggcgctcaaggacatcgtctgggccgctgccgacccggcgcctgccgccgccgccgtcgtgtgacgccgcaccgccgcgcgctcattgctctgtatcgtagtgccatgatgccattgtttagtcagtgtcagttccatttttcactcaagtgattgcttcgccgttcttgattcgataatgacgtgaggttgctgtttgtgggggcagtagcgagaggaatctgtatctcgatcgctgcctagagcggcgcctctgcataattgagttgtttttgtgattgtttatgctctgcctgcacctgaacattccatgtcttaatctagaacagcatcccttcatcattgatgtcttttttatgtgccagcattgtttgtttaagccaaaatcagctcaaacatgcg

SEQ ID NO: 5004 - DNA, 2164 bp, Pennisetum glaucum
caccgccgaggacgtgatggagtggatgcttcctcccaaagagcttcttcttcttggatcgggagggcaggcgcgagaagcagggacacgcactctccccacctcccctcttcgcaagagccaccgcgtcgccgtgtccctgcttctcgcgcctgccctcccgatccaccgccgccgagacgagcgcccccgcgcccccagggaatgcggagcgatgaggcggcgctcaggcactgacgtcgccggccagcgcgagctgcgcggcggccgcacctgccaccgcaagcacgtcgaggacgggtagacccatccccccatccacaatcctcccccccgccgctagtcgtgtcgtagggtagagtttgtttgttttttccctctcttgttggaatttcggatcggaagaagaagaaggaggtagtggatcgatcggatccgatcgggcattcgagcgccatggctggtgagggtgacggggatgtgaaggtgggcggggtgctgcagggccgctacgagctcggccgcgtcctgggaaacggcaacttcggccgcgtccacacggcccgcgacctgcgcaccgggcggagcgtggcggtcaaggtgctgtccaaggacaaggtcgtccgcgcggggatgatggagcagatcaagcgcgagatcgccgtcatgaagcgggtgtcccacccgaacatcgtcgagctccacgaggtgatggccacgcgatccaggatctacctggccctcgagctcgtccgcggcggggagctcttcacccggatcgtgcgcaccggccgggtcaaggaggacgtggcgcggcgctacttcaggcagctcgtgtccgccgtcgacttctgccacgcgcgcggcgtgttccaccgcgacctcaagcccgagaacctcctcatcgacgacgccgggaacctcaaggtggtcgacttcgggctcagcgcgctcgccgaccacgcccgcagcgacggcctgctgcacacgctctgcggcaccccggggtacgtcgcgccggaggtgttcaggaacaagggctacgacggcgccaaggcagacatatggtcgtgcggggtcatcctctacgtgctcctcgccggatcgctcccgttcccggaggacaacatcgctgccatgttcaagaagatgagccgcggggactaccggtgcccgccttggctgtccacggaggcgcgcaggctcatacccaagatgctcgaccccaaccccgacacccgcatcaccatcgcccagatcgtcgacacgccgtggttcaagaagtcgtcgtccgtcccgagacccatcaatgccgccatcgagccgccggaagagcctgcccccgccaagaaggacgggggcgacaaggacgagccgccggagacgctgaacgcgttccacctcatctcgctctcagcggggttcgacctctcgcctctgttcgacgtcgaggggggctcctcgtcgaggggccaccgggagggcggcatgcggttcgcgacgcgggagtcggcgagcggcgtcgtgtcccggctcgaggaggtggccgcccgcggcagcggccggatgcgggtgaccaagagcggcgcacgcggcgtgcggttcgagggcgcggagcgcgggggccccaagggccgcctcgccgtggccgccgacatcttcagcgtggccccgtccgtgctcgtggtcgacgtcaagaaggacggcggcgacacgctagagtaccggtccttctgcagcgacgagctccggccggcgctcaaggacatcgtctgggccgccgccgacccggcgcctgcagccaccgccgtggtgtgacgccgcgccgcgcgctcattgctctgtatcgtagcgccatgatgccattgttttagtcagtgtcagttccattttccacccaagtgattgcgtcgctgttcttgattggataatgacgtgagaagttgctgtttgtgggggcggtagcaagaggaatctgtatctcgatcgctgctgcctagagcagcggcgcctctgcataattgagttgtttttgtgttgtgcatcaatcagtgtagtatggtcttgctctgcctgcacctgaacattccatgtcttaatctagaccgtcaccccttcatcattgacgcttttttttttaatgtggcagcattgttttttcaag

SEQ ID NO: 5005 - DNA, 2102 bp, Zea mays
cccctggcccctgctagtatatccctaccgctccctgcaccagctgatccacatcgtcgggccgagaacgtatggccaccgcctactgcatgccctagtaggcccctgtaccgccgccgccacagttcagtcataataaaggcggacgccgcggagctgagccattcacagttcacatcacacacgtatatcgttcgccacgcaaaaccaccgccgcccccctgcttcctccgatctactcccggcgagactcaggcgccccggcgccccccagggaatgcggagcgatgaggcggcgctcaggcactgacgtcgccggccagcgcgagctgcgcggcgaccgaacctgccaccgcaagcacgttgaggacgggtagatcatatccatccttccttccttctgctagtcgtcgtcttcgtcgtagggtgtagtagtttgcagatagttctgtcgtttctagtagcgaatcgatccagcgatcagacatggttgagggggaggcggaggcggaggcggaggtgaagaagggcggggtgctgcagggccgatacgagctgggccacgtgctggggcacggcaacttcgggcgcgtccacgaggcgcgggacctgcgcaccgggcgtggcgtggcggtgaaggtgctcgccaaggacaagttgctgcgcacgggcatgatggagcagatcaagcgcgagatcgccgtcatgaagcgcgtgtcgcaccccaacatcgtggagctgcacgaggtgatggccacgcgcaccaagatctacctcgcgctggagctcgtccgcggcggggacctcttggctcgcatcgcgcgctccggccgcgtcagggaggacgtggcacgccgctacttccggcagctcgtctccgccgtcgacttctgccacgcgcggggcgtgttccaccgcgacctcaagcccgagaacctcctcgtcgacgaagcgggcaacctcaaggtcgtggatttcggcctcagcgcgctcgccgaccacgcgcgcgccgacgggctgctgcacacgatctgcgggacgcccgggtacgtcgcgcccgaggtgttccggaacaggggctacgacggcgccaaggccgacgtctggtcgtgcggcgtcgtcctctacgtgctcctcgccggctcgctgccgttcccaaaggacagcatcgccgccatgttcatcaagatgagccgcagggactaccgctgcccgccgtggctgtccacggaggcgcgcaggctcatccccaagctgctcgaccccgacccggacacccgcatcaccgtcgcccagatcgtcgagacgccgtggtttaacaagccgtccgtctccagggccgttacagccgccgccgccgagccgccggccgaggctgcctgctccgcaaaggacagcggcggcggcgacaaggacgagctgccggagacgctaaacgcgttccacctgatctccctctccgcagggttagacctctcgccgctgttcgacgtggaaggcggtccggcgagggggcaccgggaggacggcatgcggttcgcgacgcgggagcccgcgagcggcgtcgtctcccgtctcgaggaggtggccgcccgcagcggcgggcggatgcgggtgaccaagagcggtgcccgcggcgttcggctcgagggcgccgggcgcgggggccgcaagggccgcctagccgtcgcggccgacatattctgcttggcgccgtccgtgctcgtagtcgacatcaagaaggacggcggcgacacactcgagtaccgctccttctgcagcgaggtgctccggccggcgctcaaggacatcgtctgggcggccgacccccaccccgccgccgccgccgttgacgccgtgcggccgccttctgatcattgttctggatcatagtgccatttgtttagtcagtatcaattccattcccaagtgatatgcgtcactgttctcgattcgataatgacgtgagatgtactgcttatgggggcgacatgaatctgtatctccatggcagccggctccctcggcacaattgacttgtttatgtgatggtctaaggtcttccatctgtgcctcacatgaatatttcatgtcttatggct

SEQ ID NO: 5006 - DNA, 1884 bp, Hordeum vulgare
gggcaccccaccatacaacaccacgctcatcgatctcatcgatcgcctcccgttctcgtccgtccccttggtctcgccgggaatgcagagcgatgaggcggagacgaggcactgacgtcgccgtccagcgcaaactgcgcgtcggccgcagctgccaccgtaagcacgtcgaggacgggtagggtggccggatcggatctctgctcctctcagcttagacagacagctcgattgataggtacgtagattgtcttcaccgccgatctgttcagacttcagagagggaagtgggaagtgagcgaatcgagagaccgggaatggcggatcaggcggaggggaagaagggcggggtgttgcaggggcgctacgagatgggccgtgtgctcggccacggcaacttcgggcgggtgcacatcgcgcgggacctgaggacggggcgggccgtggcggtcaaggtcgttgccaaggacaaggtggtgcgcgccggcatggtggagcagatcaagcgggagatcgccgtcatgaagcgggtctcccaccccaacatcgtcgagctccacgaggtcatggccacgcgctccaagatctacctcgccctcgagctcgtccgcggcggggagctcttcgcgcggatcgagcggtccggccgcgtcacggaggacgtcgcgcgccgctacttccgccagctcatctccgccatcgacttctgccacgctcgcggcgtctaccaccgcgacctcaagccggagaacctgctcctcgacgaggcggggaacctcaaggtcgtcgatttcggcctcagcgcgctcgccgaccacgcccgcgctgacgggcttctccacaccctctgcggcacgccgggctatgccgcgccggaggtgctccgcgacaagggctacgacggcgccaaggccgacctctggtcctgcggcgtcatcctctacgtgctcctcgccggatccctcccgttcccggacaacaacgttgttaccatgtacaagaaggcgcagcgcggtgactaccgatgtccgccgtggttctcgacggatgcgcgcaggcttattcccaaactgctcgaccccgaccccaccacccgcatcaccgtcgcgcagctcgtggagacgccttggttcaaaaagacgtccatcgccaagcctgtaagtcttgggccgccagctgattctgcatgcgcgaaggatgccgctgacaaggacgaacccgaggcgatgaacgcgttccacctgatatctctctccgagggattcgacctctcgccgctgttcgagggccacccggcgagtcggcgtcgggagggcggcatgcggttcgcgacgcgggagccagcaacaggcgtggtgtcccgtctcgaggatgtcgctgcgcgtggcggcgggcggatgcgggtgaccaagagcagccctgggggcgtgcgcctcgagggcgcggaacgcggcgggcgcaagggccggctcaccgtggccgccgaaatattcagcgtggctccttcggtgctcgtggtcgacgtcaagaaggacggcggcgacaccctcgagtacctctccttctgctgcgaggagctccggccggccctgcaggacattgtttgggccgccgaccctccagcatcggtcgccatcgccgtctgacactgtcgcagtcgctacagttgccacttgccagtactatgttctttttttcccttctgttcttgattcgatagtgacgggagtgaagtagtatgttgctgttatgttagtccgctcagtgcgaagaagaagaatcagctgtgccttccctgaaggattttatttgttgcatattctattgtttttgttataacatctgaatattttatgtctgtcaaacttgcttgcatgattgctg

SEQ ID NO: 5007 - DNA, 1774 bp, Triticum aestivum
tcgtccccttcccccgtcccctccgtctcgccgggaatgcagagcgatgaggcggcgaccaggcactgacgtcgccgtccagcgcaagctgcgcgtcggccgcacctgccaccggaagcacgtgaggacgggtagagtggccggatctctgctcctacagttcgattgccaggtagattgtcttcaacaccgatttcttgggagagggaaggggggcgaatcgagagatcgggaatggcgggttcggcggaggggaagaagggcggggtgctgcaggggcgctacgagatgggccgcgtgctcggccacggcaacttcgggcgggtgcacatcgcgcgggacctgaggaccgggcgggccgtggcggtcaaggtggttgccaaggacaaggtggtgcgcgccggcatggtggagcagatcaagcgggagatcgccgtcatgaagcgggtctcccaccccaacatcgtcgagctccacgaggtcatggccacgcgctccaagatctacctcgccctcgagctcgtccgcggcggggagctcttctcgcggatcgagcgctccggccgcgtcacggaggacgtcgcgcgccgctacttccgccagctcatctccgccgtcgacttctgccatgcccgcggcgtctaccaccgcgacctcaagccggagaacctgctcctcgacgaggcggggaacctcaaggtcgtcgatttcggcctcagcgcgctcgccgaccacgcccgcgccgacgggcttctccacaccctctgcggcacgccgggctacgccgcgccggaggtgctccgcgacaagggctacgacggcgccaaggccgacctctggtcctgcggcgtcatcctctacgtgctcctcgccggatccctcccgttcccggacgacaacgttgttaccatgtacaagaaggcgcagcgcggtgactaccgatgcccgccgtggttctcgacggatgcgcgcaggctcattcccaaactgctcgaccccgaccccgccacccgcatcaccgtcgcgcagctcgtggagacgtcgtggttcaagaagacgtccatcgccaagcctctgagtcttgagccgccagcatgcgtgaaggatgccgccgacaaggacgaacccgaggcgctgaacgcgttccatctgatatccctttccgagggattcgacctctcgccactgttcgagggccacccggcaagtcggcggcgggagggcggcatgcggttcgcgacgcgggagccagcacggggcgtggtctcccgtctcgaggaggtcgctgcgcgtggcggcgggcggatgcgggtgaccaagagcagcccggggggcgtgcgcctcgagggcgcggaacgcggcggtcgcaagggccggctcgccgtggccgccgagatattcagcgtggctccttcggtgctcgtcgtcgacgtcaagaaggacggcggcgacaccctcgagtacctctcgttctgctgcgacgagctccggccagccctccaggacattgtctgggccgccgaccctccggcgtctgtcgccatcgccgtctgacgctgcagtaccatgtttcttttctgttgttcttgattcggtagtgacgggagtgaagtaagcagcatgtttatgttagtctggtcagtgcgaagaagaagaatcagctctgccttccctgaaggatttcattttgttgcataattgtattgtttttgttatctgaatatcatgtgtgtgtcaaagcttgcctgcatgattgctgttccttatgcgattg

SEQ ID NO: 5008 - DNA, 2318 bp, Brachypodium distachyon
ttgccatctgctggtcatgagccgttggttactgatcttaggctgtgtttggttggagaacgaagtacaatgtaatgaaaccattgcattcctagaaaatgaaatggttccatcctgatgtttggttggaaaaaatggaatcggtgtagattttgtttggttcatgaaacagacgagaacgtggaacgactcttcttcctcatcgccacgccgctcctgctgcgccgccctcgccccgcgcggatgctccgccctggcgccctgccgctgccgtcgccccgcgccgcactcgcgccgctctgctccgccgccctcgcccagcgcggctgctccgcccgcccctgctcggctgctccccatcagcgccggcggcccctcgcgtgcctctgctgcggctcccgcgctgcccctgctccgccgccctgccaccccgtgcgcggcccctgctccccatcagcgccggcggcccctcacgtgcctctgctgcggcccccgcgctgcccctgctccgctgccctgccaccccgtgcgcggcccctgctccgcctccctccgctgcctcacgccgccctgccgcccctgctccgctgcgagctcccgccgtgccgccctggtccacgcgccgcgcgccgcccttgctccgccgccgcgagcgcctccgttgccgccgtgcactcgccccgcgcgagcagagaaagagggtcggccgggacagcatcagacggcgagggcgacggaggccggttggtcggcggcccagacgatgtcctggagcgccggccggagctcctcgctgcagaaggagcggtactcgagggtgtcgcctccgtccttcttgacgtcgaccacgagcaccgacggagccacgctgaagatctctgcggccacggcgagccggcctttggcccccccgcgggccgcgccctcgaagcgcacgcccccggcgccgctcttggtcaccctcatccgcccgccgccgcgggcagcgacctcctcaaggcgggagacgacgcctttcgccggctcccgggtcgcaaacagcatgccgccctcccgtcggccacgagccgaattgccctcgaacagcggcgagaggtcgaacccctcggagagggatatcaggtggaaggcgttcatcgtctccggttcgtccttgtcttcggcctccttcgcggcgcacactacaggatggtcaattggcggtggcggtggctccgtagttacaggcctggcaatggaagtcttcttgaaccacggcgtctcgacgagctccgcgatggtgatgcgggtggccgggttggggtcgagcagcttggggacgagcctgcgggcgtccgtggagaaccacggcgggcaccggtagtctccgcgctggaccttcttgtacatggtgacaatgttgtcgtccgggaacggcagggagccggcgaggagcacgaagaggatgacgccgcaggaccagatgtcggccttggcgccgtcgtatcccttgtcgcggagcacctcgggcgcggcgtagcccggcgtgccgcagagggtgtggagcagcccgtctgcgcgggcgtggtcggcgagcgcgctgaggccgaagtcgaccaccttgaggttcccctgctcgtcgaggagcaggttctcgggcttgaggtcgcggtggaagacgccgcgcgcgtggcagaagtcgacggcggagatgagctggcggaagtagtggcgcgcgacgtcctccctgacgcggccagagcgcacgatccgggcgaagagctcgccgccgcggacgagctcgagggcgaggtagatcttggagcgcgtggccatcacctcgtggagctcgacgatgttggggtgggagacgcgcttcatgacggcgatctcccgcttcatctgctccgccatgccggcgcggaccaccttctccttggccaccaccttcaccgccacgctccgcccggtccgcaggtcccgggccacgtggacccgcccgaagttgccgtggcccaggacgcggcccatctcgtagcggccctgcagcaccccgccgccccccttcttcccctccgccgccgccgcctccgccatgtccccgatcccctcctctgaaccaatcgatggaaacaaaacctagaaatctacagtcctacggctaagaaagagggagcacagatccggcgactctacccgtcctcgacgtgcttccgatggcaggtgcggccgacgcgcagcttgcgctggccggcgacgtcagtgcctggtctccgcctcatcgctctgcattcccggtgagaccgaggggccgcggaaggggggcgatcgggggtggg

SEQ ID NO: 5009 - DNA, 1823 bp, Oryza sativa
gggaatgcggagcgatgaggcgggcacgaggcactgacgccgccgtccagcgcaagctgcgcggcggccgcacctgccaccggaagcacgtcgaggacgggtagatccatctcttggtagtagattagtagtagttaggtagattcttgaggaggaggaggaggatgatggcggcggcggcggaggagggggaggggaagaagggcggcggcgcggtgctgcaggggaggtacgagatggggcgggtgctcggccacggcaacttcgggcgggtgcacgtggcgcgggacctgaggaccgggaggagcgtggcggtgaaggtggtggcgaaggagaaggtggtgcgcgccgggatgatggagcagatcaagcgggagatcgccgtcatgaagcgcgtctcccaccccaacatcgtcgagctccacgaggtgatggccacgcgctccaagatctacctcgcgctcgagctcgtccgcggcggggagctcttcggccgcatcgtccgcctcggccgcgtcagggaggacgccgcgcggcactacttccggcagctcgtctccgccgtcgacttctgccactcccgcggcgtctaccaccgcgacctcaagccggagaacctgctgctcgacgaggccgggaacctcaaggtggtcgacttcggcctcagcgcgctcgccgaccacgcccgcgccgacggcctcctccacacgctctgcggcacgccggggtacgccgcgcccgaggtgctccgcgacaagggctacgacggcgccaaggccgacctctggtcctgcggcgtcatcctctacgtgctcctcgccgggtccctcccgttccccgacgacaacatcgtcaccctgtaccggaaggcccagcgcggcgactaccggtgcccggcgtggctgtccaccgacgcgcgccgcctcatccccaggctgctcgaccccaacccgaccacccgcatcagcgtcgcgcagctcgtcgagacgccgtggttcaagaagacgtccatctccaggcctgtgagcatagagcttcctccggcctttgccgatcctgctccggctaaggaggaggccgagaaggacgagccggagacgctgaacgcgttccacctgatatcactctcggaggggttcgacctctcgccgctgttcgagggggactcggccaaggggaggcgggacggtggcatgctgttcgcgacgcgggagccagcgagcggcgtgatctcccgcctcgagggggtggcggcgcgcggcggcggccggatgcgggtgaccaagagcggcgcccgcggcgtgcgcctggagggcgcggagcgcggcggggccaagggccgcctcgccgtggccgccgacatcttcagcgtggcgccctccgtcctcgtcgtcgacgtcaagaaggacggcggcgacacgctcgagtaccgctcattctgcagcgaggagctccggccggcgctccaggacatcgtctggggcgccgccgccgacccaacgccgaccgccgccgtctgatgccaccattgttagcgtccaaagtcattgtgtcacagtagccgatgctgttcttcctcctcccgtgcttgattcgatagcgacgtgcatgaactagtatcgctgtttgggtggtgggggcagttggcaagaacaaatctgtatctctgcctcaaaagcaacagcattttttttcttttgcacaaattgcaattgtttttgtgatggtctttgcttacatctgaatattccgtgtcttctctgggacaatctctgctgcatgattgatggtctttgctgtttatatgtattcagacgccgtgc

SEQ ID NO: 5010 - DNA, 1925 bp, Brachypodium distachyon
ccacctccctttgggccgccgcctgctgcagcctgactcccctccccacacaatataagccgcaagccgcaacgctaaactaatcccaagccaccacaaaaccacgcttagttatcgcatcgatctcccacccccgatcgccccccttccgcggcccctcggtctcaccgggaatgcagagcgatgaggcggagaccaggcactgacgtcgccggccagcgcaagctgcgcgtcggccgcacctgccatcggaagcacgtcgaggacgggtagagtcgccggatctgtgctccctctttcttagccgtaggactgtagatttctaggttttgtttccatcgattggttcagaggaggggatcggggacatggcggaggcggcggcggcggaggggaagaaggggggcggcggggtgctgcagggccgctacgagatgggccgcgtcctgggccacggcaacttcgggcgggtccacgtggcccgggacctgcggaccgggcggagcgtggcggtgaaggtggtggccaaggagaaggtggtccgcgccggcatggcggagcagatgaagcgggagatcgccgtcatgaagcgcgtctcccaccccaacatcgtcgagctccacgaggtgatggccacgcgctccaagatctacctcgccctcgagctcgtccgcggcggcgagctcttcgcccggatcgtgcgctctggccgcgtcagggaggacgtcgcgcgccactacttccgccagctcatctccgccgtcgacttctgccacgcgcgcggcgtcttccaccgcgacctcaagcccgagaacctgctcctcgacgagcaggggaacctcaaggtggtcgacttcggcctcagcgcgctcgccgaccacgcccgcgcagacgggctgctccacaccctctgcggcacgccgggctacgccgcgcccgaggtgctccgcgacaagggatacgacggcgccaaggccgacatctggtcctgcggcgtcatcctcttcgtgctcctcgccggctccctgccgttcccggacgacaacattgtcaccatgtacaagaaggtccagcgcggagactaccggtgcccgccgtggttctccacggacgcccgcaggctcgtccccaagctgctcgaccccaacccggccacccgcatcaccatcgcggagctcgtcgagacgccgtggttcaagaagacttccattgccaggcctgtaactacggagccaccgccaccgccaattgaccatcctgtagtgtgcgccgcgaaggaggccgaagacaaggacgaaccggagacgatgaacgccttccacctgatatccctctccgaggggttcgacctctcgccgctgttcgagggcaattcggctcgtggccgacgggagggcggcatgctgtttgcgacccgggagccggcgaaaggcgtcgtctcccgccttgaggaggtcgctgcccgcggcggcgggcggatgagggtgaccaagagcggcgccgggggcgtgcgcttcgagggcgcggcccgcgggggggccaaaggccggctcgccgtggccgcagagatcttcagcgtggctccgtcggtgctcgtggtcgacgtcaagaaggacggaggcgacaccctcgagtaccgctccttctgcagcgaggagctccggccggcgctccaggacatcgtctgggccgccgaccaaccggcctccgtcgccctcgccgtctgatgctgtccctgtccctgcagttgctagtagtatattccattgatgtaatgcattttctagactccattagtgtgattgtgtttgtgggtgcagtgtcaacaaagaatctgtatcttgtgcctcccaaaacgcattctttctgttccataattgcattgtgtttgtgacttgtcttggttacatgacatctgaatatgc

SEQ ID NO: 5011 - DNA, 2454 bp, Brachypodium distachyon
ccacctccctttgggccgccgcctgctgcagcctgactcccctccccacacaatataagccgcaagccgcaacgctaaactaatcccaagccaccacaaaaccacgcttagttatcgcatcgatctcccacccccgatcgccccccttccgcggcccctcggtctcaccgggaatgcagagcgatgaggcggagaccaggcactgacgtcgccggccagcgcaagctgcgcgtcggccgcacctgccatcggaagcacgtcgaggacgggtagagtcgccggatctgtgctccctctttcttagccgtaggactgtagatttctaggttttgtttccatcgattggttcagaggaggggatcggggacatggcggaggcggcggcggcggaggggaagaaggggggcggcggggtgctgcagggccgctacgagatgggccgcgtcctgggccacggcaacttcgggcgggtccacgtggcccgggacctgcggaccgggcggagcgtggcggtgaaggtggtggccaaggagaaggtggtccgcgccggcatggcggagcagatgaagcgggagatcgccgtcatgaagcgcgtctcccaccccaacatcgtcgagctccacgaggtgatggccacgcgctccaagatctacctcgccctcgagctcgtccgcggcggcgagctcttcgcccggatcgtgcgctctggccgcgtcagggaggacgtcgcgcgccactacttccgccagctcatctccgccgtcgacttctgccacgcgcgcggcgtcttccaccgcgacctcaagcccgagaacctgctcctcgacgagcaggggaacctcaaggtggtcgacttcggcctcagcgcgctcgccgaccacgcccgcgcagacgggctgctccacaccctctgcggcacgccgggctacgccgcgcccgaggtgctccgcgacaagggatacgacggcgccaaggccgacatctggtcctgcggcgtcatcctcttcgtgctcctcgccggctccctgccgttcccggacgacaacattgtcaccatgtacaagaaggtccagcgcggagactaccggtgcccgccgtggttctccacggacgcccgcaggctcgtccccaagctgctcgaccccaacccggccacccgcatcaccatcgcggagctcgtcgagacgccgtggttcaagaagacttccattgccaggcctgtaactacggagccaccgccaccgccaattgaccatcctgtagtgtgcgccgcgaaggaggccgaagacaaggacgaaccggagacgatgaacgccttccacctgatatccctctccgaggggttcgacctctcgccgctgttcgagggcaattcggctcgtggccgacgggagggcggcatgctgtttgcgacccgggagccggcgaaaggcgtcgtctcccgccttgaggaggtcgctgcccgcggcggcgggcggatgagggtgaccaagagcggcgccgggggcgtgcgcttcgagggcgcggcccgcgggggggccaaaggccggctcgccgtggccgcagagatcttcagcgtggctccgtcggtgctcgtggtcgacgtcaagaaggacggaggcgacaccctcgagtaccgctccttctgcagcgaggagctccggccggcgctccaggacatcgtctgggccgccgaccaaccggcctccgtcgccctcgccgtctgatgctgtccctgtccctgcagttgctagtagtatattccattgatgtaatgcattttctagactccattagtgtgattgtgtttgtgggtgcagtgtcaacaaagaatctgtatcttgtgcctcccaaaacgcattctttctgttccataattgcattgtgtttgtgacttgtcttggttacatgacatctgaatatgccgtccatgattgctgttttttatacgccactgttgctgtgtgattgaaatggttcagtctagttttgaacctaccgattgtgtttgacttgcagctttggctaagcgagaactttgcgactcatgaacagacaggagaagtagacacctcctaccatttgacaggaacaatcgaactctatacgtcgaaacttctgtttcaatgtccttcgttcacggatatgacggtccagctacttttgacaagcttggaatttctgaacccttggagcattagctgttaggagtttgggaactgtaaacttgcttcgcaatttgttgtcaagtgaccagaggatgaaagcagatttggcaaaaacgaccttagggctgtgtttggttgctagaatgcactgaaatgtaatggaaccgttcctcgttttagcacgatttctgcgtttggtttctggaattcacaaaagtagaatgtaacaaagtggttcctcggaaatgaatatacctcgtgtccggaaccaacccatacctccaaa

SEQ ID NO: 5012 - DNA, 3861 bp, Sorghum bicolor
ccacctcccgctccctcctttcccctctggcctctgcggctctgccactgccaggggtggtggtgggtgctcgctcgctcagacgcgcactcagccaacgcccaacgcaaccgcctcgccagtcgccaccaacaccaacaccaccaccgccgccgccccgatcagtctcggactcgatcgccggccgccgcctgcgggggtggggtttggccgcacctgagaggcagagcagccggccggagggacagcggatcgagtacgcacctagccatgggggacgccgccgtgccggcggggaccctgcagaagagctacttcgacgtgctggggatctgctgcccctccgaggtacccctcgtcgagaagctgctgcgcccgctgcccggcgtccacactgtcaccgtcatcgtcccctcccgcaccgtcatcgtcctccacgacgccgccgccacgtcgccagcacaaatcgtcaaggcgttgaaccaggcgaggctggaggcgtctgttcgagcctacggcagtggctccgaggagaaggtagccaacaaatggccgagtccctacgttcttttctgcggggttttcctggtcgtctcgctcttcgagcacttctggcctcccctgaaatggtttgcgctggtggcggcggcggccggcctgccgccgatcgttctgaggagctttgcagctgcccggaggctcaccctcgatgtcaacatactcatgctgattgcagtttctggggcgatagctctgaaggactactctgaggctgggttcattgttttcctgttcactacagctgaatggcttgagaccagggcaagccacaaggcgactgctgggatgtcatcactgatgagcatgacaccacagaaggctgttctagcagagactggggaagtggtttcagctcaggatgtcaaggtgaatacagtaatagctgtcaaagctggggaagtcgttccaattgatggtgtggttgtggatggacggagtgaggttgatgaaagtaccctaactggggagtccttcccagttgcgaagcagccagactcccaggtctgggccggcacgctcaacatagatggctatattgctgtcaggaccactgcaatggctgacaactccgcagtggctaaaatggcaaggctagttgaagaagcacaaaacagtaggtccaaaactcagaggctgattgatacatgtgccaagtactatacgcccgctgttgttgtcatggctgcgggggtagcagtgattcctgtggcgatcagagcacaccacctcaaacactggttccaattggccctggtccttctagtgagtgcttgcccatgtgctttagtgctgtcgacgccggttgctaccttctgtgctcttctgacggctgcgaggacagggctccttatcaaaggaggggatgtccttgaaaccttggcaaggatcaaaattgctgcttttgataaaacgggtacaatcactagaggagagttctgtgttgaggaattccaggcagttggcgaacgtatcccaatgcaacaacttctttactgggtatcaagcattgaaagcagatcaagccacccaatggcatctgtgctagttgactatgcccagtcaaagtcagtcgaaccaaaatctgataatgttactgagttccaaatctaccctggagaggggatttatggtgaaatcgacggggaaggtgtatatattgggaacaaaagaattctgtcaagggcttcatgtgaaacagttcctgacatgaaagatatgaaaggagttaccatcggatatgttgcctgcaaagggcaattgatcggagtatttaccctctcggattcctgccgaactggatcagctgaggccatcagggagctgaggtcactgggcatcaagtcagtgatgcttactggggatagttctgcagcagcttcatatgcacagaaccagcttgggaacatacttgatgaggttcaccctgaacttcttccagaggacaaagtgagaattgttgatgaactcaaggcaaaacatggccctactctgatgattggtgatggcatgaatgatgccccagctctggccaaggctgacgttggagtctcgatgggtgtatctggttccgctgttgcaatggagacgagccacataactttgatgtcgaacgacatccgcaggatcccaaaggctatccagctggcacggaggactcaccggactatcatcgtgaacatcatcttctcggtgatcaccaagcttgcaatcgttggacttgcactctctggacatccgcttatctgggcagccgtcctcgcagatgttggcacatgcatgctggtgatcatgtacagcatgttgctattgagatcaaagggcggtcggaaggcgaagaaatgttgtgcctcttcacagcatgggtcacacgcaaagaagcactgtgtttcccgccactgctcagatggaccgtgcaagtcgacaggctgttccaaagagtcgtctgctggtaaacatggttgtcatgatcatggccatgcccacacccactgcaaagagccgagcagccagcaccctacagaaaagcacgcttgtcatgatcacggccacagccataaccactgcaaagagcccagcagccatgtggtcacggaaaagcatgtttgccatgaccatggaaacacccataaccactgcaaggaggcaggcaaccagctgctgcttgtggagggccatggttgccatgatcgtgaccatggccatagccatgaacacaccggcaagcaggattgccatggccatgagcacagccactgcaaagaacccaagactccgcgtgctgacagtgaaggtgcttgccatggccatggccatgaccatggacatgaacataggcactgcgaaggggacagccactcacatgctacaggtgagcttggctgccatgaacactctactgttgagcatgcttgcgagcatcagtgccatgctgagcagcaaactgtgcacactgcggaaacacaccactgccatgaccatgagcatggacagcacaagcatgaccatggggagattgaggagccagaaaaggactgccatgaccacagccaccactgctgccatgagcctcatgacaaggacaagactccagctgagccagttgaagaggtcacgatttcaattgctgcccttcccaaagatgaaggccaccaccacagcgaagaacacaagggggagcactgcgggaaggcgaaagactgcggtgttcctgctcccactgactgcgctgcgagcaagaactgctgcagcgtcaaaggtggagacacctgctcgagctcgcaggctgcgtgtgccaaggagaccagcccgtgctgcaggagctacgtgaagtgccccaagacgacggcgacggtgacgaggagcagctgctgcggccacagccacaccatgctgaagctgcctgagatcgtggtagagtagtagcctagtatggtgggaattccaccggggaagaagggtgtgcacatatgagcatgactcgccggcgtaagatagactaagatcggcggtgcagggtgtttgatctagtatattctagttactatatatacttactatatagatttgctaaagaaaaaaaaaagtaggattttgaccaagcaggggtctgaaagggagggctctgcttggttttcctgcactgcttctctgtttgcaacttctgtgtgacaactcttgagtattggtgctgcaatggagactgtcacaaacgaagaatataactggtgccggccagggccaacactaatattcagaaactatccatttagccccttttttaaatgagatattttgtttttc

SEQ ID NO: 5013 - DNA, 2145 bp, Setaria italica
tggaggaagaacatgcttgcatgtgtgtaggcgtgagtctgagcgttctttttaagaccccaacatggcaacatgtttctgcaggcgtattatgcggcgtttcaaacgttagtcctccgtaaatgctctgtaattttctgatatcctctgtatcactgtaaccttgtttgggtgagggtcaagtgttttgggagctgttcagaacttcagatcgagttgcaattcttattctgatactgtgatgaatttcgattttcgacgtttggcaacaaattcaggttagaaaattcgctcaaattacacatgaaactgaaagttctccagaactcaaactgaaagagcagtgtataaaacactgcgctttctgaatcaaaggaaaacaaggcaagcacaatcccagaaagctccaaagtagcgcgtgcgcacacatggatcccctttgcctgttggttctagatctagcgacacttgcacgcgggagatgctcgcaaacaccagctcatcgccactagcaacatgccaatatcataagcgtaatcgcaagctgcatccagattgcaggtttgcagccaccacctccaccagcagaccaacccgtagccaactcccaagctaaaggagctcgttccagaggtcactaaagctaacagcggtggttggcacgtcgcagttgatacggaggcgtaggctgcacttctcccacgtcgccgccggctcaggctccctgacgctggagatgggaacggggcgcgcgtccgtcgtcggcgcgctgctcgtggcgctcgccgtcctcgcgccggcggtgacggcgcagacctgcaacgacgagctgccgtcccagcttgtccgcaactactcggggctcgcctgcgcccccgtctggaacagcttcgtgctccggtacgcgcaggacaaggacaatgtgctgcgggtggtgctgtcgaccatgtacagcacggggtgggtggggatggggttctccaagaacggcctcatggtgggctcgagcgccatggttgggtggatgggcaagacgggggtcgcccacatcaagcagttctcgctgcagggcaagaccccctcgcaggtggtcgtggacaagggcatcctcgtctccaacgaccacgaccacaccgtgctcgtgcagcaggccaagatctacctcgccttccagctcaggttcaacgagccgctcaagcgccagaacgtcctcctagccttcggctccgccatccccgtcaacgaccgcctctccgagcaccaggacaagacctccatcaccttcgatttcaccacaggcagctcttcaagcgcgtcatccttcccggaaggtctgaaaaggactcacggggcgctcaacttgttcgcgtggggtgtgctcctgccaattggggccatcgtcgcaaggtactgcaggagatgggaccctctgtggttctacctccatgccggcatccagtttgtgggattcatcctgggtctggccggcattgtcgccggagtatcattgtacagcaagatccaagccaacgtcccggcgcacaggggcctcggcatatttgtgcttgtgctaggcatcttgcagattctagcgatcttcctgaggcccaacaaggactccaagtaccgcaaattctggaactggtaccaccactgggtaggccggctggcgctcttctttgctgcgatcaacattgtcctcgggatcaaggtcggcggcgccggcaactcgtggaagatcggctacggtttcaacctggccgtcctcctgatcaccatcatcactatggaagtcctgctgtggacgaggtggagaaacaatagcagttctacggcggcatattagggacgatcggttaggttcttgtgccgtggtaactgcaggaggttcatattctttagatatttttgcgtgctatgctgttgttgtagtgttcgtgcgtgctgcagggtcttttgcagcagctaagatctgccaaggctagtagccttatgatgaccttttggcgtgcaagactgcaaaatatcatgagacggtctgcgcctctgcggaacttgtatgtgttcaactgttcgtgcttgccgttccggtgcttttgggaattgggaatttgggattgctcaaaatggaatggtgctttgcgc

SEQ ID NO: 5014 - DNA, 2105 bp, Setaria italica
gtgagtctgagcgttctttttaagaccccaacatggcaacatgtttctgcaggcgtattatgcggcgtttcaaacgttagtcctccgtaaatgctctgtaattttctgatatcctctgtatcactgtaaccttgtttgggtgagggtcaagtgttttgggagctgttcagaacttcagatcgagttgcaattcttattctgatactgtgatgaatttcgattttcgacgtttggcaacaaattcaggttagaaaattcgctcaaattacacatgaaactgaaagttctccagaactcaaactgaaagagcagtgtataaaacactgcgctttctgaatcaaaggaaaacaaggcaagcacaatcccagaaagctccaaagtagcgcgtgcgcacacatggatcccctttgcctgttggttctagatctagcgacacttgcacgcgggagatgctcgcaaacaccagctcatcgccactagcaacatgccaatatcataagcgtaatcgcaagctgcatccagattgcaggtttgcagccaccacctccaccagcagaccaacccgtagccaactcccaagctaaaggagctcgttccagaggtcactaaagctaacagcggtggttggcacgtcgcagttgatacggaggcgtaggctgcacttctcccacgtcgccgccggctcaggctccctgacgctggagatgggaacggggcgcgcgtccgtcgtcggcgcgctgctcgtggcgctcgccgtcctcgcgccggcggtgacggcgcagacctgcaacgacgagctgccgtcccagcttgtccgcaactactcggggctcgcctgcgcccccgtctggaacagcttcgtgctccggtacgcgcaggacaaggacaatgtgctgcgggtggtgctgtcgaccatgtacagcacggggtgggtggggatggggttctccaagaacggcctcatggtgggctcgagcgccatggttgggtggatgggcaagacgggggtcgcccacatcaagcagttctcgctgcagggcaagaccccctcgcaggtggtcgtggacaagggcatcctcgtctccaacgaccacgaccacaccgtgctcgtgcagcaggccaagatctacctcgccttccagctcaggttcaacgagccgctcaagcgccagaacgtcctcctagccttcggctccgccatccccgtcaacgaccgcctctccgagcaccaggacaagacctccatcaccttcgatttcaccacaggcagctcttcaagcgcgtcatccttcccggaaggtctgaaaaggactcacggggcgctcaacttgttcgcgtggggtgtgctcctgccaattggggccatcgtcgcaaggtactgcaggagatgggaccctctgtggttctacctccatgccggcatccagtttgtgggattcatcctgggtctggccggcattgtcgccggagtatcattgtacagcaagatccaagccaacgtcccggcgcacaggggcctcggcatatttgtgcttgtgctaggcatcttgcagattctagcgatcttcctgaggcccaacaaggactccaagtaccgcaaattctggaactggtaccaccactgggtaggccggctggcgctcttctttgctgcgatcaacattgtcctcgggatcaaggtcggcggcgccggcaactcgtggaagatcggctacggtttcaacctggccgtcctcctgatcaccatcatcactatggaagtcctgctgtggacgaggtggagaaacaatagcagttctacggcggcatattagggacgatcggttaggttcttgtgccgtggtaactgcaggaggttcatattctttagatatttttgcgtgctatgctgttgttgtagtgttcgtgcgtgctgcagggtcttttgcagcagctaagatctgccaaggctagtagccttatgatgaccttttggcgtgcaagactgcaaaatatcatgagacggtctgcgcctctgcggaacttgtatgtgttcaactgttcgtgcttgccgttccggtgcttttgggaattgggaatttgggattgctcaaaatggaatggtg

SEQ ID NO: 5015 - DNA, 1392 bp, Saccharum officinarum
acgacacgacacgacacgagcgagactgcagccgcggcctctccgatccgtttcctcctccctcgccatcgactcgatcaatcattgtcgtctccaccatctccgatcctccctacctagtctagtccagtccagtctgcctgctgctgcccgcctcaacggatcgacgcgacaggagggaggaagaaggggacgatcggagtctgggagacggaggaggccggtgacgggcagatccaccgcagcgacgagcgggaggagatgaagctcatcatcgacacggatcccggcatcgatgacagcgtggcaatcatgatggcattccagttgccgggcgtgcaagtcctagggctcaccaccattttcggcaactgcacgacggagcacgccacacgcaacgccttgatcctgtgcgagaaggcaggccatcctgaggttccagtagcagagggcagccatgagcctctcaagggaggaaagccggatgttgccgactttgttcatggatctgagggcctcgggaatatagggcttcccgatcccactatcaaaaaagttgaggaaagtgctgctgagttcttggtggataaagtctcgcagtttcctggagaggtctctgtgcttgccttgggtcctctgacaaacgtagcattggccatcaagaaggatccatcctttgtgaaaaatgttaagaagattgttgtgttgggtggagcatttttttcagctggaaatgccaccccttcggctgaagcaaatatccaccacgacccagaggcagccgatatagttttcacttctggggcaaacatctacgtggttggcctcaacatcacaacgcaagtcagctttacagataaggatctcctggagctaagaaactcaaaagggaagcacgcacagttcttatgcgacgtatgcaatttctacttggactggcacatcaagtcttatggtgctccggtgattttcctccatgatccggtgagctttgccgcgctagttcgtccagagctattcaccttcaagaagggcgtggtgagggtggagactcaaggcatctgcgtcgggcatacttccatggacatgttactgaagaagtggaattcagagaacccgtggactggctactcacctatttcggtcgcatggacggtcgatgtgcccaaggtggtcgcgtttgtgaaggagctcgtcatcaaacagtgaacgaaattaactaacatgttatgagcactgcattctcgcacaccagatgtgcaccaaatttgagatgtagatatttattcacatttgacgcactgcaaacactattatgtcaatcattggttcctttggaggacttcagatcagtttgagttgttttaaattgaagcatatgtgtctttggcc

SEQ ID NO: 5016 - DNA, 1453 bp, Sorghum bicolor
cacacgacgagagagtatatagcacaattcatgtgcctgggcagttggccttgcttacttgtcgatcgagtgagactactgcagccgccgccgccgccacctcctctccgatccgtttcctcctcctccctcgaaatcgattcgatcgatcaatcaatcaatcattgtcgtctgcaccatctccaatcccctaccttgctagatagtctagtcaggccgcctgctgcctgcctcaaacggatcgacgggactggagggaggaagaagacgacgatcggagtcttggagatggagggcggcaacgggcagatcgaccgcagcgacgagcgggaggagatgaagctcatcatcgacacagatcccggcatcgatgacagcgtggcgatcatgatggctttccagttgccgggagtgcaagtcctagggctcaccaccattttcggcaactgcaccacggagcacgccacacgcaacgccttgatcctgtgcgagaaggcaggccatcctgaggttccagtagcagagggcagccatgagcctctcaagggaggaaagccgcatgttgccgactttgttcatggatctgatggcctcgggaacatagttcttcctgatcccactatcaagaaagttgaggaaagcgctgctgacttcttggttgataaggtctcgcaatttcctggagaggtctctgtgcttgccttgggtcctctgacaaacatagcattggccatcaagaaggatccctcctttgtgaaaaatgttaagaagattgttgtgctgggtggagcattctttgcagctggaaatgccaccccttctgctgaagcaaatatccacagcgacccggaggcagccgatatagttttcacttctggggcagacatctatgtcgttggcctcaacatcacaacgcaagttagcttcacagataaggatctcctggagctaagaaactcaaaagggaagcacgcgcaattcctatgtgatgtatgcaagttctacttggactggcacatcaagtcttatggtgctcctgtgattttcctacatgatccggtgagctttgccgcgctggtttgtccggagatgttcacgttcaagaagggtgtggtgagggtggagacacagggcatctgcgtcgggcatacttccatggacatgttgctgaagaagtggaattcagagaacccatggactggctactcgccgatttcggtcgcatggacggtcgatgtgcccaaagtggtcgcatttgtgaaggagctcgtcatcaaacagtgaacggaattaactaacatgttatgagcactgcgttctcgcacaccagatgtgcaccaaatttgagatgtagatatttattcacatttgacgcactgcaaacactattatgtcaatcattggttcctttggaggacttcaaatcaatttgagattttttaaattgcagcat

SEQ ID NO: 5017 - DNA, 1288 bp, Echinochloa colona
aagaagcggagacgcagctagcagtctagcaccagaggaagaggaggaggaaggcgatcggaagaggagggagcgatcggaggcttggagcccgagatggcggccggcaacgggcagatccaccaccacaacgagacggagaagctcatcatcgacacggatcccggcatcgatgatagtgtggcaattatgatggcgtttcaatcgccgggcgtgcaagtcctagggctcaccaccatttttggcaactgcaccacggagcacgccacacacaatgccttgatcctgtgcgagaaggcaggccatcctgaggttccagtagcagagggcagccatgagcctctaaagggaggaaagccacatgttgccgactttgttcacggatctgatggcctcgggaacatagagcttcctaatcccactatcaagaaagtcgagcaaagcgccgctgagttcttggttgataaggtctcgcagtttcctggagaggtctctgtactcgccttgggccctctgacaaacatagcattggccatcaagaaggatccctcctttgtgaaaaatgtcaagaagattgttgtgctgggtggagccttctttgcagctggcaatgccacaccttctgctgaagcaaacatccacagtgaccctgaggcagccgacatagttttcacttctggagcagacatctacgtggttggactcaacatcacaacccaagtcagcttcacagataaggatctcctggaggtaaggaactcgaaagggaagcacgcgcagttcctatgcgacgtatgcaagttctacttggactggcacatcaagtcttacggtgctcctgtgattttcctccatgacccggtgagcttcgccgctcttgttcgtccggacctcttcactttcaagaagggcgtggtaagggtggagacccagggcatctgcaaggggcatacctccatggacatgttgctgaagaagtggaattcggagaacccgtggactggctactcgccgatctcggttgcgtggacggtcgacgtgcccaagatggtggcgtttgtgaaggagctcgtcaccaaagagtgacgaaactattagctgacatgagttgctgtaccgtatcgatccgagcattgcattgttgccctattggcgatttggcgccctgatgtgcaccaaaattgagatgctgagatgatgtatcctcatctaacgtactggaaacgctatttccagagtcattgattctatgtctctggactgcaaatcaatttcagatgtctctaac

SEQ ID NO: 5018 - DNA, 1373 bp, Panicum virgatum
catgctctgattccagatgacagcatagcaattatgatggcatttcagtcgccgggcgtgcaagtgctagggctcaccaccattttcggcaactgcacaacggagcacgccacacgcaatgccttgatcctgtgcgagaaggcaggccatcctgaggttccagtagcagagggcagccatgagcctctaaagggaggaaagccgcgtgttgccgactttgttcacggatctgacggccttggggagatagagcttcctgatcccactatcaagaaagttgaccaaagcgctgctgagttcttggttgataaggtttcgcagtttccgggagaggtctccatactcgccttgggccctctgacgaacgtagcattggctatcaagaaggatccctcctttgtgaaaaacgtgaaaaagattgttgtgctgggtggagccttctttgctgctggaaatgccacaccttctgctgaagcaaatatccacagtgacccggaggcagccgatatagttttcacttctggggcaaaaatctacgtggttggcctcaacatcacaacacaagtcagcttcacagataaggatctcctggagctgaggaactcgaaagggaagcacgcgcagttcctatgcgacgtgtgcaagttctacctggactggcacatcaagtcttacggcgcccctgtgattttcctccatgatcctgtgagcttcgcggcgctggttcgcccggatctgttcacgttcaggaagggcgtggtgagggtggagacccagggcatctgcgccgggcatacctccatggacatgttgctgaagaagtggaattcggagaacccgtggactggctactcgccgatctcggtcgcgtggacggttgacgtgcccaagatggtcgcgtttgtgaaggagctcgtcaccagagagtgacgaaatcagctgggttaacgtgagttgtttgtaccgtgacaatccgagcgttgcgctgtctgcgccctgtcgcccctgatgcgcaccaaatttgcgatgcatcaacatttgacgtactgcaaaggctattctcagaatcatcgagtccatacctccggactgcaaatcaatttgggactgagtcaaggtctttatttcaactcgatgtaatgatcttgggttcacaaagctttcctttatcggaaaaaaaaaatcagtttcagatgtctcgtgcatgcgcccaaattggcaacatggttggacgtctgttagatagagcatctacagcaactccctttccaccgtataccgacagtattggggagaatatactctagcggtttcccaaaactttttccttttctccaataattattgagttgtcctaatatttcacccccaac

SEQ ID NO: 5019 - DNA, 1419 bp, Setaria italica
gcaaccgcctctccctcccctaccctcccctcctcgccatcggtcaccgtctccgccacctccccgcctgcctataataagaagaaggggcggagacgacaactagcaccgaggaggaagaaagcgatcgaaggaggggacagagcggtcgatcggagtacgagatggaggccagcaacgggcagatccaccaccacgacgagcagccgagggcggagcagaagatcatcatcgacacggatccaggcatcgatgacagcgtggcgattatgatggcgttccagtcgccgggcgttcaagtcctagggctcaccaccatttttggcaactgcacaacggagcacgcgacacgcaacgccttgatcctgtgcgagaaggcaggccatcctgaagttccagtagcagaaggaagccatgagcctctaaagggaggaaaaccaaaagttgccgcctttgttcacggatctgatggccttgggaacatagagcttcctgatcccactatcaagaaagttgagcaaagcgctgcagagttcttggttgataaggtctcgcagtttcctggagaggtctctgtacttgccttgggtcctctgacgaacttagcattggccatcaagaaggatccctcctttgtgaaaaatgttagaaagattgttgtgctgggtggagccttcttttcagctggaaatgccaccccttctgctgaagcaaatatccacagtgacccggaggcagctgatatagttttcacttctggggcagacatctacgtggtcggcctcaacatcacaacccaagtcagcttcacagataaggacctcttggagctgaggaactcgaaagggaagcacgcgcagttcctctgcgacgtatgcaagttctacctggactggcacatcgagtcttacggcgctcctgtgattttcctccatgacccggtgagctttgccgcgctggttcgcccggacctgttcacgttcaggaagggcgtggtgagggtggagacccagggcatctgcgccgggcatacctccatggacatgttgctgaagaagtggaactcggagaacccgtggactggctactcgccgatctcggtggcgtggacggtggacgtgcccaagatggtcgcgttcgtgaaggagctcgtcaccggagagtgacgaaactagctgacatgagtcgtcgtaccatgtcagatccgagcattcaattccgcattgcgttgtcgctgcgcacaaaactgagatgcagaaatatttgacgtactgcaaacgctatttccagagtcattggttctggttctgcaaaccaattctctcattcatgcaccctaattgtatatgctttatgccgtcagatgaccgggatcagcttcagcaggtgtatatgcttggcatgcatcccatcacgcca

SEQ ID NO: 5020 - DNA, 1834 bp, Setaria italica
gatctgttcatcgagggtgtcctcctcctctgctttgctcctgcttacttgtcgagactgcaaccgcctctccctcccctaccctcccctcctcgccatcggtcaccgtctccgccacctccccgcctgcctataataagaagaaggggcggagacgacaactagcaccgaggaggaagaaagcgatcgaaggaggggagagagcggtcgatcggagtacgagatggaggccagcaacgggcagatccaccaccacgacgagcagccgagggcggagcagaagatcatcatcgacacggatccaggcatcgatgacagcgtggcgattatgatggcgttccagtcgccgggcgttcaagtcctagggctcaccaccatttttggcaactgcacaacggagcacgcgacacgcaacgccttgatcctgtgcgagaaggcaggccatcctgaagttccagtagcagaaggaagccatgagcctctaaagggaggaaaaccaaaagttgccgcctttgttcacggatctgatggccttgggaacatagagcttcctgatcccactatcaagaaagttgagcaaagcgctgcagagttcttggttgataaggtctcgcagtttcctggagaggtctctgtacttgccttgggtcctctgacgaacttagcattggccatcaagaaggatccctcctttgtgaaaaatgttagaaagattgttgtgctgggtggagccttcttttcagctggaaatgccaccccttctgctgaagcaaatatccacagtgacccggaggcagctgatatagttttcacttctggggcagacatctacgtggtcggcctcaacatcacaacccaagtcagcttcacagataaggacctcttggagctgaggaactcgaaagggaagcacgcgcagttcctctgcgacgtatgcaagttctacctggactggcacatcgagtcttacggcgctcctgtgattttcctccatgacccggtgagctttgccgcgctggttcgcccggacctgttcacgttcaggaagggcgtggtgagggtggagacccagggcatctgcgccgggcatacctccatggacatgttgctgaagaagtggaactcggagaacccgtggactggctactcgccgatctcggtggcgtggacggtggacgtgcccaagatggtcgcgttcgtgaaggagctcgtcaccggagagtgacgaaactagctgacatgagtcgtcgtaccatgtcagatccgagcattcaattccgcattgcgttgtcgctgcgcacaaaactgagatgcagaaatatttgacgtactgcaaacgctatttccagagtcattggttctggttctgcaaaccaattctctcattcatgcaccctaattgtatatgctttatgccgtcagatgaccgggatcagcttcagcaggtgtatatgcttggcatgcatcccatcacgccaaagattctgccaaccctgtttattttactacacactagcagtaagcaactaataaaaatcgtgtgatcgatcgaggaggatgcagcggcagagcctggaagcttgatttccttggcttttgcagcgggggagtatatttgcctgccaatttgggcacgcctgcctgcctgctgctgcactggtcaatcagacattcagaccaaccaccacgctgcttaactgtacttttttcgctttttcattaagagggtagaagaaaaaatacaagagctagcagtgtcatccggaggtgatgacagcaggctgcttaactgtactgctactgctactcttgttaagcactggtcacatgcaat

SEQ ID NO: 5021 - DNA, 913 bp, Panicum virgatum
gattccagatgacagcatagcaattatgatggcatttcagtcgccaggcgtgcaagtgctagggctcaccaccattttcggcaattgcacaacggagcacgccacacgcaatgccttgatcctgtgcgagaaggcaggccatcctgaggttccagtagcagagggcagccatgagcctctaaagggaggaaagccgtgtgttgccgactttgttcacggatctgacggccttggggagatagagcttcctgatcccactatcaagaaagttgaccaaagcgctgctgaatccttggttgataaggtcttacagtttcctggagaggtctccatactcgccttgggccctctgacgaacgtagcattggctatcaagaaggatccctcctttgtgaaaaacgttaaaaagattgttgtgctgggtggggccttctttgcagctggaaatgccaccccttctgctgaagcaaatatccacagtgacccggaggcagcggatatagttttcacttctggggctgaaatctacgtggttggcctcaacatcacaacgcaagtcagcttcacagacaaggatctcctggagctgaggaactcgaaagggaagcacgcgcagttcctatgcgacgtgtgcaagttctacctggactggcacatcaagtcttacggcgcccctgtaattttcctccatgaccccgtgagcttcgcggcgctggttcgcccggacctgttcacgttcaggaagggcgtggtgagggtggagacccagggcatctgcgccgggcatacctccatggacttgttgctgaagaagtggaattcggagaacccgtggactggccactcgccgatctcggtcgcgtggacggtcgacgtgcccaagatggtcgcgtttgtgaaggagctcgtcacc

SEQ ID NO: 5022 - DNA, 1337 bp, Cenchrus ciliaris
ctcctctctccctcctcgccatggatcacaaccatcaccatctccgccacctccccgcctgcctgctataagaagaagcggagtagcaccgaggaggaagaaggcgaccaaaggagaggagagagcgatcggggttagagatggaggccagcaacgggcagatccaccacggcggcgagcagcagagggcggaggagaagatcatcatcgacaccgatcccggcatcgatgacagcatggcaattatgatggccttccagtcgccgggtttgcaagtcctagggctcaccaccatttttggcaactgcaccacggagcacgccacacgcaatgccttgatcctgtgcgagaaggcaggccatcctgaggttccagtagcagagggcagccatgagccccttaagggaggaaagccaaatgttgccgactttgttcatggatctgatggccttgggaacatagagcttcctgatcccactatcaagaaagttgaccaaagtgctgctgagttcttggttgataaggtctcacagtttcctggagaggtctccgtacttgccttgggtcctcggacgaacgtagcattggccatcaagaaggatccctcttttgtgaaaaatgttaagaagattgttgtgctgggtggagccttcttttcatctggaaatgccaccccttctgctgaagcaaatatccacaatgacccagaggcagctgacatagttttcacttctggggcagacatctacgtggtcggcctcaacatcacaacgcaagtcagcttcacagataaggacctcctggagctgaggaactcgaaagggaagcacgcgcagttcctctgcaacgtatgcaagttctacctggactggcacatcaagtcttacggcgctcctgtgattttcctccatgacccggtgagcttcgccgcgctggttcgcccggatctgttcacgttcaggaagggcgtggtgagggtggagacccagggcatctgcgccgggcatacctccatggacatgttgctgaagaagtggaactcggagaacccatggactggctactcgccgatctcggtggcgtggacggtggacgtgcccaagatggtcgcgttcgtgaaggagctcgtcaccagagagtgacgaaactagctggcatgagtcgtcgtgcccgtactataccatgccgatctcccaggattcagttccgcattgcgttgcgttgtcgctgcgccctgatttgagacatgtactcacatttgacgtactgcaaagtgcaaacactattttcagagctagtcattggttctgcaaaaccaatttcagaaaaaactgaga

SEQ ID NO: 5023 - DNA, 1443 bp, Pennisetum glaucum
ccgccaccgccaccgccaccaaccaactcgtccgttcatcgaggggggtcctcctctgccttgcttctgcttacttgtccagactgcaactgcaaccgcctctcgctcctcgccatcgatcacaaccatcacgcgccgccacctccccgcctgcctataagtcggagaagcggcgaagccagtagcaccgacgaggaagaaggcgatcaatcaaggggggaagagagcgaccggggtcagaaatggaggccagcaatgggcagatccacaacagcgacgagcagccgagggcggaggagaagatcatcatcgacacggaccccggcatcgatgacagcgtggcgattatgatggccttccagtcgccgggtttgcaagtcctaggactcaccaccatttttggcaactgcaccacggagcatgccacacgcaacgccttgatcctgtgcgagaaggcaggccatcctgaggttccagtagcagagggcagccatgagcctctcaagggaggaaagccaaatgttgccgactttgttcatggatctgatggcctcgggaacatagagcttcctgaacctactattaagaaagtggaccaaagtgctgctgagttcttggttgataaggtctcacagtttcctggagaggtctctgtactcgccttgggtcctctgacgaacgtagcattggccatcaagaaggatccttcttttgtgaaaaatattaagaagattgttgtgctgggtggagccttcttttcagctggaaatgccaccccttctgctgaagcaaatatccacagtgacccggatgcagctgatatagttttcacttctggggcagacatctacgtggtgggcctcaacatcacaacgcaagtcagcttcacagataaggacctcctggagctgaggaactcgaagggaaagcacgcgcagttcctctgcgacgtatgcaagttctacctggactggcacatcaagtcttacggcgctcctgtggttttcctccatgatccggtgagcttcgccgcactggttcgcccggatctgttcacgttcaggaagggcgtggtgagggtggagacccagggcatctgcgcgggccatacctccatggacatgttgctgaagaagtggaactcggagaacccgtggactggccactcgccgatctcggtggcgtggacggtggacgtgcccaagatggtcgcgttcgtgaaggagctcgtcaccagagagtgacgaaactagctggcatgagtcgtcgtcgtgcccgtactataccatgctgatccccggattcgattccgcatcgcgttgcgttgtcactgggccctgatttgagagatgtactcacatttgacgtactgcaaagtgcaaacactatttccagagctagccattggttctgcaaaaccaatttcagatgtctctcattcat

SEQ ID NO: 5024 - DNA, 1241 bp, Secale cereale
agagaagacagagtgaccgacgcagggaaggttccaccacccaccgagcgatcgatcgaccgggcgggcatccattcgatggcggcgaacgggcaccagatccggccgtcggaggagacgatgaagctcatcatcgacaccgaccccggcatagacgacagcgtggcgatcatgatggcgttccaggcgccgggcgtcgaggtcctggggctcaccaccatcttcggcaactgcaccaccgcctacgccacccgcaacgccctgattctgtgtgagaaggctggccgtcccgacgtgccggtggcggagggcagcgcagagcctctcaagggtgggaagccgcaggttgccgattttgttcacggatccgatggcctagggaacgtacaagttcctgaaccgaccaccaagaaagcagagcaaaccgccgcggagtttctggtcgacaaggtgtcgcagttccccggggaggtctcggtgctcgccttgggccctctgaccaacatcgcattggccatcaagatggatccctccttcgtgaccaaggtgaagaagatagtggtgctgggcggagccttcttcgcagcagggaacgccacgccttcagccgaagcaaacatccatagcgacccggaggcggcggacatggtgttcacgtcgggcgcggacatcgcggtggtgggtctcaacatcactacccaggtgagcttcacggaggcggacttgtcggagctgaggaggtccgggggcaagcaggcgcagttcctctgcgacatctgcaagttttacagcgactggcacctccactcgtacggcgaccccgccgtgttcctccacgacccggtgagcctcgcggcgctggtccggccggagctcttcaccttcaggaaggcgtggtgcgggtggagacccagggcatctgcagaggccacacctccatggacatggggctcaagaagttcaagtcggagaacgcgtggtcgggtacacgccgatctcggtggcgtggacggtggacaaggccaaggtggtcgccttcgtcaaggagctcctcacaaattaatcaggagttcatatctggtcatcaaatgatttgaaattgtagagatccgtgagtcggtcgattgactcgtgatttgtgtgtaccccattcgacgcacttcatgcagacgcattgtctcgtggaattattgaactactcgtcgtgaattgtctattcttcaagatgcttcgaaccggaa

SEQ ID NO: 5025 - DNA, 1466 bp, Secale cereale
catgtgacgaacgaagatcgatctctacttgttgtcactagcccaaactgggaaaactctctgcccagccaggacaaacacgagaacggactcccaagaagagaagacggagtggctggctggctgacggaaggttccacccaccgagtgatcgaccgggcgggcggggatcgattcaatggcggcgaacgggcaccagatccggccgtcggaggagacgatgaagctcatcatcgacaccgaccccggcatagacgacagtgtggccatcatgatggcgttccaagcgccgggtgtggaggtcctaggcctcaccactatcttcggcaactgcaccaccgcctacgccacccgcaacgccctgattctgtgtgagaaggctggccgtcccgacgtgccggtggccgagggcagcgccgagcctctcaagggaggaaagccgcaggttgccgactttgttcacggatccgatggcctcgggaacgtatcagttcctgaacctaccaccaagaaagcagagcaaaccgccgcggggtttctggtcgacaaggtgtcgcagttccccggggaggtctccgtgctcgccttgggccctctgaccaacatcgcactggccatcaagatggacccctccttcgtgaccaaggtgaagaagatagtggtgctgggcggagccttcttcgcagcaggaaacgccacgccttcagccgaagcaaacatccacagcgacccggaggcggcggacatggtgttcacgtcgggggcggacatcgcggtggtcggcctcaacatcaccacccaggtgagcttcacggaggcggacctgtcggagctgaggagcaccgggggcaagcaggcgcagttcctctgcgacatctgcaagttctacagcgactggcacctccactcgtacggcgaccccgccgtgttcctgcacgacccggtgagcctcgccgcgctggtccggccggagctcttcaccttcaggaagggcgtggtgcgggtggagacccagggcatctgcagaggccacacctccatggacatggggctcaagaagttcaagtcggagaacgcgtggtcgggatacacgccgatctcggtggcgtggacggtggacaaggccaaggtggtcgccttcgtcaaggagctcctcaaaaattaatcgggagttcatgatctgtatatctggtcatcaaatgatttgaaattgtagagatccgtcggtggatcgatagactcgtgatttgtgtgtaccccattcgacgcacttcatgcagacgcattgtctcgtgcaattattgaactactcgtcgtgaattgtctatttcttcaagatgcttccaaccggatctgcaagaatattctggcctgtctcgtgctcgtagtgtgattacaccacaccacatttctggtcttgtagcatgatcttcagggcagtatataccagaatggccaagcgtacg

SEQ ID NO: 5026 - DNA, 1462 bp, Triticum aestivum
tcggcacgaggcaaacagagaggacggacggaagaagtaagttccaggcagaggagacagagtgaccgacggagggaaggttccacctacccaccgagcgatcgaccgggcgggcggcgatccatggcggcgaacgggcatcagatccagccggcggaggaggcgatgaagctcatcatcgacaccgatcccggcatagacgacagcgtggcgatcatgatggcgttccaagcgccgggcgtggaggtcctagggctcaccaccatcttcggcaactgcaccaccgcatacgccacccgcaacgccttgatactgtgtgagaaggcaggccgtcccgacgtgccggtggcggagggcagcgccgagcctctcaagggagggaagccgcaagttgcagactttgttcacggatccgatggcctcgggaacgtatcagttcctgaacccaccaccaagaaagcagagcaaactgcggcggagtttctggtcgacaaggtgtcgcagttccccggggaggtctcggtgctcgccttgggccctctgaccaacctcgcattggccatcaagatggacccctcctttgtgaccaaggtgaagaagatagtggtgctgggcggagccttcttcgcagcagggaatgccaccccttcagccgaagcaaacatccacagcgacccggaggcggcggacatggtgttcacgtcgggcgcggacatcgcggtggtcggcctcaacatcaccacccaggtgagcttcacggaggcggacctgtcggagctgaggaggtccgggggcaagcaggcgcagttcctctgcgacatctgcaagttctacagcgactggcacctccactcgtacggcgaccccgccgtgttcctgcacgacccggtgagcctcgcggcgctggtccggccggagctcttcacgttcaggaagggcgtggtgcgggtggagacccagggcatctgcagaggccacacctccatggacatggggctcaagaagttcaagtcggagaacgcgtggtcgggctacacgcccatctcggtggcgtggacggtggacaaggccaaggtggtcgccttcgtcaaggagctcctcaaaaattaatcaggagttcatgatctgtatatctggtcatcaaatgatttgaaattgtagagatccgtcggtcgatcgacccgtaatttatgtgtaccccattctgacgcacttcatgcagacacattgtctcgtggaattattgaactgctcgtcgtgaattgtcatgatcgaactcactaccgaataactggatatcgcgaaattttctatgccgacagctttttgtcgggccgtcggcataggtagaaatgctgtcggcaaacctccaactgttacgacggctatctggcctataccgacggccagaggcgtaactgcaaattctagtagtgactgcaattggttctcaatattgcga

SEQ ID NO: 5027 - DNA, 1350 bp, Cynodon dactylon
caccaccaagcagtctctccggcctagttgttggcttcaactctcattcccccatcggatcggagccggaggaagaagaggataccagtattatggcggaggtgaacggggggcagatccaccagaatcacccggtggagaaggagaaggtcatcatcgacacggatcccggcatcgatgacagcgttgcaatcatgatggcgttccagtcacctggcgtccaagtgctaggcctgaccaccatcttcggcaactgcacaaccgagcgagctacccgcaacgccttgattctgtgtgagaaggcaggccaccctgaggttccagtagcagagggcagccctgaacctctcaagggtggaaagccgcatgttgctgactttgttcacggatccgatggcctcgggaacatagacctttctgatcccactagcaacaagatcgaccaaagcgctgccgagttcttggttgataaggtttcagagtttcctggggaggtctctgtgctcgccttgggccctctgacgaacgtagcattggccatcaagaaggattcctcttttgtgagcaaggttaagaagatagttgtgcttggtggatcattctttgcagctggcaatgccaccccatcagctgaagcaaatatccacagcgacccagaagcagctgatatagttttcacctctggggcagacatttacgtccttggccttaacatcacactgcaagtcagttttacagatgaggatctcttggagctaagaaactcgaaagggaagcatgcccagttcctgtctgatgtatgcaagttctacagagactggcatgtcaagtcttacggcgcccctgtgtttttccttcatgatccggtgtgcttcgctgctctggttcatccggagttcttcacgttcaagaagggcgtggtcagggtggagacacagggcatctgcaccgggcatacttccatggacctaggactgaagaagtggaactcagagaacccgtggactggctattcgcctatttcggtcgcgtggacggtcgatgtgcccaaggtagttgcgtttgtcaaggagctagtcactaaacagtgaccaagttgacatgaagaggtgtatcaatgtttggattcttgaagatgtagagatttattgtattcgacgcactgcaattattgatccttacgaactgaaaatcttcaaatttcaaatgttcgtgtcttaaagatgagcataattatgtgctgaatctatgtttgtgactgatgcgtagagtgatgttgcctaacttgtgttgtagttgtaataaagggaaaatatcaattcaaaaggaaaatacatctggttttgattg

SEQ ID NO: 5028 - DNA, 1527 bp, Hordeum vulgare
cggtgctgatccagtcagcagcatgtgagaagaatagaagatccatctcttcttgttatccttgcccaaacacggaaaactctgcctaacctgcaggacaagaaacaaagaacggaaggaaggaaggaagaagttccaggaaaggagggaagagaagacggagagtgaccgagggacagaggctctatccactcgagcgatcgaccgggcggggatcgatggcggccaacgggcgtcagatccggccggcggagaagagggagacgatgaagctcatcatcgacaccgatcccggcatagacgacagcgtggcgatcatgatggcgttccgagcgcccggcgtcgaggtcctagggctcaccaccatcttcggcaactgcaccaccgcatacgccacccgcaacgcgttgattctgtgtgagaaggcaggccgtcccgatgtgccggtggcggagggcagcgccgagcctctcaagggagggaagccgcaggttgccgactttgttcacggatccgatggcctcgggaacatatctgttcctgaacccaccatcaagaaagcagagcaaaccgccacggaatttctggtcgacaaggtgtcgcagttccccggggaggtctcggtgctcgccttgggccctctgaccaacctcgcattggccatgaagatggacccctcctttgtgaccaaggtgaagaagatagtcgtgctgggtggagccttcttcgcagcggggaatgccaccccttcagctgaagcaaacatccacagcgacccggaggcggcggacatcgtgttcacctccggcgcggatatcgccgtggtcggcctcaacatcaccacccaggtgagcttcacggaggcggacctgtcggagctgaggagctccggcgggaagcaggcgcagttcctctgcgacatctgcaagttctacagcgactggcacctccactcgtacggtgaccccgccgtgttcctccacgacccggtgagcttcgcggcgctggtccggccggagctcttcacgttcaggaagggcgtggtgcgggtggagacccagggcatctgcagaggccacacatccatggacatggggctcaagaagttcaattcagagaacgcgtggtcgggctacacgccgatctcggtggcttggacggttgatacggccaaggtggtcgccttggtcaaggagctcctcagcaattaagcagcagcctagttgatgatccgtatacctgcgcatcaaatggtttgaaattgtactaatattgtatagatcgatgggccgatccactcatgatttatgtgtaccccattcgacgcactgcatgcagacacattgtctggtggcattattgaactgctggtaatgaattgtgatgatcaaactgcaattggttcttcacttcttctccggtacaatcattttaaacacatcaacggagaagatctcttcatacatttttataagagagtggattttcagcacctggatgcctaggcaccctctatgaacagtaaaa

SEQ ID NO: 5029 - DNA, 1102 bp, Leymus cinereus x Leymus triticoides
ggcgaacgggaatcagatccagccggcggagaagacgatgaaggtcatcatcgacaccgatcccggcatagacgacagcgtggcgatcatgatggcgttccaagcgccgggcgtggaggtcctagggctcaccaccatcttcggcaactgcaccaccgcctacgccacccgcaacgccttgatactgtgtgagaaggcaggccgtcccgacgtgccggtggcggagggcagtgccgagcctctcaagggagggaagccacaagttgctgactttgttcacggatccgatggcctagggaacatatctgttcctgaacctaccaccaagaaagcagagcaaaccgccacggagtttctggtcgataaggtgtcgcagttccctggggagatctccgtgctcgccttaggccctctgaccaacctcgcattggccatcaagatggacccctccttcgtgaccaaggtgaagaagatagtcgtgctgggcggagccttcttcgcagcaggaaatgccaccccttcagccgaagcaaacatccacagcgacccggaggcggcggacatcgtcttcacgtccggcgcggacatcgacgtggtcggcctcaacatcaccacacaggtgagcttcacggaggcggacctgtcggagctgaggagctccggggggaagcagacgcagttcctctgcgacatctgcaagttctacagcgactggcacctccactcctacggcgaccccgccgtgttccttcacgacccggtgagcttcgcggcgctggtccggccggagctcttcacgttcaggaagggcgtggtgagggtggagacccagggcatctgcaggggccacacctccatggacatggggctcaagaagttcaagtcggagaacgcgtggtcgggctacacgccgatctcggtggcgtggacggttgataaggccaaggtggttgccttcgtcaaggagctcctcaccaattaagcagcagttcatgatccgtatatctgcgcatcaaatgatttgaaattgtagagattggtgggtcgatcgactcatgatttatgtgtaccccattcgacgcactgcatgcagacacattgt

SEQ ID NO: 5030 - DNA, 1263 bp, Lolium multiflorum
acatcacacgctgacgctgagcacgagcagattctccctccagtttacttgcccgaacaaactctctgtctaggacagaggaagaagaacgacttccaggggccgggaggatcaaccgaggaagaagatagagagggaggtttagatcgccgatcgatggggcagcgatcgatggaggcgaacgggcatcagatccagcccacggcggcggagaaggagaaggtcattatcgacaccgatccgggcatagacgacagcgtggcgatcatgatggcgttccaggcaccaggcgttgaggtcataggtctcaccaccatcttcggcaactgcaccactgcctacgccacccgcaacgccttgatactgtgtgagaaggcaggacgttctgacgtgccggtagcagagggcagcgctgagcctctcaagggagggaagccgcaagtcgcagactttgttcacgggtctgacggccttggtaacatacctgttcctgatcccaccaccaagaaagcagagcagactgccgcggagttcttggtcgataaggtgtcgcggttccccggagaggtctcagtgctcgcgttgggccctctcacgaatgttgccttggccatcaagatggacccctccttcgtgagcaaggtgaagaagatcgttgtattaggtggagctttcttcgccgcagggaatgccaccccttcagccgaagcaaatatccacagcgacccggaagcggcggacatcgtgttcacctccggggccgacatcgtcgtggtcggcctcaacatcaccacccaggtgagcttcactgtggatgatcttgcagagctgaggaactctaaggggaagcacgcgcagttcctgtgcgacatctgcaagttctacagcgactggcacttcaagtcgtacggcgacccggccgtgttcctgcacgacccggtgagcttcgcggcgctgatgcggccggagctgttcacgttccggaagggcgtggtgcgggtggagactcagggcatctgccgggggcacacctccatggacatgggcctcaagaagtttaacacggagaacgcgtggtcggggtacacgcccatctcggtggcctggacggtcgacaaggccaaggtcgtctccttcgtcaaggacctcctcacagtctaaacagcaatgaccaaatgatctcagcactgatctgatttgctgatatttgcaaactcagatgattcgaaatgtaaaaactgatcgatccatatgtactctatt

SEQ ID NO: 5031 - DNA, 1316 bp, Secale cereale
gactgtgacgaagatcgatctctacttgttgtcactagcccaaactgggaaaactctctgcccagccaggacaaacacgagaacggactcccaagaagagaagacggagtggctggctggctcacggaaggttccacccaccgagtgatcgaccgggcgggcggggatcgattcaatggcggcgaacgggcaccagatccggccgtcggaggagacgatgaagctcatcatcgacaccgaccccggcatagacgacagtgtggccatcatgatggcgttccaagcgccgggtgtggaggtcctaggcctcaccactatcttcggcaactgcaccaccgcctacgccacccgcaacgccctgattctgtgtgagaaggcaggccgccccgacgtgccggtggcggagggcagcgccgagcctctcaagggaggaaagccgcaggttgccgactttgttcacggatccgatggcctcgggaacgtatcagttcctgaacctaccaccaagaaagcagagcaaaccgccgcggggtttctggtcgacaaggtgtcgcagttccccggggaggtctccgtgctcgccttgggccctctgaccaacatcgcactggccatcaagatggacccctccttcgtgaccaaggtgaagaagatagtggtgctgggcggagccttcttcgcagaagggaacgccaccccttcagccgaagcaaacatccacagtgacccggaggcggcggacattgtgttcacgtcgggcgcggacatcgcggttgtcggcctcaacatcaccacccaggtgagcttcacggaggccgacctgtcgaagctgaggagctccggcgggaagcaggcgcagttcctctgcgacatctgcaagttctacagcgactggcacctccactcgtacggcgaccccgccgtgttcctgcacgacccggtgagcctcgccgcgctggtccggccggagctcttcaccttcaggaagggcgtggtgcgggtggagacccaggggatctgcagaggccacacctccatggacatggggctcaagaagttcaagtcggagaacgcgtggtcgggatacacgccgatctcggtggcgtggacggtggacaaggccaaggtggtcgccttcgtcaaggagctcctcaaaaattaatcaggagttcatgacctgtatatctggtcatcaaatgatttgaaattgtagagatccgtcggtggatcgatagactcgtgatttgtgtgtaccccattcgacgcacttcatgcagacgcattgtctcgtgcaattattgaactactcgtcgtga

SEQ ID NO: 5032 - DNA, 1307 bp, Secale cereale
gatcggactaaccgacgacagtgctggctggcccaaaacacggagaactctcttgcccagccaggagaagaagtctcaattaactcccaagaagagagaagacagagtgaccgacggagggaaggttccaccacccaccgagcgatcgatcgaccgggcgggcatccattcgatggcggcgaacgggcaccagatccggccgtcggaggagacgatgaagctcatcatcgacacgaccccggcatagatgacagcgtggcgatcatgatggcgttccaggcgccgggcgtggaggtcctggggctcaccaccatcttcggcaactgcaccaccgcctacgccacccgcaacgccctgattctgtgtgagaaggcaggccgccccgacgtgccggtggcggagggcagcgccgagcctctcaagggagggaagccgcaggttgccgactttgttcacggatccgatggcctagggaacgtatcggttcctgaaccgaccaccaagaaagcagagcaaaccgccgcggagtttctggtcgacaaggtgtcgcagttccccggggaggtctcggtgctcgccttgggccctctgacaaacatcgcattggccatcaagatggacccctccttcgtgaccaaggtgaagaagatagtggtgctgggcggagccttcttcgcagcagggaacgccacgccttcagccgaagcaaacatccatagcgacccggaggcggcggacatggtgttcacgtcgggcgcggacatcgcggtggtgggcctcaacatcaccacccaggtgagcttcacggaggcggacctgtcggagctgaggagctccggcgggaagcaggcgcagttcctctgcgacatctgcaagttctacagcgactggcacctccactcgtacggcgaccccgccgtgttcctgcacgacccggtgagcctcgctgcgctggtcggccggagctcttcaccttcaggaagggcgtggtgcgggtggagacccagggcatctgcagaggccacacctccatggacatggggctcaagaagttcaagtcggagaacgcgtggtcgggatacacgccgatctcggtggcgtggacggtgacaaggcgaaggtggtcgccttcgtcaaggagctccacaaaaataaatcgggagttcatgatctgtatatctggtcatcaaatgatttgaaattgtagagatccgtcggtggatcgatagactcgtgatttgtgtgtacccattcgacgcacttcatgcagacgcattgtctcgtggaattattgaactgctcgtcgt

SEQ ID NO: 5033 - DNA, 1423 bp, Oryza sativa
gttccagttacagatcggacggcacagtcagcgccaccctctcctccctgcgcgccgcccccctactctactgtcaaatcatcgtcatcgtcgtcgtctcccccagttgttgtgatcgccaattcatccccgccctgctgcctccatccaactcatcaggaaccaacccatcgatcgaccatggatctgcaggaggcggcgatggaagccaggaaaggccatcggatcccgccgacggaggagaaggtcatcatcgacacggatccagggatcgatgacagcgtggcgatcatgatggcgttcgaagctcccggcgtgaaggtcgtcggactcaccaccatcttcggcaactgcactacctcccacgccacccgcaatgccctcatcctgtgcgacagagcaggccgtcctgaggtgccggtagcagagggcagcgctgagcctctcaagggagggaaacctcacgttgctgattttgttcatggatcggatggacttggtaacacgtcctttcctgattctaccaccaccaacaaagttgagcagtcagctgcagagtttctggttgataaggtatcagaatctccaggagagatctctgtactcgccttgggccctctcactaatatcgcattggccatgaagaaagactcctcctttgcaagcaaggttaagaggatagttgtgctgggtggagctttctttgcagctgggaatgccaccccttcagctgaagcaaatatccatagcgacccggaagcagctgacatagttttcacttctggggcagatatctacgtagttggccttaacataacaacccaagtctacttcacagacaaggatatgttggagctaaggaactcgaaagggaagcacgcacaattcctttgtgacatctgcaagttctacagagactggcatgtccactcctacggcgtcgatgctctttttctccatgatcctgtgagtttcaccgcgctagttcaccccgagtacttcacgttcaagaagggcgtggtgagggttgagacccagggcatctgcaaggggcatacttccatggacatgggactgaagaagtggaattcagacaacccgtggactggttactctccgatctcggttgcttggactgttgatgttcctaaggttctggcatatgccaaggagctactcttcaacgcacaatgaaaatgtaaccggatcagtgtcatctctctctctctctctctctgaactctgatgtgattgtgtcagaattggcatgcaaatatatctttttttttgggcacaagcagagatatcttggcattgttgtgtactgcagaaattgtatcatatcatttattctgatgaattgcaaattattgataaatgttcagcagcatctgctagtagtacttgctggtgacatgatgat

SEQ ID NO: 5034 - DNA, 1362 bp, Brachypodium distachyon
aacgaaactgcaagtctccgtgcctggctacgataaataacctagagataaggaccggaggaggaaccggagaagagagaagcaagtctcgagagaggaaccgggggaggtttggatcgatttgatatcgatcgatcggccggccggagatggaggggaacgggcaccgcgagatccacccggcggcggcaaaggagaaggtcatcatcgacacggatcccggcatcgatgacagtgtggcgatcatgatggcatttaatttaccgagcgttgaggtcctaggcctcaccaccatcttcggcaattgcaccactgcgtactctacccgcaacgccttgatactgtgtgagaaggcaggccgtactgaggtgccagtagccgagggcagcgctgagcctctcaagggtggcaagccgaatgttgctgactttgttcatggatcggatggcattgggaacgtacctgttactgatcccaccaccaagaaagcagagcaaaccgctgcacagtttctggtagataaggtgtcacagtcccccggggaggtctctgtacttgccttaggccctctgacaaacatcgcattggccatcaagatggacccctcctttgtgaccaaggtgaagaagatagttgtgcttggtggagctttcttttcggcaggaaatgccaccccatcagctgaagcaaacatccacagcgacccggaagcagccgacatagttttcacttcaggagcagacatctacgtggttggcctcaacataaccacccaagtcagcttcacagacgatgatctctcggagctgaggaactcgaaggggaagcacacgcagttcctgtgcgacatctgcaagttctacagagactggcacctcaagtcctatggtgatcccgctgtgttcctgcatgacccggtgagcttcgcggcgatggtccggcctgagttcttcacgttcaggaagggcgtggtgagggtggagacccagggtatctgcagagggcacacctccatggacatggggctcaagaagtttaacacggagaacgcgtggtctggcttctcgccgatctcggtggcgtggacggtggatgtgcccagggttgtcgccttcgtcaaggagcttctcctcaattaagcatcaacgatccatctcagcattgagtggtctgtaaactgtaaattattcacgatcgattcatacgtattcgacgtactgctggcaattctatggtggtcattaattattgcatgcgatgaattcgcaaattattcgaacttcgaatgtacatgaatgggacaatccatggagttagttatctgaagctaatgttatcttttctcaaataaaacacatcagt

SEQ ID NO: 5035 - DNA, 1365 bp, Brachypodium distachyon
ccaaacgaaactgcaagtctccgtgcctggctacgataaataacctagagataaggaccggaggaggaaccggagaagagagaagcaagtctcgagagaggaaccgggggaggtttggatcgatttgatatcgatcgatcggccggccggagatggaggggaacgggcaccgcgagatccacccggcggcggcaaaggagaaggtcatcatcgacacggatcccggcatcgatgacagtgtggcgatcatgatggcatttaatttaccgagcgttgaggtcctaggcctcaccaccatcttcggcaattgcaccactgcgtactctacccgcaacgccttgatactgtgtgagaaggcaggccgtactgaggtgccagtagccgagggcagcgctgagcctctcaagggtggcaagccgaatgttgctgactttgttcatggatcggatggcattgggaacgtacctgttactgatcccaccaccaagaaagcagagcaaaccgctgcacagtttctggtagataaggtgtcacagtcccccggggaggtctctgtacttgccttaggccctctgacaaacatcgcattggccatcaagatggacccctcctttgtgaccaaggtgaagaagatagttgtgcttggtggagctttcttttcggcaggaaatgccaccccatcagctgaagcaaacatccacagcgacccggaagcagccgacatagttttcacttcaggagcagacatctacgtggttggcctcaacataaccacccaagtcagcttcacagacgatgatctctcggagctgaggaactcgaaggggaagcacacgcagttcctgtgcgacatctgcaagttctacagagactggcacctcaagtcctatggtgatcccgctgtgttcctgcatgacccggtgagcttcgcggcgatggtccggcctgagttcttcacgttcaggaagggcgtggtgagggtggagacccagggtatctgcagagggcacacctccatggacatggggctcaagaagtttaacacggagaacgcgtggtctggcttctcgccgatctcggtggcgtggacggtggatgtgcccagggttgtcgccttcgtcaaggagcttctcctcaattaagcatcaacgatccatctcagcattgagtggtctgtaaactgtaaattattcacgatcgattcatacgtattcgacgtactgctggcaattctatggtggtcattaattattgcatgcgatgaattcgcaaattattcgaacttcgaatgtacatgaatgggacaatccatggagttagttatctgaagctaatgttatcttttctcaaataaaacacatcagt

SEQ ID NO: 5036 - DNA, 1220 bp, Secale cereale
agagaagacagagtgaccgacggagggaaggttccaccacccaccgagcgatcgatcgaccgggcgggcatccattcaatggcggcgaacgggcaccagatccggccgtcggaggagacgatgaagctcatcatcgacaccgaccccggcatagacgacagcgtggcgatcatgatggcgttccaggcgccgggcgtggaggtcctggggctcaccaccatcttcggcaactgcaccaccgcctacgccacccgcaacgccctgattctgtgtgagaaggctggccgtcccgacgtgccggtggcggagggcagcgcagagcctctcaagggtgggaagccgcaggttgccgattttgttcacggatccgatggcctagggaacgtacaagttcctgaaccgaccaccaagaaagcagagcaaaccgccgcggagtttctggtcgacaaggtgtcgcagttccctggggaagtttccgtgctcgccttgggccctctgaccaacatcgcactggccatcaagatggatccctctttcgtgaccaaggtgaagaagatagtggtgctgggcggagccttcttcgcagcagggaacgccacccccttcagccgaagcaaacatccatagcgacccggaggcggcggacatggtgttcacgtcgggcgcggacatcgcggtggtcggcctcaaccatcaccacccaggtgagcttcacggaggcggacctggcggagctgaggagctccggcgggaagcaggcgcagttcctctgcgacatctgcaagttctacagcgactggcacctgcactcgtacggcgaccccgccgtgttcctgcacgacccggtgagcctcgccgcgctggtccggccggagctcttcaccttcaggaagggcgtggtgcgggtggagacccaggggatctgcagaggccacacctccatggacatggggctcaagaagttcaagtcggagaacgcgtggtcgggatacacgccgatctcggtggcgtggacgggggacaaggccaaggtggtcgccttcgtcaagagctcctcaaaaattaatcaggagttcatatctggtcatcaaatgatttgaaattgtagagatccgtgagtcggtcgattgactcgtgatttgtgtgtaccccattcgacgcacttcatgcagacgcattgtctcgtgcaattattgaactactcgtcgtgaattgtctat

SEQ ID NO: 5037 - DNA, 1972 bp, Sorghum bicolor
ccgcctgttccatcgcctcttctggcagacggccaacaacaaacaaaacagagagagccacacaccccacctacccccaccccggcggccgggctccacgctcctccagcatggacctcgtgctcctggagaaggccctgctgggcctgttcgcggcggcggtgctcgccgtcgccgtggcgaagctaaccggcaagcgctaccgcctgccccctggccccgcgggcgcccccgtggtgggcaactggctgcaggtcggcgacgacctcaaccaccgcaacctgatgtccctcgccaagcggttcggcgacatcttcctcctccggatgggcgtccgcaacctggtggtggtctccaccccggagctcgccaaggaggtgctccacacgcagggcgtggagttcggctcccgcacccgcaacgtcgtcttcgacatcttcacggggaaaggccaggacatggtgttcaccgtgtacggcgaccactggcggaagatgcggcggatcatgacggtgcccttcttcaccaacaaggtggtggcgcagaaccgcgtcgggtgggaggaggaggcccgcctcgtggtggaggacgtgaggaaggacccgcgcgccgccgccgagggcgtcgtgatccggaggcggctgcagctcatgatgtacaacgacatgttccgcatcatgttcgacacaaggtttgagagcgagcaggatccgctcttcaacaagctcaaggcgctcaacgccgagaggagccgactgtcgcagagcttcgagtacaactacggtgacttcatccccgtcctccgcccgttcctccgtggctacctcaaccgctgccatgacctcaagacgcgccgcatgaaggtgtttgaggacaacttcgtccaggaacgcaagaaggtgatggctcagactggtgagatccggtgcgccatggaccacatcctcgaggccgagaggaaaggcgagatcaaccatgacaacgtcctctacatcgttgagaacatcaacgtcgcagcgatcgagacgacactgtggtcgatcgagtggggcatcgcggagctggtgaaccacccggccatccagtccaagctccgggaggagatggactcggtgctgggcgccggcgtgcctgtgacggagccggacctcgagcgcctcccctacctccaggccatcgtcaaggagacgctccgcctgcgcatggccatcccgctgctggtgccccacatgaacctcaacgacggcaagctcgccggctacgacatccccgccgagtccaagatcctcgtcaacgcctggttcctcgccaacgaccccaagaggtgggtgcggcccgacgagttccggcccgagcgcttcctggaggaggagaagaccgtggaggcacacggcaacgacttccgcttcgtgcccttcggcgtcggccgccggagctgccccgggatcatcctcgcgctgcctatcatcggcatcaccctgggcaggctggtgcagaacttccagctgctgccgccgccggggcaggacaagatcgacaccacggagaagcccggccagttcagcaaccagatcgctaagcatgccacaatcgtctgcaagcccctcgaggcctagatcaatgcgcacgcgccccgcagatccagcactctatgtattttgtctttttcttttgtgtttttatgtgtcggctctggagtctagagtgaagatgggggtacatgtggctgaggtatgatggcgtagattcactgaatggtgttctcgaaaacttatccatattttatagtgttgtaaacttgaatttagaggctgtttggtttcaggttttcagcatgtcatcgataaatgggtcatgttactttatgtttggatggaccgagtcataacaaatcatggcccaatacaaccatgggcggatgtatatgtagtagatagtgagtgcagctgcacccacacaaaaatagaaaaaa

SEQ ID NO: 5038 - DNA, 2358 bp, Zea mays
caattcattccaattcatttcattactagagtacccaaactaggcctgaagatataactattgcaaggatttttagaaaaaaatcctaattcagtccctcttggatgaaaagatcactcgatgatgaaaccggcgaactgtcgctggtaggtgggtctaactatcaaacctccgtacgtgtctcacagatagtggacgcgtgaataaacatttctgttcggttaattaggtgaggcatcttgtaagaacttggctgtgtttagtcacagcaaacgtattccactctccacaaaataaaataaaataaaataaaataaacgggtcagtgaaacggcaattaaccgactgcatgaatcccttcttttgcttgctgccaggaaatggcaatagtgtttgttcccgttccaaagaccgtgccaaccccccgcaatcggaaacgcctgcctcaccaacccccgcaatcgcaattcgcaaaccaaacaaatttgtgtactcaaaccggccccgtctcggttctattgtataaaacccccgccagaccgctggcttgttccgtcgtctccgctgtccgctgcacagagactgtaccggggcaggggcggcgcagaaacagagccacacaccacacaccccacctacgctacgcgcgtgctgggcgagtgatggacctcgccctcctggagaaggccctgctggggctgttcgctgcggcggtgctggccatcgccgtggcgaagctgacgggcaggcggtaccgccttccaccgggcccccggggcgcccccgtggtggggaactggctgcaggtgggggacgacctgaaccaccgcaacctgatggcgctggcgaggcggttcggcgacatattcctgctgcgcatgggcgtgcgcaacctggtggtggtgtcgaccccggagctggcgaaggaggtgctgcacacgcagggcgtggagttcgggtcgcgcacccgcaacgtggtgttcgacatcttcacgggggaggggcaggacatggtgttcacggtgtacggcgagcactggcgcaagatgcggcgcatcatgaccgtgcccttcttcacgggcaaggtggtggcgcggaaccgcgccgggtgggaggaggaggcccgcctggtggtggaggacgtggcgcgggaccccgccgccgccgccgcgggcgtcgtcctccgccgccgcctccagcggatgatgtacaacgacatgttccgcatcatgttcgaccgccgcttcgacagcgacgacgacccgctgttcaacaagctcaaggcgctcaacgcggagcgcagccgcctgtcgcagagcttcgagtacaactacggcgacttcatccccgtgctccgacccttcctccgcgggtacctcaaccgctgccacgacctcaagacccgccgcatgaaggtcttcgaggatagcttcgtccaggagcgcaagaaggtgatggctgagacgggtgagatccggtgcgccatggaccacatcctcgaggcggagaggaagggcgagatcaaccacgacaacgtcctctacatcgtcgagaacatcaacgtcgcagcgatcgagacgacgctgtggtcgatcgagtggggcatcgcggagctggtgaaccacccggccatccagtccaagctccgggaggagctgggctcggtcctgggcggcgccggcgtgcccgtgacggagccggacctcgagcgcctcccctacctccaggccgtcgtcaaggagacgctgcgcctgcgcatggccatcccgctgctggtcccgcacatgaacctcaacgacggcaagctcgccggctacgacatccccgccgagtccaagatcctcgtcaacgcctggttcctcgccaacgaccccaagaggtgggtgcgccccgacgagttccgccccgagcgcttcctggaggaggacaagtccgtggaggcccacggcaacgacttccgcttcgtcccgttcggggtcggccgccggagctgccccgggatcatcctcgcgctgcccatcatcggcatcaccctcgccagcctcgtgcagaacttccagctgctgccgccgcccggcctcgacaagatcgataccacggagaagcctggccagttcagcaaccagatcgccaagcacgccaccatcgtctgcaagcccctcaaggcctagaaatcacctgcacgcgcctcccgccacatcaagcactattgtaattttgtgcgtcttctctgttatgtgttgtgtccttgaaaacttctccaaaagttatagtgtcataaacttcaatttaatcaactctgttgcacaaggctttgtttccggattgtgaatttagccaaggcccagacgattaaaa

SEQ ID NO: 5039 - DNA, 2200 bp, Setaria italica
accaacccccgcagtaccaaacacaaacaagctcgtgtcctcaaatcggacccgtcttcgctccctccctgcagaaacgctataaatccccgtcatccccctcacgccgttcccatcacctcctctccacgggcaaggcaagcgaggcgaccaaacaaaacaaacacaggccacacaccccacctaccccccgccggggagacgagagccagccagccatggacctcgccctcctcgagaaggcccttctgggcctgttcgctgcggcgggtgctggccatcaccgtggcgaagctgacgggcaagcgcctccgcctgccccccggccccccggcgcccccgtggtgggcaactggctccaggtcgggcgacgacctcaaccaccgcaacctgatgaccctcgcgaagcgcttcggcgacatcttcctcctcccgaatgggcgtccgcaacctggtggtcgtgtccaccccggagctcgccaaggaggtcctccacacccagggcgtcgagttcggctcccgcacccgcaacgtcgtcttcgacatcttcaccggcaagggccaggacatggtcttcaccgtctacggcgaccactggcgcaagatgcgccgcatcatgaccgtccccttcttcaccaacaaggtcgtcgcgcagaaccgcgccggctgggaggaggaggcccgcctggtcgtggaggacgtcaagaagaaccccaaggcgcgccaccgagggtgtggtgatccgcggccgcctgcagctcatgatgtacaacgacatgttccgcatcatgttcgatcgccgcttcgacagcgaggacgacgagctcttcaacaagctcaaggccctcaacgccgagcgcagccgcctctcgcagagcttcgagtacaactacggcgacttcatccctgtcctccgccccttcctccgcgggtacctcaaccgctgccacgacctcaagacccgccgcatgaaggtcttcgaggacaacttcgtccaggagcgcaagaatgtgatggcccagactggcgagatccggtgcgccatggaccacatccttgaggccgagaggaagggcgagatcaaccacgacaacgtcctctacatcgtcgagaacatcaacgtcgcagccatcgagactaccttgtggtcgatcgagtggggcatcgccgagctggtgaaccacccggagatccagtccaagctccgggaggagctgacctccgtgctgggcgccggcgtggcggtgacggagccggacctggagcgcctgccctacctgcaggccgtggtgaaggagaccctccggctgcgcatggccatcccgctgctggtcccgcacatgaacctcaacgacggcaagctccatggctacgacatcccagccgaatccaagatcctcgtcaacgcgtggttcctcgccaacgaccccaagcggtgggtgaagcccgaggagttccgcccggaacggttcctggaggaggagaaggccgttgaggcccatggcaacgacttccggttcgtgcccttcggcgtcggccgccggagctgcccggggattatccttgcgctgcccatcatcggcatcacgctcggaaggctggtgcagaacttccagctgctgccgccgccggggcaggccaaggtcgacaccaccgagaagccggggcagttcagcaaccagatcgccaagcacgccaccatcgtctgcaagccgctcgaggcctagagcttcggagaatgtgagttcttccagagagagaggccatcgatcaagcactatgtatttttgtttttgttttttcttttgtgtttttgtactaagaggagttttgtgttgcctgttgagtgatgggggcatgtatgtggctgaggtacgtgaggtgttgtagattcacttggttatgttcttgcaaacttatccataatttatagtgctgtaaacttgaatttagatcccccctctctggtgaacatagaagaaatttcattcaagggccatttttatttcgaaattgccatagttggtccggtgtaggaattgaggtcaaatcaaagaaatcaggcatcgatacagagcagaaaatacaaattttacaatacatacttgtataaagccggcagcaatccttcgggtaccaaaagtgtgttgatgcaaaaatcgagcggtgaccttcacgtactaacacactaaaggtctgg

SEQ ID NO: 5040 - DNA, 1883 bp, Cenchrus ciliaris
acacaagccacacgcacccccacctacccccgccggggagacgagccagcaccagcagccatggacctcgccctcctcgagaaggcccttcttggcctgttcgcggcggcggtgctggccatcgccgtggcgaagctgacggggaagcgcctccgcctcccccccggcccgcccggcgcccccgtggtgggcaactggctccaggtcggcgacgacctcaaccaccgcaacctgatggccctcgccaagcgcttcggcgacatcttcctcctccgcatgggcgtccgcaacctggtggtggtgtccacccctgagctcgccaaggaggtcctccacacccagggcgtcgagttcgggtcccgcacccgcaacgtcgtcttcgacatcttcaccggcaagggccaggacatggtgttcaccgtctacggcgaccactggcgcaagatgcggcgcatcatgaccgtccccttcttcaccaacaaggtcgtggcccagaaccgcgccggctgggaggaggaggcccgcctcgtggtcgaggacgtgaagaggaaccccaaggccgccaccgagggggtcgtcatccgccgccgcctgcagctcatgatgtacaacgacatgttccgcatcatgttcgaccgccgcttcgacagcgaggacgacgcgctcttcaacaagctcaaggccctcaacgccgagcgcagccgcctgtcccagagcttcgagtacaactacggcgacttcatccccatcctccgcccgttcctccgcgggtacctcaagcgctgccacgacctcaagacccgacgcatgaaggtcttcgaggacaacttcgtccaggagcgcaagaaggtgatggcccagactggcgagatccgctgcgccatggaccacatcctcgaggcggagaggaagggcgagatcaaccacgacaacgtcctctacatcgtcgagaacatcaacgtcgcagccatcgagactaccttgtggtcgatcgagtggggcatcgccgagctggtgaaccaccctgagatgcagtccaagctccgggaggagatgacctcggtgctgggcgccggcgttgcggtgacggagccggacctggagcgcctgccctacctgcaggccgtggtgaaggagaccctccggctgcgcatggccatcccgctgctggtcccgcacatgaacctcaacgacggcaagctcaacggctacgacatccccgccgagtccaagatcctcgtcaacgcgtggttcctggccaacgaccccaagcggtgggtgaagcccgaggagttccgcccggagcgtttcctggaggaggagaaggccgtcgaggcccacggcaacgacttccggttcgtgcccttcggcgtcggccgccggagctgccccgggatcatcctcgcgctgcccatcatcggcatcacactcggcaggctggtgcagaacttccagctgctgccgccgccggggcaggccaaggtcgacaccaccgagaagccgggccagttcagcaaccagatcgccaagcacgccaccatcgtctgcaagccgctcgaggcctaagagctccggagaatgccagttcttccagaatccagagagagagaggccatcgatcaagcactatgtgttttgtcttttttttttccttttgtgttcttgtactaagaggatttgtttccttttgagttcttgtactaagaggagtttgtgttggctgttgagtgatgggtatgtgggtgaggtacgtgaggtgtcgtagattcacttggttatgttcttgcaaacttatccataatttatagtgctgtaaacttgaatttagacccgcactctggcgaacatggaagaaatttcattcaagggacaatttaatttcg

SEQ ID NO: 5041 - DNA, 2347 bp, Setaria italica
gggcccgtctcctcccacagcaccaaaacgtaccaacccccgcagtaccaaacacaaacaagctcgtgtcctcaaatcggacccgtcttcgctccctccctgcagaaacgctataaatccccgtcatccccctcacgccgttcccatcacctcctctccacgggcaaggcaagcgaggcgaccaaacaaaacaaacacaggccacacaccccacctaccccccgccggggagacgagagccagccagccatggacctcgccctcctcgagaaggcccttctgggcctgttctgcggcgggtgctggccatcaccgtggcgaagctgacgggcaagcgcctccgcctgccccccggccccccggcgcccccgtggtgggcaactggctccaggtcggcgacgacctcaaccaccgcaacctgatgaccctcgcgaagcgcttcggcgacatcttcctcctccgcatgggcgtccgcaacctggtggtcgtgtccaccccggagctcgccaaggaggtcctccacacccagggcgtcgagttcggctcccgcacccgcaacgtcgtcttcgacatcttcaccggcaagggccaggacatggtcttcaccgtctacggcgaccactggcgcaagatgcgccgcatcatgaccgtccccttcttcaccaacaaggtcgtcgcgcagaaccgcgccggctgggaggaggaggcccgcctggtcgtggaggacgtcaagaagaaccccaaggccgccaccgagggtgtggtgatccgccgccgcctgcagctcatgatgtacaacgacatgttccgcatcatgttcgatcgccgcttcgacagcgaggacgacgagctcttcaacaagctcaaggccctcaacgccgagcgcagccgcctctcgcagagcttcgagtacaactacggcgacttcatccctgtcctccgccccttcctccgcgggtacctcaaccgctgccacgacctcaagacccgccgcatgaaggtcttcgaggacaacttcgtccaggagcgcaagaatgtgatggcccagactggcgagatccggtgcgccatggaccacatccttgaggccgagaggaagggcgagatcaaccacgacaacgtcctctacatcgtcgagaacatcaacgtcgcagccatcgagactaccttgtggtcgatcgagtggggcatcgccgagctggtgaaccacccggagatccagtccaagctccgggaggagctgacctccgtgctgggcgccggcgtggcggtgacggagccggacctggagcgcctgccctacctgcaggccgtggtgaaggagaccctccggctgcgcatggccatcccgctgctggtcccgcacatgaacctcaacgacggcaagctccatggctacgacatcccagccgaatccaagatcctcgtcaacgcgtggttcctcgccaacgaccccaagcggtgggtgaagcccgaggagttccgcccggaacggttcctggaggaggagaaggccgttgaggcccatggcaacgacttccggttcgtgcccttcggcgtcggccgccggagctgcccggggattatccttgcgctgcccatcatcggcatcacgctcggaaggctggtgcagaacttccagctgctgccgccgccggggcaggccaaggtcgacaccaccgagaagccggggcagttcagcaaccagatcgccaagcacgccaccatcgtctgcaagccgctcgaggcctagagcttcggagaatgtgagttcttccagagagagaggccatcgatcaagcactatgtatttttgtttttgttttttcttttgtgtttttgtactaagaggagttttgtgttgcctgttgagtgatgggggcatgtatgtggctgaggtacgtgaggtgttgtagattcacttggttatgttcttgcaaacttatccataatttatagtgctgtaaacttgaatttagatcccccctctctggtgaacatagaagaaatttcattcaagggccatttttatttcgaaattgccatagttggtccggtgtaggaattgaggtcaaatcaaagaaatcaggcatcgatacagagcagaaaatacaaattttacaatacatacttgtataaagccggcagcaatccttcgggtaccaaaagtgtgttgatgcaaaaatcgagcggtgaccttcacgtactaacacactaaaggtctgggagatttgcttcactccggtgcaggtcctgtagatcgacgcgcgtggtgtgcgcgggcgtgccaatcagtttgatcattcaactggcaactgacaaggtgaaaataatcctttgaaatccg

SEQ ID NO: 5042 - DNA, 1785 bp, Pennisetum glaucum
gcaaccgaggcgcgcgaacaaccaaaacaaccacaagccacacatcacacgccccacctaccccccgccggggccatggacctcgccctcctcgagaaggcccttctgggcctgttcgcggcggcggtgctggccatcgccgtggcgaagctgacggggaagcggctccgcctgccccccgggccgcccggcgcccccgttgtgggcaactggctccaggtcggcgacgacctgaaccaccgcaacctgatggacctcgccaggcgcttcggcgacatcttcctcctccgcatgggcgtccgcaacctggtggtggtgtccaccccggagctcgccaaggaggtcctccacacccagggcgtcgagttcgggtcccgcacccgcaacgtcgtcttcgacatcttcaccggcaagggccaggacatggtgttcaccgtgtacggcgaccactggcgcaagatgcgtcgcatcatgaccgtccccttcttcaccaacaaggtcgtggcccagaaccgcgccggctgggaggaggaggcccggctggtggtggaggacgtgaagaagaaccccaaggccgccaccgagggggtcgtgatccgccgccgcctgcagctcatgatgtacaacgacatgttccgcatcatgttcgaccgccgcttcgacagcgaaggcgacgcgctcttcaacaagctcaaggccctcaacgccgagcgcagccgcctgtcgcagagcttcgagtacaactacggcgacttcatccccgtcctccgccccttcctccgcgggtacctcaagcgctgccacgacctcaagacccaacgcatgaaggtcttcgaggacaacttcgtccaggagcgcaagaaggtgatggcccagactggcgagatccggtgcgccatggaccacatcctcgaggccgagaggaagggcgagatcaaccacgacaacgtcctctacatcgtcgagaacatcaacgtcgcagccatcgagaccaccctgtggtcgatcgagtggggcatcgcggagctggtgaaccacccggagatccagtccaagctccgggaggagatcaactcggtgctgggcgccggcgttgcggtgacggagccggacctggagcgcctgccctacctgcaggccgtggtgaaggagaccctccggctgcgcatggccatcccgctgctggtcccgcacatgaacctcaaggacggcaagctcgacggctacgacatccccgccgagtccaagatcctcgtcaacgcgtggttcctcgccaacgaccccaagcggtgggtgaagcccgaggagttccgcccggagcgtttcctggaggaggagaaggccgtcgaggcccacggcaacgacttccggttcgtgcccttcggtgtcggccgccggagctgccccgggatcatcctcgcgctgcccatcatcggcatcacgctcggcaggctggtgcagaacttccggctgctgccgccgccggggcaggccaaggtcgacaccaccgagaagccgggccagttcagcaaccagatcgccaagcatgccaccattgtctgcaagccgctcgaggcctagagctccggagaatgccaattcttccagaaagagacagggcatcgatcaagcactatgtattttgttttgtgtttttgtactaaaaggagttttgtgttggctggtgagtgatgggagcatgtatgtggctgaggtacgtgaggtgttctagattcacttggttatgttcttgcataatttatagtgctgtaaacttgaatttag

SEQ ID NO: 5043 - DNA, 1813 bp, Triticum aestivum
ggcccgcccctccccaccagcgacacgacacacacagacacacgggagccgcacagcgcacctacccccgatggacgtgctcctcctggagaaggccctgctgggcctcttcgccgcggcggtgctggccatcgccgtcgccaagctcgccggcaagcgcctccgcctccccccgggcccctccggcgcgcccatcgtcggcaactggctgcaggtcggcgacgacctcaaccaccgcaacctgatgggcatggccaggcggttcggcgaggtgttcctcctccgcatgggcgtccgcaacctggtggtcgtctccagccccgagctcgccaaggaggtcctccacacccagggcgtcgagttcggctcccgcacccgcaacgtcgtcttcgacatcttcaccggcaagggccaggacatggtgttcacggtgtacggcgaccactggcggaagatgcggcggatcatgacggtgcccttcttcaccaacaaggtggtggcgcagaaccgggcggggtgggaggaggaggcgcggctggtggtggaggacctcagggccgacccggcggcggcggcggcgggcgtggtggtgcgccgcaggctgcagctcatgatgtacaacgacatgttccgcatcatgttcgaccgccgcttcgagagcaccgccgacccgctcttcaaccagctcaaggcgctcaacgccgagcgcagcatcctctcccagagcttcgactacaactacggcgacttcatccccgtcctccgccccttcctccgccgctacctcaaccgctgcaccaacctcaagaccaagcgcatgaaggtgttcgaggaccagttcgtccaaccgcgcaaggaggcgttggagaagacgggcgagatcaggtgcgccatggaccacatcctggaggccgagagaaagggcgagatcaaccatgacaacgtcctctacatcgtcgagaacatcaacgtcgcagccattgagacgacgctgtggtcgatcgagtggggcatcgcggagctggtgaaccacccggacatccagcagaagctgcgcgaggagatcgtcgccgtgctcggcgccggcgtggcggtgacggagcccgacctggagcgcctcccctacctgcagtccgtggtgaaggagacgctccgcctccgcatggccatcccgctcctcgtgccccacatgaacctcagcgacgccaagctcgccggctacgacatccccgccgagtccaagatcctcgtcaacgcctggttcctcgccaacgaccccaagcggtgggtgcgcgccgacgagttcaggcccgagcggttcctcgaggaggagaaggccgtcgaggcccacggcaacgacttccggttcgtgcccttcggcgtcggccgccggagctgccccgggatcatcctcgcgctgcccatcatcggcatcacgctcggacgcctggtgcagaacttccagctgctgccgccgcccgggcaggacaagatcgacaccaccgagaagcccgggcagttcagcaaccagatcctcaagcacgccaccatcgtctgcaagccactggaggcttaagaattttcgatgaacgacatggaggtttatggcatgcgtgcgtccacgctgatgcggggagatccatctatgcatgtgactttgtatttgcatttctttttggcgttttgtagtagtataagtttaaatatttttgtgttggctatttgtcttcatgtgaggcgtcgtgttgtaaatttccatatataatgtgatgtaaaacttcttggctccaaaaaacgacatggttactcattt

SEQ ID NO: 5044 - DNA, 1835 bp, Oryza sativa
agcagagcagcgcatctgcatccaaaaccaaacccaaactcgtcttctccaccggagcagagcagcggcggcggcaatggacgccctcctcgtggagaaggtcctcctgggcctgttcgtggcggcggtgctggccctagtggtggccaagctcaccgggaagaggctccgcctcccgcccggccccgccggcgcgcccatcgtcggcaactggctccaggtcggcgacgacctcaaccaccgcaacctgatggcgctggcgcggcggttcggcgacatcctcctcctccgcatgggcgtccgcaacctggtggtggtgtccagcccggacctcgccaaggaggtgctccacacccagggcgtcgagttcggctcccgcacccgcaacgtggtgttcgacatcttcaccgggaaggggcaggacatggtgttcaccgtgtacggcgaccactggcgcaagatgcggcggatcatgacggtgcccttcttcaccaacaaggtggtggcccagaaccgcgcgggttgggaggaggaggcgaggctggtggtggaggacgtccgccgcgaccccaccgcggcgacctccggcgtggtgatccggcgaaggttgcagctgatgatgtacaacgacatgttccgcatcatgttcgaccgccgtttcgacagcgtggacgacccgctcttcaacaagctcaaggccttcaacgcggagcgcagccgcctctcgcagagcttcgagtacaactacggtgacttcatccccgtcctccgccccttcctccgccgctacctcgcacgctgccaccagctcaagtcccagcgcatgaagctcttcgaggaccacttcgtccaggaacgcaagagagtgatggagcagactggtgagatccggtgcgccatggaccacatcctcgaggccgagaggaagggcgagatcaaccacgacaacgtcctctacatcgtcgagaacatcaacgttgctgctatcgagacgacgctgtggtcgatcgaatggggaatcgcggagctggtgaaccacccgagcatccagtcgaaggtgcgggaggagatggcgtcggtgctgggcggcgcggcggtgacggagccggacctggagcggctgccgtacctgcaggcggtggtgaaggagacgctgcggttgcgcatggcgatcccgctgctggtgccgcacatgaacctcgccgacggcaagctcgccggctacgacatccccgccgagtccaagatcctggtgaacgcgtggttcctcgccaacgaccccaagcggtgggtgcgccccgacgagtttaggccggagaggttcctggaggaggagaaggccgtggaggcgcacggcaacgacttccgcttcgtgcccttcggcgtcggccgccgcagctgccccgggatcatcctcgcgctgcccatcatcgggatcacgctcggccgcctcgtccagagcttcgacctgctgccgccgcccgggatggacaaggtggacaccaccgagaagcccggccagttcagcaaccagatcctcaagcacgccaccgtcgtctgcaagcccatcgacgcctaggtcgatcgatcgacctactcaaatcaatcatgtgctgcgttatcctattgcactaaaaaaaggttgtatttttgtttggggggggggggggggggtagttatgtgtgtgttctgtgaggcaggcacctgttgttgtaggtttacttaacttttttttttcttatacttgttggttcaaacttaattattggtaatctatactgcccaaacattgcaaatatatcatttctggctatttacacttcatcaagacaaa

SEQ ID NO: 5045 - DNA, 2060 bp, Triticum aestivum
acttcgcatccgtccagtctgccacctacctccatcaaatcccccgctataaaatccccaccgcgcccaatcttccgtcaaattaactcgatccgatcgggccctccaccgcagcacggcaacacatacacaggagccacacaccgcacctaccccgatggacgtcctcctcctggagaaggccctcctgggcctcttcgccgcggcggtgctggccatcgccgtcgccaagctcaccggcaagcgcttccgcctcccccctggcccctccggcgcccccatcgtcggcaactggctgcaggtcggcgacgacctcaaccaccgcaacctgatgggcctggccaagcggttcggcgaggtgttcctcctccgcatgggcgtccgcaacctggtggtcgtctccagccccgagctcgccaaggaggtcctccacacccagggcgtcgagttcggctcccgcacccgcaacgtcgtcttcgacatcttcaccggcaagggacaggacatggtgttcacggtgtacggcgaccactggcgcaagatgcggcggatcatgacggtgcccttcttcaccaacaaggtggtggcgcagaaccgcgtggggtgggaggaggaggcccggctggtggtggaggacctcaaggccgacccggcggcggcgacggcgggcgtggtggtccgccgcaggctgcagctcatgatgtacaacgacatgttccgcatcatgttcgaccgccggttcgagagcacggccgacccgctcttcaaccagctcaaggcgctcaacgccgagcgcagcatcctctcccagagcttcgactacaactacggcgacttcatccccgtcctccgccccttcctccgccgctacctcaaccgctgcaccaacctcaagaccaagcggatgaaggtcttcgaggaccaattcgtccaaccgcgcaaggaggcgttggagaagacgggtgagatcaggtgcgccatggaccacatcctggaagccgaaaggaagggcgagatcaaccacgacaacgtcctctacatcgtcgagaacatcaacgtcgcagccatcgagacgacgctgtggtcgatcgagtggggcatcgcggagctggtgaaccacccggagatccagcagaagctgcgcgaggagatcgtcgccgttctaggcgccggggcggcggtgacggagccggacctggagcgcctcccctacctgcagtccgtggtgaaggagacgctccgcctccgcatggcaatcccgctcctggtgccgcacatgaacctcagcgacgccaagctcgccggctacgacatccccgccgagtccaagatcctcgtcaacgcctggttcctcgccaacgaccccaagcggtgggtgcgcgccgatgagttcaggccggagaggttcctcgaggaggagaaggccgtcgaggcccacggcaacgatttccggttcgtgcccttcggcgtcggccgccggagctgccccgggatcatcctcgcgctgcccatcatcggcatcacgctcggacgcctggtgcagaacttccagctgctgccgccgccggggcaggacaagatcgacaccaccgagaagcccgggcagtttagcaaccagatcctcaagcacgccaccattgtctgcaagccactcgaggcttaactgaattgaggtttcggtcatgggcgcccgctgacgcggggagatggatctatgcatgtgactgtgtattttgccttctttctttttggtgttgttttttgcagtagtaagtttaatttttctttggtgttggcctatttgtcttcatgtgaggcgtcgtgttgtaaatttccatatagttggcaatgtgatgtaaaacttggctccaaatatgacatgattacaaattttgcaaacccggaaaaggtcaaaatcattggtactatgtcccgttcacaaatataaaatattttgaatatatgaatatggactacatatatacggattgaacagagggagcaatttgcaatgcttcttactcctactagtaactgaaaatacccgagagcacaactag

SEQ ID NO: 5046 - DNA, 1845 bp, Secale cereale
ccaccggaagcaccacaggagccccacaccgcacctaccccggccgcgatggacgtcctcctcctggagaaggccctcctgggcctcttcgccgcggcggtgctcgccatcgccgtcgccaagctcaccggcaagcgcctccggctcccccccggcccctccggcgcccccatcgtcggcaattggctccaggtcggcgacgacctcaaccaccgcaacctgatggacatggccaagcggttcggcgaggtgttcctcctccgcatgggtgtccgcaacctggtggtcgtctccagccccgagctcgccaaggaggtcctccacacccagggcgtcgagttcggctcccgcacccgcaacgtcgtcttcgacatcttcaccggcaagggccaggacatggtgttcacggtgtacggcgaccactggcgcaagatgcggcggatcatgacggtgcccttcttcaccaacaaggtggtggcgcagaaccgcgtggggtgggaggaggaggcccggctggtggtggaggacctcaaggccaacccggcgtcggcgacggagggcgtggtggtccgccgcaggctgcagctcatgatgtacaacgacatgttccgcatcatgttcgaccgccggttcgagagcgtggacgacccgctcttcaacaagctcaaggcgctcaacgccgagcgcagcatcctctcccagagcttcgactacaactacggcgacttcatccccgtcctccgccccttcctccgccgctacctcaaccgctgcaccaacctcaagaccaagcggatgaaggtgttcgaggaccacttcgtccagcagcgcaaagaggcattggagaagacgggcgagatcaggtgcgccatggaccatatcctggaagccgaaaggaagggcgagatcaaccacgacaacgtcctctacatcgtcgaaaacatcaacgtcgcagccattgagacgaccctgtggtcgatcgagtggggcatcgcggagctggtgaaccacccggaaatccagcagaagctgcgcgaggagatcgtcgccgttctgggccctggcacggcggtgacggagccggacctggagcgcctcccctacctgcagtccgtcgtgaaggagacgctccgcctccgcatggccatcccgctcctggtgccgcacatgaacctcagcgacgccaagctcgccggctacgacatccccgccgagtccaagatcctcgtcaacgcctggttcctcgccaacgaccccaagcggtgggtgcgcgccgacgagttcaggcccgagcggttcctcgaggaggagaaggccgtcgaggcccacggcaacgacttccggttcgtgcccttcggcgtcggccgccggagctgccccgggatcatcctcgcgctgcccatcatcggcatcacgctcggacgcctggtgcagaacttccagctgctgcccccgccggggcaggacaagatcgacaccaccgagaagcccggtcagttcagcaaccagatcctcaagcacgccacgatcgtctgcaagcccctcgaggcttaagtaaactgaggtttcggtcatggccgcacgctggcgcggggagatcgtcctttgcatgtgactgtgtattttgccttttctttttggtgttttgcagtagtaagtttaatttttctttggtgttgggctatttgtcttcatgcatgtgaggcgtcgtgttgtaaatctacatatagttggcaatgtgatgtaaaacttaatggctccaaagacgacatgattacaattttgcaaactcgaaaaaggtcaaatcattgctactctctccgttcataaatatataaaaaaaaa

SEQ ID NO: 5047 - DNA, 1810 bp, Brachypodium distachyon
ggatttgctttacatttctattcgttcccccttctgctctgcaactgcagcacacacacagaaacaccatggacgtcctcctcctggagaaggctctcctgggcctcttcgcggcggcggtgctggcgatcgccgtcgccaagctcacgggcaagcggttccgcctccctcccgggccctccggcgcccccatcgtcggcaactggctccaggtcggcgacgacctcaaccaccgcaacctgatgggcatggccaagcggttcggcgaggtgttcctcctccgcatgggcgtccgcaacctggtggtcgtctccagccccgacctcgccaaggaggtcctccacacccagggcgtagagttcggatcccgcacccgcaacgtcgtcttcgacatcttcaccggaaaaggccaggacatggtgttcacggtgtacggcgaccactggcgcaagatgcggcggatcatgacggtgcccttcttcaccaacaaggtggtggcgcagaaccgggtggggtgggaggaggaggcgaggctggtggtggaggacgtgcgggcggacccggcgtcggcggtcggcggagtcgtcatccgccgcaggctgcagctcatgatgtacaacgacatgttccgcatcatgttcgacagaaggttcgccagcgtcgacgacccgctcttcaacaagctcaaggcgctcaacgccgagcgcagcatcctctcccagagcttcgactacaactacggcgacttcatccccgtcctccgccccttcctccgccgctacctcaaccgatgccacaccctcaagtccaagcggatgaaagtcttcgaggaccatttcgtccaggagcgcaaggaggcgttggagaagactggtgagatcaggtgcgccatggaccacatcctggaggccgagaggaagggcgagatcaaccacgacaacgtcctttacatagtcgagaacatcaacgtcgcagccatcgagacaacgctgtggtcgatcgagtggggaatcgcggagctggtgaaccacccggagatccaggccaaggtccgcgaggagatcaccgcggtgctgggccccaacacggcagtgacagagccagacctagagcggctcccgtacctgcaggccgtggtgaaggagacgctccggctccgcatggccatcccgctgctcgtcccccacatgaacctgagcgacgccaagctggccggctacgacatccccgccgagtccaagatcctggtcaacgcctggttcctggccaacgaccccaagcggtgggtgcggcccgacgagttccggcccgagcgcttcatggaggaggagaaggccgtcgaggcccacggcaacgacttccgcttcgtgcccttcggcgtcggccgcaggagctgccccgggatcatcctcgcgctgcccatcatcggcatcacgctcggacgcctcgtgcagaacttcaccctgctgccgccgccggggcaggccaagatcgacaccacggagaagcccggacagttcagcaaccagatcctcaagcacgccaccgtcgtctgcaagccactccaggcttagaatcattgatgcagcgagatcatgcgtgcgttacatgccgatgaagagagatcgatctgtgttttgtgttttgtactctcggatcagttgcaattttctttgtcgggatatgtttttgttcatgtcgtgttgtagatttacaaactgaattacagtacgttgatgttaaacgctgtccgattcgtggatgcaaaaaatgaaatgattactcataaattcaaaactcaggtaacgcc

SEQ ID NO: 5048 - DNA, 1821 bp, Brachypodium distachyon
aatcatcaggatttgctttacatttctattcgttcccccttctgctctgcaactgcagcacacacacagaaacaccatggacgtcctcctcctggagaaggctctcctgggcctcttcgcggcggcggtgctggcgatcgccgtcgccaagctcacgggcaagcggttccgcctccctcccgggccctccggcgcccccatcgtcggcaactggctccaggtcggcgacgacctcaaccaccgcaacctgatgggcatggccaagcggttcggcgaggtgttcctcctccgcatgggcgtccgcaacctggtggtcgtctccagccccgacctcgccaaggaggtcctccacacccagggcgtagagttcggatcccgcacccgcaacgtcgtcttcgacatcttcaccggaaaaggccaggacatggtgttcacggtgtacggcgaccactggcgcaagatgcggcggatcatgacggtgcccttcttcaccaacaaggtggtggcgcagaaccgggtggggtgggaggaggaggcgaggctggtggtggaggacgtgcgggcggacccggcgtcggcggtcggcggagtcgtcatccgccgcaggctgcagctcatgatgtacaacgacatgttccgcatcatgttcgacagaaggttcgccagcgtcgacgacccgctcttcaacaagctcaaggcgctcaacgccgagcgcagcatcctctcccagagcttcgactacaactacggcgacttcatccccgtcctccgccccttcctccgccgctacctcaaccgatgccacaccctcaagtccaagcggatgaaagtcttcgaggaccatttcgtccaggagcgcaaggaggcgttggagaagactggtgagatcaggtgcgccatggaccacatcctggaggccgagaggaagggcgagatcaaccacgacaacgtcctttacatagtcgagaacatcaacgtcgcagccatcgagacaacgctgtggtcgatcgagtggggaatcgcggagctggtgaaccacccggagatccaggccaaggtccgcgaggagatcaccgcggtgctgggccccaacacggcagtgacagagccagacctagagcggctcccgtacctgcaggccgtggtgaaggagacgctccggctccgcatggccatcccgctgctcgtcccccacatgaacctgagcgacgccaagctggccggctacgacatccccgccgagtccaagatcctggtcaacgcctggttcctggccaacgaccccaagcggtgggtgcggcccgacgagttccggcccgagcgcttcatggaggaggagaaggccgtcgaggcccacggcaacgacttccgcttcgtgcccttcggcgtcggccgcaggagctgccccgggatcatcctcgcgctgcccatcatcggcatcacgctcggacgcctcgtgcagaacttcaccctgctgccgccgccggggcaggccaagatcgacaccacggagaagcccggacagttcagcaaccagatcctcaagcacgccaccgtcgtctgcaagccactccaggcttagaatcattgatgcagcgagatcatgcgtgcgttacatgccgatgaagagagatcgatctgtgttttgtgttttgtactctcggatcagttgcaattttctttgtcgggatatgtttttgttcatgtcgtgttgtagatttacaaactgaattacagtacgttgatgttaaacgctgtccgattcgtggatgcaaaaaatgaaatgattactcataaattcaaaactcaggtaacgccgca

SEQ ID NO: 5049 - DNA, 1807 bp, Leymus cinereus x Leymus triticoides
gatccgcccctccccagcagcacggcaacacaggagccacacgccacacctacccccggccggccccgatggacgtcctcctgctggagaaggccctcctgggcctcttcgcggcggcggtgctcgccatcgccgtggcgaagctcaccggcaagcgcttccggctccccccgggcccctcgggcgcccccatcgtgggcaactggctccaggtcggcgacgacctcaaccaccgcaacctgatgggcatggccaagcgcttcggcgaggtgttcctcctccgcatgggcgtccgcaacctggtggtcgtctccagccccgagctcgccaaggaggtcctccacacccagggcgtcgagttcggctcccgcacccgcaacgtcgtcttcgacatcttcaccggcaagggacaggacatggtgttcacggtgtacggcgaccactggcgcaagatgcggcggatcatgacggtgcccttcttcaccaacaaggtggtggcgcagaaccgcgtggggtgggaggaggaggcccggctggtggtggaggacctcaaggccaacccggcgtcggcgacggagggcgtggtggtccggcgccggctgcagctcatgatgtacaacgacatgttccgcatcatgttcgaccggcggttcgagagcgtggacgacccgctcttcaacaagctcaaggcgctcaacgccgagcgcagcatcctctcccagagcttcgactacaactacggcgacttcatccccgtcctccgccccttcctccgccgctacctcaaccgctgcaccaacctcaagaccaagcggatgaaagttttcgaggaccacttcgtccagcagcgcaaggaggcgttggagaagacgggtgagatcaggtgcgccatggaccacatcctggaagccgaaaggaagggcgagatcaaccacgacaacgtcctctacatcgtcgagaacatcaacgtcgcagccattgagacgacgctgtggtcgatcgagtggggcatcgcggagctggtgaaccacccggagatccagcagaagctgcgcgaggagatcgtcgccgtgctgggccccggcgcggcggtgacggagccggacctggagcgcctcccctacctgcagtccgtcgtcaaggagacgctccgcctccgcatggccatcccgctcctcgtgccgcacatgaacctcagcgacgccaagctcgccggctacgacatccccgccgagtccaagatcctcgtcaacgcctggttcctcgccaacgaccccaagcgctgggtgcgcgccgacgagttcaggcccgagcggttcctcgaggaggagaaggccgtcgaggcccacggcaacgacttccggttcgtgcccttcggcgtcggccggcggagctgccccgggatcatcctggcgctgcccatcatcggcatcacgctcggacgactggtgcagaacttccagctgctgccgccgccggggcaggacaagatcgacaccaccgagaagcccggacagttcagcaaccagatcctcaagcacgccaccatcgtctgcaagccactccaggcttagaattgaggtttcggtcatgcgcgcacgctgatgcggggagatcgatctatgcatgtgacggtgtactttacattttttttggggtgttttgtagtagtataagttcaatttctttttggtgttgggctatttgtcttcatgtaaggcgtcgtgttgtaaattttcatatatagatggtaatgtgatgtaaaacttcttggctccaaaaaaacgacatgattactcattttgca

SEQ ID NO: 5050 - DNA, 1987 bp, Hordeum vulgare
agcacttcgcatccgtggagcctgcctgccacctacctccatccagccccacgctataaaatccccaccgctcccaatcttgcgtcaaatcaattcgacagatcgacccgcccctccgcagcggcgacacacaggcacaggcacaggagccacacaccgcgcctaccccccgatggacgtcctcctcctggagaaggccctgctgggcctcttcgccgcggcggtgctggccatcgccgtagccaagctcgccggcaagcgcttccgcctcccacccggcccctccggcgcccccatcgtcggcaactggctgcaggtcggcgacgacctcaaccaccgcaacctgatgggcctggccaagcggttcggcgaggtgttcctcctccgcatgggcgtccgcaacctggtggtcgtctccagccccgagctcgccaaggaggtcctccacacccagggcgtcgagttcggctcccgcacccgcaacgtcgtcttcgacatcttcaccggcaagggacaggacatggtgttcacggtgtacggcgaccactggcgcaagatgcggcggatcatgacggtgcccttcttcaccaacaaggtggtggcgcagaaccgcgtggggtgggaggaggaggcccggctggtggtggaggacctcagggccgacccggcggcggcgaccaagggcgtggtggtgcgacgcaggctgcagctcatgatgtacaacgacatgttccgcatcatgttcgaccgccggttcgagaccgtggccgacccgctcttcaaccagctcaaggcgctcaacgccgagcgcagcatcctctcccagagcttcgactacaactacggcgacttcatccccgtcctccgccccttcctccgccgctacctcaaccgctgcaccaacctcaagaccaagcgcatgaaggtgttcgaagaccacttcgtccagcagcgcaaggaggcgttggagaagacgggtgagatcaagtgcgccatggaccacatcctggaagccgaaaggaagggcgagatcaaccacgacaacgtcctctacatcgtcgagaacatcaacgtcgcagccattgagacgacgctgtggtcgatcgagtggggcctcgcggagctggtgaaccacccggagatccagcagaagctgcgcgaggagatcgtcgccgtgctgggccctggcacgccggtgacggagccggacctggagcgcctcccctacctgcagtccgtcgtgaaggagacgctccgcctccgcatggccatcccgctcctggtgccgcacatgaacctcagcgatgccaagctcgccggttacgacatccccgccgaatccaagatcctcgtcaacgcctggttcctcgccaacgaccccaagcggtgggtgcgcgccgacgagttcaggcccgagcgcttcctcgaggaggagaagtccgtcgaggcccacggcaacgacttccggttcgtgcccttcggcgtcggccgccggagctgccccgggatcatcctcgcgctgcccatcatcggcatcacgctcggacgcctggtgcagaacttcgagctgctgccgccgccggggcaggacaagatcgacaccaccgagaagccagggcagttcagcaaccagatcctcaagcacgccaccatcgtctgcaagccactcgaggcttgattgagttcagatctcggtcatgcgcgtacgctgatgcggggagatcgatctatgcatgtgactctgtattttgcattttggtgtttcacagtagtaagtttaatttttctttggtgttgggctatttgtcttcatttgaggcgtcgatgttgtaaatttccaaatagttggcaatgtgatgtaaaacttcttggctccaaagatgacatgattacccaaaaacatattttgctcaaaagctcatttgagctcgtgatgaacagtaaaatcacaaaaaatgaaaacagactaagaattctgcttttcttt

SEQ ID NO: 5051 - DNA, 1878 bp, Avena sativa
gttctgcatctagcgagcgacccaattccacagcggccacagaagccacctaccaccgcgcgccgaccgattcgattcgattcgactcgatggacgtcctcctcctggagaaggccctgctgggcctcttcgccgcggcggtgctggcgatcgccgtggcgaagctcaccggcaagcgcttccgccttcccccaggcccctcgggcgcccccatcgtgggcaactggctgcaggtgggcgacgacctgaaccaccgcaacctgatgggcctggcgaagcggttcggggaggtgttcctcctccgcatgggcatccgcaacctggtggtggtgtccagcccggagctggccaaggaggtgctccacacgcagggcgtggagttcggctcacgcacccgcaacgtcgtcttcgacatcttcacggggaacggccaggacatggtcttcaccgtctacggcgaccactggcgcaagatgcgacggatcatgaccgtgcccttcttcaccaacaaggtggtggcgcagaaccgcgtgggatgggaggaggaggccaggctcgtggtggaggacgtcaaggccgacccggcctccgccacggccggggtggtcatccgccgcaggctgcagctcatgatgtacaacgacatgttccgcatcatgttcgaccgcaggttccagagcgtcgacgacccgctcttcaacaagctcaaggcgctcaacgccgagcgaagcatactctcccagagcttcgactacaactacggagacttcatccccatcctacgccccttcctccgacggtacctcaaccgatgcaccaatctcaagaccaagaggatgaagctgttcgaggaccacttcgtccaagatcgaaagaaggcgctggagcagactggtgagatcaagtgcgccatggaccacatcctggaggccgaaaggaagggggagatcaaccacgacaacgtcctttacatcgtcgagaacatcaacgtcgcagccatcgagacaactctgtggtcaatcgagtggggcattgctgagctggtgaaccacccggacgtccagtcgaagctccgtgacgagatgactgccgtgctgggcgccaacgtggcggtgacggagccggaccttgagcgcctcccctacctgcagtccgtcgtgaaggagactctccgcctccgcatggccatcccgctgctcgtgccacacatgaacctcagcgacgccaagctcgccggctacgacatccccgccgagtccaagatcctcgtcaacgcctggttcctcgccaacgaccccaagcggtgggtgaaggccgacgagttcaggccggagcggttcctcgaggaggagaaggccgtcgaggcccacggcaacgacttccggttcgtgcccttcggcgtcggccggagaagctgcccggggatcatcctcgcgctgcccatcatcggcattacgctcggccgcctggtgcagaacttccagctgctgccgccgccggggcaggacaagatcgacaccaccgagaagcccgggcagttcagcaaccagatcctcaagcacgccaccatagtctgcaagccactcgaggtttagaatcttctatccggtgatcagatatggaggcttctggcacacctgtgttcggggagattgatctatgcatgtgatgtgtattttgcattatttctttgtctgcgttttgtacttagttgcatttttgttggtgttggggctgtgtatcttcatgcgaggcgtcatgttgtagattttacaatgttggtgatatcgatgtaaaacttcttaactgcaaattgaggcgattgctcgtcaatttacaaactcagatggtgatatagaatttgtttcactattacaa

SEQ ID NO: 5052 - DNA, 1832 bp, Avena sativa
ctgcatctagcgagcgacccaattccacagcggccacagaagccacctaccaccgcgcgccgaccgattcgattcgattcgactcgatggacgtcctcctcctggagaaggccctgctgggcctcttcgcggcggcggtgctggcgatcgccgtggcgaagctcaccggcaagcgcttccgccttcccccaggcccctcgggcgcccccatcgtgggcaactggctgcaggtgggcgacgacctgaaccaccgcaacctgatgggcctggcgaagcggttcggggaggtgttcctcctccgcatgggcatccgcaacctggtggtggtgtccagcccggagctggccaaggaggtgctccacacgcagggcgtggagttcggctcacgcacccgcaacgtcgtcttcgacatcttcacggggaacggccaggacatggtcttcaccgtctacggcgaccactggcgcaagatgcgccggatcatgaccgtgccgttcttcaccaacaaggtggtggcgcagaaccgcgtgggatgggaggaggaggccaggctcgtggtggaggacgtcaaggccgacccggcctccgccacggacggggtggtcatccgccgcaggctgcagctcatgatgtacaacgacatgttccgcatcatgttcgaccgcaggttccagagcgtcgacgacccgctattcaacaagctcaaggcgctcaacgccgagcgaagcatactgtcacagagcttcgactacaactacggagacttcatccccatcctacgccccttcctccgacggtacctcaaccgatgcaccaatctcaagaccaagaggatgaagctgttcgaggaccacttcgtccaagacagaaagaaggcgctggagcagactggtgagatcaagtgcgccatggaccacatcctggaggccgaaaggaagggggagatcaaccacgacaacgtcctttacatcgtcgagaacatcaacgtcgcagccattgagacaactctgtggtcaatcgagtggggcattgctgagctggtgaaccacccggacgtccagtcgaagctccgtgacgagatgactgccgtgctgggcgccaacgtggcggtgacggagccggaccttgagcgcctcccctacctgcagtccgtcgtgaaggagactctccgcctccgcatggccatcccgctgctcgtgccacacatgaacctcagcgacgccaagctcgccggctacgacatccccgccgagtccaagatcctcgtcaacgcctggttcctcgccaacgaccccaagcggtgggtgaaggccgacgagttcaggccggagcggttcctcgaggaggagaaggccgtcgaggcccacggcaacgacttccggttcgtgcccttcggcgtcggccggagaagctgcccggggatcatcctcgcgctgcccatcatcggcattacgctcggccgcctggtgcagaacttccagctgctgccgccgccggggcaggacaagatcgacaccaccgagaagcccgggcagttcagcaaccagatcctcaagcacgccaccatagtctgcaagccactcgaggtttagaatcttctatccggtgatcagatatggaggcttctggcacacctgtgttcggggagattgatctatgcatgtgatgtgtattttgcattatttctttgtctgcgttttgtacttagttgcatttttgttggtgttggggctgtgtatcttcatgcgaggcgtcatgttgtagattttacaatgttggtgatatcgatgtaaaacttcttaactgcaaattgaggcgattgctcgtcaatt

SEQ ID NO: 5053 - DNA, 1867 bp, Avena sativa
tccccgccgtgctcccattccacccaccaatctcaactgcatctagcgagcgacccaattccacagcggccacagaagccacctaccaccgcgcgccgaccgattcgattcgactcgatggacgtcctcctcctggagaaggccctgctgggcctcttcgcggcggcggtgctggcgatcgccgtggcgaagctcaccggcaagcgcttccgccttcccccaggcccctcgggcgcccccatcgtgggcaactggctgcaggtgggcgacgacctgaaccaccgcaacctgatgggcctggcgaagcggttcggggaggtgttcctcctccgcatgggcatccgcaacctggtggtggtgtccagcccggagctggccaaggaggtgctccacacgcagggcgtggagttcggctcacgcacccgcaacgtcgtcttcgacatcttcacggggaacggccaggacatggtcttcaccgtctacggcgaccactggcgcaagatgcgccggatcatgaccgtgccattcttcaccaacaaggtggtggcgcagaaccgcgtgggctgggaggaggaggccaggctcgtggtggaggacgtcaaggccgacccggcctccgccacggacggggtggtcatccgccgcaggctgcagctcatgatgtacaacgacatgttccgcatcatgttcgaccgcaggttccagagcgtcgacgacccgctcttcaacaagctcaaggcgctcaacgccgagcgaagcatactgtcacagagcttcgactacaactacggagacttcatccccatcctacgccccttcctccgacggtacctcaacagatgcaccaatctcaagaccaagaggatgaagctgttcgaggaccacttcgtccaagaccgaaagaaggcgctggagcagactggtgagatcaagtgcgccatggaccacatcctggaggccgaaaggaagggggagatcaaccacgacaacgtcctttacatcgtcgagaacatcaacgtcgcagccattgagacaactctgtggtcaatcgagtggggcattgctgagctggtgaaccaccctgacgtccagtcgaagctccgtgacgagatgactgccgtgctcggccccaacgtggcggtgacggagccggacctagagcgcctcccctacctgcagtccgtcgtgaaggagactctccgcctccgcatggccatcccgctgctcgtgccacacatgaacctcagcgacgccaagctcgccggctacgacatccccgccgagtccaagatcctcgtcaacgcctggttcctcgccaacgaccccaagcggtgggtgaaggccgacgagttcaggccggagcggttcctcgaggaggagaaggccgtcgaggcccacggcaacgacttccggttcgtgcccttcggcgtcggccggagaagctgcccggggatcatcctcgcgctgcccatcatcggcattacgctcggccgcctcgtgcagaacttccagctgctgccgccgccggggcaggacaagatcgacaccaccgagaagcccgggcagttcagcaaccagatcctcaagcacgccaccatagtctgcaagccgctcgaggtttagaatcttctatccggtgatcagatggaggcttctggcacacctgtgttcgggggagattgatctgtgcatgtgatgtgtattttgcatttctttgtctgcgttttgtacttagttgcatttttgttggtgttggggctgtgtatcttcatgcgaggcgtcatgttgtagattttacaatgttggtgatatcgatgtaaaacttcttaactgcaaattgagacgattactcatcaatttacaaact

SEQ ID NO: 5054 - DNA, 1814 bp, Lolium multiflorum
ctcaacactccccaatcccacagccacagaagccacctaccaccgcgcgctcgaccgatcgacgatggaggtcctcctcctggagaaggccctgctggggctcttcgcggcggcggtgctggccatcgccgtcgcgaagctcaccggcaagcgcttccgcctcccgcccggcccctccggcgcccccatcgtcggcaactggctccaggtcggcgacgacctgaaccaccgcaacctgatgggcatcgcgaagcggttcggggaggtgttcctgctccgcatgggcatccgcaacctggtggtggtgtccagcccggagctggccaaggaggtgctccacacgcagggcgtggagttcggctcccgcacccgcaacgtcgtcttcgacatcttcaccggcaacggccaggacatggtcttcaccgtctacggcgaccactggcgcaagatgcgccggatcatgaccgtgcccttcttcaccaacaaggtggtggcgcagaaccgcgtgggctgggaggaggaggccaggctcgtggtggaggacgttaaggccgacccggcgtccgcgaccaccggcaccgtgatccgccgcaggctgcagctcatgatgtacaacgacatgttccgcatcatgttcgaccgcaggttcgagtccgtcgacgacccgctcttcaacaagctcaaggccatgaacgccgagcgcagcatcctgtcgcagagcttcgactacaactacggcgacttcatccccatcctcaggccgttcctcaggaagtacctcaaccggtgcacaaacctcaagaccaagaggatgaagctcttcgaggaccacttcgtcgctgaccgcaagaaggcgctggagcagaatggggagatcaggtgcgccatggaccacatcttggaggcggagaggaagggtgagatcaaccacgacaacgtcctctacatcgtcgagaacatcaacgttgcagccatcgagacaaccctgtggtcgatcgagtggggcattgccgagctggtgaaccacccggacgtccagtccaagctccgcgacgagatggccgccgtgctgggcgccgacgtggcggtgacggagccggacctcgagcgcctcccgtacctgcagtccgttgtgaaggagacgctccgcctccgcatggccatcccgctgctcgtgccgcacatgaacctcagcgacgccaagctcgccggctacgacatccccgccgagtccaagatcctcgtcaacgcatggttcctcgccaacgaccccaagcggtgggtgcgcgccgacgagttcaggcccgagcgcttcctcgaggaggagaaggccgtcgaggcccacggcaacgacttccgcttcgtgcccttcggcgtcggccgccggagctgccccgggatcgtcctcgcgctgcccatcatcggcatcacgctcggacgcctcgtgcagaacttccagctgctgccgccgcccgggcaggacaagatcgataccaccgagaagcccggacagttcagcaaccagatcctcaagcacgccaccgtcgtctgcaagccgctcgaggcctagaattttctatttgatcatatggaggcttctgacatgcgtgtctgtgcatgcatgcgtgaacgctggtgccgagagatcgatctatgcacgcatgtgatgtgtattttcctttttttgtgcttttattttacttagttgcatttttgttggtcttcatgtgaggcgtcatgttgtagatttactatgttggtgataatgatgtaaaacttcttcactgcgaagtgagacgattactcatcagtac

SEQ ID NO: 5055 - DNA, 1647 bp, Secale cereale
acacacagccacacgcaagtacacgacgatggacgtcaacctcctggagaaggccctcctgggcctcttcgtggcggcgatgctcgccatcgccgtcgcgaagctgaccggcaagcgcttccggctgcccccggggcccccggtgccccgatcgtgggcaactggctccaggtgggtgatgacctcaatcaccgcaacctcatgggcatggccaagcgcttcggcgaggtgttcctcctacgcatgggcgtccgcaacctcgtggtcgtctccagtcctgagctcgccaaggaggtgctccacacccagggcgtcgagttcggctcccgcacccgcaacgtcgtcttcgacatcttcaccggcaaaggccaggacatggtgttcaccgtgtacggtgaccactggcgcaagatgcgccggatcatgacggtgcccttcttcaccaacaaggtggtggtgcagaaccgcgaggggtgggaggaggaggcccggctggtggtggaggacctcaaggccgacccggcgtcggccactggcgtggtgatccgccgcaggctgcagctcatgatgtacaacgacatgttccgcatcatgttcgaccgccggttcgagagcctcgccgacccgctcttcaacaagctgagggcgctcaacgcggagcgcagcatgctctcccagagcttcgactacaactacggcgacttcatccccatcctccgccccttcctccgcggctacctcaaccggtgcaccaacctcaaggccaagaggatgaaagtcttcgaggaccacttcgtccaagagcgcaagaaggcgttggagaagaacggggagatcagatgcgccatggaccacatcctcgaggccgaaaggaagggcgagatcaaccacgacaacgtcctgtacatcgtcgagaacatcaacgtcgcagcaatcgagacgaccctgtggtctatcgaatggggagtcgcggagctggtgaaccacccggacatccagtcaaagctccgccatgagatcgccgccgtgctaggccctgatgcagcggtgacagagccggacctggagcgtctcccctacctgcaagccgtcgtcaaggagactctccgcctccgcatggccatcccgctcctagtgccacacatgaacctcaaggacgccaagctcaccggctacgacatccccgccgagtccaagatcctcgtcaacgcctggttcctcgccaacgaccccaagcgctgggtgcgcgccgatgagttccggccagagcggttccttgaggaggagagggccgtcgaggccaacggtaacgacttccggtttgtgcccttcggtgtcggccggaggagctgcccggggatcatcctcgcgatgcccatcattggcatcacgcttggccgcctggtgcagaacttccagcttctgccgccgctggggcaggacaagatcgacaccacggagaagcctggacagttcagcaaccagatccgcaaccacgccaccgtcgtctgcaagccgctcaaggcttagaagattttttggtccgacgagctagacgaaggatcctctggcatgcatgcacgagattgtataagtattttgttgtttttgtaataagtttaagttttcttcctgttcggttatttt

SEQ ID NO: 5056 - DNA, 1765 bp, Secale cereale
gcaacacacacacagccacacgcaagtacacgacgatggacgtcaacctcctggagaaggccctcctgggcctcttcgtggcggcgatgctcgccatcgccgtcgcgaagctgacaggcaagcgcttccggctgccccggggcccccggtgccccgatcgtgggcaactggctccaggtgggtgatgacctcaatcaccgcaacctcatgggcatggccaagcgcttcggcgaggtgttcctcctacgcatgggcgtccgcaacctggtggtcgtctccagtcctgagctcgccaaggaggtgctccacacccagggcgtcgagttcggctcccgcacccgcaacgtcgtcttcgacatctttaccggcaaaggccaggacatggtgttcacagtgtacggcgaccactggcgcaggatgcgccggatcatgacggtgcccttcttcaccaacaaggtggtggtgcagaaccgcgaggggtgggaggaggaggcccggctggtggtggaggacctcaaggccgacccggcgtcggccactggcgtggtgatccgccgcaggctgcagctcatgatgtacaacgacatgttccgcatcatgttcgaccgccggttcgagagcctcgccgacccgctcttcaacaagctgagggcgctcaacgcggagcgcagcatgctctcgcagagcttcgactacaactacggcgacttcatccccattctccgccccttcctccgcggctacctcaaccggtgcaccaacctcaaggccaagaggatgaaagtcttcgaggaccacttcgtccaagagcgcaagaaggcgttggagaagaacggggagatcagatgcgccatggaccacatcctcgaggccgaaaggaagggcgagatcaaccacgacaacgtcctgtacatcgtcgagaacatcaacgtcgcagcaatcgagacgaccctgtggtctatcgaatggggagtcgcggagctggtgaaccacccggacatccagtcaaagctccgccatgagatcgccgccgtgctaggccccgatgcggcggtgacagagccagacctagagcgcctcccttacctgcaagccgtcgtcaaggagactctccgcctccgcatggccatccctctcctcgtgccacacatgaacctcaaggacgccaagctcgcaggctacgacatccccgccgagtccaagatcctcgtcaacgcctggttcctcgccaacgaccccaagcgctgggtgcgcgccgatgagttccggccagagcggttccttgaggaggagaggtccgtcgaggccaacggcaacgacttccggttcgtgcccttcggtgttggccggaggagctgcccggggatcatcctcgcgatgcccatcatcggcatcacgcttggccgcctggtgcagaacttccagcttctgccgccgctggggcaggacaagatcgacaccacggagaagcctggacagttcagcaaccagatccgcaaccacgccaccgtcgtctgcaagccgctcaaggcttagaagattttttggtccgacgagctagacgaaggatcctctggcatgcatgcacgagattgtataagtattttgttgtttttgtaataagtttaagttttcttcctgttcggttatttttcttcatgtgaggcaccaggtcgttggtttgcaaacttggtaatgttgatgtaaaagttttcgctccaaattcacgttattaataacttactccctccgtcccaaaaaagtc

SEQ ID NO: 5057 - DNA, 1746 bp, Secale cereale
aagcaccacaggagccccacaccgcacctaccccggccgcgatggacgtcctcctcctggagaaggccctcctgggcctcttcgccgcggcggtgctcgccatcgccgtcgccaagctcaccggcaagcgcctccggctccccccggccctccggcgcccccatcgtcggcaattggctccaggtcggcgacgacctcaaccaccgcaacctgatggacatggccaagcggttcggcgaggtgttcctcctccgcatgggtgtccgcaacctggtggtcgtctccagccccgagctcgccaaggaggtcctccacacccagggcgtcgagttcggctcccgcacccgcaacgtcgtcttcgacatctttaccggcaaaggccaggacatggtgttcacagtgtacggcgaccactggcgcaagatgcgccggatcatgacggtgcccttcttcaccaacaaggtggtggtgcagaaccgcgaggggtgggaggaggaggcccggctggtggtggaggacctcaaagccgacccggcgtcagccactggcgtggtgatccgccgcaggctgcagctcatgatgtacaacgacatgttccgcatcatgttcgaccgccggttcgagagcctcgccgacccgctcttcaacaagctgagggcgctcaacgcggagcgcagcatgctctcgcagagcttcgactacaactacggcgacttcatccccatcctccgccccttcctccgcggctacctcaaccggtgcaccaacctcaaggccaagaggatgaaagtcttcgaggaccacttcgtccaagagcgcaagaaggcgttggagaagaacggggagatcagatgcgccatggaccacatcctcgaggccgaaaggaagggcgagatcaaccacgacaacgtcctgtacatcgtcgagaacatcaacgtcgcagcaatcgagacgaccctgtggtctatcgaatggggagtcgcggagctggtgaaccacccggacatccagtcaaagctccgccatgagatcgccgccgtgctaggccccgatgcggcggtgacagagccagacctagagcgcctcccttacctgcaagccgtcgtcaaggagactctccgcctccgcatggccatcccgctcctcgtgccacacatgaacctcaaggacgccaagctcaccggctacgacatccctgccgagtccaagatcctcgtcaacgcctggttcctcgccaacgaccccaagcgctgggtgcgcgccgacgagttccggccggagcggttccttgaggaggagagggccgtcgaggccaacggtaacgactccggtttgtgcccttcggtgtcggccggaggagctgcccggggatcatcctcgcgatgcccatcattggcatcacgcttggccgcctggtgcagaacttccagcttctgccgccgctggggcaggacaagatcgacaccacggagaagcctggacagttcagcaaccagatccgcaaccacgccaccgtcgtctgcaagccgctcaaggcttagaagaatttttgatccgacgagctagacgaaggatccgctggcatgcatgcgcgtgattgaataagtattttggtttttgtaataagtttactttttctttgtgttcggttatttttcttcatgtgaagcaccaggtcgttggtttgcaaacttggtaatgttgatgtaaaagttttcgctccaaattcacgttattaataactta

SEQ ID NO: 5058 - DNA, 1682 bp, Echinochloa colona
gccgggccccttcccggtccccatcttcggcaactggctccaggtgggcgacgacctgaaccaccgcaacctgatggccctggcgaagcggttcggcgacatcttcctcctccgcatgggcgtgcgcaacctggtggtggtgtccaccccggagctcgccaaggaggtgctccacacccagggcgtcgagttcggctcccgcacccgcaacgtcgtcttcgacatcttcaccggcaaggggcaggacatggtcttcaccgtgtacggcgaccactggcgcaagatgcggcgcatcatgacggtgcccttcttcaccaacaaggtcgtggcccagaaccgcgccgggtgggaggaggaggcgcgcctcgtggtggaggacgtcaggaggaaccccaaggccgccaccgagggcgtcgtcatccgccgccgcctccagctcatgatgtacaacgacatgttccgcatcatgttcgaccgcaggttcgacagcgaggacgacccgctcttcaacaagctcaaggcgctcaacgccgagcgcagccgcctctcgcagagcttcgagtacaactacggcgacttcatccccgtcctccgccccttcctccgcaagtacctcaaccgctgccacgacctcaagacccgccgcatgaaggtcttcgaggacaacttcgtcgaggagcgcaagaaggtgatggcccagactggcgagatccggtgcgctatggaccacatcctcgaggccgagaggaagggcgagatcaaccacgacaacgtcctctacatcgtcgagaacatcaacgtcgcagctatcgagactacactgtggtcgatcgagtggggcatcgcggagctgacgaaccacccggcgatccaggccaagctccgggaggagatgacctcggtgctgggcgccggcgtggcggtgacggagccggacctggagcgcctgccctacctgcaggccgtggtgaaggagaccctccgcctgcgcatggccatcccgctactggtcccgcacatgaacctcaacgacggcaagctcaacggctacgacatccccgccgagtccaagatcctcgtcaacgcgtggttcctcgccaacgaccccaagcggtgggtgaagcccgaggagttccgccccgagcgcttcctggaggaggagaaggccgtggaggcccacggcaacgacttccggttcgtgcccttcggcgtcggccgccgaagctgccccgggatcatcctcgcgctgcccatcatcggcatcacgctgggcaggctggtgcagaacttccagctgctgccgccgccggggcaggcgcaggtcgacaccaccgagaagccagggcagttcagcaaccagatcgccaagcacgccaccatcgtctgcaagccgctcgaggcctagagcgcgctgttacatatattccagagaggcagccatcgatcaagcactatgttatttttggtttttgtctttcgtactaagaagacaaaagagaggagacgcgtttcttgctttttgtgttggctgttgagtgatgggggtgtatgtggctgaggtatgtaaggtgttgtagattcacttggttatgttctaaaaaacttatccataatttatagtgctgtaaacttgaatttagacgcactctctggtgaacatggtagaaatttcattcatgggc

SEQ ID NO: 5059 - DNA, 1682 bp, Festuca arundinacea
atggacgtcaacctcctggagaaggccctactgggcctcttcgcggcggcggtgctcgccatcgcagtcgcgaagctcaccggtaagcgcttcaagcttcctccaggcccgtccggttaccccatcgtgggcaactggctccaggtcggcgatgacctgaaccaccgcaacctgatgggcatggccaagcgcttcggcgaggtgttccacctccgcatgggcgtccgcaacctggtggtcgtctccagccccgagctggccaaggaggtcctccacacccagggcgtggagttcggctcccgcacccgcaacgccgtcttcgacatcttcaccggcaaggggcaggacatggtgttcaccgtctacggcgaccactggcgcaagatgcggcggatcatgaccgtgcccttcttcaccagcaaggtggtggcgcagaaccgcgtcgggtgggaggaggaggcgaggctggtggtcgaggacgtgaaggccgacccggcgtcggcgacgaccggcgtggtcatccgccgcaggctgcagctgatgatgtacaacgacatgttccgcatcatgttcgaccgccgcttcgagtccctcgccgacccgctcttcaacaagctcagggcgctcaacgccgagcgcagcatcctctcccagagcttcgactacaactacggcgacttcatccccttcctccgcccattcctccgcggatacctcaaccgctgcaccaatctcaagaccaagaggatgaaagtcttcgaggacgacttcgtcacaccacgcaagaaggcgttggagcagagtggtgaaatcaagtgtgccatggaccacatcctcgaggccgaaaggaaaggcgagatcaaccacgacaacgtcctctacatcgtcgagaacatcaatgtcgcagccatcgagacgacgctgtggtcaatcgagtggggcattgctgagctggtgaaccacccagaagtccagtcaaagctgcgcaacgagattgccgccgtacttggccccaacgtggcggtgacggagccggacctggagcgcctcccctacctgcagtctgtggtgaaggagaccctccgcctccgcatggccatcccgctgctcgtgccacacatgaacctcaaccaggcgaagctggccggctacgacatccccgcagagtccaagatcctcgtgaacgcctggttcctcgccaacgaccccaagcgctgggtgcgggccgacgagttcaggccggagcgattcctcgaggaggagaaggccgtccaagctcatggcaatgacttccgcttcgtgcccttcggtgtcggccgccgaaactgcccggggatcatcctagcactgcccatcatcggcattacgctcggcaacatggtgcagaacttcaatctgctgccgccgccgggtcaggacaagatcgacaccaccgagaagcccggacagttcagcaaccagatccgcacccacgccaacgtcgtctgcaagcccctcaaggcttagaattctcgatctaatgagatgtctttctcgcacacgtttgtgtattttatttgtacttcgtatttacattttttagttacttgtacgaagttgtatttttgttggtattagcctatgtgtcttcatgtcatgaatcaggcttaaacttggtaattttgttgtaaaatttgtctgct

SEQ ID NO: 5060 - DNA, 1531 bp, Avena sativa
gaccaatctcaactgcatctagcgagcgacccaattccacagcggccacagaagccacctaccaccgcgcgccgaccgattcgattcgattcgactcgatggacgtcctcctcctggagaaggccctgctgggcctcttcgcggcggcggtgctggcgatcgccgtggcgaagctcaccggcaagcgcttccgccttcccccaggcccctcgggcgcccccatcgtgggcaactggctgcaggtgggcgacgacctgaaccaccgcaacctgatgggcctggcgaagcggttcggggaggtgttcctcctccgcatgggcatccgcaacctggtggtggtgtccagcccggagctggccaaggaggtgctccacacgcagggcgtggagttcggctcacgcacccgcaacgtcgtcttcgacatcttcacggggaacggccaggacatggtcttcaccgtctacggcgaccactggcgcaagatgcgccggatcatgaccgtgccgttcttcaccaacaaggtggtggcgcagaaccgcgtgggatgggaggaggaggccaggctcgtggtggaggacgtcaaggccgacccggcctccgccacggacggggtggtcatccgccgcaggctgcagctcatgatgtacaacgacatgttccgcatcatgttcgaccgcaggttccagagcgtcgacgacccgctattcaacaagctcaaggcgctcaacgccgagcgaagcatactgtcacagagcttcgactacaactacggagacttcatccccatcctacgccccttcctccgacggtacctcaacagatgcaccaatctcaagaccaagaggatgaagctgttcgaggaccacttcgtccaagacagaaagaaggcgctggagcagactggtgagatcaagtgcgccatggaccacatcctggaggccgaaaggaagggggagatcaaccacgacaacgtcctttacatcgtcgagaacatcaacgtcgcagccattgagacaactctgtggtcaatcgagtggggcattgctgagctggtgaaccacccggacgtccagtcgaagctccgtgacgagatgactgccgtcctgggcgccaacgtggcggtgacggagccggaccttgagcgcctcccctacctgcagtccgtcgtgaaggagactctccgcctccgcatggccatcccgctgctcgtgccacacatgaacctcagcgacgccaagctcgccggctacgacatccccgccgagtccaagatcctcgtcaacgcctggttcctcgccaacgaccccaagcggtgggtgaaggccgacgagttcaggccggagcggttcctcgaggaggagaaggccgtcgaggcccacggcaacgacttccggttcgtgcccttcggcgtcggccggagaagctgcccggggatcatcctcgcgctgcccatcatcggcattacgctcggccgcctcgtgcagaacttccagctgctgccgccgccggggcaggacaagatcgacaccac

SEQ ID NO: 5061 - DNA, 1631 bp, Panicum virgatum
tggacctggcgaagcggttcggcgacatcttcctcctccgcatgggcgtgcgcaacctggtggtggtgtccacgcccgagctcgccaaggaggtgctccacacgcagggcgtggagttcggctcccgcacccgcaacgtcgtcttcgacatcttcaccggcaagggccaggacatggtgttcaccgtctacggcgaccactggcgcaagatgcggcgcatcatgaccgtccccttcttcaccaacaaggtggtggtgcagaaccgcgccgggtgggaggaggaggcccgcctcgtggtggaggacgtgcggagggaccccagggccgccgccgagggcgtcgtcatccgcaaacgcctccagctcatgatgtacaacgacatgttccgcatcatgttcgaccgccgcttcgagagcgagcaggactcgctcttcaacaagctcaaggcgctcaacgccgagcgcagccgcctctcccagagcttcgagtacaactacggcgacttcatccccgtcctccgccccttcctccgcggctacctcaaccgatgccacgacctcaagacccggcgcatgaaggtcttcgaggacaacttcgtccaggagcgcaagaaggtgatggcgcagactggcgagatccggtgcgccatggaccacatcctcgaggccgagaggaagggcgagatcaaccacgacaacgtcctctacatcgttgagaacatcaacgtggcagcgatcgagactaccttgtggtcgatcgagtggggcatcgctgagctggtgaaccacccaacgatccagtccaagctccgggaggagatcacctccgtgttgggtgccggcgtggcggtgacggagccggacctggagcgcctgccctacctgcaggccgtggtcaaggagaccctccgcctccgcatggccatcccgctgctggtcccgcacatgaacctcaacgacggcaagctccacggctacgacatccccgccgagtctaagatcctcgtcaacgcgtggttcctcgccaacgaccccaagcggtgggtgaagcccgaggaattccgccccgagaggttcctggaggaggagaaggccgtggaggcccacggcaacgacttccggttcgtgcccttcggcgtcggccggcggagctgccccgggatcatcctcgcgctgcccatcatcggcatcacgctgggcaggctggtacagaacttccagctgctgccgccgccggggcaggacaaggtcgacaccaccgagaagcccgggcagttcagcaaccagatcgccaagcacgccaccattgtctgcaagccgctcgaggcctagagtcccggaaacgcgcgttccagagcagaggccatcgaacaagcactatgtattttggttcttttatttttcttgtgttttttgtactaagaggatacgcatattcttgttcgtgttgggtgttgagtgatggcggggggggggggggggtagtgtggctgaggtacgtgaggtgttgtagattcacttggttatgttctcgcaaacttatccataatttatagtgctttaaacttgaattcagacccaatctctggtgaacatggcagaaatttcattaaagggccatttttagttttg

SEQ ID NO: 5062 - DNA, 1679 bp, Avena sativa
ccggcaagcgcttccgccttcccccaggcccctcgggcgcccccatcgtgggcaactggctgcaggtgggcgacgacctgaaccaccgcaacctgatgggcatggccaagcgcttcggggaggtgttcctcctccgcatgggcatccgcaacctggtggtggtgtccagccccgagctggcgaaggaggtgctccacacccagggcgtggagttcggctcccgcacccgcaacgtcgtcttcgacatcttcacggggaacggccaggacatggtcttcaccgtctacggcgaccactggcgcaagatgcgccggatcatgaccgtgccattcttcaccaacaaggtggtggcgcagaaccgcgtgggctgggaggaggaggccaggctcgtggtggaggacgtcaaggccgacccggcctccgccacggacggggtggtcatccgccgcaggctgcagctcatgatgtacaacgacatgttccgcatcatgttcgaccgcaggttccagagcgtcgacgacccgctcttcaacaagctcaaggcgctcaacgccgagcgaagcatactgtcacagagcttcgactacaactacggagacttcatccccatcctccgcccgttcctgcgacgctacctcaaccgatgcaccaatctcaagacaaagaggatgaagctattcgaggaccactttgtccaagaccgcaagaaggcgctcgagcagactggtgagatcaagtgcgccatggaccacatcctggaggccgaaaggaagggggagatcaaccacgacaacgtcctttacatcgtcgagaacatcaacgtcgcagccattgagacaactctgtggtcaatcgagtggggcattgctgagctggtgaaccaccctgacgtccagtcgaagctccgtgacgagatgactgccgtgctcggccccaacgtggcggtgacggagccggacctagagcgcctcccctacctgcagtccgtcgtgaaggagactctccgcctccgcatggccatcccgctgctcgtgccacacatgaacctcagcgacgccaagctcgccggctacgacatccccgccgagtccaagatcctcgtcaacgcctggttcctcgccaacgaccccaagcggtgggtgaaggccgacgagttcaggccggagcggttcctcgaggaggagaaggccgtcgaggcccacggcaacgacttccggttcgtgcccttcggcgtcggccggagaagctgcccggggatcatcctggcgctgcccatcattggcattacgctcggccacctggtgcagaacttcgagctgctgccgccgccggggcaggacaagatcgacaccaccgagaagcccgggcagttcagcaaccagatcctcaagcacgccaccatagtctgcaagccgctcgaggtttagaatcttctatccggtgatcagatggaggcttctggcacacctgtgttcgggggagattgatctatgcatgtgatgtgtattttgcatttctttgtctgcgttttgtacttagttgcatttttattggtgttggggccgtgtgtcttcatgagaggcgtcatgttgtagattttacaatgttggtgatatcgatgtaaaacttcttaactgcaaattgagacgattactcgtcaatttacaaactcagatggc

SEQ ID NO: 5063 - DNA, 1680 bp, Festuca arundinacea
ggcacgagggcggttccgcctccccccgggcccctccggcgcgcccatcgtgggcaactggctccaggtcggcgacgacctgaaccaccgcaacctgatgggcatcgccaagcggttcggggaggtgttcctcctccgcatgggcatccgcaacctggtggtggtgtccagcccggagctggccaaggaggtgctccacacgcagggcgtggagttcggctcccgcacccgcaacgtcgtcttcgacatcttcaccggcaacggccaggacatggtcttcaccgtctacggcgaccactggcgcaagatgcgccggatcatgaccgtccccttcttcaccaacaaggtggtggcgcagaaccgcgtcggctgggaggaggaggccaggctcgtggtggaggacgtgaaggccgacccggcgtccgccacggcgggcacagtgatccggcgcaggctgcagctcatgatgtacaacgacatgttccgcatcatgttcgaccgccgcttcgagagcgtggacgacccgctcttcaacaagctcaaggcgctcaacgccgagcgcagcatcctctcgcagagcttcgactacaactacggcgacttcatccccatcctccgccccttcctccgcaagtacctcaaccgatgcaccaacctcaagaccaagaggatgaagctcttcgaggaccacttcgtcgcagaccgcaagaaggcgctggagcagaatggggagatcaggtgcgccatggaccacatcctggaggccgaaaggaagggggagatcaaccacgacaacgtcctctacatcgtcgagaacatcaacgttgctgccatcgagacaaccctgtggtcgatcgagtggggcattgccgagctggtgaaccacccggacgtccagtccaagctccgcgacgagatggccgccgtgctgggccccgacgtggcggtgacggagccggacctcgagcgcctcccgtacctgcagtccgttgtgaaggagacgctccgcctccgcatggccatcccgctgctcgtgccgcacatgaacctcagcgacgccaagctcgccggctacgacatccccgccgagtccaagatcctcgtcaacgcctggttcctcgccaacgaccccaagcggtgggtgcgcgccgacgagttcaggcccgagcgcttcctcgaggaggagaaggccgtcgaggcccacggcaacgacttccgcttcgtgcccttcggcgtcggccggcggagctgccccgggatcatcctggccctgcccatcatcggcatcacgctcggaagcctcgtgcagaacttccaactgctgccgccgccggggcaggacaagatcgacaccaccgagaagcccggacagttcagcaaccagatcctcaagcacgccaccgtcgtctgcaagccgctcgaggcctagaattttctatttgatcatatggaggcttctgacatgcgtgtctgtgcatgcatgcgtgaacgctggtgccgggagatcgatctatgcacgcatgtgatgtgtattttcctttttttgtgcttttattttacttagttgcatttttgttggtcttcatgtgaggcgtcatgttgtagatttactatgttggtgataatgatgtaaacttcttcactgcgaagtgagacgattactcatcagttacctgcccg

SEQ ID NO: 5064 - DNA, 1592 bp, Secale cereale
ccggggcccccggtgccccgatcgtgggcaactggctccaggtgggtgatgacctcaatcaccgcaacctcatgggcatggccaagcgcttcggcgaggtgttcctcctacgcatgggcgtccgcaacctcgtggtcgtctccagtcctgagctcgccaaggagtgctccacacccagggcgtcgagttcggctcccgcacccgcaacgtcgtcttcgacatctttaccggcaaaggccaggacatggtgttcacagtgtacggcgaccactggcgcaagatgcgccggatcatgacggtgcccttcttcaccaacaaggtggtggtgcagaaccgcgtggggtgggaggaggaggcccggctggtggtggaggacctcaaagccgacccggcgtcagccactggcgtggtgatccgccgcaggctgcagctcatgatgtacaacgacatgttccgcatcatgttcgaccgccggttcgagagcctcgccgacccgctcttcaacaagctgagggcgctcaacgcggagcgcagcatgctctcgcagagcttcgactacaactacggcgacttcatccccatcctccgccccttcctccgcggctacctcaaccggtgcaccaacctcaaggccaagaggatgaaagtcttcgaggaccacttcgtccaagagcgcaagaaggcgttggagaagaacggtgagatcagatgcgccatggaccacatcctcgaggccgaaaggaagggcgagatcaaccacgacaacgtcctgtacatcgtcgagaacatcaacgtcgcagcaatcgagacgaccctgtggtctatcgaatggggagtcgcggagctggtgaaccacccggacatccagtcaaagctccgccatgagatcgccgccgtgctaggccctgatgcagcggtgacagagccggacctggagcgtctcccctacctgcaagccgtcgtcaaggagactctccgcctccgcatggccatcccgctcctagtgccacacatgaacctcaaggacgccaagctcgcaggctacgacatccccgccgagtccaagatcctcgtcaacgcctggttcctcgccaacgaccccaagcgctgggtgcgcgccgatgagttccggccagagcggttccttgaggaggagaggtccgtcgaggccaacggcaacgacttccggttcgtgcccttcggtgttggccggaggagctgcccggggatcatcctcgcgatgcccatcatcggcatcacgcttggccgcctggtgcagaacttccagcttctgccgccgctggggcaggacaagatcgacaccacggagaagcctggacagttcagcaaccagatccgcaaccacgccaccgtcgtctgcaagccgctcaaggcttagaagattttttggtccgacgagctagacgaaggatccgctggcatgcatgcgcgtgattgaataagtattttggttttgtaataagtttactttttctttgtgttcggttatttttcttcatgtgaggcaccaggtcgttggtttgcaaacttggtaatgttgatgtaaaagttttcgtcccaaattcacgtta

SEQ ID NO: 5065 - DNA, 1839 bp, Secale cereale
ctcccccaccggaagcaccacaggagccccacaccgcacctaccccggccgcgatggacgtcctcctcctggagaaggccctcctgggcctcttcgccgcggcggtgctcgccatcgccgtcgccaagctcaccggcaagcgcctccggctccccccggcccctccggcgcccccatcgtcggcaactggctccaggtcggcgacgacctcaaccaccgcaacctgatggacatggcgaagcggttcggcgaggtgttcctcctccgcatgggcgtccgcaacctggtggtcgtctccagccccgagctcgccaaggaggtcctccacacccagggcgtcgagttcggctcccgcacccgcaacgtcgtcttcgacatcttcaccggcaagggccaggacatggtgttcacggtgtacggcgaccactggcgcaagatgcggcggatcatgacggtgcccttcttcaccaacaaggtggtggcgcagaaccgcgtggggtgggaggaggaggcccggctggtggtggaggacctcaaggccaacccggcgtcggcgacggagggcgtggtggtccgccgcaggctgcagctcatgatgtacaacgacatgttccgcatcatgttcgaccgccgcttcgagagcgtggacgacccgctcttcaacaagctcaaggcgctcaacgccgagcgcagcatcctctcccagagcttcgactacaactacggcgacttcatccccgtcctccgccccttcctccgccgctacctcaaccgctgcaccaacctcaagaccaagcggatgaaggtgttcgaggaccacttcgtccagcagcgcaaagaggcattggagaagacgggtgagatcaggtgcgccatggaccatatcctggaagccgaaaggaagggcgagatcaaccacgacaacgtcctctacatcgtcgaaaacatcaacgtcgcagccattgagacgaccctgtggtcgatcgagtggggcatcgcggagctggtgaaccacccggagatccagcagaagctgcgcgaggagatcgtcgccgttctgggccctggcacggcggtgacggagccggacctggagcgccttccctacctgcagtccgtcgtgaaggagacgctccgcctccgcatggccataccgctcctggtgccgcacatgaacctcagcgacgccaagctcgccggctacgacatccccgccgagtccaagatcctcgtcaacgcctggttcctcgccaacgaccccaagcggtgggtgcgcgccgacgagttcaggcccgagcggttcctcgaggaggagaaggccgtcgaggcccacggcaacgacttccggttcgtgcccttcggcgtcggccgccggagctgccccgggatcatcctcgcgctgcccatcatcggcatcacgctcggacgcctggtgcagaacttccagctgctgcccccgccggggcaggacaagatcgacaccaccgagaagcccggtcagttcagcaaccagatcctcaagcacgccacgatcgtctgcaagcccctcgaggcttaagtaaactgaggtttcggtcatggccgcacgctggcgcggggagatcgtcctttgcatgtgactgtgtattttgccttttctttttggtgttttgcagtagtaagtttaatttttctttggtgttgggctatttgtcttcatgcatgtgaggcgtcgtgttgtaaatctacatatagttggcaatgtgatgtaaaacttaatggctccaaagacgacatgattacaattttgacaactacgaaaaaggtacaaatcattgctactctctccgtacataaata

SEQ ID NO: 5066 - DNA, 1578 bp, Saccharum officinarum
ggctccgagctcgccaaggaggtgctccacacgcagggcgtggagttcgggtcccgcacccgcaacgtcgtcttcgagatcttcacggggaagggccaggacatggtgttcaccgtgtacggcgaccactggcgcaagatgcggcggatcatgacggtgcccttcttcaccaacaaggtggtcgcgcagaaccgcgccgggtgggaggaggaggcccgcctcgtggtggaggacgtgcggcgggaccccagggccgccgccgagggcgtcgtgatccggaagcgcctgcagctcatgatgtacaacgacatgttccgcatcatgttcgaccggaggttcgagagcgaggaggatccgctcttcaacaagctcaaggcgcttaacgccgagaggagccgcctgtcgcagagcttcgagtacaactatggcgacttcatccccgtgctccgcccgttcctccgtgggtatcttaacagatgccacgacctcaagaagcgccgcatgaaggtcttcgaggacaacttcgtccaggaacgcaagaaggtgatggctcagactggtgagatccggtgcgccatggaccacatcctcgaggccgagaggaaaggcgagatcaaccatgacaacgtcctctacatcgtcgagaacatcaacgtcgcagcgatcgagacgacactgtggtcgatcgagtggggcgtcgcggagctggtgaaccacccggcgatccagtccaagctccgggaggagctggcctcagtgctgggtgccggcgtgcctgtgacggagccggacctcgagcgcctcccctacctccaggccatcgtcaaggagacgctccgcctgcgcatggccatcccgctgctggtgccccacatgaacctcaacgacggcaagctcgtcggctacgacatccccgccgagtccaagatcctcgtcaacgcctggttcctcgccaacgaccccaagaggtgggtgcggcccgacgagttccggccggagcgcttcctggaggaggagaagaccgtggaggcacacggcaacgacttccgcttcgtgcccttcggcgtcggccgccggagctgccccgggatcatccttgcgctgcctatcatcggcatcaccctgggcaggctcgtgcagaacttccagctgctgccgccgccgggccaggataagatcgacaccacggagaagcccggccagttcagcaaccagatcgccaagcacgccaccatcgtctgcaagcccctcgaggcctagagatcaatgcgtgttccatgcacgcgcccccgcagatccagcactatgtattttgtctttttctctttttttgtttttgttttttgtactaagaggagatgcgtctgttgtttgtgttggccctcgagtctagagtgaagatgggggtacatgtagctgaggaatggtgttggatatttacttggttatgttctcaaaaacttatccgtaatttatatgttgtaaatttaaatttaaaaaaaaaatacatcaaatataaataaaatatatatctccttcaaaaaatttttatttataataaaataaagataattttgg

SEQ ID NO: 5067 - DNA, 906 bp, Echinochloa colona
gcttggctgcagccatggcggcctccacggcgctctccactgccgccaaccccacccagctctgccgtcccctcggcgcctcatcgctgggcaagccggtgaagggcctgggccttggccgggagcgcgcccagcggagcagcatcacgtgccaggcggcgagcatctccgccgaccgcgtcccggacatggagaagcggaagctgatgaacctcctcctcctcggcgccatctcgctgcccaccgtcggcatggtcgtcccctacggcgccttcttcgtccccgccgggtccggcggcgccggcggcgggacgtacgccaaggacaagctgggcaacgacatcaaggtggaggactggctcaacacgcacggccccaacgaccgcacgctggcgcaggggctcaggggcgacccgacctacctggtggtggagcaggacaagacgctggccacctacggcatcaacgccgtctgcacccacctggggtgcgtcgtgccatggaacagcgccgagaacaagttcatctgcccgtgccacgggtcccagtacaacaaccagggcagggtcgtccgtggcccggcgccactgtcgctggccttggtgcacgccgacgtcgacgacggcaaggtgctcttcgtcccgtgggtggagaccgacttcaggaccggcgaggacccgtggtggaaggcgtaaggcggcctccggcaccggcagcagcggcggcgctcaccggcatcctgtgatgagttcatcgtagcattgcgtcgttcctgcgttcgttatcagagggcgtataaatttcgcttgcttcttgcctcccaattacatatgtacacacactgtatgaaagagaacacctgtttctctcatctctgcatatatactcttttcaagactactaaag

SEQ ID NO: 5068 - DNA, 940 bp, Echinochloa colona
ctcggcccgaccatcaccagcaacccgatcctcccctgcttggctgcagccatggcggcctccacggcgctctccaccgccgccaaccccacccagctctgccggccccgcggcgcttcgtcgctggccaagccggtgaagggcctgggtctgggccgggagcgcgcccagcggagcagcatcacgtgccaggcggcgagcagcatctccgccgaccgcgtccccgacatggagaagcggaagctgatgaacctcctcctcctcggcgccatctcgctgcccaccgtcggcatggtcgtcccctacggcgccttcttcgtccccgccgggtccggcggctccggcggcgggacgtacgccaaggacaagctgggcaacgacatcaaggtggaggactggctcaacacgcacggccccaacgaccgcacgctggcgcaggggctcaggggcgacccgacctacctggtggtggagcaggacaagacgctggccacctacggcatcaacgccgtctgcacccacctggggtgcgtcgtgccatggaacagcgccgagaacaagttcatctgcccatgccacgggtcccagtacaacaaccagggcagggtcgtccgtggcccggcgccactgtcgctggccttggtgcacgccgacgtggacgacggcaaggtgctcttcgtcccgtgggtggagaccgacttcaggaccggcgaggacccgtggtggaaggcgtaaggggggctccggtaccggcagcagcggcgctcaccggcgtcctgtgatgagttcatcgtagcattgcgttcctgcgttcgttgtcagagggcgtataaattcgcttgcttcttgcctcccaattatatatgtatgtacacacactgtataaaagaagaacacctgtttctcatctctgcacagtcgtggtgtggtcggcgtctct

SEQ ID NO: 5069 - DNA, 945 bp, Echinochloa colona
caaggcctcgcctcgacccgaccctccgccccagcaatccgatcctcccctgcttggctgcagccatggcggcctccacggcgctctccaccgccgccaaccccacccagctctgccgtcccctcggcgcctcgtcgctgggcaagccggtgaagggcctgggcctgggccgtgagcgcgcccagcggagcagcagcatcacgtgccaggcggcgagcagcatccccgccgaccgcgtccccgacatggagaagcggaagctgatgaacctcctcctcctcggcgccatctcgctgcccaccgtcggcatggtcgtcccctacggcgccttcttcgtccccgccgggtccggcggcgccggcggcgggacgtacgccaaggacaagctgggcaacgacatcaaggtggaggactggctcaacacgcacggccccaacgaccgcacgctggcgcaggggctcaggggcgacccgacctacctggtggtggagcaggacaagacgctggccacctacggcatcaacgccgtctgcacccacctggggtgcgtcgtgccatggaacagcgccgagaacaagttcatctgcccatgccacggatcccagtacaacaaccagggaagggtcgtccgtggcccggcgccactgtcgctggccttggtgcacgccgacgtggacgacggcaaggtgctcttcgtcccgtgggtggagaccgacttcaggaccggcgaggacccgtggtggaaggcgtaagggggctccggcaccggcagcagcggcgctcaccggcttcctgtgatgagtccatcgtagcattgcgttcctgcgttcgttgtcagagggcgtataaattcgcttgcttcttgcctcccaattacatatgtacacacactgtatgaaagaagaacacctgtttctcatctctgcatatattctcttttcaata

SEQ ID NO: 5070 - DNA, 1178 bp, Setaria italica
cgcgtgccacggccgcgcgcccctcgcaacatgtggtcgtcgcggcccggtcgctgcgcatcaaccaatcaccggccgccctccccccctccaccagggacacacacacatatagccccggggctcatccgcaagcctgtggacgccagcgacagaagcctcgctcgacacctcccccagcaatccgatcctcccttccctgcagccatggcggcctccacggcgctctccaccgccgccaaccccacccagctctgccggccccgcgctgcttcttcgctgggcaagccggtgaagggcctcggcctcgggatgggccggcggagcatcacgtgccaggcggcgagcagcatccccgccgaccgcgtccccgacatggagaagcggaagctgatgaacctcctcctcctgggcgccatctcgctgcccaccgtcggcatggtcgtcccctacggcgccttcttcatccccgccgggtccggcagcgccggcggcgggacgtacgccaaggacaagctgggcaacgacatcaaggtggacgagtggctcaagacccacggccccaacgaccggacgctggcgcaggggctcaagggcgacccgacgtacctggtggtggagcaggacaagacgctggccacctacggcatcaacgccgtctgcacccacctggggtgcgtcgtgccgtggaacagcgccgagaacaagttcatctgcccctgccacggctcgcagtacaacaaccagggcagggtcgtccgtggcccggcgcccctgtcgctggccctggtgcacgccgacgtcgacgacggcaaggtcctcttcgtcccgtgggtggagaccgacttcaggaccggcgaggacccgtggtggaaggcataagggggcttcctcgatcttcctgtctgtcatcagctgctcgtagccttgagttcctgtgttccttctctgagggagggctataaattcacttactccatgcctccaaactattacatatgtacacaacacactgtatgaaacaagaacacctctgtttctcatctctgcatatacaacctttttgattgaagactctaaaatctgctggaatggaatgatgaccatttttgcaatgccagtagcaggtcatccgctgagcttcgcatctacattcatttcaatatgagcgacggcga

SEQ ID NO: 5071 - DNA, 1088 bp, Setaria italica
cgcgtgccacggccgcgcgcccctcgcaacatgtggtcgtcgcggcccggtcgctgcgcatcaaccaatcaccggccgccctccccccctccaccagggacacacacacatatagccccggggctcatccgcaagcctgtggacgccagcgacagaagcctcgctcgacacctcccccagcaatccgatcctcccttccctgcagccatggcggcctccacggcgctctccaccgccgccaaccccacccagctctgccggccccgcgctgcttcttcgctgggcaagccggtgaagggcctcggcctcgggatgggccggcggagcatcacgtgccaggcggcgagcagcatccccgccgaccgcgtccccgacatggagaagcggaagctgatgaacctcctcctcctgggcgccatctcgctgcccaccgtcggcatggtcgtcccctacggcgccttcttcatccccgccgggtccggcagcgccggcggcgggacgtacgccaaggacaagctgggcaacgacatcaaggtggacgagtggctcaagacccacggccccaacgaccggacgctggcgcaggggctcaagggcgacccgacgtacctggtggtggagcaggacaagacgctggccacctacggcatcaacgccgtctgcacccacctggggtgcgtcgtgccgtggaacagcgccgagaacaagttcatctgcccctgccacggctcgcagtacaacaaccagggcagggtcgtccgtggcccggcgcccctgtcgctggccctggtgcacgccgacgtcgacgacggcaaggtcctcttcgtcccgtgggtggagaccgacttcaggaccggcgaggacccgtggtggaaggcataagggggcttcctcgatcttcctgtctgtcatcagctgctcgtagccttgagttcctgtgttccttctctgagggagggctataaattcacttactccatgcctccaaactattacatatgtacacaacacactgtatgaaacaagaacacctctgtttctcatctctgcatatacaacctttttgattgaagactctaaaatctgct

SEQ ID NO: 5072 - DNA, 2158 bp, Pennisetum glaucum
ccccagggctcatccgcaagcctgtggacgccagcgacacaagcctccttcggtccttccccagcaatcgatccccccctcccagcagccatggcggcctccacggcgctctccaccgcctccaaccccacccagctctgccggccccgcgcttcttctccggtgggcaagccggtgaagggcctaggcggcctcggtatgggccggcggagcatcacgtgccaggcggcgagcagcatccccgccgaccgcgtccccgacatggagaagcggaagctgatgaacctcctcctcctcggcgccatctcgctgcccaccgtcggcatggtcgtcccctacggcgccttcttcgtccccgccgggtccggcggcgccggcggcgggacgtacgccaaggacaagctggggaacgacatcaaggtggaggagtggctcaagacgcacgggcccaacgaccggacgctggcgcaggggctccggggcgacccgacgtacctggtggtggagcaggacaagacgctggctacctacggcatcaacgccgtgtgcacccacctcggttgcgtcgtgccgtggaacagcgccgagaacaagttcatctgcccctgccatggctcccagtacaataaccagggcagggtcgtccgtggcccggcgccattgtcgctggccttggtgcacgccgatgtcgacgacggcaaggtcctcttcgtcccgtgggtggagaccgacttcaggaccggcgaggacccgtggtggaaggcataaggaggggggcttcgtcgatgttcctgtctgtcatcagctgctcactgctcttaccttcggcgttcctgtgttccttctctgagggagggctataaattcacttactccatgcctccacaccattatatatgtacacaacacactgtatgaaacaagaacacctctgttttctcatctctgcatgcatatgcaaaccttttttgattccggaactctgaagccgtattgttttatagaaattaatggtctcaaattagcttctcctgagaatatctacaaggttatatacgaacagttgagtgggcatagggttgggtggaaaaaggctcttcactatttaacagagcatttttcaggtgtttcaaaaattggaaagcaagcaaaccagccaataattttgctcattgatgagcttgatcttcttttgacaagaaaccagtcggtgctgtataacattcttgattggcccaccaaaccaaattctaacctagttgttataggcatagcaaacacaatggatcttccggaaaagttattgccacgtatatcaagtcggatgggtatacaacgactgtgttttggcccgtacaattttcgccaattgcaggaaattataacaagtcgtctaaagggtattgatgcctttgaggatcaggcgattgaatttgcttctagaaaggtagctgctatgtcaggtgatgctaggcgagctttagaaatttgtagacgggcagcagagttcgcagactaccgtatcaaacagtctcaacagtctgggaagacttgtgcaaataaaggagacggtgttgtttgcatgggtgatatagaagctgctattcaggaagtcttccaggcaccacacattcaagtgatgaggaactgcccaaagtttggaaaagtcattttggtcgctatggttcatgaattgtacaagagtggactaggtgaagtaacttttgagaagttagcagcaacagttctgtcctggtgccacgtcaatagagaactcttgcctggatatgacactctcatgaaaatctgctgcaagcttggtgaaagcaaggtcatccttagcgaagaaggtagtaagcacaagttgcagaagctgcaacttaactacccaagtgacgacataacatttgccctcaaggaatctcccgatcttccttggttgtccaagtacttgtgactgcagtgggtcctattcctagcattgtgttctgttctctaggagtcgttggtacttgccacataatctgcaaacctgaagctacacaagattaatggagaatcctctgatctgcaaatgtaatgtaactgttgaagctgcgccgcgccgaaagcatcacatacattttccctctgtcaatacccaaagcaacctgtacgt

SEQ ID NO: 5073 - DNA, 1570 bp, Panicum virgatum
ggctaaatagtaaaatatacgggcgggcgcgggccgggccttgtgccctggactcactggctaaattggaggcaaccagtcgaagccgccgtgtgcgagtgcgagccacgttcactaatccaaggtgacccaagatacttgtgttgccaaaaacgcccaaagccacacccaggggaggaggggagcgataaccctgcgcgcgtgtgccacagccgcgcgcccctcgcaacatgtgtggccgtcgcggtcgcggccccgtcgctgcgcatcaaccaatcaccgcccgccttactgagcgtacgacacagacatgagatagccccggggctcatccgcaagcctgtggtcgccagcgacactagcctcttccttgctccttccctccctccccagcaaccgatcctcccctccgcctgctgctgcagcagcagccatggcggcctccacggcgctctccacctccgccaaccccacccagctctgccgcccccgcgcctctcccaacaagccggcgaagggcctgggcctcgggacaggccgcgaccgcttctcccagcgcagcagcggcggcggcgtcacgtgccaggcggcgagcagcatccccgccgaccgcgtccccgacatggagaagcgcaagctgatgaacctcctcctcctgggcgccatctcgctgcccaccgccggcatgctcgtcccctacggctccttcttcatccccgccgggtccggcggcgccggcggcggcacctacgccaaggacaagctgggcaacgacatcaaggtggaggagtggctgcagacgcacggccccaacgaccgcaccctcgcgcaggggctcaagggcgacccgacctacctggtggtggagcaggacaagacgctggccacctacggcatcaacgccgtctgcacccacctcggctgcgtcgtgccctggaacagcgccgagaacaagttcatctgcccctgccacggctcccagtacaacaaccagggcaaggtcgtccgtggcccggcgcccctgtcgctggccctggtgcacgccgacgtcgacgacggcaaggtgctcttcgtcccgtgggtggagaccgacttcaggaccggcgaggacccctggtggaaggcgtaagcgggggcgctccggcggcggcggcgatcgccgtcacccagtgatgagctcatagcctttgcgttcctgtgttgctgcttctcagagggcgttatcgctataaattcacttgcttcttgcttgctgcctccagattatatgttgtacacagcacactgtatgaaacaagaacacttgcttctcatctgatctgcatatacataacctttctcgagactctgaaattctgctggaatggatcggaatggacacctttcttgccagcgacagggcatccatctcctgagccaggcatctgcatgactgcatccatttcaaaatggcgtaaccacagtatttttttgccagaacatcgtgcagctgttctgtttctgtatttttacaagttcctgctctctcttgctgtgataagtgataactctcaagcgattgaaatcgaca

SEQ ID NO: 5074 - DNA, 980 bp, Cynodon dactylon
gccgggggtggacccactggcactcgccccgacttgcggatcctccttcgcctacctgcaacgagccagagagagctagctgctgagcagccatggccgcctccacggcgctctccaccgccgccaaccccacccagttgtgccggtcccggtcttcgctgggcaagccggtgaagggtctgggcttcggccgggagcgcgccttgaggaccgtgacatgccaggcgggcagcatcaccgccgaccgcgtccccgacatggagaagcgcaagctgatgaacctcctcctgctcggcgccatctcgctcccggtgggcggcatggtcctcccgtacggcgccttcttcgtccccggcgggtcggggagcggcggcggcggggtctacgccaaggacaagctcggcaacgacgtcaagatcgacgaatggctcaagacgcacggccccaacgaccgcacgctcacgcaggggctcaagggtgaccccacgtacctggtcgtggagcaggacaagacgctggccacctacggcatcaacgccgtctgcacccacctgggatgcgtcgtgccgtggaacgccgccgagaacaagttcatgtgcccgtgccacggatcccagtacaacaaccagggcaaggtcgtccgtggaccggcgccactgtcgctggccttggttcacgccgacgtcgacgacggcaaggtcctcttcgtcccgtgggtggagaccgacttcaggaccggcgaggacccctggtggaaggcataagaagctcctaatggcagcagcagggcacttctgtgagcagaccatagcttattcgttctcggaagggcatttcttgctacaagttcctcacttgcttcttgctcccgaattatatacgtacacacactgtatgaaagaagaaaactgttttgtttcatcctcctgcatgtataattaacctttttgcagactctgaaatctgttggaatggagacc

SEQ ID NO: 5075 - DNA, 2072 bp, Panicum virgatum
cacagcaggtagctagtgtatttaactgacaggatccatatatagatgataacaacaatatattgcttctataaagataattaaatctaggaaaaaaacgataaaactaaaattatataccttttgagacgcagagagtatcctcaggacccgcgtgcttaaaaataaaattgagcatgctcttttttcactcaattgagcatggtctttcgaaaagaaaaaaaaagaatcgagcacggccgggccgggccttctgccctggactcactggctaaattggaggcaaccagtcgaagccgtgtgcgagccacgttcactgatccaaggagacccaagatacttcttgttgccaaaaacgcccaagctgagccacacccaggagagataaccgtgcgcgcgcgtgccacagccgcgcgcccctcgcaacatgtgtggccgtcgcggccccgtcgctgagcatcaaccaatcaccgcccgccttgcattgctggagcgagcgacacagatatgatgatatagccccggggctcatccgcaaccctgtggtcgccagcgacactgctagtaacctcgacctcccttcctccccagcaaccgatcctcatctccgcctgcagcagcagcagcagcagccatggcggcctccacggcactctccaccgccgccaaccccacccagctctgccgcccccgcgcctctcccaacaagccggccgtcaagggcctgggcctcgggacgggccgggaccgcttctcccagcggcggagcagcagcagcgtcacgtgccaggcggcgagcagcatccccgccgaccgcgtccccgacatggagaagcgcaagctgatgaacctcctcctcctgggcgccatctcgctgcccaccgccggcatgctcgtcccctacggctccttcttcatccccgccgggtccggcggcgccggcgacggcacgtacgccaaggacaagctgggcaacgacatcaagttggaggagtggctgcagacgcacgggcccaacgaccgcaccctggcgcaggggctcaagggcgacccgacgtacctggtggtggagcaggacaagacgctggcctcctacggcatcaacgccgtgtgcacccacctcggttgcgtcgtgccgtggaacggcgccgagaacaagttcatctgcccctgccacggatcccagtacaacaaccagggcaaggtcgtccgtggcccggcgcccctgtcgctggccctggtgcacgtcgacgtcgacgacggcaaggtgctcttcgtcccgtgggtggagaccgacttcaggaccggcgaggacccctggtggaaggcataagcggcggcgttgtcctgtctgccatctcagaggacgttacgttactgctggcttccagattatatatgtacacaacaggctgtatgaaacaagaacacatgcttctcatcagatctgcatatatataacctgaacaggtcatagcctgaactcctggtgtgttctcattcgttttgctacatacgatctcaccggctattaaaacatcagtgattcatagcctcaaatcatacgtagtacattacgtgcttcacgggcatatgaggagtgcaggtataaaagcagaagtatttagaaatgttaagaactagtcagttactactaaccaagtgaaggcagcaaaatcatttagaaaatctgaaaatgcatgatctaggcagactctaacaaccctaaatcaatttatatacatgcagtaaaagcctcaggaagagatgtgcagctgaaatgctgaatggaagggaagcaagtaaaagacaaaatccaggagggggtgaaacatcagtggatacaagagaaaggtggcgctggaaggacaatatggaagaaaattagagctgctcagcatgggacgagggagcaggcctaaaaaccaaaccaagaaagcagtatgggaaatggtaaacaactgagcagaaggttgtagaaataattatgttctatctttgcaatttggagccttaaaaggtagaaagggtaaatgaaatattttcataaaagaaaataatcaaccaaaact

SEQ ID NO: 5076 - DNA, 1146 bp, Oryza sativa
gtggacaccctgcgctgcagccgaacgaccgagctaccgagctaatccagccatggcctccaccgcgctctccaccgcctccaaccctactcagctgtgcaggtctcgcgcctcgctgggcaagcccgtcaagggcctgggcttcggccgggagcgcgtgccgaggacggcgacgaccatcacatgccaggccgcgagcagcatcccggccgaccgcgtcccggacatgggcaagcgccagctgatgaacctcctcctgctcggcgccatctcgctccccaccgtcggcatgctcgtcccctacggcgccttcttcatccccgccgggtccgggaacgccggcggcgggcaggtcgccaaggacaagctcggcaacgacgtgctcgccgaggagtggctcaagacacacggccccaacgaccgcaccctcacccaggggctcaagggtgacccgacgtacctcgtcgtggaggccgacaagacgctggccacgtacgggatcaacgccgtgtgcacgcaccttgggtgcgtcgtgccgtggaacgccgccgagaacaagttcatctgcccctgccacggctcgcagtacaacaaccagggcagggtcgtccgtggacctgctcccctgtcgctggcattggtgcacgccgacgtcgacgacggcaaggttctcttcgtgccgtgggtggagaccgacttcaggaccggcgacaacccgtggtgggcgtaagctataacaacatgatccatatcatcatcagcagcaaagttcacttgtgtgatcagcttgtagctataagtccgctgtatctgagaaacgctgctgtaaatccatcttcactttgtttttccaaattatatgtacacacactgtcacactgtatgaaagagcataaaacccttttcactgcataagtaaccctttttgagggttatgaatctgtgagatggatactcttttatagcagatcataccttagatgtcttcctgaatatgggcatttctgcatctgcactacactctgaaactgaaagactgaagaattcagggcataagatagcatatatagagaattgtttcagagcaattgcatgagtttgatttgttttgaccttgagaaacataagttggcctggttctctttc

SEQ ID NO: 5077 - DNA, 1372 bp, Hordeum vulgare
gtcggagccggtttgctgcgcatcaaccaatcaccggccgcctcttctccacttcccgcagggacatataacccgtgcctcatctgcaagcctgtggtggacacaggcagtgctagctcgctcgctcgatcgtcctctccgccctgtagcagccagccaccatggcctccaccgcgctctccaccgcctccaaccccacccagctctgccgaacccgtgcgagctcgctatgcaagcccgtcaagggcctgggcttcggccgggagcgcatcccgaggaacatcacatgcatggccggcagcatctccgcggaccgcgtcccggacatgagcaagagggagctgatgaacctcctgctgctgggcgccatctcgctccccaccttcggcatgctcgtcccctacggctccttcctcgtcccggccggctccgggagcaacgccggaggggtcgccgccaaggacaagctcggcaacgacatcctcgtcgaggattggctcaagacgcacggccccaacgaccgcacgctcgcccaggggctcaagggtgatcctacctaccttgtggtggagtccgacaagaccctcgccacctacgggatcaacgccgtctgcacgcatcttggctgcgtcgtgccttggaacgccgccgagaacaagttcctctgcccttgccatggatcccagtacaacaaccagggcaaggttgtccgtggacctgcacctctgtcgctggccctcgttcacgccgacgtcgacgacggcaaggtcgtcttcgtgccatgggtggagaccgacttcaggaccggcgagaacccgtggtggaaataagcgacacaagctccggcagcaaagctcactcgtgtgatatgttaagcctcctgccagtcctaagaacgctgctataagagtactcctgctataaatgcacctgtttcttgtatccagttatatgtatacagtctatgaaagaagagaaaccttttcattgcatataagtagtagttgtatcatattttgaggactcagaatctggtacgacgtagacactttttccatagctgatcaaacctgaaacacatctcctgaatttagacaccccaatatttgttgttggagagaattagtctagttctcccaacaacaaatatgtaggaacaaaggaagtagtagtaatagttaaagagctaggatggcatatctgcagcatttgtttcaaaagggcaatgcagagtcgatctgttctggaaacgatacgagccactgtctctagaggctattctctcaagtaggagtatctggcatagcttctctgttcagaaacgacactttcctcttgaatcaagtcaacaatggaactttaattcgttctc

SEQ ID NO: 5078 - DNA, 894 bp, Pseudoroegneria spicata
ggcagtgctcgctcgctcgatcgtcctctccggctccgccccgtagcagccagccaccatggcctccaccgcgctctccaccgcctccaaccctacccagctctgccggacccgcgcaagctcgctgtgcaagcccgtcaagggcctgggcttcggccgggagcgcatcccgaggaacatcacgtgcatggccggcagcatctccgccgaccgcgtcccggacatgagcaagagggagctgatgaacctgctcctgctgggcgccatctcgctccccaccttcggcatgctcgtcccctacggctccttcctcgtcccggccggctccgggagcaacgccggaggggtcgccgccaaggacaagctcggcaacgacatcctcgtcgaggactggctcaagacgcacggccccaacgaccgcacgctcgcccaggggctcaagggtgatcctacttaccttgtggtggagtccgacaagaccctcgccacctacgggatcaacgccgtctgcacgcatcttggctgcgtcgtgccgtggaacgccgccgagaacaagttcctctgcccttgccatggatcccagtacaacaaccagggcaaggttgtccgtggacctgcacctctgtcgctggcccttgttcacgccgatgtcgacgacggcaaggtcgtcttcgtgccatgggtggagaccgacttcaggaccggcgagaacccgtggtggaaataagccacacaagctccagcagcaatgctcacttgtgtaatatgttaagcccattatagcctcctgccactcctaagaacgctgctataagagttctcctgctatacatgcacctgtttcttgtatccagttatatgaaagaagagaaacttttccattgcaaaaaaaaa

SEQ ID NO: 5079 - DNA, 896 bp, Leymus cinereus x Leymus triticoides
gcacgagggtgctagctcgctcgatcgtcctctccgccctgtagcagcagccaccatggcctccaccgcgctctccaccgcctccaaccctacccagctctgccggacccgtgcaagctcgctatgcaagcccgtcaagggcctgggcttcggccgggagcgcgtcccgaggaacaccacctgcatggccggcagcatctccgccgaccgcgtcccggacatgagcaagagggagctgatgaacctcctcctgctgggcgccatctcgctccccaccttcggcatgctcgtcccctacggctccttcctcgtcccggccgggtccgggagcaacgccggaggggtcgccgccaaggacaagctcggcaacgacatcctcgtcgaggactggctcaagacgcatggccccaacgaccgcacgctcgcccagggactcaagggtgatcctacctaccttgtggtagagtccgacaagaccctcgccacctacgggatcaacgccgtctgcacgcatcttggctgcgtcgttccgtggaacgccgccgagaacaagttcctctgcccttgccatggatcccagtacaacaaccagggcaaggttgtccgcggacctgcacctctgtcactggccctagttcacgccgacgtcgacgacggcaaggtcgtctttgtgccatgggtggagaccgacttcaggaccggcgagaacccgtggtggaaataagcgacacaagctccagcagcaatgctcacttgtgtgttaaacccgcccattatagcctcctgccactcctaagaacgctgctataagagtactgctataaatgcacctgtttcttgtatccagttatatgtatacagtctatggaagaagagaaaccttttcattgcaaaaa

SEQ ID NO: 5080 - DNA, 1172 bp, Secale cereale
gggacacacacaggcagtgctcgctcgatcgtcctctccggctccgccctgtagcagccagccaccatggcctccaccgcgctctccaccgcctccaaccctacccagctctgccggacccgcgcaagctcgctgtgcaagcccgtcaagggcctgggcttcggccgggagcgcatcccgaggaacatcacctgcatggccggcagcatctccgcggaccgcgtcccggacatgagcaagagggagctgatgaacctgctcctgctgggcgccatctcgctccccaccttcggcatgctcgtcccctacggctccttcctcgtcccggccggctccggcagcaacgctggaggggtcgccgccaaggacaagctcggcaacgacatcctcgtcgaggactggctcaagacgcacggccccaacgaccgcacgctcgcccaggggctcaagggtgatcctacctaccttgtggtggagtccgacaagaccctcgccacctacgggatcaacgccgtctgcacgcatcttggatgcgtcgtgccgtggaacgccgccgagaacaagttcctctgcccctgccatggatcccagtacaacaaccagggcaaggttgtccgtgggcctgcacctctgtcgctggcccttgttcacgccgacatcgacgacggcaaggtcgtcttcgtgccatgggtggagaccgacttcaggactggcgagaacccatggtggaaataagcggcgcaagctccggcagcaatgctcactttgtgtgatatgttaagcctcctaagaacgctgctataagagtactcctgctataaatgcacctgtttcttgtatccagttatatgtactatacagtctacacttgaaagaagagaaaccttctcattgcatatagcatcacattttgagggctcggaatctggtacggcgtagactctttctttttctatagctgatcaaacctgaacacacatctcctgaatctagacaaactagatagcaatcggaatagttaaaagagctaggatggcatatttgtctgcagcatttgtttcaaaagggcaatgcaattgcagagtcgatctgttctgtaaatgatacaagtcactgtctctagaggctatcctctaagtactccctctgtaaagaaatattagtgatcagtc

SEQ ID NO: 5081 - DNA, 1005 bp, Secale cereale
acacacaggcagtgctcgctcgatcgtcctctccggctccgccctgtagcagccagccaccatggcctccaccgcgctctccaccgcctccaaccctacccagctctgccggacccgcgcaagctcgctgtgcaagcccgttaagggcctgggcttcggccgggagcgcatcccgaggaacatcacctgcatggccggcagcatctccgcggaccgcgtgccggacatgagcaagagggagctgatgaacctgctcctgctgggcgccatctcgctccccaccttcggcatgctcgtcccctacggctccttcctcgtcccggccggctccgggagcaacgcgggaggggtcgccgccaaggacaagctcggcaacgacatcctcgtcgaggactggctcaagacgcacggccccaacgaccgcacgctcgctcaggggctcaagggtgatcctacctaccttgtggtggagtccgacaagaccctcgccacctacgggatcaacgccgtctgcacgcatcttggatgcgtcgtgccgtggaacgccgccgagaacaagttcctctgcccctgccatggatcccagtacaacaaccagggcaaggttgtccgcgggcctgcacctctgtcgctggcccttgttcacgccgacatcgacgacggcaaggtcgtcttcgtgccatgggtggagaccgacttcaggactggcgagaacccatggtggaaataagcggcgcaagctccggcagcaatgctcactttgtgtgatatgttaagcctcctaagaacgctgctataagagtactcctgctataaatgcacctgtttcttgtatccagttatatgtactatacagtctacacttgaaagaagagaaaccttctcattgcatatagcatcacattttgagggctcggaatctggtacggcgtagactctttctttttctatagctgatcaaacctgaacacacatctccttaatctagacaaactagatagcaat

SEQ ID NO: 5082 - DNA, 1470 bp, Triticum aestivum
cgctacctccctccgttggtcgtcgttcggtcgacgtctcaagaagaggtaggtgtacacacgagagaggggggggcacaggcagtgctagctcgctcgctcgctcgatcgtcctctccgccgtgacgcagccagtcgccatggcctccaccgcgctctccaccgcctccaaccctacccagctctgccggacccgcgcaagctcgctgtgcaagcccgtcaagggcctgggcttcggccgggagcgcgtcccgaggaacatcacctgcatggccggcagcatctccgcggaccgcgtgccggacatgagcaagagggagctgatgaacctgctcctgctgggcgccatctcgctccccaccttcggcatgctcgtcccctacggctccttcctcgtcccggccggctccgggagcaacgccggaggggtcgccgccaaggacaagctcggcaacgacatcctcgtcgaggactggctcaagacgcacggccccaacgaccgcacgctcgcccaggggctcaagggtgatcctacctaccttgtggtggagtccgacaagaccctcgccacctacgggatcaacgccgtgtgcacgcatcttggatgcgtcgtgccgtggaacgccgccgagaacaagttcctctgcccctgccatggatcccagtacaacaaccagggcaaggttgtccgtgggcctgcacctctgtcgctggccctggttcacgccgacgtcgacgacggcaaggtcgtcttcgtgccgtgggtggagaccgacttcaggaccggcgacaacccgtggtggaaataagcgacgcaagctccggcagcaatgctcactcgtgtgatatgttaagcctcctgccagtcctaagaacgctgctataagactactcctgctataaatgcacctgtttcttgtatccagttatatgtatacagtctatggaagaagagaaaccttttcattgcatatatagtagtatcacattttgagggctctgaatctggtagtacctacgatgtagacgactctttttctatagcagatcaaacctgaacctgaatctacacctagatagcaatctgaatagttaaagaggtagcatggcatatctgcagcattgttcaaaagggcaatgcagagtcgatatgttctgggaatgatacaagccactgtctctagaggctattctctcaagtatatttggcatagcttctctgttcagaaacggcactttcctcttgaatcaagtcaacaatggaactctaattgtttctccctagttctactcgaagattcgagccattctaataagtagagaatcatccggatatgttcaaattagttcaaaaaaaactgggcatgttaatgccagaaaaagagcgggtcaggataaacagcaagtgtaaaaaatgaagaaatgaaacaatgtgggttaccaaaagcaagcaatcaaaaatttctggac

SEQ ID NO: 5083 - DNA, 1483 bp, Triticum aestivum
cgacggggcagtgggacctgtacggcagcgacgcggcgtcgccctacaacggcctgcagagcaagttcttcaacaccttcgccgcgcccttcaccaagcgggggctgctgctcaaggtgctgctgctcggcggcggctcgctgctcgcctacgtcagcgccaccgcctcccccgacctgctccccatcaagaaggggccccagctgccgcccaccccgggaccacgcggcaagatctaaatcccatccttcttcttccctcgtctcgcctcgtgcttgtgtaccatggatctcatctgatctgatggatctcccctatctatgtgttctgttgatacttgatcgttgtacttcgtatcagtaattggaaagatgctgcgtgcatggtgcacaagcacgaggcgagacgagggaagaagaaggatgggatttagatcttgccgcgtggtcccggggtggacacaggcagtgctagctcgctcgatcgatcgtcctctcaccaccatggcctccaccgcgctctccaccgcctccaaccccacccagctctgccggacccgcgcgagcgcgctgtgcaagcccgtcaagggcctgggcttcggccgggagcgcgtcccgaggaacatcacctgcatggccggcagcatctccgcggaccgcgtgccggacatgagcaagagggagctgatgaacctgctcctgctgggcgccatctcgctccccaccttcggcatgctcgtcccctacggctccttcctcgtcccggccggctccgggagcaacgccggaggcgtcgccgccaaggacaagctcggcaacgacatcctcgtcgaggactggctcaagacgcacggccccaacgaccgcacgctcgcccaggggctcaagggtgatcctacctaccttgtggtggagtccgacaagaccctcgccacctacgggatcaacgccgtctgcacgcatcttggatgcgtcgtgccgtggaacgccgccgagaacaagttcctctgcccctgccatggatcccagtacaacaaccagggcaaggtcgtccgtgggcctgcacctctgtcgctggccctggttcacgcggacgttgacgacggcaaggtcgtcttcgtgccgtgggtggagaccgacttcaggaccggcgacaacccgtggtggaaataagcgacgcaactccggcagcaatgctcacttgtgtgatatgttaagcctcctgccagtcctaagaacgctgctataagactactcctgctataaatgcacctgtttcttgtatccagttatatgtatacagtctatggaagaagagaaaccttttcattgcatatagcatcacattttgaggactcgggatctggtactacgatgtagacgactctttttctatagctgatcaaacctgaaacacacatctcctgaatctagacaacctagatagcgatctgaatagttaaagatctaggatggcatatctg

SEQ ID NO: 5084 - DNA, 796 bp, Avena sativa
ctcgatcgtcctctccgccgtgacgcagccagtcgccatggcctccaccgcgctctccaccgcctccaaccctacccagctctgccggacccgcgcaagctcgctgtgcaagcccgtcaagggcctgggcttcggccgggagcgcgtcccgaggaacatcacctgcatggccggcagcatctccgcggaccgcgtgccggacatgagcaagagggagctgatgaacctgctcctgctgggcgccatctcgcctccccaccttcggcatgctcgtcccctacggctccttcctcgtcccggccggctccgggagcaacgccggaggggtcgccgccaaggacaagctcggcaacgacatcctcgtcgaggactggctcaagacgcacggcccaacgaccgcacgctcgcccaggggctcaagggtgatcctacctaccttgtggtggagtccgacaagaccctcgccacctacgggatcaacgccgtgtgcacgcatcttggatgcgtcgtgccgtggaacgccgccgagaacaagttcctctgcccctgccatggatcccagtacaacaaccagggcaaggttgtccgtgggcctgcacctctgtcgctggccctggttcacgccgacgtcgacgacggcaaggtcgtcttcgtgccgtgggtggagaccgacttcaggaccggcgacaacccgtggtggaaataagcgacgcaagctccggcagcaatgctcactcgtgtgatatgttaagcctcctgccagtcctaagaacgctgctataagactactcctgct

SEQ ID NO: 5085 - DNA, 858 bp, Festuca arundinacea
acaggcagtgctagctcgctcgatcgccgtctccgcactgcagcagctgccatggcgtccaccgcgctctccaccgcctccaaccccacccagctctgccggtccagagcttcgccgtgcaagcccgtcaagggccttggcatcggccgggagcgcgtcccgaggaacatcacatgcatggccggcagcatctccgccgaccgcgtgccggacatgagcaagagggagacgatgaacctcctcctgctcggcgccatctcgctccccaccttcggcatgctcgtcccctacggctccttcctcgtcccagccggatcaggaagcaacgccggcggtgtcgtcgccaaggacaagctcggcaacgacatccgcgtcgaggactggctcaaaacgcacggccccaatgaccgcacgctcgcccagggactcaagggtgatcctacctaccttgtcgtggagtccgacaagaccctcgccacctacggtgtcaacgccgtctgcacgcatcttggttgtgtcgtgccgtggaacgccgccgagaacaagttcctctgcccttgccacggttcccagtacaacaaccagggcaaggtcgtccgtggacctgcacccctgtcgctggccctggttcacgccgacgtcgacgatggcaaggtcgtcttcgtgccgtggaccgagaccgacttcaggaccggcgagaacccatggtggaagtaagcaacacgagctccagaagaagcaatgttcacttctgtgatcagcccgcctcctgagaacgctgctataaatgcacctgtttcttgtatccccaacttatatgtatacactgtacgtatgaaagaccagaaacttcctgat

SEQ ID NO: 5086 - DNA, 1152 bp, Lolium multiflorum
tccgatctagccacaacgcgcgcaacatgtggttctcggagccggctcgctgcgcatcaaccaatcaccttctccgctcccccaaaaggacatataacccgtgcctcatctgcaagcctgtggacacaggcagtgctagctcgctcgatcgccgtctccgcactgcagcagctgccatggcgtctaccgcgctctccaccgcttccaaccccacccagctctgccggtccagagcttcgccgtgcaagcctgtcaagggcctgggcatcggccgggagcgcgtcccaaggaacatcacatgcatggccggcagcatctccgccgaccgcgtgccggacatgagcaagagggagacgatgaacctcctcctgctcggcgccatctcgctccccaccttcggcatgctcgtcccctacggctccttcctcgtcccagccggatcaggaagcaacgccggcggtgtcgtcgccaaggacaagctcggcaacgatatccgcgtcgaggactggctcaaaacgcacggccccaatgaccgcacactcgcccagggactcaagggtgatcctacctaccttgtcgtggagtccgacaagaccctcgccacctacggtgtcaacgccgtctgcacgcatcttggttgtgtcgtgccgtggaacgccgccgagaacaagttcctctgcccttgccacggttcccagtacaacaaccagggcaaggtcgtccgtggacctgcacccctgtcgctggccctggttcacgccgacgtcgacgatggcaaggtcgtcttcgtgccgtggaccgagaccgacttcaggaccggcgagaacccatggtggaagtaagcaacacgagctccagcagaagcaatgttcacttctgtgatcagcccgtatagcctcctgagaacgctgctataaatgcacctgtttcttgtatccccaacttatatgtatacactgtacgtatgaaagaacagaaacttcctgattgaatatatgatcacattttgaggagactgaatctggtaagatcgtagaccttcttttgacagctgaacaagcctgaaggatatctcctgaatctggacacccagatagcaatcctgaagaattgaagagctaaaaatagcatatctgcagtatcgtttcaaaa

SEQ ID NO: 5087 - DNA, 846 bp, Brachypodium distachyon
aggcactgagctccaccttgcacctagccatggcttccaccgcgctctccaccgcctccaaccccactcggctctgccggccccttccttcgctgggcaagccggtcaggggcctgggcttcgcccgggagcgcatcccgaggaacatcacgtgcatggccggcagcatctccgccgaccgcgtcccggacatgagtaagagggagctgatgaacctcctcctgctgggcgccatctcgctccccaccttcggcatgctcgtcccctacggctccttcctcgtccccgccggctccgggagcaacaccggcgggaccgtcgccaaggacaagctcggcaacgacatcctcgtcgaggaatggctcaagacgcacggccccaacgaccgcacgctcgcacagggactcaagggtgatccgacgtacctcgtcgtggaggccgacaagaccctcgccacctacgggatcaacgcggtctgcacccaccttggctgcgtcgtgccgtttaacaccgccgagaacaagttcctttgcccttgccatggatcccagtacaacaaccagggcaaggttgtccgtggacctgctcccctgtcgctggccctggttcatgctgacgttgatgatggcaaggtcgtcttcgtcccgtgggtcgagaccgacttcaggaccggcgagaacccatggtggaaataagcaacacaagctccagcacagcaatgtctttgcttctgtgatcagcccgtaaagcctcctgtactgctgagaagctgctataaaaccacctgttccttgtatccagttatatctatctatatacactgtatgaaataacagaaacttttcc

SEQ ID NO: 5088 - DNA, 859 bp, Brachypodium distachyon
ggacagcgaggcactgagctccaccttgcacctagccatggcttccaccgcgctctccaccgcctccaaccccactcggctctgccggccccttccttcgctgggcaagccggtcaggggcctgggcttcgcccgggagcgcatcccgaggaacatcacgtgcatggccggcagcatctccgccgaccgcgtcccggacatgagtaagagggagctgatgaacctcctcctgctgggcgccatctcgctccccaccttcggcatgctcgtcccctacggctccttcctcgtccccgccggctccgggagcaacaccggcgggaccgtcgccaaggacaagctcggcaacgacatcctcgtcgaggaatggctcaagacgcacggccccaacgaccgcacgctcgcacagggactcaagggtgatccgacgtacctcgtcgtggaggccgacaagaccctcgccacctacgggatcaacgcggtctgcacccaccttggctgcgtcgtgccgtttaacaccgccgagaacaagttcctttgcccttgccatggatcccagtacaacaaccagggcaaggttgtccgtggacctgctcccctgtcgctggccctggttcatgctgacgttgatgatggcaaggtcgtcttcgtcccgtgggtcgagaccgacttcaggaccggcgagaacccatggtggaaataagcaacacaagctccagcacagcaatgtctttgcttctgtgatcagcccgtaaagcctcctgtactgctgagaagctgctataaaaccacctgttccttgtatccagttatatctatctatatacactgtatgaaataacagaaacttttccattgc

SEQ ID NO: 5089 - DNA, 1179 bp, Gossypium raimondii
aacatatccaaatgtcatgggtaccgggtaggccgaaaacattataaaagagctttgagcaattaagttggtttctgtctttcaacttctgagcttctttctttctttctttcagtcgttcaacaatggctacaactgaggtttccccaatggatcaaaatcccacacctccgaaacagccatcatttcaacaacactaccctcctgattttccaagaaaggtgtttgcagagacgatagcaacctacttgctggtttttgtcacatgtggatcagctgccatttgttcggttgatgaacacaaaatctcaaggttaggagcttcagttgcaggtggacttattgtgactgtaatgatctatgcagttggtcatgtttctggtgcacatatgaaccctgctgttaccctcgcttttgcagctgtcagacattttccatggaaacaggtcccattttatggtgcagctcaactaacaggagcaatctctgcatcattcacactccgtgtattattgcatccaataaaacatgccggcaccacatcaccatcaggctcagatttgcaagctctaatcatggaaatagttgttaccttttcaatgatgtttatcacctcagctgtggccactgatactaaagctataggagagctagcaggcatagctgttgggtctgctgtttgcataacttcaatcttggctggaccaatatcaggtggatcaatgaacccagcaaggagcatagggccagcaatagccagtggtgagtacaagggaatatgggtgtacgtggtaggaccagtaacggggacattgatgggggcgtggtcttacaatctcatccggatgacagacaagcctcaccatgcaatctctccacgttcctcctccttcaaacttcggcgaatgaataaccaagatggagaggtataaggcaaacttgagtgtattcagtattgattcatatccattcatcctcaagagccaataatattcctcactaccctttttttcattttaccctcaaacttagatcatatataaactttgtaaatttgttatcatatgaataatgtaaaataataataattttagtctttcatttattttttcgcctctttttactattgaacttgtaatattttgtcaatttatctcaaaatgaatagaaaagttaacg

SEQ ID NO: 5090 - DNA, 1302 bp, Theobroma cacao
gctggaacattataaaaggaccagacagatgatgcaatttgagcattgagataattaatattcccttgtattcttattctctcccttcatctttcctcttctcagcaagctcagtccttccgcaatggctacgacggatcataggaatgagatagtcccagtggatcaaactccaacaccccaaaggccagacatagttcgcaattcatttctacaacactaccctcctgattttccaagaaaggtgtttgccgaggtcatagcaacctacttgctggtgtttgtgacatgtggatcagctgctgtgagttccactgacgaaaacaaaatctcaaggcttggagcttcagttgccggtggtcttatagtaactgtaatgatctatgcagttgggcatgtctctggtgcacacatgaacccagctgttactgtggcatttgcagctgtcagacattttccatggaaacaggtcccattttatgctgcagctcaattcacgggatcaatttctgcatcgttcacacttagagtattattgcatccgataaaacttcttggcacaacatcaccttcaggatcggatgttcaagctctagtcatggaaatggtcgtcacattttcaatgatgtttgttacttcagctgtagcaactgatactaaagcggtaggagagctagcaggcatggctgttggttctgcggtctgcataacttcaatcttggcaggaccaatatcaggtggatcaatgaacccagcaaggaccataggaccagcacttgctagtgctcactacaaggcaatttgggtgtacgtggtaggaccagtgacaggaaccttgatgggggcatggtcttacagtcggattcgggcaacagacaagccgggtcaagcaatctctccacaatcatcttcattcaaacttcgccggatgaggggccaagatggagagcttccaaacaaagaccctttcgatgatctttgaattgatccactttgcaacatcaagggcaatcctcactagcctttttcatgtaccctgaaaagctagattatgagcttagcacaaatgttcttgcatttgtagttctgataaagagtgtaagctatagtaaatagaattaagaatgtaatataaaataatggtaaagaaaaagccaagcctgctccggctacttcaacatgaaaccaagtttcctgtgttgccaaaaatgcattttgtaaaagaagtctgtccagggtcggagtcagtcaacttgtgttagagagatcaaagataaaaaggaataaagattaaaacttttt

SEQ ID NO: 5091 - DNA, 2633 bp, Brachypodium distachyon
attattgcctcgcggctccttgcttagcgcgccccacccaaccaacccagccaaagcccaaacacaaacagccccaccaccccccggccaccgcgcccccgtccgtcgctcgctggcttccaacgcacgcagcatccgaatccgcacacgatccccgcgccacttgtccgcgggggcatccccgtcccgtcccgccggccaatgcccgcctcccggtgagatggcgccgccgcacggcggtgctcctcccaccctctcggattccccccacttcatttattattctccccccacaacgccaacgctccgtcgtcgtcatccgcaaccgcgcccctcgcctatttaaggcgctcccagccagccgatatgctctgcaggaggccgctcgccgctgccgccgcgctccacctcgcgcccctctcgcctcccctcctcctcttcttcgcgtcgtcgtcatcgtccgcctcctgctcccccgccgccgccgccgcagcagcaactcccgcttcgggccatagaggctgcagtgctgtaaggatggataccggtgcggtggaaccagcatcaacggggacgatatggtcaacaccgtcagtggagccgagaagcatttccattgggaagcagatattctgcaatagatcactaaacatgaggaacatcaccgcagtgggatttgatatggactacactcttgcacagtacaagcccgagacgttcgagtcccttgcttaccatggcacgattgagaagcttgtcaaggatctcaactaccctcaagagctgttaacatggcagtttgactggaaatatatggtcagaggactagttcttgataagaagagaggaaatatcttgaagatggatcggcacaagtatgtaaaagttgcataccatggattcagggagatgtcaaaggaagaaaaagttgctgcttacgggaatacattgattagggattcctttgatgaacctgattacgcccttatagatacgcttttctcactaggtgaagcctatctatttgctcaacttgtggatttcatggacaacaatcctggaaaagttccttcaggcatcgattatgcgctgatgtataaagacgtgaggtctgcggttgacctgtgtcatcgtgacggaactttaaaacgaatggttgcaatggaacctggaaggtatatcaatgaggacttggcaattgtaccaatgcttgaaatgcttagaaaatctggacgctcaacattcttggtgacaaatagtctgtgggactacactgatgttgtcatgaactacctatgtgggccatatatatcggatgtaagctcaaatcacaaccgcaagtggctcgagtattttgatgttgttataacaggcagttcaaagccaagtttttttcatgatgataatcgaacaggactgtttgaagttgagcctgattctggaaaacttctaaatgctgatcttcagattggaagcccaagatcaagtcaacatcagtcaaaaccaattcacaaagtttaccagggaggcaatgtgggccatctccatagactactttctgttgcttctagttcgcagatcctctatgttggcgatcacatatacggagacatactgcgtagcaagaaagtcctcggttggcggactatgctggtaatacctgagctggagcaagaggtgaagcttctttcagaatcaaaatctactcgaaaggagcttagacaccttaggatggagcgtgattcaattgaagacacaatccatcgccttgaatggtctcttcaatttgaagatcttacagagaatagaaaggagaagttgttctctgagcatgacattctactgcaaaagctgaagggtatccgatgcgttctccgagatgctcagctgcagcatcatcagaagtttcacaaggtgtggggccagcttatgaagactgggtaccaaaattctcggtttgcccatcaggttgagagatttgcgtgcctatactgcagccaagttacaaacttcggtttgtattctcccaacaagtattaccgcccgagcgaagattatatgccccatgagtttgatgtgctaggcctgtagctacaagtttattctcatgttgaattgaagttccccttgggagactcggctgcagcaagatttgagcatgaaattatgattcactgaataacaatctagtttcatatattaccaccttaaacaagggattaggtttttctggtgaagctccgttcacccactgtacatgtttatctgaagtaattatagctgtttatagaaaattcacatgtttatccttttgtacatgccatatcattaacagagagcgattgaaagaaaagttgagggctgatcatgtcctagccttgaagcaattgtcacactgctattgtgtttgcatcattcgtcaatgctcgtttggattgaatgataaaataattcctttcgtggattgggttcaaacagtttctggtaggactgttggcttggagggctgccgccaatgtactggcatgtaggggctgtttggattgagccccatctagctgtaccaacagtttggcatgaccaaattaaagacatgaccaaaatattgacaaagctccctggacttttcccgt

SEQ ID NO: 5092 - DNA, 2630 bp, Brachypodium distachyon
attgcctcgcggctccttgcttagcgcgccccacccaaccaacccagccaaagcccaaacacaaacagccccaccaccccccggccaccgcgcccccgtccgtcgctcgctggcttccaacgcacgcagcatccgaatccgcacacgatccccgcgccacttgtccgcgggggcatccccgtcccgtcccgccggccaatgcccgcctcccggtgagatggcgccgccgcacggcggtgctcctcccaccctctcggattccccccacttcatttattattctccccccacaacgccaacgctccgtcgtcgtcatccgcaaccgcgcccctcgcctatttaaggcgctcccagccagccgatatgctctgcaggaggccgctcgccgctgccgccgcgctccacctcgcgcccctctcgcctcccctcctcctcttcttcgcgtcgtcgtcatcgtccgcctcctgctcccccgccgccgccgccgcagcagcaactcccgcttcgggccatagaggctgcagtgctgtaaggatggataccggtgcggtggaaccagcatcaacggggacgatatggtcaacaccgtcagtggagccgagaagcatttccattgggaagcagatattctgcaatagatcactaaacatgaggaacatcaccgcagtgggatttgatatggactacactcttgcacagtacaagcccgagacgttcgagtcccttgcttaccatggcacgattgagaagcttgtcaaggatctcaactaccctcaagagctgttaacatggcagtttgactggaaatatatggtcagaggactagttcttgataagaagagaggaaatatcttgaagatggatcggcacaagtatgtaaaagttgcataccatggattcagggagatgtcaaaggaagaaaaagttgctgcttacgggaatacattgattagggattcctttgatgaacctgattacgcccttatagatacgcttttctcactaggtgaagcctatctatttgctcaacttgtggatttcatggacaacaatcctggaaaagttccttcaggcatcgattatgcgctgatgtataaagacgtgaggtctgcggttgacctgtgtcatcgtgacggaactttaaaacgaatggttgcaatggaacctggaaggtatatcaatgaggacttggcaattgtaccaatgcttgaaatgcttagaaaatctggacgctcaacattcttggtgacaaatagtctgtgggactacactgatgttgtcatgaactacctatgtgggccatatatatcggatgtaagctcaaatcacaaccgcaagtggctcgagtattttgatgttgttataacaggcagttcaaagccaagtttttttcatgatgataatcgaacaggactgtttgaagttgagcctgattctggaaaacttctaaatgctgatcttcagattggaagcccaagatcaagtcaacatcagtcaaaaccaattcacaaagtttaccagggaggcaatgtgggccatctccatagactactttctgttgcttctagttcgcagatcctctatgttggcgatcacatatacggagacatactgcgtagcaagaaagtcctcggttggcggactatgctggtaatacctgagctggagcaagaggtgaagcttctttcagaatcaaaatctactcgaaaggagcttagacaccttaggatggagcgtgattcaattgaagacacaatccatcgccttgaatggtctcttcaatttgaagatcttacagagaatagaaaggagaagttgttctctgagcatgacattctactgcaaaagctgaagggtatccgatgcgttctccgagatgctcagctgcagcatcatcagaagtttcacaaggtgtggggccagcttatgaagactgggtaccaaaattctcggtttgcccatcaggttgagagatttgcgtgcctatactgcagccaagttacaaacttcggtttgtattctcccaacaagtattaccgcccgagcgaagattatatgccccatgagtttgatgtgctaggcctgtagctacaagtttattctcatgttgaattgaagttccccttgggagactcggctgcagcaagatttgagcatgaaattatgattcactgaataacaatctagtttcatatattaccaccttaaacaagggattaggtttttctggtgaagctccgttcacccactgtacatgtttatctgaagtaattatagctgtttatagaaaattcacatgtttatccttttgtacatgccatatcattaacagagagcgattgaaagaaaagttgagggctgatcatgtcctagccttgaagcaattgtcacactgctattgtgtttgcatcattcgtcaatgctcgtttggattgaatgataaaataattcctttcgtggattgggttcaaacagtttctggtaggactgttggcttggagggctgccgccaatgtactggcatgtaggggctgtttggattgagccccatctagctgtaccaacagtttggcatgaccaaattaaagacatgaccaaaatattgacaaagctccctggacttttcccgt

SEQ ID NO: 5093 - DNA, 2412 bp, Avena sativa
ccgctctcgctccgccgatcgctggcttggcttccaacgcacgcggcatctgaatccgcacacgatccccgcgccacttgtcccgcgggcatccgcctcggtcccctccctccctcccgcccgcccgcccgccggccaatgcccgccctccggtgagatggcgccgccgcgcggcggtgctccccccaccatctcgggttccccccactcccgcatttattccctcgcgccaacaacgtcccgtcgtcctcatcctcattcctcctcgcctatttaaaggaggggcgatatgctctccaggaggccgctcgccgccgcgctacgcctcgcgcccctctcccctcccctcctcctcttcctcgcctcctcctcctcctcctcctcatcgtcgtgctcccccgccgcttcggctccggcttccagccctagaggctgcagcgctgtaaggatggatactggtgctgtggaaccagcctcaacggggacaatctggtcaacaccgtccgcggagctgggaagcatttcgatcgggaagcagatattctgtaacaggtcactcaacatgaggaacatcacagctgtaggatttgatatggactacactctggcgcagtacaagcccgagacatttgaagctcttgcttaccatggcacgatcgagaagcttgtgaaggatctcaactaccctgaggagctgttaacatggcagtttgactggaaatatatggtcagaggactagttcttgataagaagagaggaaatatcttgaagatggatcggcacaagtatgtaaaagttgcataccatggatttagggagatgtcgaaggaagaaaaagttgctgcctatgggagtacattgataagggattcctttgatgaacctgattatgcccttatagacactctattctcactgggtgaagcctatctatttgctcagcttgttgacttcatggacagcaatcctggaaaagtaccttcaggcactgattatgcgcttatgtacagagatgtgaggtctgcggttgacttgtgccatcgtgatggaactttaaaacgaatggttgcaaaggaacctagcaggtatatcaatgaggacttggcaattgtgccaatgcttgaaatgctaagaaaatcaggacgctcaacattcttggtaacaaatagtttgtgggactacactgatgttgtcatgaactacctatgtgggccatatatatcggatttgggctcaaatcacaagcagaagtggcttgagtattttgatgttgttataacaggcagttcaaagccaagtttttttcatgatgataatcgagcaggactgttcgaagttgaacctcattctggaaaacttctaaatgctgatcttcaggttgggagcccaagatcaagtcaacctctgccaaaaccaattcgcaaagtttaccagggaggcaatgttggtcatcttcatagattactttctgttgcttctagttcacagatcctatatgttggcgatcacatatatggagatatactacgcagcaagaaagtcctaggttggcggactatgctggtaatacctgagctggagcaagaggtgaagcttctttccgaatcaaagtctactcgaaaggagcttagacgacttaggatggagcgtgattcgattgaagacagaatccatcgccttgaatggtctcttcaatttgaaaatcttgcagaaaatgacaaggaaaagttgttatctgagcatgccaatctactgcaaaagctgaagggtatccgctgcgttctccgagatgctcagctgcaacatcatcagaagtttcacaaggtgtgggggcagcttatgaagactggataccaaaattctcgttttgctcatcaggttgagagatttgcgtgcttatactgcagccaagttacaaactttggtttatattctcccaacaagtattaccgcccaagcgaagattacatgccccatgagtttgatgtgcttggcctgtaggaactaatttatgctcatgttgaatcaaagttctccttggaagtctcggctgcagcaagatatgagcatgattttagcgtgacactgaataacaatctagtgtcctatattaccaccttatacaaaggatgaggttacctggtgaaacttcacccattttactatagttgctcatagaaaatttacatgtttccctttttgtacataacatgtcttaacagagggtgaatgaaagtaatgttgaatgtcgatcatatcctagtttttaagtgaacaatgtagtatagtggttagaccggctggtaatgctcatctggcttgatgcggaatcaattgcatcgaggtggtgtgtaacaattgataatatcctgacaacagtcctgcctgacaacatagatcatgagtttctc

SEQ ID NO: 5094 - DNA, 2375 bp, Oryza sativa
ggccggagcaatatcccggaagcggtagccgagccgcaccgtccgtttcccccctcgaggccctgaaccgcaaggcccccctcgtgtgtgcttctcctgcttggcgcgcccccggccaaacgcatccccacctcctccccttcccgtcgctcgctggcttccaacgcacgcgagcctcgcatcgcatcggaatcctcacgcgatccctctgccccccgccgcggcgccggccaccaccgccaatgcccggcggcgcgcggcgccggtgaagggtgagggcgagcagcgccgtcgcgcgcgcgccccgcccgtttggattccattccttcctctccccactcacacccactgctcaatttattcccacgcgccccacgctgacgcctcgtcgcactcgtgtctcgcgtcccgtcccgtctcggcgtcgcctcgccttcgccttcgcctatttaagggggggcgatatgctcttcgccaggaggccgctcgccaccgccgccagccacctcgcgcccttctcccctcccctcctcctcttcttcgcctccgcctcctcgtcgtgctcatccgccgcgtcgccttcttcggcctcgggccctagagggtgcagtgctgtaaggatggagaccggtgcggtggagccagcatcaacaggagcaatatggtcaacgccatcagtggaatctagaaccatttctgttgggaaagagatattctgcaaccggtcactcaacatgaggaacatcactgcagtaggatttgatatggactacactcttgcgcagtacaagcccgagacatttgaggctcttgcttaccatggcacaatagagaagcttgtcaaggaccttggctaccctgaggagctgttaacatggcagtttgactggaaatatatggtcagaggattagttcttgataagaagagagggaatatcttgaagatggatcggcacaagtatgtgaaagttgcttatcatggatttagggaaatgtcaaaagaagaaaaagtgtctgcttatggaagtacattgatacgagattcctttgatgagcctgactatgccctcatagatacacttttctcattgggtgaagcctatctgtttgctcaacttgttgatttcatggataacaatcctggaaaagtaccttcaggcactgactatccgcttatgtacagagatgtgaggtctgctgttgacttgtgccatcgtgatggaacattaaagagaatggtcgcaaaggatcctagcaggtacatcaacgaggacttggccattgtaccgatgcttgaaatgattagaaaatctgggcgctcaacattcttggtgacaaatagtctgtgggactacacagatgttgtcatgaactacctctgtaggccatatacctcagatgtaagctccagtcacaaccacaagtggcttggatatttcgatgttgtgataacaggaagtgcaaagccagggttcttccatgatggtaaccgtgctggactgtttgaagttgagcctgattctggaaagcttttaaatgctgatcttcatattggaagccccagatcaggtcagcagccttcaaggccaatccacaaaatttaccagggaggaaatgttggtcatcttcacagattactttctgttgcttctagttcacagatcttatatgttggagatcacatttatggagacatactgcgcagcaagaaagtccttggttggcgcacaatgctagtaataccagagctagagcaagaggtgaaacttctttcggaatcaaaatctactcgaaaggagcttaggcatcttaggatggagcgtgattcaattgaagataaaatccatcgtcttgaatggtcactcaagtttgaaaatcttacagaagatgagaaggaaaagttattctcggagcatgacattctgctgcaaaagaaggaacatgttcgtcggcttcatcaagaggctcaaaggcaacatcatcataagttccataaagtgtgggggcaactcatgaagacgggttatcaaaactcccgatttgctcatcaggtcgagagatttgcgtgcctttacagtagtcaagtcacaaactttgctttgtattctcccaacaagtactaccgtccaagcgaagattacatgccccatgagttcgatgtgcttgggcttcaacccgttcatttcataccagggagtccaggactgagaggacagatgggccagacactggtgcaattgccacaaaccggcccgacgaaccgcctccgcgtcctctctaggccgcatccaaacgcgcagctcgggccgtccgcgacggcgatgcaggggcacatccggacctacatgggcgcagggaagcccacgaggttcaaa

SEQ ID NO: 5095 - DNA, 1744 bp, Festuca arundinacea
ggcacgaggagcactctgaggatggataccgcagccgtggaagcagcatcaacgggggcaatctggtcaacaccgtccgcagagcccagaagcatttcgatcgggaagcagatattctgtaacaggtcactcaacatgaggaacatcaccgctgtaggatttgatatggactacactcttgcgcagtacaagcccgagacgttcgaggcccttgcttacaatggcacaatcgagaagcttgttaaggatctcaactaccctgaggagctgttaacatggcagtttgactggaaatatatggtcagaggactagttcttgataagaagagaggaaatatcttgaagatggatcggcacaagtatgtaaaagttgcataccatggatttagggagatgtcgaaggaagaaaaagttgctgcctacgggagtacattgataagggattcctttgatgaacctgattatgcccttatagacactctattctcactgggtgaagcctatctatttgcccagcttgttgatttcatggacatcaatcctggaaaagtaccttcaggcactgattatgcgcttatgtatagagatgtgaggtctgcggttgacttgtgccatcgtgatggaactttaaaacgaatggttgcaaaggaacctggcaggtatatcaatgaggacttggcaattgtaccaatgcttgaaatgctaagaaaatctggacgctcaacattcttggtaacaaatagtttgtgggactacactgatgttgtcatgaactacctatgtgggccatatatatctgatttgggatcaagtcacaagcagaagtggcttgagtattttgatgttgttataacaggcagttcaaagccaagtttttttcatgatgataatcgaacaggactgttcgaagttgagcctcattctggaaaacttctaaatgctgatcttcagattggaagcccaagatcaagtcaacatcagccaaaaccaattcacaaagtttaccagggaggcaatgttggtcatcttcatagattactttctattgcttctagttcacagatcctatatgttggcgatcacatatacggagatatactgcgcagcaagaaagtcctaggttggcggactatgttggtaatacctgagctggagcaagaggtgaagcttctttctgaatcaaagtctactcgaaaggagcttagacaacttaggatggagcgtgactcagttgaagacagaatccatcgccttgaatggtctcttcaatttgaaaatcttgcagaaaatgagaaggaaaagttgttaactgagcatgccaatctactgcaaaagctgaagggtatccgctgccttctccgagatgctcagttgcaacatcatcagaagtttcacaaggtgtgggggcagcttatgaagactggataccaaaattcccgttttgctcatcaggtcgagagatttgcgtgcttatactgcagccaagttacaaactttggtttatattctcccaacaagtattaccgcccaagcgaagattacatgccccatgagttcgatgtgcttggcctgtaggaactaatttatgctcatgttgaatcgaagttctccttggaagtcttggctgcagcaaagatatgagcatgatctaagcatgaaaccgaaaaacaatctagtatcctatttaccaccttaaacaaaggatgaggttacctggtgaaactccacccatttacatgtttat

SEQ ID NO: 5096 - DNA, 2884 bp, Sorghum bicolor
cgttttgggtacgggcgcgtgtggccggagccaagccgcgggagggaaagcggcgccgcgtcatccgttaccagcggccagcggggcaacatcaccacaagcgccaactcaaacgcatccagccagagcgagcaggagttcctccaccaccagcccagccctcccctgtccggccgcccgcgcccgcgcccgcgcccgctgctgcttccaacgcacgcgagctccgttccgctccgcagcatccgcatccgaatccgcacacgatccccgcgccacttgcctcgtcaccccatcgcggcccgcgcctccgcccgctcgtcggccaatgcccgctgctcggcgcaggccagcgcgatgagatgagatgacgccgccgcgcggcggtgcccggcctcccgtccctcacgcgcaccaccaccaccaccaccacccggccccatcgggattcctcctcccatcctcccacctagcgccgcatttattccctcccccgcacgacagcggtcacgcttccgtcgcgcggtcttctctccctcgtcgcatccggcgctcctcctcgccgcctatttaaagcgcgcccggctgggagccagcgataatgctcttctccaggaggcctctcgccgccgctctccacctcgcgcccctctcgcctccgctgctgctcctcttcgcgtccgcgtcctcctcctgctcgcccgccgccgccgcttcggcctccggctccagaggttgcactgctgtaaggatggacagtggcgcggtggagacagcgtccactggggcagtatggtcaacaccttcggcagaaccgagaagcatttctgtcgggaaggaggtattctgcaataggtcactcaacatgaggaacattacagcagtgggatttgatatggactacactctggcacagtacaagcctgagaccttcgaggcccttgcttactatggtacaatagagaagcttgtgaaggatctgcgctaccctgaagagttgctgacttgggagtttgattggaaatatatggtcagaggactagttcttgataagaagagaggaaatatcttgaagatggatcgacacaagtatgtaaaagttgcataccatggttttaaggaactgtcgaaagaagaaaaagttgctgcttatgggagtacattgataagagattcatttgatgaacctgattatgcccttatagatacgcttttctcactgggtgaagcttatctatttgctcagcttgttgatttcatggacaagaatcctggaaaagtacctgcaggcacagactatccacttatgtacagagatgtgaggtctgcggttgatttgtgtcatcgtgatggaactttaaagcgcatggtggcgaaggatcctgccaggtacatcaatgaggacttggcaattgtaccaatgcttgaaatgatcaggaaatctggacgctcaacattcttagtgacgaatagtttgtgggactacactgatgttgtcatgaactacctttgtgggccatacacttcggatgtaggctctggtctcaaccacaaatggcttcaatattttgatattgtaataacaggcagttcgaagccaagtttcttccatgatgataaccgtgcaggcctctttgaagttgagcctgattctggaaagcttctgaatgctgatattcagattggaagcccaagatcaagtcatcaacactcaacaccagttcagaaagtttaccagggaggcaatgttggtcatctccacagattactttctgttgcttctagttcacagattctctatgttggtgatcacatatatggagatattctgcggagcaagaaagttctgggttggcggactatgctagtaattccagaactagaacaagaggtgaagcttctctcagaatcaaagtctacaaggaaggagcttagacatcttagaatgaagcgtgattcaattgaagacagaatccatcatcttgaatggtctcttaaacttgatgatgtcacagaaaatcagaaggagaagttgttctctgaacatgacaatctgctgaaacagagagagcatgttcgccgccttcatcaagaggctcagaggcaacatcatcagaagtttcataaggtgtggggacagctcatgaagactgggtaccaaaattccagatttgctcatcaggttgagagatttgcatgcttgtacagcagccaggttacaaacttcggtttgtattcccccaacaagtactatcgtccgagcgaagattacatgccccatgagtttgatgtgcttgggctgtaggagcagtctctgctgctgctcggagttccccgttgtaattgacctacagcaggataggagggtgattttagttgtgacattatagtttctgtatttatagacagaaagcttcgcccattgtgaaggagcaaggtataactatagtaaccacagttctacattataaccgtaacattacctgtatataaatatgtgcataataactagttttaggatgcaaaggaaagcagtgccgatcatgcctggattgaacattgagaattcagcattttgttaagtgtcccaaccacaaccatggttagcatgctcaagtcaggctgacgtctctctgaaaacagtttgtttcgtctgacttaatctttcagcttcaaaggttagcgatgcaaagtcggcagcgtttcaacccgacgcaatggaccccctccttgtgtgcttgtcccgacgatcttggtgtgcttgagaagacactgatttaaatcttcacccccgtaactgatataaactcaagtgatgcatatatttgtgggcacgtgataagtagttggcttatggcatcatgtgcaaatgtgcacgtcatccttg

SEQ ID NO: 5097 - DNA, 2916 bp, Setaria italica
tatttgacaaaatatgtgcaaggctcatccgtcgtgccctatttccgcgggtccatccatggtcaccgtgccctcctgcgctcgggaaagcgcgcgtgtggccggagcaaagctccggaaggtcagccgcgccgcgccacgccacgccatccgttaccgccggagcaacgtcagcagccccccaactcaaactcatccatcccccgcagttcctccaccaccagcccaccccgcccgcccgcgcccgctgctgcttccgacgcacgcgagctccgcggcatccgcatccgaatccgcacacgatccccgcgccacttgcccgcccccctcgcgccccgcgcctccgccaatgcccgccgcgatgagatgagatgacgccgccgcgcggcggtgctcggccaccctcgcagcccctccctcctcacgcgcgccaccatcgggatccctcctccctcccacccaccctcctccccaccagcgccgcatttattcccttcccccgcacgacagcggtcacgcttccgtcgtcccgtcctcgtcgcatccggcgctccgcctatttaaggcgcgcgggctgagaaccagcgataatgctcttcgccaggaggcccctctccgccgcactccacctcgcgcccctctcgccccccttgctcctcttcttcgcgtccgcgtcgtcctcgtgctcgcccgccgccgcgtcggcctccggcggcaccagaggttgcagtgctgtaaggatggacagcggtgcagtggagacaacgtcaactggggcagtatggtcaacaccttcggcagaaccaagaagcgtttctatcgggaaggcgatattctgcaataggtcactcaacatgaggaacatcacagcagtgggatttgatatggactacactcttgcacagtacaagcctgagaccttcgaggcccttgcttactatggtacaattgagaagcttgtgaaggatctgcactaccctgaagagctgttgacttgggagtttgattggaaatacatggtcagagggctagttcttgacaagaagagaggaaatatcttgaagatggatcggcacaagtatgtaaaagttgcataccatggttttagggaactgtcgaaagaagaaaaagttgctgcttatgggagtacattgataagagattcatttgatgaacctgattatgccctgatagatacgcttttctcattgggtgaagcttatctatttgctcagcttgttgattttatggacaataatcctggaaaagtacctgccggcacagactacccgcttatgtataaagatgtgaggtctgcagttgacttgtgtcatcgtgatggaactttaaagcggatggttgcgaaggaacctggcaggtacatcaatgaggacttggcaattgtaccaatgcttgaaatgataaaaaaatctggacgctcaacattcttagtgacaaatagtttgtgggactacaccgatgttgtcatgaactacctttgtggagcatacacttcagatgcaggatctggtctcaaccacaagtggcttcaatattttgatattgtaataactggcagttcgaagccaagtttcttccacgatgataaccgtgcgggcctctttgaagttgagcctgattctggaaaacttctaaatgctgatattcagattggaagcccaagatcaagtcatcagcatgcaacaccagttcacaaagtttaccagggaggcaatgtcggtcatcttcacagattactttctattgcttctagttcacagattctctatgttggtgatcacatatatggagatattctgcgcagcaagaaagttctgggctggcggactatgctggtgattccagaactggagcatgaggtgaagcttctttcagaatcgaagtcgacacggaaggagcttagacatcttagaatggaacgtgattcaattgaagacagaatccatcatcttgaatggtctctcaaatttgatgatatcacggaaaatcagaaggaaaagttgttctctgaacatgttgatctgctgcaacagcgagagcatgttcgccgccttcatcaagaggctcagaggcaacatcatcagaagtttcataaggtgtggggacagctcatgaagactggttaccaaaattcccgatttgctcatcaggtcgagagatttgcatgcctgtacagcagccaggttacaaacttcggtttgtattcccccaacaagtactatcgtccgagcgaagattacatgccccatgagttcgatgtgcttgggctgtaggagcaatccctgccgatgctcagagctccccgttgtaactgaaccagagcaggataggagggtgatttgagttgcggcattgattaacatgtgtacttggcatatttatcgagtgaaagcttcaccattggacatgttatggatatgggaggtaaagggtggtggtttaaatagcagctatagtttctcatagagcagcaattttacctgtatatttttgtacataacaagttttaagcagaagcaaaggaaagcaacgccgatcatgtcttgggtacacattgtgaattcagctttttgttaagtgttccaatcacaaccattgtgtagtgcagcgtgcttgtcaggctgaattcttgctgaaaagcttgtctagtccaacattttgtatttataatcttgcagcttcaaggttagttatgctaggtcacacgattcaacccgacgcgggtgtggggacccctcgatgtgctagcgagttgtgagggtaccaactcacccgtctggattcaatcttgatgtccatatctgataatgttgagtgctttcatcaaattatttataagcacgtgatgagcagtagacttgtgagctgtgggattgtgttgtgcgtttgtggtgg

SEQ ID NO: 5098 - DNA, 2831 bp, Zea mays
gttttgttctccactcctcctgccctagtctttggcctttgggtacggaggcgcgtgtgcccggagccaagtcgcgggagggaaagcggcgcgcgtcatccgttaccagtggccagtgggggcaacgtcaccacagcggccaactcgaacgaatacgcatccatcccatcccaagccagcaccagcagttcctccaccaccagcccagccctcgccccgtccgttcgtccgcccgcgcccgctgctgcttgcctgcttcccacgcacgcgagctctgttccgtgctgcagcaaccgcaaccgcatccgcatccgaatccgcacacgatccccgcgccacttgccccgtcaccccccacgcggcccgcgcctccgcccgctcgtcggccaatgcccggcgcaggccagctcggcgagatgagatgacgccgccgcgcggcggtgcccggcctcccgtcgctcacgcgcgccagcaccagcaccacccggccccatcgggattcttcatcccgtcctccacctagcgcggtagcgccgcatttattccctcccccgcacaacggtcacgtttccatcgcccccccgtcttctctccctcgtcgcatccggcactcctcctcgtctcctatttaaagcgcgccgggctgggagccagcgatcatgctattctctaggaggcctctcgccgccgctttccacctcgcgcccctttcgcctccgctgctcctcttcttcgcatccgcgtcctcgtcctgctcgcccgccgcctccgccgccgccgcgtcggtctccggctccaggggttgcactgctgcaaggatggacagcggtgcggtggagacagcgtccactggggcagtatggtcatcaccttcggcagaaccgagaagcatttctgtcgggaaggaggtattctgcaacaggtcactcaacatgaggaacatcacagcagtgggatttgatatggactacactctggcacagtacaagcctgaaaccttcgagtcccttgcttactatggtacaatagagaagcttgtgaaggatctccgctaccctgaagagctgttgacttgggaatttgattggaaatatatggtcagaggactagttctcgataagaagagaggaaatatcttgaagatggatcgacacaagtatgtaaaagttgcataccatggttttaaggaactatcgaaagaagaaaaagttgctgcttatgggagtacattgataagagattcatttgatgaacctgattatgcccttatagatacacttttctcactgggtgaagcttatctatttgctcagcttgttgatttcatagacaagaatcctggaaaagtacctgcaggcacagactatccacttatgtacagagatgtgaggtctgcggttgacttgtgtcatcgtgatggaactctaaagcggatggttgcgaaggatcctgccaggtacatcaatgaggacttggcaattgtaccaatgcttgaaatgatcaggaaatctggacgctcaacattcttagtgacaaatagtttgtgggactacaccgatgttgtcatgaactacctttgtgggccatacacttcaggtgtaggctctggtctcaatcacaagtggcttcaatattttgatattgtaataacaggcagttcgaagccaagtttcttccatgatgataaccgtgcaggattgtttgaagttgagcctgattctggaaaacttctgaatgctgatattcagatcggaagcccaagatcaagtcatcaacactcaacaccagttcagaaagtttatcaggggggcaatgttggtcatctccacagattactttctgttgcttctagttcacagattctctatgttggtgatcacatatacggagatattctgcggagcaagaaagttctaggctggcggactatgctggtgattccagaactagaacaagagctgaagcttctctcagaatcaaagtctactcgaaaggagcttagacatcttagaatggagcgtgattcgattgaagacaaaatccatcatcttgaatggtctcttaagcttgatgatatctcagaaaaccagaaggagaaattgttctctgaacatgacaatctgctgaaacagagagggcatgttcgtggtcttcatcaagaagctcagaggcaacatcatcagaagtttcataaggtgtggggacagctcatgaagactgggtaccaaaattccagatttgctcatcaggttgagagatttgcttgcttgtacagcagccaggttacaaacttcggtttgtattctcctgacaaatactatcgtccgagcgaagattacatgccccacgagtttgatgtgcttgggctgtaggagcagcccctactgctggtcggagttcctcgttgtaattgatccatagcctaggaggggacatcgtagttgccgtattatataacaggaagcttcacccattgtgaaggagagaaggtttataactatagtagctacatttctacttatcagtaagtttacctgtatataaatatgtacataactgatatatgatgcgtgttatttgtgagcacgcgataagtagtactgactaagtcctgctggtgtagtcattggtttttttatgatggattagcatgtaattattgtctattaaatgattctaatttttttaaaagtggattaaattataggacaaacatcatctgaaaatataccaaataacatttcttataaggtaataattagtatatacatgaggaacgagttgatttcaccaaaatttataggataaatcatacacaccataataaattg

SEQ ID NO: 5099 - DNA, 1935 bp, Triticum aestivum
cttcaaccggggcaatctggtcaacgccgtcggtggagccgagaagcatttccatcgggaagcagatattctgcaacaggtctctcaacatgaggaacatcaccgcagtaggatttgatatggactacactcttgcgcagtacaaacctgagacattcgaggcccttgcttaccatggcaccattgagaagctcgtgaaggatctcaactaccctgaggagctgttgacatggcaatttgactggaagtatatggtcagaggactagttcttgataagaaaagaggaaatatcttgaagatggaccggcacaagtatgtaaaagttgcataccatggatttagggagatgtcgaaggaagaaaaagttgctgcttatgggagtacattgataagggattccttcgatgaacctgattatgcccttatagatacacttttctcactgggtgaagcctatctgtttgctcagcttgttgatttcatggacagcaatcctgcaaaagtaccttcaggcactgactatgcgcatatgtatagagatgtgaggtctgcggttgatctgtgtcatcgtgatggaactttaaaacgaatggttgcaaaggaacctagcaggtatatcaatgaagacttggcaattgtgccgatgcttcaaatgcttagaaaatctggacgctccacattcttggtgacaaacagtttatgggactacactgatgttgtcatgaactacctatgtgggccatatatgtcagatgtaagctcaagtcacaaccacaagtggcttgagtattttgatgttgttataacaggcagttcaaagccaagcttttttcatgatgataatcgaacaggattgtttgaagttgagcctgattctgggaaacttctaaatgctgatcttcagattggaagcccaagatcaagtcaacatcagccaaaaccaattcacaaagtttaccagggaggcaatgttggtcatcttcacagactactttctgttgcttctagttcgcagatcctctatgttggtgatcacatatatggagacatactccgcagcaagaaagttctaggttggcggactatgctggtaatacctgagctggagcaagaggtgaagcttcaatcagaatcaaagtctactcgaaaggagcttagacaccttagaatggagcgtgattcagttgaagacacgatccatcgccttgaatggtctcttcaatttgaagatcttacagagaatgagaagggaaagttgttatctgagcatgataatctactgcaaaagctgaagggtatccgctgccttctccgagatgctcagatgcaacatcaccagaagtttcacaaggtgtggggacagcttatgaagactgggtaccaaaattctcggtttgctcaccaggtcgagagatttgcgtgcctatactgcagccaagttacagactttgggttgtattctcccaacaagtattaccgtccgagcgaagattacatgccccatgagttcgatgtgcttggcctgtagaactagtttgtgttgatgcggaatcgaagttctcctttgaggtgtaggttgcaacaagatatgggcacaattttagcatgataccgaataacaaatgtttaccacctcacacaatggatgaggtctacctggtgaaacttcacccattttacatgtttatatactatagttgctgataggaaattttacaggtttcccgctttgtacataacatgttctaacagggggcgaatgaaaccaatgttgaatgttgatcatttcaactttcaaagtaaataatttaatttggttattactccgcttggctatgctcatctgaatttgaagtggtgtataacaattcataatatcccgatgaggtctgtaactcctaattaattttgagggtcatttggttctctgtttt

SEQ ID NO: 5100 - DNA, 2739 bp, Brassica oleracea
gtctctttctcactctctcaatcaatcaagcaagcaaggaagcaaatacgggagacgggggagatggcagggtacaaagtggaagacgactacgattacctcttcaaagttgttcttataggcgattccggagtaggcaaatccaatctcctctccagattcaccaaaaacgagttcaacctcgagtctaaatccaccattggagtcgagttcgccactcggaccttgaaggttgatgataaggtcgtcaaagctcagatttgggacactgctggtcaagagaggtaccgtgccatcaccagtgcatactaccgtggagcagttggcgcactcctagtatacgataccacccgccgtgcaacatttgagaacgtagaccggtggttaaaagagctcaagaaccacacagacccaaacattgtggtgatgctcgttggtaacaaatctgatctgcgccatttactagctgttccgacagaagatggtaaatcctatgctgagcaggaatcgctttgcttcatggaaacatctgcccttgaagccaccaacgtggaggacgcgttcgcagaggttttgacgcagatttaccgcatcactagcaagaagcaagtcgaagctggtgaagatgcgaacgggtctgtcccgaaaggggagaaaatcgaagttaagaacgatgtctctgctctgaagaaactcggttgctgctcaaattgaaggctttttggtttatatatgttgagagagagagagagagagagagagagagagattgtaatacccgaaggtccattgtttggttatgttattgttttgtaataaatatagacatctatatgagttttacactatacataattacatatgataacaatgttttaactttattcgaaagtattgttggtcaaccaatttgtaacttgaaaaatcagcagcaaaagaaccagagccgggttaaaccgggtcggggtgcgttatgttttggtcgtcgggttaggtctcatttcgtttcctacagaacatagaagcgacaacgtttgaaaaacaaactcctgagagagaagagagaagagagaagagagaaggagatagcgattagaaggaagaatgatagaggaaggtccaccggctccgaaggttctccgtatggtctacttcgtcggcgccggatttttatgtactttcgcgatcaacaaatggcgtgagatggagaaaaaatcaaatctgaaagagcaggagaagaatcagcaagcagatggaggaggtttattgcatcaaattcctgcagattcggttcagaaagcaatgaaatgatgatttttttttctcttttgtctattgctatgatccagatgcaaaagataacgcaactccagttgtatctttgacctcaaagtttgcattttcttttatattttccctgaatttttgttttcctctgatgaacctctctgcctttcctttaatcatctacaactgtgatatccggacgctaagtgagaatcaagtttcgatattgattttgtatacgacttatctacctgtttagtgttgggatttttagtttccgaacttcaaaataaagtttcgtcgctttcagtatcgaacaaaatagctttactaatatttgatgtttaccagtggaagtcttaacatcttttagtaaccctctagaccgataaaactcagttcagtgtccagtttggagctgaacgtaacaactaataactgctcagtccccgttcacggttcatagtggttggtttgtagtgaatctccacaaggcaaaaagaagatcatgttattgatgttgacacactaatgctgccaataatgtccaactttcttaatccttctttatattttgcgttagaccaacgcgtcgttaaaaggaaaaataaagaaaattaaaaggaaaaagaataaaaaacaatcaagaggggtcacaagacgagacacgacgtagcatccgttgctagctagcttcgttctctctaaaataaaccctaaattatccgcgagatcgatcgaatccgataatggcgaatagtaatctaccgcgaagaatcatcaaggaaactcaacggctgcttagtgaaccggctccggggataagtgcgtctccgtcagaggagaatatgcgatatttcaatgttatgattcttggtcctacccagtctccttatgaaggaggagttttcaagttggagctctttttgcctgaagagtatcctatggcagctcccaaagttaggtttctcaccaagatttaccatcctaacattgacaagcttggaagaatttgccttgacatattgaaagacaagtggagtcctgcgctacaaataagaactgtgctcttgagtattcaagctcttctaagtgcaccaaacccagatgatccactctctgagaacatagctaagcattggaagagtaatgaagctgaagctgtggagacagctaaggagtggactcgtctgtatgcaagtggcgcttgatggggggagtgcaagaggagaaagatcattgtcatttaaataagattatatatggtgaaacactctatctcaaggttttatccaaatcctttttttctaaaacatggaaaaaaaaagatttgtactctctggatatgtataactactagggaggatttaagactagtttacccatatttgcaaactaactttcttcaaatgtgcttgcgcttgtgcttctgtgtttagaaatattctctaa

SEQ ID NO: 5101 - DNA, 3123 bp, Brassica oleracea
atacttttcacttttgattgcttcaccgagaagggagcttctgcaatctgcactcgccgcgaccattttccgatggatctaacgacgacgcggcagaggcgcccactcctaaccggctcttcttcatcttcaccaaagccatactcgaagactgataaacccggccgatctgacggcggagacgcggaggatcgcggcctcgggtggttcttgccgtttatagcgctatgctatctccgttacatgagcgcgacttctaacatcgttcacgactgcgacgaagtattcaactactgggagcctctccattaccttctctacaagtcaggatttcaaacctgggaatacagttccaactttgctcttcgctcctacttatacattctcttccatgaattggctgggcggcctgctgcttggtggtttggtgatgacaaggttagagttttctatgcggtgagactctttctcgggctggtttctgcagtgtcagacactgtcctggttgttgcgatctccagaaagtacgggaagcgtctcgggacgtatgcagttgctatgctctgcttaactagtggctgcttctttgctagtaccagtttcctcccgagttcgttctctatgtatgccatgagtctgtcttctggtttgttgcttttcgagaagtatgccatggctgttgcagtttcagttgttggtgtgattcttggctggccgttttctatcctggcctttttacctgttgttatttactctctggttaagagattcaagcaagcgtttatctctggagccgtcacctctattcttctccttggaggctcagtacttgtggattactattactacaagagatggacatcttcggttttgaatctcttggtgtacaatgtcttagggggtggagaaagccatctctatgggactgaaggaccgttgttttatataagaaatggttttaacaacttcaacttgtgtttcgttttggcaatcttgttcatcgcactatatcctgttatcagaagaaagtatgaccgttgcttgcttgttgtgatttcgccaatgtatatttggctggcgttcatgtcacttcagccccacaaagaagaaaggttcctttatccaatataccctcttatatgtgtttctgcctctgctgttattgaaaacatccctgagctgttccgagaaaagtatagcacacgcgaaaatcttctggtgacaataaccaaatacctccgacctgtgatccttggtattatcttatgtgcttcacatgctcgcacattttctataattaatggctattccgctcccttagaggtctacaagctgctggagcaccacgatgatgctggaccaggttctgttctgtgtgtgggaagcgaatggcatcgatacccgtcatcgtttttcgtgcctgactacattagcgaagtacgttggatcgatgatgggttccgtggtcttcttccattcccatttaacaatacacttggaggcaccgcagcatcacctccatacttcaacaacaagaaccaagcatctgatgaacaatttttaaagaatatcgaaagttgcacattcctcattgagttgcagctaagcagaccgtatccgtatcgaggcagcgacttatcaacatgggagacgattgttgtgctaccatatctggacagagagctatcgccagcaaagtatagatcgttcttcatcccatacaagtggcaagagaaaaacgtgttcggcaaatacgtaatactaagaagagtacccaaatgatatcgtctttttaaaaactttgtagacagatgactttaaactcagttgattggccagttttgagccgaatgtaatatagctagtaactgatctgtattgtctttgtagaaggaagaagatcatgttgttgaggttgacactaatgaattatgattcttccgtgcaacgtttgattctttagattttgtgaagccaatttataagaaaagaatatatagcgacaaacatttgacggaatgaggtagctcacttcatgctcacggattcgacgccaggcggaggcgaactgcccattctgtcaccaaatgcggtactgggtgttggggcttgtccccagccccgggaaagctcttccgggtgaagtggaccgctgtctaaccaggtacaggggaataatctacgtaagtggggaaaccgtggattattaaaaaacaaaaaaaaaaaaacattacggggacctttaagttggcgtttgaccaacgcgtacgaacaaaaaaaacctttattttgttttacaaaaaaaagagttcgtaaaacatttataaacgagacgagagagccgaagaagcttctttctctgtgaaaaaccctaaattctctgagagatcgatcaaatcggatagcacgcaataatggcgaatagtaatcttcctcgaaggatcatcaaggaaactcaacgtcttcttagtgaacccgctccggggataagtgcgtctccgtcagaggaaaatatgcgctacttcaatgttatgattcttggtcctacccagtctccttatgaaggtggagttttcaagttggagctctttttacctgaagaatatcccatggcagctcccaaggttaggtttctcaccaagatttaccatcctaacattgacaagcttggaagaatctgccttgacatactgaaagacaagtggagtcctgcgctacaaataagaactgtgctcttgagtattcaagctcttctaagtgcaccaaacccagatgatcccctctctgagaacatagctaagcactggaaaagtaatgaagcagaagctgtggagacagctaaggagtggactcgtctatatgcaagtggcgcttgatatagagtgcagaaggagaaagttcattgtcattttaaataacaatatatatggtgaatccttctttctaaaacaggaaagaaaaagatttgtactctatgaatctgtataactaggggggggtctaagactcgtttatccacatttgcaaactaactttcttcaaatgtgtttgtgcttgagctttgtctgtgttgaatatcctctataatcatttaatcgttgtgaatgaaggtaaatgtgataa

SEQ ID NO: 5102 - DNA, 908 bp, Setaria italica
catggatccaagtaggatagggaaccaaacatgtggcctaacacaagtttcgcaacgacgtcgaaagcgcagaaatactggcactacggcggcgctgaaacggaagaccttataaaggcgtccgtccgtccgttggtgtgtcgctgccctttcgccctctcctttgacccctcgtctcgtcctcctctccaagcccccccgcccccccgcccccgcgggcgtaatccagctcggctcggcgccatggccaacagcaacctcccgcgccgaatcatcaaggagacgcagcggctcctcagcgaaccagcgccagggattagtgcctcgccgtcggaggagaacatgcggtacttcaatgtcatgatccttggccccgcgcagtcaccctatgaaggtggagttttcaagcttgaactattcttgcctgaggagtatccaatggctgctccaaaagttagatttctcaccaaaatttaccatcccaatattgataagcttggtaggatatgccttgacattcttaaggacaaatggagtccagctcttcagatacgtactgttctgttgagtatccaggcactgctgagcgcaccaaatccagatgatcctctctcagacaacattgcaaaacactggaaaagcaatgaagctgaagctgtcgaaacagcgaaagagtggactcgcctgtatgcaagtggggcatgacaaccaagtgtgttgttatctttgtaataacagtgtcatagtttgatcccgattgaatatcacttgcttgagcgagcaaattgcgatattttgcaacggggaaaaatgttcgaacaaaacaacagttcgaattatgctttgtacttgtggctctagctcccttcactgcagtaagcatcagagcaggtgttgtttggtctgtt

SEQ ID NO: 5103 - DNA, 837 bp, Echinochloa colona
cccgccgctcccccgttccccacccccgaccgactgctcctcctccacctccgcgcattcctcgaggcatcagcggcgccgcaacttcgcaggggaggaagcccgcgccccggccccgatccgatggccaacagcaacctcccccgccggatcatcaaggagacgcagcggctgctcagcgagccagcgccggggatcagcgcgtcgccgtcggaggagaacatgcgctacttcaacgtcatgatccttggcccggcgcagtcgccctacgaaggtggagtttttaagcttgagctctttttaccagaggaatatccaatggctgccccaaaggttaggtttctgaccaagatttaccatcccaacattgacaagcttggtaggatatgccttgacattctcaaggacaaatggagcccagcacttcagattcgaacagttcttttgagtattcaggctctcctgagtgcaccaaatccagatgaccctctctctgataacattgcaaaacactggaaatccaatgaggcagaagctgttgaaacagctaaggagtggactcgcctgtatgcgagcggtgcatgacaacccagcactgttcttgatgtaataacccgacatacttcagtcctaatctattggcatttgcttgatgagagcagactggagatatttgccatggaaggaagtctctaaatgacttacctgtggtcggttccctttacctttgggcaccttcgactaatcagcatctgtggtagaacttgctgctactgcaatatatttattacttatgtaggagagtttctcaactgtccatattgttgaaactgaggc

SEQ ID NO: 5104 - DNA, 1073 bp, Echinochloa colona
agcacaggcagaccactacggcaaaaaccgcgtccgcgtacaatagcgagcgcccaacgccccaacccgccgctcccccgttccccacccccgaccgactgctcctcctccacctccgcgcattcctcgaggcatcagcggcgccgcaacttcgcaggggaggaagcccgcgccccggccccgatccgatggccaacagcaacctcccccgccggatcatcaaggagacgcagcggctgctcagcgagccagcgccggggatcagcgcgtcgccctcggaggagaacatgcgctacttcaacgtcatgatccttggcccggcgcagtcgccctacgaaggtggagtttttaagcttgagctctttttaccagaggaatatccaatggctgccccaaaggttaggtttctgaccaagatttaccatcccaacattgacaagcttggtaggatatgccttgacattctcaaggacaaatggagcccagcacttcagattcgaacagttcttttgagtattcaggctctcctgagtgcaccaaatccagatgaccctctctctgataacattgcaaaacactggaaatccaatgaggcagaagctgttgaaacagctaaggagtggactcgcctgtatgcgagcggtgcatgacaacccagtgctgttcttgatgcaataacccgtcatacttcagtcctaatctattggcatttgcttgatgagaacagactggagatatttgccctggaaggaagtctctaaatgacttaccagtcgaattgtttggttgtaaacctgtggtcggttccctttacctttgggcacctttgactaatcagcatatgtggtagaacttgctgctactgcaatatatttattactttatgtaggagagtttctcaactgtccatattgtcgaaactgatggatgcttgttacccgcacttttgttgctcatctcgtttgtgcctctgttctggaaaccgtactgctgaaactaaagttgacatcttcggcggagtgttccttttttgagtgatggaaagatgttgttgtattgcaacgatttgatag

SEQ ID NO: 5105 - DNA, 611 bp, Capsicum annuum
aataatccaatcgattcaattttcaatggcgaacagcaatcttcctcgaagaattattaaggaaacgcaacgtctactaagtgaacctgccccaggaataagtgcttctccctcggaagaaaatatgcgatattttaatgtcatgattcttggtccaacacagtctccttatgaaggaggtgttttcaaactggaactctttttgcctgaagagtacccaatggctgcgccaaaggttcgattcctcaccaaaatctaccatccgaatattgataagcttggaaggatatgcctcgatattctcaaagacaagtggagccctgctcttcagattcgtaccgttctcttgagcattcaagcacttttgagtgctccaaatccagatgatccactttcggagaacatcgcgaagcactggaagtcaaatgaggctgaagctgttgaaacagctaaagaatggacgcgtctttatgctagtggtgcctgaaggcattattaagtgattttgacaaagaaaaaagcgaaaaatctgtggaatgccattgtaattcactgtctaatcagaacgggacttgggaggaccgaaagctgaatgcttcgacttaccatct

SEQ ID NO: 5106 - DNA, 742 bp, Arabidopsis thaliana
acgaagcgtactcgattattatcagcctttggtagcttcgttctctctcaaaaaccctaacttctctgtgacgatcgaatccgatagcgtgcgataatggccaatagtaatcttccccgacgaatcatcaaggaaactcaacgtctgcttagtgaacctgctcctgggataagtgcgtctccatcagaggaaaatatgagatatttcaatgttatgattcttggtcctactcaatctccttatgaaggaggagttttcaagttggagctctttttgcctgaagaatatcctatggcagctcccaaggttaggtttctcaccaagatttaccatcctaacatcgacaagcttggaagaatctgccttgacatactgaaagacaagtggagtcctgcactacaaatacgaactgtgctcttgagtatccaagctcttttaagtgcaccaaacccagatgatcctctgtctgagaacatagctaagcattggaagagcaatgaggcagaagctgtggaaacagctaaggaatggactcgtctttacgcaagtggtgcttaaagaagactgcaaatggagaaagatcattgtcatttaaataacattatatatggtgaaactctatctcaaggttttatctgaatcctttttctgaaaacagaggaaaaagatttgtactctctgaatttgtataactagggggatctaagactcgtttacccatatctggaatctaactttcttc

SEQ ID NO: 5107 - DNA, 772 bp, Brachypodium distachyon
ccccgtaccctgttccccatctcggctgacggctcctgcgcctctcccgcacggaacttaaagcatctccggcgccgcgctcaccggagggagaaacccgcgccccggcccgatccgatggccaacagcaacctcccgcgacgaatcatcaaggagacgcagagacttctcagcgagccagcgccgggtatcagtgcgtcgccctcggaggaaaacatgcgctacttcaacgtcatgatccttgggccggcgcagtcgccctacgaaggtggagtttttaagctggaactcttcttgcctgaggaatatccgatggctgcaccaaaggttaggttcctgaccaaaatataccatcccaacattgacaagcttggtaggatatgccttgacattctgaaggacaaatggagtccggctcttcagatccgaacagttcttctaagtatccaggcactcctaagtgcaccaaatccagatgaccctctctctgataacattgcgaagcactggaaatccaatgaggcagaagctgttgaaacagcaaaggagtggactcgtctgtatgcgagtggcgcatgaacccaacactgctcttgatgtaataactcatcatactttagctggtaatgaagtgccattcgcttgataagaacatacaggagatatttgcaatgaaaagatcttaatgactaccactatttggttgtacacctgtggttggttccctttaccctggggcacctttgactaatcagtatctgtggtagaactt

SEQ ID NO: 5108 - DNA, 809 bp, Brachypodium distachyon
acccccgtaccctgttccccatctcggctgacggctcctgcgcctctcccgcacggaacttaaagcatctccggcgccgcgctcaccggagggagaaacccgcgccccggcccgatccgatggccaacagcaacctcccgcgacgaatcatcaaggagacgcagagacttctcagcgagccagcgccgggtatcagtgcgtcgccctcggaggaaaacatgcgctacttcaacgtcatgatccttgggccggcgcagtcgccctacgaaggtggagtttttaagctggaactcttcttgcctgaggaatatccgatggctgcaccaaaggttaggttcctgaccaaaatataccatcccaacattgacaagcttggtaggatatgccttgacattctgaaggacaaatggagtccggctcttcagatccgaacagttcttctaagtatccaggcactcctaagtgcaccaaatccagatgaccctctctctgataacattgcgaagcactggaaatccaatgaggcagaagctgttgaaacagcaaaggagtggactcgtctgtatgcgagtggcgcatgaacccaacactgctcttgatgtaataactcatcatactttagctggtaatgaagtgccattcgcttgataagaacatacaggagatatttgcaatgaaaagatcttaatgactaccactatttggttgtacacctgtggttggttccctttaccctggggcacctttgactaatcagtatctgtggtagaacttcctgctactccagtatattaattactctatgtagg

SEQ ID NO: 5109 - DNA, 841 bp, Festuca arundinacea
gcactcatcggggaggaagaagacatcgccccggcttgatccgatggccaacagcaacctcccgcgacgaatcatcaaggagacgcagagactcctcagcgagccagcgccggggatcagcgcttcgccctcggaggagaacatgcgctacttcaacgtcatgatccttgggccggcgcagtcgccctatgaaggtggagtttttaagctggaactctttttacctgaggaatatccgatggctgccccgaaggtaaggtttctgaccaaaatataccatcccaacattgacaagcttggtaggatatgccttgacattctcaaggacaaatggagtccagctcttcagattcgaacagttctcttgagtatccaggcactcctaagtgcaccaaacccagatgaccctctctctgataacattgctaagcactggaaatccaacgaggcagaagctgttgaaacagcgaaggagtggactcgtctttacgccagcggtgcatgaagacccaacgctggcgctgatgtaataatcaatcatactctagtcggtagtcgagtgccatttgcctgataagaagaaactggagatatctgcagtggaaggaagtatctaaatgactaccgctcgtcgctctatctggttgtacaacgtgttggttccctttaccctggggtgcctttgactgatcaatatttgtggtagacctttccgtgccgctccaagtatatcggttactctatgtaggagaacttaacattattgtagttgaagttaaagattgcttgttttgctgcgaatttgttcttcctactaggctatctgggaattgttctgtca

SEQ ID NO: 5110 - DNA, 730 bp, Vitis vinifera
cttgactccctccctccctccctctctccaaaatctcagagtcaatggccaatagcaatcttcctcgaaggattatcaaggaaacacagaggcttctcagtgaaccagctccaggaattagtgcttctccttcagaagagaacatgcggtattttaatgtaatgattttgggtccaacacaatccccttatgaaggaggggttttcaaattggaattatttctccccgaagaatatccaatggcggctcccaaggttcgcttcttgaccaagatataccatcctaacattgataagcttggaaggatatgcctggatattctcaaagacaagtggagtccggccctccaaatccgaacggtgttgctgagcatccaagctcttctaagtgctccaaatcctgatgatccactttctgagaacattgcaaagcattggaagagcaatgaggctgaagctgttgaaactgcaaaagaatggacccgcttatatgcgagtggtgcatgatgggagttgtcgtctggaaatactatttctgcattgtatgttaaaccgaatgcttttcctttggactttaatccaaaaagcaaaaaaaaatgggaatgatccgatggatcatttagagatgaatcttcctgaaattggcggacatggatttggttctattttttttatcttctggaagggcatgttttaagaccgtatggttataaaagttgatggtttttcca

SEQ ID NO: 5111 - DNA, 736 bp, Lolium multiflorum
atggccaacagcaacctcccgcgccggatcatcaaggagacgcagcggctgctcagcgaaccagcgccggggatcagcgcgtcgccgtcggaggagaacatgcgctacttcaacgtcatgatccttgggccagcgcagtcgccctatgaaggtggagtttttaagctggaactctttttacccgaggaatatccgatggctgccccgaaggttaggtttctgaccaaaatataccatcccaacattgacaagcttggtaggatatgccttgacattctaaaggacaaatggagtccggctcttcagattcgaacagttctcttgagtatccaggcactcctaagtgcaccaaacccagatgaccctctctctgataacattgctaagcactggaaatccaacgaggcagaagctgttgaaacagcgaaggagtggactcgtctgtacgccagcggtgcatgaagacccaatgctggcgctgatgtaataatcaatcatactctagtcggtagtcgagtgccatttgcctgataagaagaaactggagatatctgcagtggaaggaagtatctaaatgactaccgctcgcgctctatctggttgtacaacgtgttggttccctttaccctggggtgcctttgactgatcaatatttgtggtagacctttccgtgccgctccaagtatatcggttactctatgtaggagaacttaacaagtgtccacattattgtagt

SEQ ID NO: 5112 - DNA, 815 bp, Arabidopsis lyrata
aaaaggatcaaaggggcacgaaattagagacgacgaagagtagtcgattatcatcagccttctctagcttcgttctctctcaaaaaccctaacttctctgagaccgatcgaatccgatagcgtgcgataatggccaatagtaatcttccccgaagaatcatcaaggaaactcaacgtctgcttagtgaacctgctcctgggataagtgcgtctccatcagaggaaaatatgcgatatttcaatgttatgattcttggtcctactcaatctccttatgaaggaggagttttcaagttggagctctttttgcctgaagaatatcccatggcagctcccaaggttaggtttctcaccaagatataccatcctaacatcgacaagcttggaagaatctgccttgacatactgaaagacaagtggagtcctgcactacaaatacgtactgtgctcttgagtatccaagctcttctaagtgcaccaaatccagatgatcctctgtctgagaacatagctaagcattggaagagcaatgaagcagaagctgtggaaacagctaaggaatggactcgtctttacgcaagtggtgcttgaagattgcaaatggaaaaagaacattgtcatttaaataacattatatggtgaaactctatctcaaggttttatctaaatcctttttctgaaaacagggaaaaaagatttgtactctctgaatttgtataactagggggatctaagtttacccatatctggaatctaactttcatcaattgtgcttgcttttgatctttggttgtgttaaatatgctctataatct

SEQ ID NO: 5113 - DNA, 1037 bp, Cenchrus ciliaris
gaaaaaccgcgtccgcgtacaatagcgagcgcccaacgccccaacccgcctctcccccccgttccccaccctcctcgaccgactgcttcctcctcctccacaccaccgcgcgatcctcaaggcatcagcggcgccgcaacttcgcagaggaggaagcccgcgccccagccccgatccgatggccaacagcaacctcccgcgccggatcatcaaggagacgcagcggctgctcagcgagccagccccggggatcagcgcgtcgccctcggaggagaacatgcgctacttcaacgtcatgatccttggcccggcgcagtcgccctatgaaggtggagtttttaagcttgagctctttttacctgaagaatatccaatggctgccccaaaggttaggtttctgaccaagatttaccatcccaacattgacaagcttggtaggatatgccttgacattctcaaggacaaatggagcccagcacttcagatccgaacagttcttttgagtatccaagctctcttgagtgcaccgaatccagatgaccctctgtccgataacatcgcaaaacactggaaatccaatgaggcagaggctgttgaaacagcgaaggaatggactcgcctgtatgcaagtggtgcatgacaacccagtgctgttcttgatgtaataacctgtcatacttcagtcctaatctattgccatttgcttgatgagaacagactggagatatttgccatggaaggaagtctctaaatgacttaccagtcgaattgtttggttgtacacctgtggtcggttccctttacctttgggcacctttgactaatcagtatctgtggtagaacttgctctactccaatatatttattacttcatgtaggagagtttctcaactgtccatattgttaaaactgaggcttgttaccttggctgcactttggttggtccactcgttttcctgcttgtcatctgtgaaaccgtgctgctgaaactagagttgctcatgcacatttacattttgatagggatcactctagtc

SEQ ID NO: 5114 - DNA, 1080 bp, Setaria italica
ctgctcctttccgaattagaagtattttgatttttattcatctatattaatgaattgtagtccatggatccaagtaggatagggaaccaaacatgtggcctaacacaagtttcgcaacgacgtcgaaagcgcagaaatactggcactacggcggcgctgaaacggaagaccttataaaggcgtccgtccgtccgttggtgtgtcgctgccctttcgccctctcctttgacccctcgtctcgtcctcctctccaagcccccccgcccccccgcccccgcgggcgtaatccagctcggctcggcgccatggccaacagcaacctcccgcgccgaatcatcaaggagacgcagcggctcctcagcgaaccagcgccagggattagtgcctcgccgtcggaggagaacatgcggtacttcaatgtcatgatccttggccccgcgcagtcaccctatgaaggtggagttttcaagcttgaactattcttgcctgaggagtatccaatggctgctccaaaagttagatttctcaccaaaatttaccatcccaatattgataagcttggtaggatatgccttgacattcttaaggacaaatggagtccagctcttcagatacgtactgttctgttgagtatccaggcactgctgagcgcaccaaatccagatgatcctctctcagacaacattgcaaaacactggaaaagcaatgaagctgaagctgtcgaaacagcgaaagagtggactcgcctgtatgcaagtggggcatgacaaccaagtgtgttgttatctttgtaataacagtgtcatagtttgatcccgattgaatatcacttgcttgagcgagcaaattgcgatattttgcaacggggaaaaatgttcgaacaaaacaacagttcgaattatgctttgtacttgtggctctagctcccttcactgcagtaagcatcagagcaggtgttgtttggtctgtttctacttgctctttagtggctcgtgctcccgttacagtccgatctattttgacttgttcaccattcctgctatttcttctaaactgtctaaacctcttggtggaccgtgg

SEQ ID NO: 5115 - DNA, 769 bp, Raphanus sativus
gagacgacaaagcgttctcgataaccaccgtccgtctcgagctttaccttccttctctctcaaaaaccctaaaaaaaatcatctctggagatcgatcgatcgaatccgttagtaatggcgaatagcaatcttccgcgaagaatcatcaaggaaactcaacgtctacttagtgaacctgctccggggataagcgcgtctccgtcagaggaaaatatgcgttatttcaatgtcatgatccttggtcctacccagtctccttatgaaggaggagttttcaagttggagctctttttgcctgaagaataccctatggcagctcccaaagttaggtttctcaccaagatataccatcctaacattgacaagctcggaaggatctgccttgacatactgaaagacaagtggagtcctgcgcttcaaataagaactgtcctcttgagtattcaagctctcctaagtgcaccaaacccagatgatccactgtctgagaacatagctaagcattggaagagtaatgaagcagaagccgtggagacagctaaggagtggactcgtctatatgcaagtggcgcttgatgatggagtgcaaaaggagaacgatcgttgtcatttaaataacattatatatggtgaaactctttaaggttttatctgaatcttttttctttaaaaaaagaactggggaaaaagatttgtactctctgaatcttctttgtataactagaagaattgaaagactcgtttatccatgcaaactaacgttcttcaa

SEQ ID NO: 5116 - DNA, 863 bp, Raphanus sativus
atatcaacgagacgagagacgaaaaagcctctttagctagctccgttctctatcaaaaaaaaaaaagaaaacctaaattctctgagagatcgatcaaatcggatagcacgcaataatggccaatagtaatcttccacgaaggatcatcaaggaaacacaacgtctgcttagtgaacctgctcccgggataagtgcctctccgtctgaggaaaatatgcgctacttcaatgttatgattcttggtcctacccagtctccttatgaaggaggcgttttcaagttggagctctttttgcctgaagaatatccgatggcagctcccaaggttaggtttctcaccaagatataccatcctaacattgacaagcttggaagaatctgccttgacatactgaaagacaagtggagtcctgctctccaaataaggaccgtgctcttgagtattcaagcccttctaagtgcaccaaacccagatgatcccctctctgagaacatagctaagcactggaaaagcaatgaagcagaagctgtggagacagctaaggagtggactcgtctatatgcaagtggcgcttgatatagagtgcaaaaaggagaaagttccttgtcattttaaataacaatctatctggtgaaacactctcatctcaaggttttatctagaatcctttttttttctaaaacaggaaagaaaaagatttgtactctatgcatatgtataacttgggtgggtatttaagactcgtttgcccatatttgcaaactaacttatgagctttgtctctgttgttctattatcatttgctcactgtagacaataagatttcacttttcacaggctgtggataaaggtaaatttgaca

SEQ ID NO: 5117 - DNA, 1065 bp, Solanum lycopersicum
agtgcttctaaaactcccaatccatttttctactttctctctctagaaaaagtgcgttttagcttaaattttctgcgaaccaactttttttttcaatcgattcaatttcaatggctaacagcaatcttcctcgaagaatcatcaaggaaactcagcgtcttctaagtgaacctgcaccaggaataagtgcttctccctcagaagaaaatatgcgatattttaatgtcatgattcttggtccaacgcagtctccttatgaaggaggtgttttcaaactggaactctttttgcctgaagagtacccaatggccgctccaaaggttcgattcctcaccaaaatctatcatccgaatattgataagcttggaaggatatgccttgatattctgaaggacaagtggagtcctgctcttcagattcgtaccgttcttttgagcattcaagcacttttgagtgctccaaatccagacgatccactctctgagaacattgcaaagcactggaagtcaaacgaggctgaagctgttgaaaccgctaaagaatggacacgtctttatgcaagtggtgcctgaagaccataaattagtgaaaaaaaaacccgtggaatgttatcgatccactgtttaatccgaatgggacttgggaggactgaagctgaacgctttgaattacccatctaaaattgtttccctgtccttgaaattgtacaattgaacgatgcacctttttttcaagttgaattggtctttacttctagaccagaaatggttctaaagtattatctcacagatcactgaattggaggacaacgtttgttgcgtgagcaggttgctttctccacttctctttttgaaccaagggtctatcggaaatcacctctctacctacccccataaaggtaggtaggggtaaggctttgtgtacatgttatcctctcaaacttaacttgtggggttacatgtgctcccgttgtcatataaagttcatgtacttccttgacaagacttgcccatagcttcttgaaaagtatcatgtgttttgctttagatgttatcatcttcagtt

SEQ ID NO: 5118 - DNA, 705 bp, Brassica oleracea
gaagcgttctcgataatcaccgtgcttctttagcttagcttcgttctctctctcacaaaaaccctaaattctccgagaccgatagaccgcgataatggcgaatagcaatctaccgcgaagaatcatcaaggaaacacaacgtctacttagtgaacctgctccggggataagtgcgtctccgtcagaggaaaacatgcgttatttcaatgtcatggttcttggtcctacccagtctccttatgaaggaggagttttcaagttggagctctttttgcctgaagaataccctatggcagctcccaaagttaggtttctcaccaaaatataccatcctaacattgacaagcttggaaggatctgccttgacattctgaaagacaaatggagtcctgcgctacagataagaactgtgctcttgagtatccaagctcttctaagtgcaccaaaccctgatgatccactttctgagaacatagctaagcattggaagagtaatgaagcagaagctgttgagacagctaaggagtggactcgtctatatgcaagtggcgcttgatgggggggagtgcaaaaaggagaatgatgttgtcatttaaataacattatatatggtgataactctacctcaaagtttatctgaatcctttttcttaaaacaagggaaaaagatttgcactctcttgatatgtataactagaagaattt

SEQ ID NO: 5119 - DNA, 567 bp, Brassica oleracea
cgaaagtgttctctcggatctctctctaaaaccctaactctgatcaatcgaattcggcagcgcgagatcatggccaacagcaatctgccccgaagaatcatcaaggaaacgcaacgtctgctcagtgaaccggctccgggtataagtgcatctccatctgaggagaacatgagatacttcaacgttatggttcttggtccttctcaatcaccttatgaaggaggtgttttcaagttggagctctttttgcctgaagagtaccctatggcagctcccaaggttaggtttctcaccaagatataccatcctaatattgacaagctgggaagaatctgtcttgatatcctgaaagacaaatggagccctgctctacaaatacgaacagtgctcttaagtattcaagctcttctgagtgcaccaaaccctgatgatccattgtctgagaacatcgctaagcattggaagagtaatgaggctgaagctgtggagacagctaaagaatggacccgtctgtacgcaagcggcgcatgatggattggagggtgaaaagatctcattcatccaaat

SEQ ID NO: 5120 - DNA, 786 bp, Castanea mollissima
tctctctcttcgccaaatcttcgaagaatcaatggcgaacagtaatcttcctcgacgaattatcaaggaaacccagcggcttctcagtgaaccagctcccggaataagtgcttctccttctgaggacaacatgcgatacttcaatgttatgattcttggtccagctcaatctccatatgaaggtggagtgttcaaattagaattgtttcttcctgaagaatatccaatggccgctcctaaggttcgcttcctgaccaaaatatatcatcctaatattgataagcttggaaggatatgcctcgatattcttaaagataaatggagtccagccctccaaatccgaacagtattgcttagcatccaagctcttttgagtgctccaaaccctgatgatccactttctgagaacattgcaaagcattggaagacaaatgaagctgaagctgttgagacagcaaaggaatggacccgtctgtatgcaagtggagcctgatgagcttgatggtcaacatatcaatctctaaaatgtctgttaaacttgatggttggtttgtcatttggtattaaaaatatgaatggaaaaatgatctatgacttgatctatgaaagatgaatcttcttgagaacatcaattaactgagagtcatcatcaggaatgaacaaatgatttctgaattgatcaatgaaagatgattcttgtgaagaacttcatttatttgatagtcatctttaataacttgaaaggctttttcatcttttgaagagcctgcatgattatattgaagt

SEQ ID NO: 5121 - DNA, 1393 bp, Chrysanthemum coronarium
tgttaaatcattttatatccttcaaagggcaaacattagtcctcgactgaaaacagtttttgttcttttcaatgagccaagcaaacatatttcaaacaaagctttgttcctctcgtcttatttttagaatcccgaacaaaaaggaatggactcgaatagcttctcctgaagcagcaaccaaaaaatcagtatccccaataatcgtttctgatttcatcatcaaatttctttttcaattccgggtgcttctcaaagtattcatcagctgtcatcgtacttagttttttcttgagttcttggacatcagcaatttctttttccaatctttcagattccttgagggacttctgctcagcatctttaagttccaccaacagttcatcaaacttgggtttgtacttgggagtggtagtgtctacaaacttgggaatttcaacgctgtcatagtactctttgtaagaatcaactatgcgggatccaagtccttttctgtagtactcccagtcaattggctctggttcctgactgaatttggtttgaagagtggaattaacttcttcaaaggcgcgacggagagacgagaactcttttttagcttcatctgttacgatcattttcgccattccttcccaatctattgtctttgaggccttgaatgccacgtcactcaccttcttcaccactccgctcatcttttgattttttctttctctctctagaaaagtagcgtaaatcttcatcttcttcaatggcgaacagtaatctccctcgaagaatcatcaaggagactcagcgtttactcagcgagccagcgccggggataagcgcgtcgccatcggaagataatatgcggtattttaatgtcatgatccttggtccaacacagtctccttatgaaggaggagttttcaagctggagttatttttgccggaagaatatccaatggctgctcccaaggttcgttttcttacaaaaatttaccatccgaacattgacaagcttggtaggatttgtctagatatcctcaaagacaaatggagccctgctcttcagatccgcactgtacttctgagcattcaagctcttctaagtgctccaaatccagatgatccactatctgagaacatagcaaagcactggaaatctaatgaagcggaagctgtggaaacagcaaaggaatggacccgtttgtacgcaagtggtgcctagctggaatgtcggtcaacaacatgttactcctgaaaaataacaatgtacttgtttaggtcttgaaatttggaaattaaaacttaaatgattctgctggctagttccaaacaccaatgttgttaacttccttctatacctttaagtttttccagtatatgagatatgtaactctctttttcctaa

SEQ ID NO: 5122 - DNA, 811 bp, Chrysanthemum coronarium
gatcaacttagcgtaaacaatttctctctctagaaaaagatcaacttagcgtaaaccttcatcttcattttcaatggcgaacagtaatctacctcgaagaatcatcaaagagactcagcgtttactcagcgagccagcgccggggataagcgcgtcaccatctgaagataatatgcggtattttaatgttatgattcttggtccaactcagtctccttatgaaggaggagttttcaagcttgagttatttttgccggaagaatatccgatggctgctcccaaggttcgttttctaacgaaaatttaccacccgaacattgacaagcttggtaggatttgtctcgatatccttaaagacaaatggagccctgcacttcagatccgcactgtactcctgagcattcaagctcttctaagtgctccaaatcctgatgatccactatctgagaacatagctaagcattggaaatctaatgaagctgaagctgtggaaacagcgaaggagtggactcgtttgtacgcaagtggtgcctaactggaatgtcggtcaacaacatgttactcctggaaaataacaatgtacttgtttattaggtcttgaaatttcgagattaaaacttatatgattctgctggctggttccaaacaccaatgttgttaacttccttttatacccttgtgtttttccagtatatgagatatgtaactctgtttttctagtcttcttttttgaaacatttatttggttcatcatgtgaaattgtgtactgtggcctgtgggagtgtgggtatataagcagtatcatctaac

SEQ ID NO: 5123 - DNA, 838 bp, Cichorium intybus
aaatagtcgcagcgtgaaagaaagtgcttaaatccatcatcccccaacacattctctatctagaactttatctctctctctttctaaaaaggcaaaagccccttagcgtaaatcttccacttctatggcgaacagcaacctacctcgaagaattatcaaggaaactcagcgcttacttagcgaaccagctccggggataagcgcatcgccatcagaagataacatgcggtatttcaatgtcatgattcttgggccatcacagtctccttatgaaggaggagtctttaagctggaattatttcttcccgaggaatacccaatggctgcccccaaggtccgattccttacaaagatataccatccaaatatcgacaagcttggcagaatatgtcttgatattctaaaagacaaatggagccctgctcttcagattcgcacagtacttttgagcattcaagcacttttaagtgctccaaatccagatgatccactttcagaaaatatagcaaaacactggaaatcgaatgaagcagaagctgtggaaacagcaaaggagtggacacgtttgtatgcaagtggcgcctaatggatatagacgctcaaaataaaagataacaaatttacttttattacaacatattccaccatttgctttttctgtaaactcttgtttcttgaatatatgatgtatcttttatttcaagaatttagtgagcaatgtttacttgatttggttattatttgtttcaaacgaaatttattgggattttgtttgaccttgcgagggttgtgacatctatttccgatttagaagccaacgttgcttcttatttacctt

SEQ ID NO: 5124 - DNA, 903 bp, Cichorium intybus
agtctcgaatcaataacctgcccttcactttctctctctagaaaaccctcttttctctctttgtcgaaaaaaggcaaaagcccccttagcgtaaatcttccccttccatggcgaacagcaatctacctcgaagaattatcaaggaaactcagcgcttacttagcgaaccagctccggggattagcgcatcgccatcggaagataacatgaggtatttcaatgtcatgatccttggtccaacacagtctccttatgaaggaggagttttcaaattggagttatttttgccagaagaatatccaatggctgctcccaaggttcggtttcttacaaaaatttaccaccccaatattgacaagcttggtaggatttgtcttgatatccttaaagacaaatggagccctgctcttcagattcgcactgtcctcttgagcattcaagctcttctaagtgctccaaatccagatgatccgctctcagagaacatagcaaaacactggaaatccaatgaagctgaagctgttgaaacagcaaaggaatggactcgcctgtatgctagtggtgcctaatggatgagatgtgggtcattcgtgaaaataacaatgtactttgttaggtcttcaaatttaaaaattcaaaacttgaatgattttactctgccagtccctgaaccatcaatgttgttcacttcctaccttcatatctttgtgttttcttctgagtatatgagataagctactctcttttttctatttttctttcatgatacactcgtatgcttaactatgtggaattgcatcttttaaagagacttgtgcttatagccttgaacatattttcaagtgaaaagctagagattcaagtgatcttggattgttggtggtaatttttcttaaaatagtc

SEQ ID NO: 5125 - DNA, 851 bp, Cichorium intybus
tgctcacggctagagaaggaagtctcgaatcaataacctgcccttcactttctctctctagaaaaccctcttttctctctttgtcgaaaaaaggcaaaagcccccttagcgtaaatcttccacttctatggcgaacagcaacctacctcgaagaattatcaaggaaactcagcgcttacttagcgaaccagctccggggataagcgcatcgccatcagaagataacatgcggtatttcaatgtcatgattcttgggccatcacagtctccttatgaaggaggagtctttaagctggaattatttctgcctgaggaatacccaatggctgcccccaaggtccgattccttacaaagatataccatccaaatatcgacaagcttggcagaatatgtcttgatattctaaaagacaaatggagccctgctcttcagattcgcacagtacttttgagcattcaagcacttttaagtgctccaaatccagatgatccactttcagaaaatatagcaaaacactggaaatcgaatgaagcagaagctgtggaaacagcaaaggagtggacacgtttgtatgcaagtggcgcctaatggatatagacgctcaaaataaaagataacaaatttacttttattacaacatattcaccatttgcttttcatgtaaactcttgtttctttttgggttgaatgaatatatgatgtatcttttatttcaagaatttagtgaaacaatgtttacttgatttggttattatttgtttcaaacggaatttattgggattttgtttgaccttgcgggttgtgacatctatttccgatttagaagccaacgttgcttcttatttacctt

SEQ ID NO: 5126 - DNA, 788 bp, Cichorium intybus
aagcattcccagaaatagtcgcagcgtgaaagaaagtgcttaaatccatcatcccccaacacattctctctctagaactttatctctctctctttctaaaaaggcaaaagccccttagcgtaaatcttccacttctatggcgaacagcaacctacctcgaagaattatcaaggaaactcagcgcttacttagcgaaccagctccggggataagcgcatcgccatcagaagataacatgcggtatttcaatgtcatgattcttgggccatcacagtctccttatgaaggaggagtttttaagctggaattatttctgcccgaggaatacccaatggctgcccccaaggtccgattccttacaaagatataccatccaaatatcgacaagcttggcagaatatgtcttgatattctaaaagacaaatggagccctgctcttcagattcgcacagtacttttgagcattcaagcacttttaagtgctccaaatccagatgatccactttcagaaaatatagcaaaacactggaaatcgaatgaagcagaagctgttgaaacagcaaaggagtggacacgtttgtatgcaagtggcgcctaatggatatgaatgctgaaaataaaagataacaaatttacttttattacaaaatattcaccatttgcttattactctttttcatttgtaaactcttgtttcttttttgggttgaatgaatatatgatgtatcttttatttcaagaatttagtgaagcaatgtttacttgatttggttattatttgtttcaaa

SEQ ID NO: 5127 - DNA, 1317 bp, Trifolium pratense
gtattttcatttcattgagctttaatttgtgtttagtgagagaaaccttttttctctctctcagaaacacaaagccctattgcgtattttgcaatcgaccccaataatggccaacagtaacctccctcgaagaatcatcaaggaaacacagcgtttgctcagtgagccagcgcctggaattagtgcgtccccttcggaagacaatatgagatatttcaatgtgatgatccttggcccaactcagtctccttatgaagggggagttttcaagctagaactatttttgccagaagaatatccaatggctgctccaaaggttaggttcctgacaaaaatatatcatcctaacattgataagcttggcaggatatgtcttgatattctgaaagataagtggagtcctgcccttcagatccgcactgtacttttgagtattcaagcacttttgagtgctccaaacccagatgatccactttctgagaacattgccaagcattggaaatctaatgaggccgaggctgttgagacagccaaagagtggaccagattatatgctagcggcgcttgacaattgagtggatacttttggtctcaaataacaatagtggaagtgtatgcttattaactatcaaattgaaatggaaaaatttagaggaattgtctaaactattttggagtccatattcctcttagcttccggttacatgtttattgttttctatctcctggaagccttctattggaacttgtatgaatatatgggatgttttatgtgtcaaatttaaaacttggtccttcttcaactgctaaatgtaatttgggattctaaactcatacttttgaataagtttttcttctgggttgtcctcgttaccgtggatttggcttctcttaagtgaagagtgcctttttaaagtgaaagtgtggaatcatatctgattaagtgcatgttttgtgatcatgtttggtatcacaattggtttcgctagaatcaatgagtcaccaacaccatgattttggcaaaaacatgctctaattgaaaaatctaacagttgtactttgataatattctcagccttggaatttttcaattattatcagttagcacttgaattttatcatttatcaattttaacattctcactttcctcagagaagtcaaatccattaccctgtgaatccatgcttgttgtttggttgtcaagtaaagaaaactatctcaaaacaagacgtttctgtccaatcagtaaaagatgattatgttttgttagagttggataaaaacgttctaatcaaactatgtctctttcctcgtag

SEQ ID NO: 5128 - DNA, 816 bp, Setaria italica
ccccccgttccccaccctcgaccgactgcttcctcctcctcctccaccgcgcgatccttaaggcatcagcggcgccgcaacttcgcagaggaggaagtccgcgccccggccccgatccgatggccaacagcaacctcccgcgccggatcatcaaggagacgcagcggctgctcagcgagccagcgccggggatcagcgcgtcgccctcggaggagaacatgcgctacttcaacgtcatgatccttggcccggcgcagtcgccctatgaaggtggagtttttaagcttgagctctttttacctgaggaatatccaatggctgccccaaaggttaggtttctgaccaagatttaccatcccaacattgacaagcttggtaggatatgccttgacattctcaaggacaaatggagcccagcacttcagatccgaacagttcttttgagtatccaggctctcttgagtgcaccaaatccagatgaccctctgtctgataacattgcaaaacactggaaagccaatgaggctgaagctgttgaaacagcgaaggaatggactcgcctgtatgcgagcggtgcatgacaacccagtgctgttcttgatgtaataacccgtcatacttcagtcctaatctattgccatttgcttgatgagaacagactggagatatttgccatggaaggaagtctctaaatgacttaccggtcgaattgtttggttgtacacctgtggtcggttccctttacctttgggcacctttgactaatcagtatctgtggtagaactttctctactccaatatatttattacttcatg

SEQ ID NO: 5129 - DNA, 737 bp, Vicia sativa
ctcagcaactctcaaacccctatagcgtgtttttcaatcgacctagtaatggccaacagcaaccttccccgaagaatcatcaaggaaactcagcgtttgctcagtgagccagcgccgggaattagtgcgtcgccttctgaagacaatatgcggtatttcaatgtgatgatccttggcccaactcagtctccttatgaaggtggggttttcaagctagaactgtttttgcctgaagaatatccaatggctgctccgaaggttaggttcctgacaaaaatatatcaccctaacattgataagcttggcagaatatgtcttgatattctgaaagataagtggagtcccgcccttcagattcgcactgttcttttgagtattcaagctcttctgagtgcaccgaaccctgatgatccactttctgagaacattgccaagcattggaaatctaatgaggctgaggctgttgagacagccaaggagtggacccgattatacgccagtggcgcttgacaattgggtggatacttctggtctcaaataacaatagtggaaatgtatgctattaactatcaaattgaaatggaaaattttagaggaattgtctaatactattttggagtctatattcctcctagtttctggttacatgtctattggaacttgtatgaatatatgggatgttgtgtcaaaaatttaaaactccatcttcaacagctaaatgtaatttgggattctct

SEQ ID NO: 5130 - DNA, 857 bp, Brachypodium distachyon
ctcctcccccggctcgccctccccgacagatcgacgactcctttgacctctctcgcgctgtcttctcctccgtcgccgcgcgaagctcgaggcggtccctccccccctcccctctaggctctcgctccagccccggccggactccatggccaacagcaacctcccgcgccggatcatcaaggagacgcagcggctgctcagcgaaccagcgccggggattagcgcgtcgccgtcggaggagaacatgcgctacttcaatgtcatggtccttggtccggcgcagtctccttatgaaggtggagttttcaagcttgaacttttcttacctgaggaatatccgatggctgctccaaaagttaggtttctcacaaaaatataccatcccaacattgacaagcttggtaggatatgcctcgatatcctgaaggacaaatggagcccagctcttcagatacgtactgttcttttgagcattcaggcactgctgagcgctccgaatccagatgatccgctctcagaaaacgtggcaaaacactggaaatccaatgaagctgaagctgtcgagacagcgaaggagtggactcgcctgtatgccagtggtgcttgacaagccagcgctgttatgcatgtaataacaccatgtcatatctgggcctaatcgaaaaccatttgcttgataagaacaaactcgaagtgttttgcgatggaagaaagtgtccaaagctataaacagttcgagttcctgattgtatttgaggtgcatgttccagcacctgccactgctgtgccactctagcaaaatctgttgccgcttatgtaacttgctgtgtcctttcttcatcttcaattatttccca

SEQ ID NO: 5131 - DNA, 868 bp, Brachypodium distachyon
ctcctcccccggctcgccctccccgacagatcgacgactcctttgacctctctcgcgctgtcttctcctccgtcgccgcgcgaagctcgaggcggtccctccccccctcccctctaggctctcgctccagccccggccggactccatggccaacagcaacctcccgcgccggatcatcaaggagacgcagcggctgctcagcgaaccagcgccggggattagcgcgtcgccgtcggaggagaacatgcgctacttcaatgtcatggtccttggtccggcgcagtctccttatgaaggtggagttttcaagcttgaacttttcttacctgaggaatatccgatggctgctccaaaagttaggtttctcacaaaaatataccatcccaacattgacaagcttggtaggatatgcctcgatatcctgaaggacaaatggagcccagctcttcagatacgtactgttcttttgagcattcaggcactgctgagcgctccgaatccagatgatccgctctcagaaaacgtggcaaaacactggaaatccaatgaagctgaagctgtcgagacagcgaaggagtggactcgcctgtatgccagtggtgcttgacaagccagcgctgttatgcatgtaataacaccatgtcatatctgggcctaatcgaaaaccatttgcttgataagaacaaactcgaagtgttttgcgatggaagaaagtgtccaaagctataaacagttcgagttcctgattgtatttgaggtgcatgttccagcacctgccactgctgtgccactctagcaaaatctgttgccgcttatgtaacttgctgtgtcctttcttcatcttcaattatttcccagttaactcgcc

SEQ ID NO: 5132 - DNA, 980 bp, Cenchrus ciliaris
ttccccttcctcgaccgactgcttcctccttagaacaccaccgcgcgatcctcaaggcatcagcggcgccgcaacttcgcctctcttggaagaagcgccccggccccgatccgatggccaacagcaacctcccgcgccggatcatcaaggagacgcagcggctgctcagcgagccagcaccggggatcagcgcgtcgccttcggaggagaacatgcgctacttcaacgtcatgatccttgggccggcgcagtcgccgtacgaaggtggagtttttaagcttgagctctttttacctgaggaatatccaatggctgccccaaaggttaggtttctgaccaagatttaccatcccaacattgacaagcttggtaggatatgccttgacattctcaaggacaagtggagcccagcacttcagatccgaacagttcttttgagtatccaggctctcttgagtgcaccaaatccagatgaccctctgtccgataacattgcaaaacactggaaatccaatgaggcagaagctgttgaaacagcgaaggaatggactcgcatgtatgcgagtggtgcatgacaacccagtactgttcttgatgtaataacccgtcatacttcagtcctaatctattgccatttgcttgatgagagcagactggagatattgccatggaaggaagtctctaaatgacttaccagtcgaattgtttggttgtacacctgtggtcggttccctttacctttgggcaccttttgactaatcagtatctgtggtagaacttgctctactccaatatatttattacttcatgtaggggagtttctcaactgtccatattgttaaaactgaggcttgttaccttggctgcactttggttggtccactcgtttttgtgcttgtcatctgtgaaaccgtgctgctgaaactagagttgctcttgcacatttacattttgatagggatcactctagtcagtaaact

SEQ ID NO: 5133 - DNA, 989 bp, Setaria italica
cagcaaaaaccgcgtccgcgtacaatagcgagcgcccaacgccccaacccgcctctccccccgttccccaccctcgaccgactgcttcctcctcctcctccaccgcgcgatccttaaggcatcagcggcgccgcaacttcgcagaggaggaagtccgcgccccggccccgatccgatggccaacagcaacctcccgcgccggatcatcaaggagacgcagcggctgctcagcgagccagcgccggggatcagcgcgtcgccctcggaggagaacatgcgctacttcaacgtcatgatccttggcccggcgcagtcgccctatgaaggtggagtttttaagcttgagctctttttacctgaggaatatccaatggctgccccaaaggttaggtttctgaccaagatttaccatcccaacattgacaagcttggtaggatatgccttgacattctcaaggacaaatggagcccagcacttcagatccgaacagttcttttgagtatccaggctctcttgagtgcaccaaatccagatgaccctctgtctgataacattgcaaaacactggaaagccaatgaggctgaagctgttgaaacagcgaaggaatggactcgcctgtatgcgagcggtgcatgacaacccagtgctgttcttgatgtaataacccgtcatacttcagtcctaatctattgccatttgcttgatgagaacagactggagatatttgccatggaaggaagtctctaaatgacttaccggtcgaattgtttggttgtacacctgtggtcggttccctttacctttgggcacctttgactaatcagtatctgtggtagaactttctctactccaatatatttattacttcatgtaggagagtttctcaactgtccatattgttgaaactgaggcttgttaccttggctgcacctttgttggtccactcgtttttgtgctggtcatctgtgaaactagagttgcacttggc

SEQ ID NO: 5134 - DNA, 909 bp, Gossypium raimondii
acctttcttctttcctctgattttcttattctcggattctctcttcatctcccacttctcaaaaccctaattatatttttttatttcccattttgattcagcaatcgaagcttgccaatggccaacagtaatctccctcgaagaatcatcaaggaaactcagcgtctcctcagtgaacctgctccgggaattagtgcttcaccatcagaggataatatgcgatatttcaatgtgatgatccttggtcccacacagtctccatatgaaggaggggttttcaagttggaactatttttgcctgaagaatatcccatggctgctcccaaggttcgatttcttacaaagatatatcatcctaacattgataagcttgggagaatatgcctcgatattctcaaggacaaatggagtccagctctgcagatccgaactgtacttttaagcatccaggcactcttgagtgctccaaatccagatgatccactctccgagaatattgctaagcactggaaatcaaacgaggctgaagctgttgagacagcaaaggaatggacgcgtttatatgcaagcggtgcatgaagaccggtggaaccgtttgctctcataaaataacatttttatgcaatgtaagctattcaatgtcaattccatattgaaatctggacgaatgacagtttgaaagagtttgatatttgcaaccaaaaaaaaaaaagcttccaggtgctacccttttaatagtaattcggtcggaagcaatctctaagcttgtatgataatacacatggttctctaaaactcccaaaggctttaactatgggattattctctaatatggtgatttcagattctggctatatgtgtgtgtaatgaatctatcaactggaaatgaaagaatggattgattaaatt

SEQ ID NO: 5135 - DNA, 983 bp, Lolium multiflorum
ccaacccccgccgcctaccccttgttccccaagcccggctgacgcctcctcccgtcgcccccttcctccgcacgaaacaccggcgccgcactcatcggcgaggaagaagacatcgccccggcttgatccgatggccaacagcaacctcccgcgacgaatcatcaaggagacgcagaggctcctcagcgagccagcgccggggatcagcgcttcgccctcggaggagaacatgcgctacttcaatgtcatggtccttggaccggcgcagtctccttacgaaggtggagtttttaagcttgaacttttcttacccgaggaatatccgatggctgctccaaaagttaggtttctcacaaaaatataccatcccaacattgacaagcttggtaggatatgccttgacattctaaaggacaaatggagtccggctcttcagattcgaacagttctcttgagtatccaggcactcctaagtgcaccaaacccagatgaccctctctctgataacattgctaagcactggaaatccaacgaggcagaagctgttgaaacagcgaaggagtggactcgtctgtacgccagcggtgcatgaagacccaatgctggcgctgatgtaataatcaatcatactctagtcggtagtcgagtgccatttgcctgataagaagaaactggagatatctgcagtggaaggaagtatctaaatgactaccgctcgtcgctctatctggttgtacaacgtgttggttccctttaccctggggtgcctttgactgatcaatatttgtggtagacctttccgtgccgctccaagtatatcggttactctatgtaggagaacttaacaagtgtccacattattgtagttgaagttaaagatggcttgttttgctgcgaatttgttcttcctactaggctatctgggaattgttctgtcacacttggttgcgatttccgacggaatttagtttggtgaggctgcg

SEQ ID NO: 5136 - DNA, 840 bp, Lupinus angustifolius
agaggtgaaagttgaagattgattggttggtgagagaaagttgtgtgtgaaaacaaaaccctattgcttgctctgaaatcgaacccgatcatggccaacgctaatctccctcgaagaatcatcaaggaaacgcagcgtttgctcagtgaaccagcacctggaattagcgcttcgccttcagaagaaaatatgcgatatttcaatgtgatgatccttggcccatcccagtcaccttatgaaggaggggttttcaagttagaactatttttgccagaagaatatccaatggctgctccgaaggttaggtttctgacaaaaatatatcatccaaacattgataagcttggcaggatatgtcttgatattctgaaagataagtggagtcctgcccttcaaatacgcactgtgcttttgagtattcaagcccttttaagtgcaccaaacccagatgatccactttctgagaacattgctaagcattggaaaagtaatgaggccgaggctgttgaaacagcaaaggaatggaccagattatatgctagtggtgcctgatgtttgggtggaaacttttgccatcaaataacaatagtttctcatgtcaatttgaaatggaaatctgctggaactatttgggaattgatattcttggtagcttccactcttgtttattgctttcttctcctggaagccttttcctagaacatgtatcatttatgtgactttttatctgtcaaaatttataatatatttcatcttcaaccgctaagtaatttggaactcccaagttacaaggtacttgttttatcatttccttgagcctcatatatagctttatatata

SEQ ID NO: 5137 - DNA, 862 bp, Lupinus angustifolius
gagagaaactctctctctctctctctatatatatatatatatatattttttatatataaatctccgaaaccctattgcgtgctttgcaatcgacctcgataatggcgaacagtaacctccctcgaagaatcatcaaggaaacgcagcgtttgcttagtgagccagcacctgggattagtgcttctccttcagaagagaatatgcggtatttcaatgtgatgatccttgggcctacccagtcaccttatgaaggaggagttttcaagttggaactatttttgccagaagagtatccaatggctgctccaaaggtcaggtttctgacaaaaatatatcatccgaacatagataagcttggtaggatatgtcttgatattctgaaagataagtggagccctgctcttcagattcgtactgttcttttgagcattcaggctcttttgagtgcaccaaacccagatgacccactttcggagaacattgccaagcattggaaatctaatgaggccgaggctgttgaaacagccaaggaatggacccaattatatgctagtggcgcctgaggttggcctcaaataacagtagctgaagtgtatgctattagcaatcaattaaaaatagaaacatggaggatttgtggtttgaactattggagttaatattcctcttagctctctgttacttgttaattaatgtattccctcgaaatctaccttattttggaacttgtatgaatatatgtgttgagcatttatctgtctcagaatttagaacagactcaatcttcaagtgctatgtcccaatttatttggggctctaaacatcaaaagccaaactgtgaataattttgttagttctcttc

SEQ ID NO: 5138 - DNA, 650 bp, Medicago truncatula
aattctagtgagagaaaccttctttttctctctcttctctcatcaaccctcaaacccctattgcgtactttgcaatcgacccaataatggctaacagtaaccttcctcgaagaatcatcaaggaaacacagcgtttgctcagtgagccagcgcctggaattagtgcatccccttccgaagacaatatgcggtatttcaatgtgatgatccttggcccaactcagtctccttatgaagggggagttttcaagctagaactatttttgcctgaagaatatccaatggctgctccaaaggttaggttcttgacaaaaatatatcatcctaacattgacaagcttggcaggatatgtcttgatattctgaaagataagtggagtcctgccctccagattcgcactgtacttttgagtattcaagctcttttgagtgcaccaaacccagatgatcctctttctgagaacattgctaagcattggaaatctaacgaggctgaggctgttgagacagccaaagagtggaccagattatatgcaagcggtgcttgacaatttggtggatacttttggtctcaaataacaatagtggaagtgtatgctattaactatcaaattgaaatggaaaaatttagaggaattgtctaaactatg

SEQ ID NO: 5139 - DNA, 910 bp, Arachis hypogaea
gtgggagaaagcactctctctctcatttcttttttctttgtgtgttcctctctttctctctttctttttctccgagactcaaaaccctattgcgtgttttgcaatcgaccctccaaaaatggcgaacagcaacctccctcgaagaatcatcaaggaaacgcagcgtttgctcagtgagccagcacctggaattagtgcttcgccttcggaagacaacatgcgatatttcaatgtgatgatccttggccctactcagtcaccctatgaaggtggagttttcaagttagaactatttttgccagaagaatatccaatggctgctccaaaggttcggtttctaacaaaaatatatcatccaaacatcgataagcttggcaggatatgtcttgatattctgaaagataagtggagccctgcccttcagatacgcactgtactcttgagtatccaggctctgttgagtgcaccaaacccagatgatccactatctgagaacattgccaagcattggaaaagtaacgaggccgaggctgttgaaactgcgaaggaatggactcgattatatgctagcggtgcatgatttacgtggtggagactttcaggctgaaataacaatagtgcaagtgtaatggtagtaactgcaaatttgaaatgggaacgcggaggaattgatgtctgaacttattttggagttgatgttcctcatacatagtttccagttacctgttaattgctttcttccccgggtggaagcctttatcttggagcttgtattaatataaatgtgatctttttatctgccaaaattaagaacacactcccaacttcaactgttaagtaatttggaattgttaaagtcaaaatcaaaatcaaaacttttaaaaaaaaaaaaaaaaaaaaaacaaaagta

SEQ ID NO: 5140 - DNA, 573 bp, Arachis hypogaea
ggcaatcgacccctgacaatggccaacagtaacctccctcgaagaatcatcaaggaaacgcagcgtttgctcagtgagccagcaccgggaattagtgcttccccttcggaagataatatgcgatatttcaatgtcatgatcctcgggccgacccagtcaccgtacgaaggtggagtcttcaaattagagctatttttgccagaagaatatccaatggctgctccgaaggttaggtttctgacgaaaatatatcacccaaacattgacaagcttggcaggatatgtcttgatattcttaaagataagtggagtcctgcccttcagatacgcaccgttcttttgagtattcaggctcttttgagtgcaccaaacccggacgatccactttctgagaacattgcaaagcactggaaatcaaatgaggctgaggctgttgaaacagcgaaggaatggactcgattatatgcaagcggtgcctgatgattgggttcaaacttacggcttcaaacgttcaagtgtatgatatgactgagacacgcaacaggggataggcaaggcacacaggggataggc

SEQ ID NO: 5141 - DNA, 893 bp, Oryza sativa
cccccgtttcccccaccctcggctgacggctcctcctcctcctcctcctcttcctccctcccgatcccctcccccgcacgaaactcaaagcatccccggcgccgcagctccccggaggaggaagcccccgcgccccgccccgaccagatccgatggccaacagcaacctcccccggcgaatcatcaaggagacgcagcgactcctcagcgagccagcgccgggaatcagcgcgtctccgtcggaggagaacatgcgctacttcaacgtcatgatccttggcccggcacagtccccctatgaaggtggagtttttaagcttgaactctttttacccgaggaatatcctatggctgctccaaaggttaggttcctgaccaaaatataccaccccaacattgacaagcttggtaggatatgccttgacattctcaaggacaaatggagcccagcccttcagattcggacagttcttttgagtatccaggcactcctaagtgcaccaaaccctgatgatcctctctctgataacattgcaaagcactggaaagccaatgaagcagaagctgttgaaacagcaaaggagtggactcgcctgtatgccagcggtgcataaaacccaatgcctctcgtgatgtaataacccgtcatgctttagccttaatcaaatgccatttgcttgataagaacaaactggagatattggcagtggaagggagtttaaatgactaccgcttgaattatttgtctgtatacatgtggttggttccctttaccctagggcacccttgactaatcagtatctgtggtagaacttggtgctcctccaatatatttattactttatgttggaaaacttaaattgttgaaattggatctttgttcgtgtggctgc

SEQ ID NO: 5142 - DNA, 840 bp, Glycine max
attgagctttgttctcttttgtgttagtgagagaaagttctctctgcttctctctcttagactcaaaaccctattgcgtgctttgcaatcgaccccgattatggccaacagtaacctccctcgaagaatcatcaaggaaacgcagcgtttgctcagtgagccagcacctggaattagtgcgtccccttcggaagacaatatgcggtatttcaatgtgatgatccttggcccaactcagtcgccttatgaagggggagttttcaagttggaattatttttgccagaagaatatccaatggctgctccaaaggttaggtttctgacaaaaatatatcatccaaacattgataagcttggcaggatatgtcttgacattctgaaagataagtggagtcctgcccttcagattcgcactgtacttttgagtattcaagctcttctaagtgcaccaaacccagatgatccgctttctgagaacattgccaagcattggaaatctaatgaggccgaggcagttgaaacggccaaggaatggacccggttatatgctagcggcgcttgatgctttggtggaaacttttggcttcaaataactatagtgtgggagtgtatgctatataactgtcaaattgaaatggaaatttggaggaattgtctaaactattttggagttaatattccccgtagcttccggttacctgttaattactttctttctcctggaagcattatcttggaacttgtatgaaaaatatgtgatcttttctgtgacaaatttaaacatgcttcatctcccaactcctgagtaatttgggatcctcaaacttaatagtaaaaaat

SEQ ID NO: 5143 - DNA, 892 bp, Eutrema halophilum
gaaaaagaaaggaaaaatagaattaaaagcatcaaagagagacgacgaagcgtcctcgattatcaccgtgcgtcctttgctagcttcgctctctctcaaaaaccctaacttctctgagatcgatcgaacctgatagcgcgcgataatggcgaatagtaatcttccccgaagaatcatcaaggaaactcagcgtctacttagtgagccggctcctgggatcagtgcatctccgtcagaggaaaatatgcgctatttcaatgttatgattcttggtcctacacaatctccttatgaaggaggagttttcaagttggagctctttttgcctgaagaatatcccatggcagctcccaaggttaggtttctcaccaagatataccatcctaacatcgacaagcttggaaggatctgccttgacatactgaaagacaagtggagtcctgctctacaaatacgaactgtgctcttgagtattcaagctcttctaagtgcacccaacccagacgatccactgtctgagaacatagctaaacattggaagagtaatgaagcagaagctgtggacacagctaaggagtggactcgtctatatgcaagtggtgcttgatgaagattggaaacggagaaagatcattgtcatttaaataacattatatatggtgaaactctatctcaaggttttatctgaatcctttttctaaaactaaggaaaaagatttgtactctctgaatctgtataactagggggatttaagactcgtttacccatatttgcagtttatttttctttaaatgtgcttgcttaagctttgtttgtgttaaagatcttctctaatctctaaaacgctgtggatatcagatttcacaggttgtgaatgaaggtaaatttgat

SEQ ID NO: 5144 - DNA, 769 bp, Eutrema parvulum
aacctgatagcgcgcgataatggcgaatagtaatcttccccgaagaatcatcaaggaaactcagcgtctacttagtgagccggctcctgggatcagtgcatctccgtcagaggaaaatatgcgctatttcaatgttatgattcttggtcctacacaatctccttatgaaggaggagttttcaagttggagctctttttgcctgaagaatatcccatggcagctcccaaggttaggtttctcaccaagatataccatcctaacatcgacaagcttggaaggatctgccttgacatactgaaagacaagtggagtcctgctctacaaatacgaactgtgctcttgagtattcaagctcttctaagtgcacccaacccagacgatccactgtctgagaacatagctaaacattggaagagtaatgaagcagaagctgtggacacagctaaggagtggactcgtctatatgcaagtggtgcttgatgaagattggaaacggagaaagatcattgtcatttaaataacattatatatggtgaaactctatctcaaggttttatctgaattctttttctaaaactaaggaaaaagatttgtactctctgaatctgtataactagggggatttaagactcgtttacccatatttgcaaactaactttcttcaaatgtgcttgcgcttgagctttgattgtgttaaagatcctctctaatcattgaaataatatagatcataaggattcacaggttgtgggtgaagataaatctgat

SEQ ID NO: 5145 - DNA, 764 bp, Triphysaria pusilla
ttttctagtgagagaaaccaatcgagagaagaaaaccttttcgtgttagcgtaaaatctacgaacagagacccgtgggaagaagctcacgaaatcagcttaccaaatccgatctaatggccaacagcaacttaccgcgtagaatcatcaaggagacgcagcgtcttctgagcgaaccagcaccaggaataagtgcatccccatcagaagaaaatatgcggtatttcaatgttatgattcttggcccaacacagtctccttatgaaggaggtgtttttaagctggagttgtttttacctgaggaataccccatggctgccccgaaggttcgcttcctcactaaaatttaccaccctaacattgataagcttggaaggatatgcctagatattctgaaggataaatggagtccggctcttcagattagaactgttcttttgagcattcaagcacttttgagtgctccaaatcctgatgaccctctctctgaaaacattgccaagcattggaaatcaaacgagactgaagctgtcgaaacagctaaagagtggacgcgtttatatgcaagtggtgcttgaataagcatggaactttggtttacttatttaataattaaaaattgtattatattatcgtctggcaagtaaaacgtggaaagattggaaggacgggtctctataggtcttgtgttttcaattgttctcgtttttgttcgactgttcttgaaagtgtgcagatgatatatataaaggcactcatgttatg

SEQ ID NO: 5146 - DNA, 858 bp, Triphysaria pusilla
tcgcattttctagtgagagaaaccaatcgagagagaagaaaaccttttcgtgttagcgtaaaatctacgaacagagactcgtgggaagaagctcacaaaaatcagcttagcaaatccgatctaatggccaacagcaacctaccgcgtagaatcatcaaggagacgcagcgtcttctgagcgaaccagcaccaggaataagtgcatccccatcagaagaaaatatgcgttatttcaatgttatgattcttggcccaacacagtctccttatgaaggaggtgtttttaagctggagttgtttttacctgaggaataccccatggctgccccgaaggttcgtttcctcactaaaatttaccaccccaacattgataagcttggaaggatatgcctagatattctgaaggataaatggagtcccgctcttcagattagaactgttcttttgagcatacaagcacttttgagtgctccaaatcctgatgaccctctctctgaaaacattgccaagcattggaaatcaaacgagactgaagctgtcgaaacagctaaagagtggacgcgtttatatgcgagtggtgcttgaataagcatggaactttggtttacttatttaataatttaaaaattgtattatattatcgtctggcaagtaaaacgtggaaacgtttgaaggacggctctctacaggggcttgtgttttcaattgttctcgtttttgttcgactgttcttgaaagtgtgcagatgatatatataaaggcactcgtgttatgtcttgtcattgggaagcctatgaaattcttgattttactactttgaagtctgcagttcagttctatttcatttttggctccgca

SEQ ID NO: 5147 - DNA, 761 bp, Arabidopsis lyrata
aagatagagaaaggaaatcgaattaaaatcatcgtcagattcgagagacgacgacgaagttgttctcgattatcatcagcggctcccttcaaaaaccctaactctctgagctcgatcgacaagtgataatggccaacagtaatttgccgcgaagaatcatcaaggaaactcaacgtctgctcagtgaaccggctcccggtataagtgcctctccgtctgaggataatatgcggtatttcaacgttatgattcttggtcctacacaatcaccttatgaaggaggagttttcaagttggagctctttttgccggaagaataccctatggcagctcccaaggttaggtttctcacaaagatataccatcctaacattgacaagcttggaagaatctgtcttgatattctgaaggacaaatggagtcctgcactacaaatacgaacagtgctcttaagtattcaagctcttctgagtgcaccaaacccagatgacccgctgtctgagaacattgcgaagcactggaagagtaatgaggcagaagctgtggagacagccaaagaatggacccgcctttacgcaagtggcgcataatggattggagggtgaaaagatctctttcatccaaataacattacatttgatgaaatctatctcaacagaaagcttatattttgctggctcgtccccctcgcctgtaatttctctaaatcactgtatcattatcaataggatcaagactcgtttttcatatttgaagtactt

SEQ ID NO: 5148 - DNA, 921 bp, Cichorium intybus
tgctcacggctagagaaggaagtctcgaatcaataatctgcccttcactttctctctctagaaaaccctcttttctctctttgtcgaaaaaaggcaaaagcccccttagcgtaaatcttccccttccatggcgaacagcaatctacctcgaagaattatcaaggaaactcagcgcttacttagcgaaccagctccggggattagcgcatcgccatcggaagataacatgaggtatttcaatgtcatgatccttggtccaacacagtctccttatgaaggaggagttttcaaattggagttatttttgccagaagaatatccaatggctgctcccaaggttcggtttcttacaaaaatttaccaccccaatattgacaagcttggtaggatttgtcttgatatccttaaagacaaatggagccctgctcttcagattcgcactgtacttttgagcattcaagctcttctaagtgctccaaatccagatgatccgctctcagagaacatagcaaaacactggaaatccaatgaagctgaagctgttgaaacagcaaaggaatggactcgcctgtatgctagtggtgcctaatggatgagatgtgggtcattggtgaaaataacaatgtacttttttaggtcttgaaatttaaaacttgaatgattttactctgctagtccctgaaccatcaatgttgttcacttcctaccttcatatctttgtgttttcttccgagtatatgagataagctactctcttttttctattttcctttcatcatacactcatatgcttaactatgtgaaattgcatattttaaagagagttgtgcttatagccttgaacatattttgaagcgaaaagctagagattcaagtgatgttggattgttggtggtaaattttcttaaaaatagcttcttc

SEQ ID NO: 5149 - DNA, 1094 bp, Trifolium pratense
gaaaccttctttttcctctttctctctctctctctctgaaactcaaagccctattgcgtattttgcaatcgaccccaataatggccaacagtaaccttcctcgaagaatcatcaaggaaacacagcgtttgctcagtgagccagcgcctggaattagtgcatctccttcggaagacaatatgagatatttcaatgtgatgatccttggcccaactcagtctccttatgaagggggtgttttcaagctagaactatttttgccagaagaatatcctatggctgctccaaaggttaggttcctgacaaaaatatatcatcctaacattgataagcttggcaggatatgtcttgatattctgaaggacaagtggagtcctgcccttcagatacgcactgtacttttgagtattcaagcacttttgagtgctccaaacccagatgatccactttctgagaacattgccaagcattggaaatctaatgaggccgaggctgttgagacagccaaagagtggaccagattatatgctagcggcgcttgacaattgggtggatacttttggtctcaaataacaatagtggaagtgtatgcttattaactatcaaattgaaatggaaaaatttagaggaattgtctaaactattttggagtccatattcctcttagcttccggttacatgtttattgttttctatctcctggaagccttctattggaacttgtatgaatatatgggatgttttatgtgtcaaatttaaaacttggtccttcttcaactgctaaatgtaatttgggattctaaactcatcatacttttgaataagtttttttttattttggattgtcctcgttaccacggatttggcttctcttaagtgaagagtgccttttaaagaaagtgtgaaatcatatctgattaagtgcatgttttgtgatcgtgtttggtatcacagtcggttgctagaataatagtgagtcaccatgattttggcaaactcactttgttaccgaacatgctactttataataatctcagccgtggaattttatcacctatcaattttaacattatcactttcctcagagaaaaaaa

SEQ ID NO: 5150 - DNA, 899 bp, Cynara scolymus
ggcggggggctgcggctgagagagaagtctcgaatccataatttcccattcactttctctctctagaaaaccctctttctctctttatctctcctaaaaaaggcaaaagcccccttagcgtaaatcttccccttccatggcgaacagcaatctccctcgcagaattatcaaggaaactcagcgcttactcagcgaaccagctccggggataagcgcatcgccatcggaagataacatgcggtattttaatgtcatgatccttggtccaacacagtctccttacgaaggaggagttttcaaactggagttatttctgccagaagaatatccaatggctgctcccaaggttcggtttcttacaaaaatttaccatcctaacattgacaagcttggtaggatttgtcttgatatcctcaaagacaaatggagccctgctcttcagattcgcactgtactcttgagcattcaagctcttctaagtgctccaaaccctgatgatcctctttctgagaacatagcaaagcactggaaatctaatgaagctgaagctgttgaaacagcaaaggaatggacccgtttgtatgcgagtggtgcgtaaccgagatgtggaagacgagtgttggtcagaatgaaagaaataacaatgtacttggttaggtcttgagattgaaaacttgaatgattccgctgaatgaacgatcaatgttgttcacttccttcataccgttgtatttttttcgataagtaactctccatttcctaaattgttttgtgaacatctatagcggtagtattatggggtaaagtagcagcagcagcatcttatgttttagagacttcataccacctgaatctctgttgttttgttgcacaaaagagatccataaatttgggtggtg

SEQ ID NO: 5151 - DNA, 1202 bp, Mesembryanthemum crystallinum
ctccggattctctctttctctctcttcgtatctgaagctttctgcatcgaagctcgccccaatttcatcgatggcgaacagcaatctgcctcggagaattatcaaggaaactcagcgtctcctcagcgagccagctccgggcattagtgcttcgccatcagaagagaatatgcgatacttcaatgttatgattcttgggccttctcagtctccatatgaaggaggagttttcaaattggaactattcttgcccgaggaatatcctatggctgctcctaaggttcggtttctcaccaaaatatatcatcccaacattgataagcttggaaggatatgccttgatattctcaaggacaaatggagtcctgctctccagatacgaactgtacttttgagcattcaagcacttctcagtgctcccaaccctgatgaccctctctccgagaacatagctaaacactggaaagcaaatgaagctgaagccgttgaaactgcaaaagaatggactcgtctatatgcaagtggggcgtgacaacatggcgaaaacattatcttcttaaagacatttcatgagaatatgtttactatcaattgtcaattctgatttgagctgcaggattagaaatgaatctccaagtgaaaaatttagaagaaatgatgttaaaatgtgagtatgagatggctaaagcttcttgttacttgttctttaactgttttatcgtgtctttgaaatggtaaaagtagatgggttgctttcgttcccattaagttgtgtggtctggagacgctatcttttactgataaaaggcaacttagaattctaagtacatgtcattactgcacaagggtacctgttgtacatgcatcgtgagcttttagtggcactgggtgaattaacacaacatgtagccaattatgagaggaggaagataatcatgcaggttcagtgcagttaaaaaaaaaaatcaattaatataaaataaatcaggggggcccgtaccaatcgcctatgtggtcgattaaccgctactgccgctttacacgtctgactgaaaaaccgcgtacccactaatgctgcagaatcccttcgccgtgctatatcaaagccctacgacgccttcacagtgcaactgatgtatggaccgcctgtcggtctaatccgcctagtttgtcccatgtccttaatttcagccttcccttcg

SEQ ID NO: 5152 - DNA, 838 bp, Zea mays
aacccaccactgcctccctccccgttccccagtccccaccccgaccggctgctcctcctcctttccccgcgccatcctcgaggcatcaccggcgccgcaacttcgttgaggaggaagcccgcacccgcccccgatccgatggccaacagcaacctcccgcggcggatcatcaaggagacgcagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgaggaatatcccatggctgccccaaaggttaggtttctgaccaagatttatcatcccaacattgacaagcttggtaggatatgcctcgacattctcaaggacaaatggagcccagcacttcagattcgaacagttcttttgagtatacaggctctactgagtgcaccaaatccagatgaccctctctccgataacattgcaaagcactggaaatccaatgaggtagaagctgttgaaacagccaaggagtggactcgcctgtatgcgagcggtgcatgagagcgcagtgctgttcttggtgtaataaccccatcatacttcagtcctaatccgttgccatttgcttgataaaaatagactggagatatttgccatggaatgaagtctctaaatgactaccactctgaattgtttggttgtacacctgtggtcggttccctttacctttgggcacctttgactaatcagtatatgtggtagaacttgcagttactctaatatatttgtcacttcatgt

SEQ ID NO: 5153 - DNA, 1010 bp, Zea mays
ccttcgtctgtcgtctcgtctcgtccacctccccagcggcgcgtgaagcttgaggcaatccccgccctctctagccctgcgcaaccagttcggttccatggccaacagcaatctcccgcgccgaatcatcaaggagacgcagcggcttctcagcgaaccagcaccggggattagcgcgtcgccgtcggaggagaatatgcggtacttcaatgtcatgatccttggccccgcgcagtcaccctatgaaggtggagttttcaagcttgaactattcttgcctgaggaatatccaatggctgccccaaaagttagatttctcacaaaaatttaccatcctaatattgacaagcttggtaggatatgcctcgacattcttaaggacaaatggagtccagctcttcagatacgtacagttctactgagcattcaggcacttctgagcgccccaaacccagatgatcctctctcagacaacattgcgaaacactggaaatccaacgaagctgaagctgttgagacagcgaaggagtggactcgcctgtacacaagtggggcatgacagccaagtgttgttccagatgtaacaacacttccatagtttggggtcgattgaacacccctcttgcttggtgtgcgcaaatttgtgaaatgttgcaatggggtaaaaaacaaaaagctccaatcatgctttgtacttgtggctgtagctccgttcgctgcagtgcccatgaacatcaaagcaggtgttgctttgtccgttcctatccgaccatcagttgcttatcccccctgttccatgtgttgtggctatgaggattcagattcatgctgcctggaccagcagtcagcagataagctccggcgcgcacccccaccccacccacacgcgcgcgcgcacacacacgtaacataaaaaaaatgtctgccataagctagccctcccccgttttaggggtgtttgaatgcagataatagtaaattgctaaaattgtagaaacatccaaacaact

SEQ ID NO: 5154 - DNA, 899 bp, Glycine max
tttttttttttttcattttaatagagcgtttgctgcctgcaaaaaaagtttttcgatctcagcattgttcatttctgtctcactgagagaaactctctctctctctctctctctctctctagaaaccctattgcacgttttgcaatcgaactcgacaatggccaacagcaacctccctcgaagaatcatcaaggaaacgcagcgtttgctcagtgagccagcacctggtattagtgcctccccctctgaagagaatatgcgatatttcaatgtgatgatccttgggcctacccagtcgccttatgaaggaggcgttttcaagttagaactatttttgccagaagaatatccaatggctgctccaaaggttaggtttctaacaaaaatatatcatccgaacattgataagcttggcaggatatgtcttgatattctgaaagataagtggagtcctgcacttcagatacgcactgttctattaagcattcaagctctattgagtgcaccaaacccagatgatccactttctgagaacattgccaagcattggaaatctaatgaggccgaggctgtcgaaacagcgaaggaatggacccaattatatgctagtggcgcctgatgataggcttcaaacttatggctccaaaataacaattgtaaccattttatattggaaatctacaggaatttatgtatgaactattcgaattaatattcctagcagcttccagttacctgttaatttcttctcttggaagctgccttatgttggaacttgtatgaatatatgtgttgatcatttacctatctaacaatttagaacgtgcttcagtcgttgactgaagtaatttggtattctcaacatcaaaggccaaaatttgtgatttagtttctgttct

SEQ ID NO: 5155 - DNA, 873 bp, Glycine max
tgattctctcggcgttgttcatttctgtctcagtgagagaaactctctctctagaaaccctattgcacgttttgcaatcgaactcgacaatggccaacagcaacctccctcgaagaatcatcaaggaaacgcagcgtttgctcagtgagccagcaccaggaattagtgcctccccttctgaagagaatatgcgatatttcaatgtgatgatccttgggccaacccagtcgccttatgaaggaggagttttcaagttagaactatttttgccagaagaatatccaatggctgctccaaaggttaggtttctaacaaaaatatatcatccaaacattgataagcttggcaggatttgtcttgatattctgaaagataagtggagtcctgcccttcagatccgcactgttctactaagcattcaagctctattaagtgcaccaaacccagatgatccactttctgagaacattgccaagcattggaaatctaatgaggctgaggctgtcgaaacagcgaaggaatggacccgattatatgctagtggcgtctgatgatagggttcaaactcatggctccaaaataacaattgtaaccattttatattggaaatctagaggaattgatttatgaactattggaattaatattcctcgcagtttccagttaccttttaatttcttctcttgaaagctgccttatgtttgaatttgtatgaatatatgcgttgatcatttacctatctaacaatttagagcgtgcttcaatcatcgactgtgaagtaatttggtattctcaacatcaaaggccaaaatttgtgaattagtttctgttctctttactcatcaatgaatcattcaaagatttgattggtta

SEQ ID NO: 5156 - DNA, 738 bp, Euphorbia esula
tctctctttctctcaaaaaccctcgagtagcgttcgttctctgcaatccacctctaaagaaatggccaacagtaatctccctcgaagaatcatcaaggaaacccaacgtcttcttagtgaaccagctccggggataagtgcctcgccatcagaggataatatgcggtatttcaatgtcatgattcttggcccaacacagtctccatatgaaggaggagttttcaagctggaattgtttcttcctgaagaatatccaatggctgcacccaaggttcgatttttgaccaagatttatcatcctaatattgacaagcttggaaggatttgtcttgatattctgaaagacaaatggagtcctgctcttcagatacgaactgtacttttgagcatccaagcgctccttagtgctccaaaccccgatgatccactctcggagaatatagcaaagcactggaaatcaaatgaagctgaagctgttgaaacagcaaaggaatggacccgtttgtatgcgagtggtgcatgaagatgtgcgtcaactatttctcccttcaaacaaacttcatgtgatatatgctctctattaacttgttaaattgaatggaaaattgaagaattgatgtttgaacaaattataatttaatgttttcccaagcttccagatactgccctgatgagaatgtctgaagttggaagcatctttgttgaatttgtatgattagataacgtacatttttcctc

SEQ ID NO: 5157 - DNA, 846 bp, Triphysaria pusilla
aactaccgccattaggtgagggagacacgcccacaggaccatttcgcattttctagtgagagaaaccaatccagagaagaaaaccttttcgtgttagcgtaaaatctacgaacagagacccgtgggacgaagctcacgaaatcagcttagcaaatccgatctaatggccaacagcaacttaccgcgtagaatcatcaaggagacgcagcgtcttctgagcgaaccagcaccaggaataagtgcatccccatcagaagaaaatatgcggtatttcaatgttatgattcttggcccaacacagtctccttatgaaggaggtgtttttaagctggagttgtttttacctgaggaataccccatggctgccccgaaggttcgcttcctcactaaaatttaccaccctaacattgataagcttggaaggatatgcctagatattctgaaggacaaatggagtccggctcttcagattagaactgtactcttgagcatacaagcacttttgagtgctccaaatccggatgaccctctctctgaaaacattgccaagcattggaaatcaaacgagactgaagctgtcgaaacagcaaaagagtggacgcgtttatatgcgagtggtgcatgaataagcatggaactttggtttacttttttaataattaaaaattgtattatattatcgtctcgcaagtaaaatgtggaaagattggaaggatggctctctatagggcttgtgttttcagttgttctcatttttgttcgactgttcttgaaagtgtgcagatgatatatataaaggcactcgtgttatgtcttgtcattgggaagtctatgaaattcttgatt

SEQ ID NO: 5158 - DNA, 898 bp, Allium cepa
aatatcgaataaacattttcttctcacctatcgtttgtttcttaggtttcgcccccatttaaaacgaaagttaaatttagggtttctttcgattagatcagatggctaatagcaatcttcctcgaagaatcatcaaggaaactcaaaggttgttgagtgaaccggctcccggaataagtgcatcgccatcggaagaaaatatgagatattttaatgtcatgattcttgggccaactcagtctccatacgagggtggtgtgttcaagcttgaactttttctgcctgaagaatacccaatggctgccccaaaggtccggttccttaccaaaatctatcatcccaacattgacaagcttggaagaatatgccttgacattctcaaagacaaatggagtcctgctttgcagattcgaacagtattgctaagcatacaagcgcttttgagtgctccaaaccctgatgacccgctttcagaaaacattgccaagcattggaaggcaaatgaggctgaggccgtcgaaaccgcgaaggaatggacacgcttatatgccagtggtgcttgaatatgttaaggtcaacatatggggaaaacaataacaaatctgttatgtgcatcctgcttattgttttataaatgaatatgaaagtgctaaaatgataactcgcaagcagttcaatcatttgatgctattatatcgtatcatactatcatgtatatcacctttttcaaattgaaaaacctttgtattagtggtctgtttgaacctgtttattcatgttttaagagtctactttgagtgggttcccaagcactaagcaccttactgtttcttaataacaagggcctttgctacttggaatgctgtgaaattatctgatttgctatgcttgttttccc

SEQ ID NO: 5159 - DNA, 673 bp, Zea mays
cctcgacccaccccctcgtctcgtctcgtctcgtctcgtccacctccccagcggcgcgtgcgcgtgaagcttgaggcaatccccgctccgtctagcggccctgcgcaatcagtcagggttccatggccaacagcaacctcccgcgccgaatcatcaaggagacgcagcggctcctcagcgaaccagcgccggggattagcgcgtcgccgtcggaagagaacatgcggtacttcaatgtcatgatccttggccccgcacagtcaccctatgaaggtggagttttcaagcttgagctattcttgcctgaggaatatccaatggctgccccgaaagttaggtttctcaccaaaatttaccatccgaacattgacaagcttggtaggatatgcctcgacattcttaaggacaaatggagtcccgctcttcagatacgtacagttctgctcagcattcaggcacttctgagtgccccaaatccagatgatcctctctcagacaacattgcgaaacactggaaatcaaatgaagctgaagcttttgagacagcgaaggagtggactcgcctgtatgcaagtggggcattgtaaccaagtgttgtttcagatgtgatgttataacatttccatagtttggggccgactgaatacccctcttgcttgatgagagcaaattt

SEQ ID NO: 5160 - DNA, 730 bp, Musa acuminata
gccctttttcttttgccgggggctttccatacgagagtgaaggtctagatcggtaagagagagagagagagagagagagatcatcgtcccgatggcaaacagcaacctccctcgacggatcatcaaggaaacgcagcgtcttcttagcgaaccagctcctggcataagtgcatctccgtccgaggataacatgcgctacttcaatgtgatgatccttgggccaactcagtctccgtatgaaggaggggttttcaagctcgagttgtttttgcctgaggaatatccaatggctgccccaaaggtccgttttctcaccaaaatttatcatcccaacattgacaagcttggaagaatatgccttgacattttaaaggacaaatggagtccagccctccaaattcgaacagtactacttagcatacaagcacttcttagtgccccaaacccagatgaccctctttcagaaaacattgcaaaacattggaagacaaatgaagcagaagctgtcgaaactgcaaaagaatggacacgtctctatgctagtggggcataaaactcttcaggcagttctaataacatgtctaagtttatttgtccaacgccggctgctgacagttaaaaagggtggccgtcacactgtcatatcgcagggtgtatatcattttcttgagttgaaggtacctcttcatatatttatgtcatgaagttatattcctacgtctctttctag

SEQ ID NO: 5161 - DNA, 1092 bp, Daucus carota
gagatgaactgtaaaatgcaagttgaattttaggccacatatttgcgcagaaaaatagaccatgatactcatcacacttatgtacactctccttacattcagcaatatgcgtggttctttctgaaaaagacgacccgcaatttggatccctgccgaacaaaagtcttctccaaaccctctcctctttatacacatctctctctcttttaatattagcgtattttgtaatctatttatcttctcctttcttccgatggccaacagtaatctcccccgccgaatcatcaaggaaactcagcggcttctcagtgaaccagctccggggataagtgcatcgccgtcggaagaaaatatgcgctacttcaatgtcatgatcctcggtccctcacagtctccgtatgaaggtggcgtctataagttggaactgtttttacctgaggaatatccgatggctgctccaaaggtacgctttctcaccaaaatatatcatcccaacattgacaagcttggaagaatatgtcttgatattcttaaagataaatggagtcccgctcttcagattcgtaccgtattgttaagcattcaagctctattgagtgctccaaacccggatgatcctctctctgaaaacatagcaaagcattggaaatcaaatgagactgaagctgttgaaacagcaaaggagtggacccgcctatatgccagtggtgcatgatgaagttgggaaaccgggagccatcttcctcaccaaaaataacaatagatgcaacgttatcctaccaaagttgaagttaaaatggaatttggaagaaaggatccttgtgcagctggagcttaaaattatcaaaacatgctggcaaatacttgtttcttgactcaaggttgaaattagatttgtatcatgatatgcgatcttgtcctgtttttgtgattgttctcatgttgggatttgttattgtatgaaaatgttggagtcacttggtacaagtaaatataaataggtggtgtttggttgtgcttacaaagcttagcttctccaaaatctataatgtgtgtaataaatttataaattgatttctgacctaagtgaga

SEQ ID NO: 5162 - DNA, 593 bp, Ricinus communis
aaaagttgctaatagagttgtagtgagggaaagaaataaatattctctctccctgaaaaacccttgaagtagcgttcattgcaatcgacttttcaaagaaatggcaaacagtaatctccctcgaagaatcattaaggaaactcaacgacttctcagtgaaccagctccaggaataagtgcttcgccctctgaagataatatgcgatatttcaatgtgatgattcttggccccacacagtctccttatgaaggtggagttttcaaactggaactctttcttcctgaagaatatcccatggctgcaccaaaggttcggtttctgaccaaaatataccatcctaacattgacaagcttgggagaatatgtcttgatattctgaaagacaaatggagtcctgctcttcagatacgaactgtacttctcagcatccaagcactgctcagcgccccaaaccccgatgacccactttctgagaacattgccaagcattggaagacgaatgaggctgaagctgtggaaacagccaaggaatggacccgtttatatgcaagtggtgcgtgaagatttggtgggaacttctaccctttcaaac

SEQ ID NO: 5163 - DNA, 738 bp, Cyclamen graecum
ctctctctttctctgaatcgatccttcaagcaatggccaacagcaatttaccacgaagaatcatcaaggaaactcagcgtcttctcagcgaacctgcaccaggaattagtgcatctccttcggaagataatatgcgttattttaacgtaatgattcttggtccgacacagtctccttatgaaggaggggttttcaagctggagttgtttttgcctgaagaatacccaatggcagctcccaaggttcggtttctcacaaaaatctaccatcctaatattgacaagctggggagaatatgcctcgatattctcaaggacaaatggagccctgcccttcagattcgaactgtacttttgagtattcaagctcttttgagtgctccgaacccagacgaccctttatccgagaacattgccaaacattggaaatcaaatgaagccgaggctgttgaaactgctaaagaatggacccgtctatacgcaactggagcttgaagcatgttgccttatgattatccgaaataacaaaatgtgctatatgttaatctgtggccgagatctatgaaattggagagaatacttcctaagattgttatgttgtcaaagcttccaatatattcccataattgtttttcaacttccaaaacttgtaatgaaagtgtataattagacacaacgcctttgttggttatttcaaaattttcgtgatgctatgtcggagcactggttagtcgtaaaa

SEQ ID NO: 5164 - DNA, 832 bp, Echinochloa colona
gccctccccgaccctgacggctctttgacccctcgtctcatcccgtctctcctccatcgccgcggcaaatccccccgcacccaccttgccctacggccgccttagccctgcgcaatccagccgggcaccatggccaacagcaacctcccgcgccgaatcatcaaggagacgcagcggctcctcagcgaaccagcgccagggattagcgcgtcgccgtcggaggagaacatgcggtactttaatgtcatgatccttggccccgcgcagtcaccctatgaaggtggagttttcaagcttgaactattcttgcctgaggaatatccaatggctgctccaaaagttagatttctcaccaaaatttaccatcccaacattgacaagcttggtaggatatgccttgatatccttaaggacaaatggagtccagctcttcagatacgtactgttctgttgagcatccaggcactgctgagcgcaccaaatccagatgatcctctctcagacaacattgcaaaacactggaaagccaatgaagccgaagctgtcgagacagcgaaggaatggactcgcgtgtatgcgagtggggcatgacatccaagcattgttatctttgtaataacactttaatagtttgatcccgattgaatatcacttgcttgacagagcaaattgcaacaatctgtaatggggggaaaatgttcgaaacataacagttcgaattatgctttgtacctgttgctctagctcccttcactgcagtaagcatcaaagcaagtgttgcttggtctgttactatttgctcttcagtggctcttgctccctgcactacccg

SEQ ID NO: 5165 - DNA, 936 bp, Avena sativa
tggcttctcccctcgctcgcctcgggctctctcatccaggtccaggcgcatcctccctcctctcccgacctgttgacgactcctttgacctctcgcgctgtcccctcctccaccgtcgccgcacgaagctcgaggcgtccccctccccccacccccacccctcgatccgccggcagctccagcgccatggccaacagcaacctcccgcgccggatcatcaaggagacgcaacggctgctcagcgaaccagcgccggggatcagcgcgtcgccgtcggaggagaacatgcgctacttcaatgtcatggtcctcggcccggcccagtctccttacgaaggtggagtttttaagcttgaacttttcttgcccgaggaatatccgatggctgctcccaaagttaggtttctcacaaaaatataccatcccaacattgacaagcttggtagaatatgccttgacatcctcaaggacaaatggagtccagctcttcaaatacgcactgttcttttgagcattcaggcactcctgagtgctccaaacccagatgaccctctctcagaaaacgtcgcaaagcactggaaatccaatgaagctgaagctgtcgagacagcgaaggagtggactcgcgtgtatgccagtggtgcatgacagtctaagagcgctgttatggatgtaataacaccatgtcgtagttgggtctaactgaaaacaatttgcttgataagaacaaacttgaaaccttgttgcgttggaattaaagtgtccagagcgataacacggttcaagttaccggttgtatttgtggtgcatgatctggcaccctgtcactgctgcgccattctagcaaaatctgtttccgcttgtggaagaacatgctgtgtttccccttgatcttcaatcatttatcagttccgctgtgatcctatgtaaagctgt

SEQ ID NO: 5166 - DNA, 1666 bp, Petroselinum crispum
cccgactgaggaaggatgggtcgtaagcagaaaaaacaacccacgttataattttggatctgccgaacaaagtctcccccaaacccccactatatatacacctactctctctccctgtatctatatctgctactgctactcccaaatccctttctatctagcgtactttgtaatctatttcttttttcttccatggccaacagtaatttacccagacgaatcatcaaagaaactcagcgtcttctcagcgaaccagcgccgggaattagtgcatcgccgtctgaagataacatgcgatactttaatgtcatgattcttgggccaacacaatctccatatgaaggtggggtttttaagcttgaattgtttttgcctgaagaatacccaatggctgctcccaaggtgcggttcctgacgaaaatttatcatcctaacattgacaagcttggaaggatatgtcttgatattttgaaagataaatggagccctgctcttcagattcgtactgtgctgttaagcattcaagcccttctcagtgctcctaatcctgatgacccactctccgagaatattgcaaagcattggaaaacaaatgaggctgaagctgttgagacagcaaaggaatggacccgtttatatgctagtggcgcttgaagaaatttctcaaactggaagcgcgccaaataacaatatctgcgatgtactctaaggaagaactgaagtttgaacaggaacttttattatcttggaaacatactagcttacagatactttgttccgaaccttggtgttgaaagctaaaaactgtaatttgagacatggtgttcttgttcttttacttcattatagcaatgcttgaaaatagctgtttgcaattttgtggctacagtcatgagcagcatggcaggtataaatcaaatctcatggatggtgatgttgcgcaccctggtctggtaaagtttgtctctctattgatgaactcataccttcaccttcaccaagtgtgaatccaaataaacgcctgcaccttaagtgagtgggagaatttagatttttgtctgatagtatttcgcatatgtttattatttatagatgtgagagtagagtggtcatttttagatttaggaagtagaaactaggttgggttaatgtaacgagcgagtagtaataattaggaagcgtcatcttggatacgacagaagtagatagaaagatagagttgtgcacagaaggtagaaattattgttctttttaaattaatgttggtggtacgggtaaattatcattttgcccctgaccgcgtaccgcgaacaatgtccaggatacgtctatgttcccttctcctcagcagtccctccaatctgctggctggctctgctggataaaatctgaacatgggtgaagttattggtaaagtaggagcacaattctcatcaaaattagatggtctcggatttggacctctagaagattggacaggatacattttgggaaaccccatcatcgagtaaaagtcgttatggttaaaaattgtatccctaggggtggaactcaaacaggaaatttcagctcatgtaagattagatggtcttggtgtcatcagcgaaaccgaacccaatcctaaacatctctcgtcacatgaagcttcccatcagttccaatctct

SEQ ID NO: 5167 - DNA, 863 bp, Petroselinum crispum
cccgactgaggaaggatgggtcgtaagcagaaaaaacaacccacgttataattttggatctgccgaacaaagtctcccccaaacccccactatatatacacctactctctctccctgtatctatatctgctactgctactcccaaatccctttctatctagcgtactttgtaatctatttcttttttcttccatggccaacagtaatttacccagacgaatcatcaaagaaactcagcgtcttctcagcgaaccagctccaggaataagtgcatcgccatctgaagaaaatatgcgctacttcaatgttatgattctcggtccatcacagtctccttatgaaggtggcgtgtttaagctggagctgtttttacctgaggaatatccaatggctgctcctaaggttcgatttctcaccaagatataccatcccaacattgacaagcttggaagaatatgtcttgatattttaaaagacaaatggagtcctgctcttcaaattcgtaccgtactcttaagcattcaagccctattgagtgctccaaacccggatgatcctctctctgagaacatagcaaagcattggaaaacgaatgagaccgaagctgtagaaacagcaaaggagtggacccgcctgtatgccagtggtgcatgacaaaattgggaaatggggaactatcttctacaaataacaatagatgcaaatgtattcctattaaagttgaaatttacggtatggaaagaatggatccttgagcagccagctggagattaaaattgtgaaagcatgctggcagttgcatgtttcttgtcttaaacttgaaattggatttgtatcatgatatgcgaacttgtccctttttt

SEQ ID NO: 5168 - DNA, 606 bp, Capsicum annuum
aaactattctccagttgctctcattcccccttttctctctctagaacccttggcgtaaactctacccccgaagaacccaaaaggcttttctccaatttcaatggctaacagcaatcttcctcgaagaattatcaaggaaactcaacgtcttcttagcgaacctgcgcctgggataagtgcgtcgccatcggaagacaatatgcgatactttaatgtcatgattcttggtccaacacagtctccttatgaaggaggtgtcttcaagctcgaactatttttgcctgaagagtacccaatggctgctcctaaggttcgattcctcaccaaaatctaccatccgaacattgataagcttggtaggatatgtcttgacattcttaaagacaagtggagtcctgctcttcagatccgtactgtacttttgagcattcaagcacttttgagtgctccaaatccagatgatccactctctgaaaacatcgcaaagcactggaaggcaaatgaggctgaagctgttgaaacggctaaggagtggacgcgtctatatgctagtggtgcatgaagagatagcaatgaaatattcaaatataacaaaaatcatggaat

SEQ ID NO: 5169 - DNA, 787 bp, Theobroma cacao
accttttttattttctgtgttttgttcgccaaaatttttctctctcttcccctttctctctcaattctcaaaaaccctaaatttttttggctttcccttttgcttcatcaatcgatcctcgtcaatggccaacagtaatctcccgcgaagaattatcaaggaaactcagcgtctcctcagtgaaccagcacctggaattagtgcttcaccatcagaagataacatgcgatatttcaatgtgatgattcttggtcccacacagtctccatatgaaggaggggttttcaagttggaactatttttgcctgaagaatatcccatggctgctcccaaggttcgatttcttacaaagatatatcatcctaacattgataagcttggaagaatatgccttgatattctcaaagacaaatggagtccagctctccagatccgaactgtacttctgagcattcaagcacttctaagtgccccaaatcctgatgatccactctccgagaacattgctaagcactggaaaacaaatgaggctgaagcggttgagacagcgaaggaatggacccgtttatatgcaagtggtgcatgatgactggtgcaaacgattgccctcttgaaataactttctatgcaatgtaagctattcaatgtcaatttgatatggaaatttggaagaattgatgttttaaagagtttgatatctatcaaaagcttccagttgctacctgttaattgttttccttgttggaagcagtctctgaacttgtatgataatatataccttgttctc

SEQ ID NO: 5170 - DNA, 1017 bp, Echinacea purpurea
gggggagagaagaaagtctggaatccataatctcattctcccgtttactttactttctctctctaaactaaaaacccctcttttctctctcttctttgcgtaaatcttcccttcaatggcgaacagcaatcttcctcgaagaattatcaaggaaactcagcggctactcagcgaaccagctccggggataagcgcatcgccatctgaagataatatgcgctattttaatgttatgatccttggtccaacacagtctccttatgaaggaggagttttcaagctggagttgtttttgccagaagaatatcctatggctgctcccaaggttcgatttcttacaaaaatttaccatccaaacattgacaagcttggtaggatttgtcttgatatcctcaaagacaagtggagccctgctcttcagattcgcactgtgctcttcagcattcaagctcttttaagtgctccaaatccagatgatccgctttccgagaacattgcgaagcattggaaatctaatgaagctgaagctgttgaaacagcaaaagagtggacccgtttgtatgccagtggcgcctaacggagctttggtcactgtgttgttcggacaaaataactatgtatttggttagaggtctaaatcttgaatggttccgcctgctgcaatgttgttcacttcttttttcagataaaacactaattgtcatatgtgaaacactcatctggtaactatgtgaaaaagtaattctgaacacagttgttataaccctatgcctttagggtgatttgatgtgattcctgttgttacaactgaccggttgcatttagggtgaacgtcacaaaatgacatcaataaaacaataagaattcattaagaaaagtgtaatagtgacaatgttcttatgccttttagttgtgtactatttatctatagcgttcgttaacaaggataattttgtgtttttgttagctccagtgtttcgaaaccggaccattccattacggctattggtatcgtga

SEQ ID NO: 5171 - DNA, 929 bp, Panax ginseng
aaactcacattttttcaagtgagaggaagtcttaaagccaccacactttctctctctgaaaacccttgttagcgtactttgtaatcgaagcttcttcaatggcgaatagcaatttacctcgaagaattatcaaagaaactcagcgtctcctcagcgaaccagctcctggaataagtgcatcgccatctgaagacaatatgcggtactttaatgtcatgattcttggtccgacacaatctccatatgaaggtggggtttttaagctggaattgtttttacctgaagaatacccaatggctgctccaaaggttcggttcctcaccaaaatttaccatcctaacattgacaagcttggaaggatatgcctcgatatcctgaaggacaaatggagtcctgctcttcagattcgtactgtactattaagtattcaagccctattgagtgctcctaacccagacgaccccctctctgaaaacattgcaaagcattggaaaacaaatgaggctgaagctgttgaaacagcgaaggaatggacccgtttatatgccagtggtgcataacaaagttgtggaaactggaatctctgccaaaataacaatatatgcagtgtattctcaaagcatactcactgatcattgtatcctgacttccaaaccttgctgttgaaattgtataatgagatgagatactcctgtcgagtgttgtctgtctttcaagtttaggaatgtgtgaaaattgtctgaaaatttgggattcacttggtaaaatcattgtgaagctaagtaaaattatatgcgtgtttgggctgctgatcagcttttaacttcttttgcttcttcaaaaagagtattatactataaccgagtgtgcatttataaatcttgttcaaacttggtcataattgttgaattcaatgatgtgattagaca

SEQ ID NO: 5172 - DNA, 1128 bp, Panax ginseng
ggtatcaacgcagagtacatggggactcacattttttcaagtgagagaaagtctcaaagccaccgcactttctctctctctctgaaaacccttgttagcgtactttgtaatcgaagcttcttcaatggcgaacagcaatttacctcgaagaattatcaaagaaactcagcgtctcctcagcgaaccagctcctggaataagtgcatcgccatctgaagacaatatgcggtactttaatgtcatgattcttggtccaacacaatctccatatgaaggtggggtttttaagctggaattgtttttacctgaagaatacccaatggctgctccaaaggttcggttcctcactaaaatttaccatcctaacattgacaagcttggaaggatatgcctcgatatcctgaaggacaaatggagtcctgctcttcagattcgtactgtactattaagtattcaagccctattgagtgctcctaacccagacgaccccctctctgaaaacattgcaaagcattggaaaacaaacgaggctgaagctgttgaaacagcgaaggaatggacccgtttatatgccagtggtgcataacaaagttgtggaaactggaatctctgccaaaataacaatatatgcagtgtattctcaaagcatactcactgatcattgtatcctgacttccaaaccttgatgttgaaattgtataatgagataagatactcctgtcgagtgtgtctgtctttcaagtttaggaatgtgtgaaaattgtctgaaagtttgggattcacttggtaaaatcattgtgaagctaagtaaaattatatgcgtgttggggctgctgatcagcttttaacttcatttgcttcttcaaagagtatactataaccgagtgtgcatttataaatcttgttcaaacttggtcttaattgttgaattcaatgatgttgtgattagacataacaagtattactgacataattttttttacctctttcttcgttgctttagcaacttctaatgttttcttattactggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 5173 - DNA, 707 bp, Panax ginseng
agagagagagagtcccaaaaagccattgcaatctcctctttccctctctgaaacccttattagcgtaaatcttattcaaagcttcttcaatggcgaatagcaatctacctcgaagaataatcaaagaaactcagcgtctcctcagcgaaccagctccgggaataagtgcttcgccgtcagaagacaatatgcgctactttaacgtcatgattcttggtccgacacaatctccatacgaaggtggggtttttaagctggaattgtttttgcctgaagaatacccaatggctgctccaaaggttcggttcctaaccaaaatataccatcccaacatagacaagcttggaaggatatgtcttgatattcttaaagacaagtggagccctgctcttcagattcgtaccgtactattaagcattcaagccctattgagtgctccgaacccagacgatccactctctgagaacattgcaaagcattggaaaacaaatgaggctgaagctgttgaaacagccaaggaatggacccgtttatacgccagtggtgcatgacgaggttgtggaaactggaatctccaccaaaataacaataacaatatatatatatatatatatatataactgggagcttaaaatattctcaaagcatgcatacttccaaaccatgatgtctaaattgtataatgagataagatggtcgtttctatc

SEQ ID NO: 5174 - DNA, 885 bp, Panax ginseng
acattttttcaagtgagaggaagtcttaaagccaccacactttctctctctgaaaacccttgttagcgtactttgtaatcgaagcttcttcaatggcgaatagcaatttacctcgaagaattatcaaagaaactcagcgtctcctcagcgaaccagctcctggaataagtgcatcgccatctgaagacaatatgcggtactttaatgtcatgattcttggtccgacacaatctccatatgaaggtggggtttttaagctggaattgtttttacctgaagaatacccaatggctgctccaaaggttcggttcctcaccaaaatttaccatcctaacattgacaagcttggaaggatatgcctcgatatcctgaaggacaaatggagtcctgctcttcagattcgtactgtactattaagtattcaagccctattgagtgctcctaacccagacgaccccctctctgaaaacattgcaaagcattggaaaacaaatgaggctgaagctgttgaaacagcgaaggaatggacccgtttatatgccagtggtgcataacaaagttgtggaaactggaatctctgccaaaataacaatatatgcagtgtattctcaaagcatacttcactgatcattgtatcctgacttccaaaccttgatgttgaaattgtataatgagatgagatactcctgtcgagtgttgtctgtctttcaagtttaggaatgtgtgaaaattgtctgaaaatttgggattcacttggtaaaatcattgtgaagctaagtaaaattatatgcgtgttggggctgctgatcagcttttaacttcatttgcttcttcaaagagtatactataaccgagtgtgcatttataaatcttgttcaaacttgg

SEQ ID NO: 5175 - DNA, 857 bp, Panax ginseng
aaaaagccattgcaatttgctctttccctctctgaaacccttattagcgtaaatcttattcaaagcttcttcaatggcgaatagcaatctacctcgaagaataatcaaagaaactcagcgtctcctcagcgaaccagctccgggaataagtgcttcgccgtcagaagacaatatgcgctactttaacgtcatgattcttggtccgacacaatctccatacgaaggtggggtttttaagctggaattgtttttgcctgaagaatacccaatggctgctccaaaggttcggttcctaaccaaaatataccatcccaacatagacaagcttggaaggatatgtcttgatattcttaaagacaaatggagccctgctcttcagattcgtaccgtactattaagcattcaagccctattgagtgctccaaacccagacgatccactctctgagaacattgcaaagcattggaaaacaaatgaggctgaagctgttgaaacagccaaggaatggacccgtttatacgccagtggtgcatgacgaggttgtggaaactggaatctccgccaaaataacaataacaatatatatatatatatatatatggggtgtagtgtaatctatggacacttgaaatttaatgggaagaactagtagttgaataactgggagcttaaaatattctcaaagcatgcatacttccaaaccatgatgtctaaattgtataatgagataagatggtcgtttctatcgtattagttgtgaatgtgagaaagtagtttgaatgtttggattttttttcccccttgcaatctgtgatacataaggtgtaaatatatttaaaaaaaaattggaagtaaaa

SEQ ID NO: 5176 - DNA, 790 bp, Vitis vinifera
ctcttttctctctttactttctctctgcctttcgtcctctcttcaatggcgaacagcaaccttcctcgccggatcatcaaggaaactcaacgtctccttagtgaaccagcgccgggaatcagtgcttcgccatctgaagacaatatgagatattttaatgtcatgatccttggtccaactcaatctccatatgaaggtggggttttcaagttggagttgtttctgcctgaagaatatccaatggcagctcccaaggttcgttttctcaccaaaatatatcatcccaacatcgacaagctcggaaggatatgccttgatatcctgaaagacaaatggagccctgctctccagattcgaaccgtactcttgagcattcaagcactactaagtgctccaaacccggatgatcctctttctgagaacattgctaagcattggaagacaaacgaagctgaagctgttgaaacagcgaaggaatggactcgcctgtatgcaagtggcgcatgatggcgatgacatggtgaaaatttgtgccctctttgaataacttctgtgcttctgtatgttaatgactgaatttcaaatggaacttgtgtagaagtaatgcttgatcgatcagagtttaatatttgcaaagcttctcgataatgcctattaattattctcctttggaagctttgtatttcaacttgtatgattagaatgacataccaatcttctctatatctctccaatgcaggattttggatgggagatgggggagtaattgaaatgtgaaagttgattagga

SEQ ID NO: 5177 - DNA, 923 bp, Lupinus angustifolius
accctggccatgtggttttaatactttgtttgttgccttgtcggaaataatttgaagtttttcaaggtctcaaatttccgacagaacccaccatatttctctatatatctgaaaccctatcgcgtgctttgcaatcgactccgataatggccaacagtaacctccctcgaagaatcatcaaggaaacgcagcgtcttcttagtgagccagcacctgggattagtgcttccccttcagaagacaatatgcgatatttcaatgtgatgatccttgggcctacccagtcaccttatgaaggaggagtgttcaagttggaactatttttgccagaggagtatcctatggctgctccaaaggtcaggtttctgacaaaaatatatcatccgaacattgataagcttggtaggatatgtcttgatattctaaaagataagtggagccctgcccttcagattcgcactgttcttttgagcattcaagctcttttgagtgccccaaacccagatgacccactttcggagaatgttgccaagcattggaaatctaatgaggccgaggctgttgaaacagccaaggaatggacccgactatatgctagtggcgcctgaggttttcctcaatcaacagtagctgaagtgtatgctattaacaatcaattgaaaatagaaacctggaggaattgttgtttgaactattggagttaatattcctcttagcttcctgttttacctgctaattaacatcttctcttgaaagctaccttatcttggtacttgtatgaatatgtgttgagcattatctgtctcacaatttagaacatactcaatcttcaaatgctgagtcctaatttatttggggctctaaacatcaaaagctaaactgtgaataaattttagttgctctcttcacttcaatgaatctgt

SEQ ID NO: 5178 - DNA, 1056 bp, Lupinus angustifolius
tggttggaaagaatttaaagaaggtttcggagttgcctaatttctaatccaacccaacatcatagtcacataaactctctctctctctctctctctctctctctctctcaaaccctcttgcgtgctttgtaatcgacctcgatcatggccaacagtaaccttcctcgaagaatcatcaaagaaacgcagcgtcttctcagtgagccagcacctggaattagtgcttccccttcagaagataatatgcgatatttcaatgtgatgatccttggaccaacccagtcaccttatgaaggaggagttttcaagttagaactatttttgcccgaagaatatccaatggctgctccaaaggtcaggtttctgacaaaaatatatcatccgaacatcgataagcttggtaggatatgtcttgatattctgaaagataaatggagccctgcccttcagatacgcactgttcttttgagcattcaagctctgttgagtgcaccaaacccggatgatccactttctgagaacattgccaagcattggaaatctaatgaggtcgaggctgttgaaacagccaaggaatggacccgattgtatgctagcggggcttgaggttgttctcaaacaataataactgaagtgtatgctattaacagtcaaatgaaaatgaaaatctggaggaattgtttgaactattggagttaatattctccttagcttacagttacctgttaatttcttctcttgaaatgaaagctgtcttatcttggaacttatatgaatatatgtgttgaccatttatctgcgatatctcttacaattcagaacatactaaatcttgaaattccaagtcctaatttatttggggctataaacatcaaaagctaaattgtgaatgaagttatatcccttatttcttgaagagtggtaaaacaatccgtttcaggagccattgcctaagactgtacgtacagtgttactaatgcaaaaaaagaacatatcttgtctaccctgtctcacaaggaaaaatggtcaaattggattgtatttgtaagagtaaag

SEQ ID NO: 5179 - DNA, 824 bp, Zea mays
gctttcccgttccccaccccgaccgactgctccccctcccccgcaccagcctcaaggcatcgccggcgccgcaacatcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatgatccttgggccggcgcagtcgccctatgaaggtggagtttttaagcttgaactctttttacctgaggaatatccaatggctgccccaaaggttaggtttctgacaaagatttatcatcccaacatcgacaagcttggtaggatatgcctcgacattctcaaggacaaatggagcccagcacttcagattcgaacagttcttttgagtatacaggctctactgagtgcgccaaatccagacgaccctctttcggataacattgcaaagcactggaaagccaatgaagtagaagctgtcgaaacagctaaggagtggactcgcctgtatgcgagcggtgcatgagaacgcagtgatgttcttgatgtaataacccatcatacttcagtcctcatctattgccatttgcttgataaaaaataggctggagatatttgccatggaatgaagtctctacatgactatcactctgaattgtttggttgtacacctgtggtcggttccctttaccttggggcacctttgacaaatcagtatctgtggtagaacttgctgatactgtaatatatttgttacttcatgtagaagagcttctca

SEQ ID NO: 5180 - DNA, 630 bp, Sorghum bicolor
gaagcccgcaccccggccccgatccgatggccaacagcaacctcccgcggcggatcatcaaggagacgcagcggctgctcagcgagccagcaccggggatcagcgcgtcgccctcggaggagaacatgcgctacttcaacgttatgatccttgggccggcgcagtcgccctatgaagggggagtttttaagcttgaactctttttacccgaggaatatccaatggctgccccaaaggttaggtttctgaccaagatttatcatcccaacattgacaagcttggtaggatatgcctcgacattctcaaggacaaatggagcccggcacttcagattcgcacggttcttttgagtatacaggctctcctgagtgcgccaaatccagatgaccctctttccgataacattgcaaagcactggaaagccaatgaggtagaagctgttgaaacagccaaggagtggactcgcctgtatgcgagcggtgcatgagaacctggttctgttcttgatgtaataacccgtcatacttcagtcctaatctattgccatttgcttgataaaaacagactggagatatttgccatggaaggaagtctctaaatgactaccactctgaattgtttggttgtac

SEQ ID NO: 5181 - DNA, 884 bp, Solanum lycopersicum
gttgtcaaattctcacaaaactattctccacttgctcccctttctctctctagaaaagaagaacccttagcgtaaactctgcgaaccccaaaaggctttcaattcaatggctaacagcaatcttcctcgaagaattatcaaggaaactcaacgtcttctcagcgaaccagcgcctgggataagtgcgtcgccgtcggaagacaatatgcgatactttaatgtcatgatacttggtccaacacagtctccttatgaaggaggtgtcttcaagctcgaactatttttacctgaagagtacccaatggctgctcctaaggttcgattcctcaccaaaatctaccatccgaacatcgataagcttggaaggatatgtcttgatattcttaaagacaaatggagtcctgctcttcagatccgtactgtacttttgagcattcaagcacttttgagtgctccaaatccagatgatccactctctgaaaacattgctaagcactggaagtcaaatgaggttgaagctgttgaaacggctaaggagtggacacgcctatatgctagtggtgcatgaagatatagcaacgaaatgttcaaaataacaaaaatcatggaatgtaatcaatattgactggcttatcaatatgaacctggatagcaccctccaaatttgtataattgaacgtgacacccttttgttttttaatgttcaggaatgaactttgttacaacaaaactggaaatggtaaggattttgtcactgcaaagagtagtaaatgattcagatctgtgggtttggaattgaaaagtactgttgctgcacagcttctatcaacctccatagattttgtttcagaaaattgaattttccaagggaaatccttttgttt

SEQ ID NO: 5182 - DNA, 794 bp, Triphysaria pusilla
cacactacacgggaccatttcccattttatagtgagataaacatatttagaaaagcaaaacccttttgttagcgtaaaatctccgaacagaggacccgtgggaagaaattcagggaaacagcttcgcaaatccgattcaatggccaacagcaacttaccgcgtaggatcatcaaggagacacagcgtcttctgagtgaaccagcaccaggaataagtgcatccccatcagaagaaaatatgcgatatttcaatgttatgattcttggcccaagtcaatctccttatgaaggaggtgtttttaagctggagttgtttttacctgaggaataccccatggctgccccaaaggttcgcttcctcaccaagatttaccaccctaacattgacaagcttggaaggatatgcctagatattcttaaggacaaatggagtccggctcttcagattagaactgttcttttgagtatacaagcacttttgagtgctccaaatcctgatgaccctctctctgaaaacgttgcaaagcattggaaatctaacgagtctgaagctgtggaaacagctaaagagtggacgcgtttatacgcgagtggtgcttgagtaagcatggaacattggcttacttttattgtattctattgtcgtctggcaagtaaaacgtggaaaagttggaaggacgactctctatagggattgtgttttcaactgctcgtttttgttttagactgttcttaaatgtgtgtcagatgatatatatatatgcacttgtgttatggaattattgattttacaa

SEQ ID NO: 5183 - DNA, 1009 bp, Festuca arundinacea
ggcacgaggccggctctcatctcatcctccctcctctccccgaccgattgacgactcctttgacctctcgccgcgctgtcccccttccctccctcctccaccgtcgccgcacgaagctcgaggcgtccccccttgccccccctcgccccgccggcagctccagctccagcgccatggccaacagcaacctcccgcgccggatcatcaaggagacgcagcggctgctcagcgaaccagcgccggggatcagcgcgtcgccgtcggaggagaacatgcgctacttcaatgtcatggtccttggaccggcgcagtctccttacgaaggtggagtttttaagcttgaacttttcttacccgaggaatatccgatggctgctccaaaagttaggtttctcacaaaaatataccatcccaacattgacaagcttggtagaatatgccttgacatcctcaaggacaaatggagtccagctcttcaaatacgcactgttcttttgagcattcaggcactgctgagcgctccaaacccagatgaccctctctcagaaaatgttgcaaaacactggaaatccaatgaagccgaagctgttgagacagcgaaagagtggactcgcgtgtatgccagtggtgcatgacaagctaacgctggttatggatgtaataacaccatgtcatagtcgggtctaactgaaaaccatttgcttgataagaacaaacttgaaactgttttgcgatggaagtaagtgtccatagcgataacggttcaagttaccggttgtatttgtggtgcatgttcttgcacctgtcaatgctgtgccactctagccaaatctgttgctgcttatagaacatgctgtgtttcctcttgatcttcaattatttatcagttaactcgtccgctaagatcctatgtaaattgttcaaaagatggtggctctggttctcagtttgtgttcttccctagagaatcctctgataaattgcattttctccaaaaaaaaaaaaaaaa

SEQ ID NO: 5184 - DNA, 994 bp, Avena sativa
ccgttggtggcttctcccctcgctcgcctcgggctctctcatccaggtccaggctcatcctccctcctctcccgaccggttgacgactcctttgacctctcgcgctgtcccctcctccaccgtcgccgcacgaagctcgaggcctccccctcccccacccccctcgacccgccggcagctccagcgccatggccaacagcaacctcccgcgccggatcatcaaggagacgcaacggctgctcagcgaaccagcgccggggatcagcgcgtcgccgtcggaggagaacatgcgctacttcaatgtcatggtcctcggcccggcgcagtctccttacgaaggtggagtttttaagcttgaacttttcttacccgaggaatatccgatggctgctcccaaagttaggtttctcacaaaaatataccatcccaacattgataagcttggtagaatatgccttgacatcctcaaggacaaatggagtccggctcttcaaatacgcactgttcttttgagcattcaagcactgctgagtgctccaaacccagatgaccctctctcagaaaacgttgcaaagcactggaaatccaatgaagctgaagctgtcgagacagcgaaggagtggactcgtgtgtatgccagcggtgcatgacagtctaagagcgccgttatggatgtaataacaccatgtcgtagtcgggtctaactgaaaacaatttgcttgataagaacaaacttgaaaccgtgttgcgttggaaggaaagtgtccagagcgaataacggttccaaggtaccggttgtatttgtggtgcatgttctggcacccgtcactgctgtgccactctagccaaaatctgttgccgcttgtggaagaacatgctgtgtttccccttgatcttcaattatttattagttccgctgtgatcctatgtaaagctgtccaagtggtggttgctggttctcaatttgtgttcttaaccagagaacactaatggt

SEQ ID NO: 5185 - DNA, 985 bp, Avena sativa
ctctctcatccaggtccaggctcatccctccctcctctcccgaccggttgacgactcctttgacctctcgcgctgtcccctcctccaccgtcgccgcacgaagctcgaggcgtccccgcctccccccaccccaccccctcgacccgccggcagctccagcgccatggccaacagcaacctcccgcgccggatcatcaaggagacgcagaggctgctcagcgaaccagcgccggggatcagcgcgtcgccgtcggaggagaacatgcgctacttcaatgtcatggtcctcggcccggcgcagtctccttacgaaggtggagtttttaagcttgaacttttcttacccgaggaatatccgatggctgctcccaaagttaggtttctcacaaaaatataccatcccaacattgacaagcttggtagaatatgccttgacatcctcaaggacaaatggagtccagctcttcaaatacgcactgttcttttgagcattcaggcactgctgagtgctccaaacccagatgaccctctctcagaaaacgttgcaaagcactggaaatccaatgaagctgaagctgtcgagacagcaaaggagtggactcgcgtgtatgccagtggtgcatgacagtctaagagcgctgttatggatgtaataacaccatgtcgtagtcgggtctaactgaaaacaatttgcttgataagaacgaacttgaaaccttgttgcgttggaattaaagtgtccagagccataacacggttcaagttaccggttgtatttgtggtgcatgttctggcaccctgtctctgctgcgccactctagccaaatctgtttccgcttgtggaagaacatgctgtgtttccccttgatcttcaatcatttatcagttccgctgtgatccaatgtaaagctgtccaaatgatggtagctggttatcaattcgtgttcttcccaagagaacactattgataaattgcatttgcttc

SEQ ID NO: 5186 - DNA, 789 bp, Brassica oleracea
acgcgtccgatcgaggagacgaaagtgttctctcggatctctctctaaaaccccaactctgatcaatcgaaatcggcagcgcgagatcatggccaacagcaatctgccccgaagaatcatcaaggaaacgcaacgtctgctcagtgaaccggctccgggtataagtgcatctccatctgaggagaacatgagatacttcaacgttatggttcttggtccttctcaatcaccttatgaaggaggtgttttcaagttggagctctttttgcctgaagagtaccctatgtcagctcccaaggttaggtttctcaccaagatataccatcctaacattgacaagcttggaagaatctgtcttgatatcctgaaagacaaatggagccctgctctacaaatacgaacagtgctcttaagtattcaagctcttctgagtgcaccaaaccctgatgatccattgtctgagaacatcgctaagcattggaagagtaatgaggctgaagctgtggagacagctaaagaatggacccgtctgtacgcaagcggcgcataatggattggagggcgaaacgatctcacattcatccaaataacatttacagtttcgtgataatctatctcaacctccaaagttataaaaagcttatactttcctgtttctcccctcttataatgataaaaatgtgagtttcggcacaggaagatgtatattgtatcattactagtagggtcaagactcgtgtgcctacttgagctcgtcaagtttcgttgaatcaaaacatcttctctacg

SEQ ID NO: 5187 - DNA, 716 bp, Antirrhinum majus
ggttagcgtactctctctctctctccagagacttaaaaagagtcgaacagagatcatcatcatcatcatcaccaacaacaacaaaaagtcttcgcaatttcaattcaatggccaacagcaatctaccgaggagaatcatcaaggagacgcagcgtcttctcagcgaaccagctccaggcataagtgcatctccatctgaagagaatatgcggtatttcaatgttatgattctcggtccgacacaatctccttatgaaggaggggtttttaagctggaattgtttttgcccgaagaatacccaatggctgctccaaaggttcgcttcctcacaaaaatctaccacccgaatattgataagcttggaaggatatgtcttgatatcttgaaagacaaatggagtcctgcccttcagattagaaccgtacttttgagcatccaagcactattgagcgctccaaaccccgatgatccactttctgaaaacattgctaagcattggaaagctaatgaggttgaagctgttgaaacagccaaagaatggacccgtctgtatgcaagtggggcatgaggtatatggaactccggttcctatgaataattgaaaatgtaatattgcgagtccatgaatttgggtaaatttatgatgttcgaaactgttgggattaactgtttccagactccccattagtactttatactttatttcctgcatgaa

SEQ ID NO: 5188 - DNA, 770 bp, Arabidopsis thaliana
aggaaatcgaattaaaatcttcgtcagattcgagagacgacgacgacgaacttgttgttctcgattatcatcagcagctcccttcaaaaaccctaactctctgagctcgatcgacaagtgataatggccaacagtaatttgccgcgaagaatcatcaaggaaactcaacgtctgctcagtgaaccggctcccggtataagtgcctctccatctgaggataatatgcggtatttcaacgttatgattcttggtcctacacaatcaccttatgaaggaggagttttcaagttggagctctttttgcctgaagaataccctatggcagctcccaaggttaggtttctcacaaagatataccatcctaacattgacaagcttggaagaatctgtcttgatattctcaaggacaaatggagccctgcactacaaatacgaacagtgctcttaagtattcaagctcttctgagtgcaccaaacccagatgatccgctttctgagaacattgctaagcactggaagagtaatgaggcagaagctgtggatacagctaaggaatggacccgtctttatgcaagcggcgcatgataaattggagggtgaaaactgaaaagatctctttcatccaaataacattacatttgctgaaatctatctcaacatcaaagttataagaaagcttatattttgctggttatttccccccgccactgctctgtaatctctcttaatcacactgtatcattactcctaggatcaatactcgttcttat

SEQ ID NO: 5189 - DNA, 852 bp, Castanea mollissima
cagaaattggtgaaatcgagccctcttcgtcttcgtcttcgtcttcgccctcggcactttcgtcttaattttaaaaagtaattgcaattgcaatagtggtagtaacagcgtgggcctggtctggaaatcaatagaaaaaatggccaacagtaatctcccccgaagaatcatcaaggaaactcagcgtcttctaagtgaaccagcaccgggaattagtgcttctccatcagaggacaacatgcgatattttaatgtaatgatcctcggcccaacacagtctccatacgaaggaggagttttcaaattggaactatttttgcctgaagaatatccaatggctgctcctaaggtccgatttctcaccaaaatatatcatcctaacattgacaagcttgggaggatatgccttgatattctgaaagacaaatggagtcctgctcttcaaattcgaactgtacttttgagcattcaagctcttctgagtgctccgaaccctgatgatccactctctgagaacattgcgaagcattggaaaacgaatgaggctgaagctgttgaaacagcgaaggagtggacccgtttatacgcaagtggtgcctgatgacatggtggaaagttttgcttcccctgaataacattaatgaaatgtatgctattgactgtcaattttaaatggaaatttggtacaactgatctttgaacaatcggagtttaatattctcaaagcttccagttgctgtccggtcattgtttcactctcacggaagccttgtgaaacttgtatgataaaatgggccattaagtggcaaactattctatatataatattcatgcctggtaggtttctttagt

SEQ ID NO: 5190 - DNA, 706 bp, Actinidia deliciosa
aaattcgatccaaccaaaacacagttttcccaagtctcgattctcaaaccatcagcttctctctctactttctctctctatttgttctgtctcaaacccttagcgtactctgcaatcgaaccttgtacaatggcgaacagcaatcttcctcgaagaatcatcaaggaaactcaacgtctcctcagcgaacccgcaccgggaataagtgcatcaccttcggaagaaaatatgcggtattttaatgtcatgattcttggtcccacgcagtctccttatgaagggggcgttttcaaacttgaactgttcttgcctgaagaatacccaatggctgctcccaaggtccgatttctcaccaaaatctaccatcctaacattgataagcttggaaggatatgccttgatattctcaaggacaaatggagtcccgctcttcagattcgaactgtactcttgagcattcaagcacttttaagcgctccaaaccctgacgatcccctatctgagaatattgcaaagcattggaaaacaaatgaagctgaagccgttgaaacagcgaaggaatggactcttctatacgcgagtggtgcgtgatgaacgggtggaggtgatggttctccgaaataacagaatatccaatgtatcttatttaactgttgaatttaaattgaaatttgaaaaagtgatgtgctgggatgattggaattgg

SEQ ID NO: 5191 - DNA, 804 bp, Juglans hindsii x Juglans regia
ggggctctccgatattcgtcatatcgggcattctcttcggtgttctctcttttaactctctctctctctctctctctaaaccctttggcatttgcgtgcactgtaatcggccctgaaatggccaacagtaatctaccgcgaagaatcatcaaggaaactcagcgtctcctaagtgaacctgcgccgggaattagtgcttcaccatcggaggacaacatgcgatattttaatgtaatgatccttggcccaacacagtctccatatgaaggaggggtcttcaagttggaattgtttttgcctgaagaatatccaatggctgctcccaaggtcagatttctcactaaaatatatcatcctaacattgacaagcttggaaggatatgccttgatattctgaaagacaaatggagccctgctctccaaatacgaactgtacttttgagcattcaagcacttttgagtgctccaaaccccgatgatccactttctgagaacatcgctaagcattggaaaacaaatgaggctgaagctgttgaaacagcgaaggagtggactcgtttatatgcaagtggtgcctgatgacacggctgaaagctttgcttcccctctagtaacatttaatgaaatgttgtatggaattgactgtcaattttaaatggaaatttggaagaaatgatctttgaaaaatcggagtttaatatttctccaaagcttccagttgccccctcccctggaagtctttgtggaacttgtatgatatattcagccattaatttggcgaaggatctatatatatatatatat

SEQ ID NO: 5192 - DNA, 905 bp, Allium cepa
tatttgaccattttaaattgatatcgaataagtactttctcttttcttcccatctaccatttcgtttcttagatttcggccccgtaaaggaaagttatatttagggtttctttcgatttggtcagatggctaatagcaatcttcctcgacgaatcatcaaggaaacgcaaaggttgttgagtgaaccagctcctggaattagtgcatcgccgtcggaagaaaatatgagatattttaatgtcatgattcttggtccaactcagtctccatacgagggtggtgttttcaagctagaactttttctgcctgaagaatatccaatggccgctccaaaggtccggttcctgaccaaaatctatcatcccaacattgacaagcttggaagaatatgccttgacattctcaaagacaaatggagtccagctttgcagattcgaacagtgttgctaagtatacaagcacttttgagtgctccaaaccctgatgacccgatttcagaaaacatcgctaagcactggaaggcaaacgaagccgaggctgtcgaaaccgcaaaggagtggacacgcctatatgccagtggtgcttgagtacattgaggccaatatatggggaaaacaataacaagtctgttatgtgcatcctgcttattattctataaatgaatgtgaaagtgctaaactgataacttgctagcagctaaatcatttgatgctattatatcatatcatgtatatgactttttctaaattggaaacctctgtatcagcgatcaggtacgtttgaacctgtctattcatgtttttagactctacttgtcagttggtatcccaagcgctaggcatctttctgtttcctaataacatgagccttggctacttgttaaaccgtgaaattatctgatttgc

SEQ ID NO: 5193 - DNA, 904 bp, Gossypium raimondii
attgcattttggaaaaaaaaaaaaaagagagcgagttaaagagaccgagggatctctttgtcttctcagattttctctttccatctctcaattctcaaaaccctaatttctctgctttcccttttgcttaatcaatcgatcctcgtcaatggccaacagtaatctccctcgaagaatcatcaaggaaactcaacgtctcctcagtgaacctgcacctggaattagtgcttcaccatcagaggataacatgcggtatttcaatgtgatgatccttggtccaacacagtcaccatatgaaggtggggttttcaagttggaactatttttgcctgaagaatatcccatggctgctcccaaggttcgatttcttacaaagatatatcatcctaacattgacaagcttggaagaatatgccttgatattctcaaagacaaatggagtccagctctccagattcgaactgtacttttaagtattcaagcacttttgagtgctccaaatcccgatgatccactctctgaaaacattgctaagcactggaaaacgaatgaggctgaagccgttgagacagcaaaggaatggacccgtttgtatgcaagcggtgcatgaagactgtttggtatcatttgccctcttaaaataacatgttatgcagtgtaagctattccatgtcaattacatatggaaatttggaaaaattgatgtttgaaaagagtctgatattcacaaaaagcttccagttgcgacctgtttatcgttttctggttggaagcagtcactgaagttgtatgataaaaatacaatgttgtctaaaactctcaaatgctgaactaagagattattctcaaatacagctatttcatgttctgtttatttatgatattaaagtttgatgcatacata

SEQ ID NO: 5194 - DNA, 1147 bp, Glycine max
caagcaaaaattatataaacaacggcgagagataatggattttcattgagctttctttctttttgtgttagtgagagaaagttctctctctttgactcacaaccctattgcgtgctttgcaatcgaccccgcttatggccaacagtaacctccctcgaagaatcatcaaggaaacgcagcgtttgctcagtgagccagcgcctggaattagtgcgtccccttcggaggacaatatgcggtatttcaatgtgatgatccttggcccgactcagtcgccatatgaagggggagttttcaagttggaattatttttgccagaagaatatccaatggctgctccaaaggttaggtttctgacaaaaatatatcatccgaacattgataagcttggcaggatatgtcttgacattctgaaagataagtggagtcctgcccttgggattcgcactgtacttttgagtattcaagctcttctaagtgcacctaacccagatgatccactttctgagaacattgccaagcattggaaatctaatgaggccgaggctgttgaaacagccaaggaatggacccggttatatgctagtggcgcttgatgctttgggggaaacttttggcttcaaatatctatagtggacgtgtatgctgtataactgtcaaattgaaatggaaatttggaggaattgtctaaactattttggagtaaatattccccgtagcttccgggtacctgttaattactttctttctcctggaagcctgatcttggaacttgtatgaaaaacatgtgatcttttctgtgacaaatttaaacatgcttcatctcccaactcctgagtaatttgggatcctcaaacttaatagtaaaaaatttcgaataagcttctgttggtttgtgtccttttccatgaatccatagatatgtttggttgtgtaaaatcaagagcataatgcaggcatttgtccaaccaggaatagatcttctcatgaaaatagaaaatacattagttttaggtttaattagtgttaggtatgtcggggtctctctttgtcactgcaaagttttgatatatcctagggtttggtaaataaaggttagggttggtagacttgagcatatggacccaaatgtctttttatgtattca

SEQ ID NO: 5195 - DNA, 627 bp, Musa acuminata
gggaatataagcgatttagtcgagtttttgatggcttcacatcggcttcttccttcaccccgtcgactcatctctcctcttccgtcctcgtgggatccgaccatcgcgtggaatggccaacagcaatcttcctcgaaggatcatcaaggagacgcagcggcttctcagcgaaccagctccgggaataagtgcttccccgtcggaagacaacatgcgctacttcaacgtgatgattctcgggccgtcccagtctccgtatgaaggaggagtattcaagcttgagttgtttttacccgaagaatatccaatggctgccccaaaggtccgcttcctcaccaaaatttatcatcctaatattgacaagcttggaagaatatgcctagacattctaaaagacaagtggagtccagctctccaaattagaacagtacttctcagtattcaagctcttctcagtgccccaaatccagatgatccactttcagacaacattgcaaagcattggaagacaaacgaagcagaagcagtggaaacagccaaggaatggacccgtctatatgcttctggggcatgaaatggacaacactatccatttcatgacagctacagtggagttttaacaaaaag

SEQ ID NO: 5196 - DNA, 862 bp, Daucus carota
gtgaaacccttgcgtagtttgtaatctaaaaaagcccctttttgcaattcaattctctctcaaatggcgaatagcagcaatcttcctcgtcgcatcatcaaagaaactcagcgtcttctcagcgaaccagcgcctggaataagcgcatcgccatctgaggataatatgcgatacttcaatgtcatgattcttgggccaacacaatctccatatgaaggtggggtatttaagcttgagttatttttgcctgaagaatacccaatggctgctcccaaggtccggttccttaccaaaatttaccatcctaacatcgacaagcttggaaggatatgtcttgatattttgaaagacaaatggagtcctgctcttcagattcgtaccgtactgttaagcattcaagcccttctgagtgctccgaatcctgatgacccactctctgagaatattgcaaagcattggaaaacaaatgaggctgaagctgttgagacagcaaaggagtggacccgtttgtatgctagtggtgcttaaagaaattgctcaatggaagggcgccaaaataacataatctgcaatgtactctattgaagcactgatgggttgaacaggatcaattttatattctcaaaacatactagctcatagatagtcccgttcagaaccttgatattgaaaagttgaaaactgtaatttgcgacatggtgtcctccttctgttaccttatatcattataatttatagcaatgcatgaaattagctgtttgggatttctgtggctacagttgtgtgcagcatggcaactagaaattaaatcttttggctgctgatgctgcactccatggtttggtgaagttctcatcacttt

SEQ ID NO: 5197 - DNA, 646 bp, Chrysanthemum coronarium
gaacagtaatctacctcgaagaatcatcaaagagactcagcgtttactcagcgagccagcgcctgggataagcgcgtcgccatcggaggataatatgcggtattttaatgttatgattcttggtccaactcagtctccttatgaaggaggagttttcaagcttgagttatttttgccggaagaatatccaatggctgctcccaaggttcggtttctaacaaaaatttaccacccgaacattgacaagcttggtagaatttgtctcgatatccttaaagacaaatggagccctgcacttcagatccgcactgtactcctgagcattcaagctcttctaagtgctccaaatcctgatgatccactatctgagaacatagctaagcattggaaatctaatgaagctgaagctgtggaaacagcaaaggagtggactcgtttgtacgccagtggtgcctaactggaatgtcagtcaacaacatgttactcctggaaaataacaatgtacttgtttactaggtcttgaaatttcgaaattaaaacttatatgattctgctggctggttttaaacaccaatgttgtcgactttcttttacacccttgtgtttttcagtgtatgagatgtgtaactctgttatcctagtcttc

SEQ ID NO: 5198 - DNA, 951 bp, Cichorium intybus
tacataaatacaatcgaaccgttcttcgaagcttggctcacggctagagaaggaactaggaagtctcgaatcaataacctgcccttcactttctctctctagaaaaccctcttttctctctttgtcgaaaaaaggcaaaagcccccttagcgtaaatcttccccttccatggcgaacagcaatctacctcgaagaattatcaaggaaactcagcgcttacttagcgaaccagctccggggattagcgcagcgccatcggaagataacatgaggtatttcaatgtcatgatccttggtacaacacagtctccttatgaaggaggagttttcaaattggagttatttttgccagaagaatatccaatggctgctcccaaggttcggtttcttacaaaaatttaccaccccaatattgacaagcttggtaggatttgtcttgatatccttaaagacaaatggagccctgctcttcagattcgcactgtacttttgagcattcaagctcttctaagtgctccaaatccagatgatccgctctcagagaacatagcaaaacactggaaatccaatgaagctgaagctgttgaaacagcaaaggaatggactcgcctgtatgctagtggtgcctaatggatgagatgtgggtcattcgtgaaaataacaatgtactttgttaggtcttgaaatttaaaacttgaatgattttactctgctagtccctgaaccatcaatgttgttcacttcctaccttcatatctttgtgttttcttctgagtatatgagataagctactctcttttttctatttttctttcatgatacactcgtatgcttaactatgtggaattgcatcttttaaagagacttgtgcttatagccttgaacatattttcaagtgaaaagctagagattcaagtgatcttggattgttggtggtaatttttcttaaaa

SEQ ID NO: 5199 - DNA, 846 bp, Panax ginseng
cctatccccctgtgtgccttggcagtctcagcagtggtatcaacgcagagtacatgggggaagcctttccttcctattcttctgaaaactgtctctcaaaatctagttgtttgacttttttgggtaaatctttggagaagaggaaatggcaaatagcaatctgcctcgaagaataatcaaggaaacacagcgacttctaagtgaaccagctccaggaatcagtgcttcaccttcagaagaaaacatgcgatatttcaatgtgatgatacttggtccaacacaatctccttatgaaggaggggtattcaagttggaattgtttttgcctgaagaatatccaatggcagctcctaaggttcgcttcctgaccaaaatatatcatcctaatattgacaagttgggaaggatatgcctcgatattctcaaagacaagtggagtcccgccctccaaattcgtacagtattgttgagcatccaagcacttcttagtgctccaaacccagatgatccactttctgagaacattgcaaagcactggaaaacaaatgaggcagaagctgttgaaactgcaaaagaatggagccgtctgtacgcaactggtgcatgataatgggatatggtagttgcgaatatcgtttctgcaaatgtatgttagctgaactgaatggtcccatttgattttatgttgaaatatctatgaggaatttctctaaaaagatagccctttggcattggatagttaggtcgtaatttctttaagggcatgataaattgtacaatgatgtgaaagctcaatgttcattaatctattgacttttatatgattattactaatttagaaagtag

SEQ ID NO: 5200 - DNA, 846 bp, Lupinus angustifolius
agtgattctctcacgtttttgttagtcacagaaacttctcttttcatttctgtgactcaaaacaaaaccctattgcgtgctttgtaatcgaccttcatcatggccaacactaatctccctcgaagaatcatcaaggaaacgcagcgtttactcagtgaaccagcgcctggaattagcgcttcgccttcagaagacaatatgcgctatttcaatgtgatgatccttggtccaagccagtcaccttatgaaggaggggttttcaagttagaactatttttgccagaagaatatccaatggctgctccaaaggttaggtttctgacaaaaatatatcatccaaacattgataagcttggcaggatatgtcttgatattctgaaagataagtggagtcctgcccttcagatacgcactgtacttttgagtattcaagcccttttaagtgcaccaaacccagatgatccactttctgagaacattgctaagcattggaaaagtaatgaggctgaggctgttgaaacagcaaaggaatggacccgagtatatgctagtggcgcctgattattgggtggaaacttatgccctcaaataacaatgttctgaagccaatttcaaaatggaaatctagaggaattaatgtctgaactattttggaggtcatatttgtcttaacttccagtcttgttatttgctttcttctcctgaaagccttatcctagaacatgtatcaattatgtcattccactaggtgaaattggctaggtgtgaccttttgtgtcaaactttataatatatttcatcttcaactgttaagtaattttgttaaatatttaactaaataatttt

SEQ ID NO: 5201 - DNA, 1216 bp, Chenopodium quinoa
aataaagcagccaacgtctgtgaaaatacaaaataaagaacaaagatcgagctcctactgtaggactcccatttccattttctctctctagattctctctctttctctctcctcccaagctcctcatcaatggcgaacagtaatctacctcgaagaatcatcaaggaaactcagcgtctcctcagcgagccagctccgggtataagtgcttcaccttcagaagacaatatgcggtacttcaatgttatgattcttggaccttcacagtcaccatatgaaggaggagtctttaagttggaactatttttgccggaggagtatccaatggctgctccaaaggttcgatttctcaccaagatatatcatccaaacattgataagctagggaggatatgccttgatattctcaaagacaagtggagtcctgctcttcagatacgaactgtactcttgagtattcaagcattacttagtgctccaaaccctgatgaccctttgtctgagaacattgctaagcattggaaaacagatgaggcagaagctgttgaaactgcaaaagaatggactcgtctatatgcaagtggggcttaaattacatggcaactttaccctcttcaaataacaattgtgatgtttgttatctgactgaattctaaaccaagcctgctggttagaaacatgaatatcaagtgataatctaggttaaatgatgatcaattgttcgtataaaatagccttgttttctgttgtctcttctatcttttctaccctgtcgaatcttttgcttggaattgtataatttgtatttgcgttgcatatctggagctgttttattgtcattatagaaggtaactgaaattcagttgcatgtaagcatcgtgcgggaactatttttcaagcttcctggtgatccttggaggtgagtaactgtgagtttatggtggatccaactcatccaagggtgtgaagttctaataactcgtaccaaattgttttctgttatgttcagctaacagggacatagtttaaactccgaacttgttaatcttattgtttatcgtaaaattttggattccaattacttagaaagtttgaagtacatgataaccttataatgtaagccgactctgattttcatgactacctaaaatagtgtaacagtattcctgaactttcccccgatctagtgccagtgaattttacaaatgcatttaaa

SEQ ID NO: 5202 - DNA, 829 bp, Triphysaria pusilla
aaaatttccacgatcgaacatttccccatttcctagtgacggagagcaaagaaaaatccctctgttagcgtaaaatctcaaactgaaagagccgagggaagaaaacgaagcttgtgaacccaatccaatggccaacagcaatttgccgcggagaatcatcaaggagacacagcgtcttctgagcgaacctgctccaggaataagtgcatctccttcagaagagaatatgcggtactttaatgtaatgattcttggtccaacacagtctccttttgaaggaggtgtctttaagctggagttatttttacctgaagaatacccgatggctgctccaaaggtccgtttcctcacgaaaatttaccacccaaacatcgacaagcttggaaggatatgcctagatattctcaaggacaaatggagccccgcacttcagattagaactgtacttttgagcatccaagcacttttgagtgctccaaatcccgacgatccactctctgaaaacgttgccaagcattggaaatcgaacgaggctgaagctgttaatacagctaaagaatggacgcgtttatatgcgagtggtgcttgaagcacatggtactaccacctaagtagtgattgtatcttgttgaccatcaaatgatttcggaacatttggaagaacacttatacaaacaactggcgtttctatctggcatttaactagttcccaaatttaaacagttgctcaaagtttataactggatgagaattgtttgttaattgtttctcatgatatgtgattttgctatacactaaaaaaaatttctccggacaaaaaaaaaaaaaa

SEQ ID NO: 5203 - DNA, 774 bp, Raphanus sativus
ggcttcattaatctgaccgacgacgacgacgacgacgacgaagtgttctcgattctcggcgtgcggatcttctctctcgaaaccctaactattatcgatcgattgaggttagcagcgagcgataatggccaacagtaatcttccccgaagaatcatcaaggaaactcaacgactgctcagtgaacctgctcctggtataagtgcgtctccatctgaggagaacatgcgttacttcaacgttatggttcttggtccttctcaatcaccttatgaaggaggagttttcaagttggagctctttctgcctgaagaataccctatgtcagctcccaaggttaggtttctcaccaagatataccatcctaacattgataagcttggaagaatatgtcttgatattctgaaagacaaatggagccctgctctacaaatacgaacagtgcttttaagtatccaagctcttctgagtgcaccaaaccctgatgatcccttgtctgagaacatcgctaagcattggaagagtaatgaggcagaagctgtggagacagctaaggaatggacccgtctttacgcaagtggcgaatgatgcagtgttggagggttaaaaagatctcgctcatccaaataaacattacatttggttaaatcttattatcctttgctggttcttccctctcattatgataaaaaatgttgtgtgtcggcacacaaaagctgtaatctctctgaatgattgtatcattaactaatagggtctgtcaagacatttagtaa

SEQ ID NO: 5204 - DNA, 711 bp, Antirrhinum majus
aaactctccgatgatagcaaaaagctctacaatctcttgaatttggattcaatggctaatagcaatttgccgcggagaattatcaaggagactcagcgtcttctgagcgagccagcaccaggaataagtgcatctccatcagaagacaatatgcggtatttcaacgtaatgattctcggtccatcccaatctccttatgaaggaggtgtttttaagctggaattgtttttgcctgaagagtacccaatggctgctcccaaggttcgtttcctcacaaaaatttaccacccaaacattgataagcttggaaggatatgcctggatattcttaaagacaaatggagtcctgctcttcagataagaaccgtacttttgagcattcaagcgctgttgagtgctccaaaccctgatgacccactttctgagaatattgcgaagcattggaaatcaaatgaaactgaagctgttgaaacagctaaagagtggacacgtttatatgcaagtggcgaatgaagtgtttgtagctgggggtcaccattaataaccaaaaaatgtaatgttgtatgtcgactgatatatgaaggtttgctttgtacgatgctggaatcttctaggatctgcattattagcacatattttctgcttgaaacttaaaatgtgcgatgaaatgaaatactttttgctgccgctccgatgaaaggccgctagctc

SEQ ID NO: 5205 - DNA, 672 bp, Ocimum basilicum
ggccaacagcaatcttccgcgtaggattatcaaggagacgcagcggcttctcagcgaaccagcacctgggataagcgcttctccatcagaagacaatatgcggtacttcaatgttatgattcttggtccaacacagtctccttatgaaggaggtgtttttaagctggaattgtttttacctgaggaatacccaatggctgctccaaaggttcgcttcctcactaagatttaccaccctaacattgacaagcttggaaggatatgcttagatattctcaaggacaaatggagtcctgctcttcaaatcagaactgtgcttctgagtattcaagcacttctgagtgctcctaatcccgatgacccactctccgaaaacattgccaagcattggaaatcaaatgaggccgaggctgtggaaacagctaaagaatggacgcgcttatatgcgactggcgcgtgatttacgtggacctgactgtattgtatcgcacatcaaaccaatttggaagattaatgaatgctcaaaacctcatgctgtcttgtatcagattcccatttcaaactctcagtttgaatgttccatgttataaaagcactttgtcattatgttctgcactctatttgtcgtacttgaatttgtccattaatattaccatccatcatttagaaaaa

SEQ ID NO: 5206 - DNA, 799 bp, Actinidia deliciosa
cttctcgctctagccgacgactcagactcttctccctctgactctctctctctctctctcaaccacaaccagttcttcggcgttcggtgaggtctgacaactgatcaaatggcgaacagcaatttgcctcgaaggattatcaaggaaacgcagcggcttctcagcgaaccagcacctggaatcagtgcttcaccttcagaagataatatgcggtacttcaatgtcatgatacttggtccatcacagtctccttatgaaggaggggtattcaaattggagttgtttttgccagaagagtatcctatggcggctcccaaggttcggttcctgaccaaaatataccatcctaacattgacaagctgggaaggatatgcctcgatattcttaaagataaatggagtcctgccctccagatacgaactgtattgctgagcatccaagctctccttagtgctccaaatccagacgatccactttctgagaacattgcgaagcactggaagaccaatgaagctgaagctgttgaaacagcgaaggaatggacccgtttatatgcaaccggtgcatgatgatcggagtctattacttgaaaatatcatttctccaaatgtatgctaaatgaatggctgccttcggtcttgcattgaaaatgaagaaaactctgtatgaacagtcccatcttcccaagtcccgctatacttatgttgatgaatttcatctttactaagtttatgatgccattctgcacaattctatgaaattctaatatccctttagtgatatttcttttaaaaaaaa

SEQ ID NO: 5207 - DNA, 707 bp, Cichorium intybus
ctctctttcttttctattctctaaaatcaaaaatcttctgtagcgtaacctctactcctttcatggcgaacagcaatctacctcgaagaattattaaggaaacacagcggttgctcagcgaaccagctccggggataagtgcatcaccatcagaagagaacatgcggtatttcaatgtcatggttcttggtccaacacagtctccttatgaaggcggagtcttcaaattggagttatttttgcctgaagaatacccaatggctgccccaaaggtccgatttcttacaaaaatataccatcctaatattgacaagcttggccggatatgtcttgatatacttaaagacaaatggagccctgctcttcagattcgcactgtactcttaagtattcaagcacttttgagtgcaccaaatccagatgatccattatctgagaacatagcaaaacactggaaaactaacgaagctgaagctgttgaaacggcaaaagaatggacacatttgtatgctagtggcgcgtaacacaggtatcatgttgccccgaaaaaataatatgtattattaaatattaattccgtatttcaattaggataaaaagtttcattgtattttgagataagttactctcattataaatatttttcattgggtgggataaaaaattgtgcgacaaacggggtctatagcaacggtttgtgataaaaa

SEQ ID NO: 5208 - DNA, 856 bp, Phaseolus vulgaris
tttcattgagcattgttctgctttgtgttagtgagagaaagttgtctctgtttctctctctttgactcaaaaccctattgcgtgctttgcaatcgaccctgattatggccaacagtaacctccctcgaagaatcatcaaggaaacgcagcgtttgctcagtgagccagcgcctggaattagtgcttccccctcggaagacaatatgagatatttcaacgttatgatccttggaccgactcagtcaccttatgaaggtggagtttttaaactagaattatttttgccagaagaatatccgatggctgctcctaaggttagatttctgacaaaaatatatcatccgaacattgataagcttggcaggatatgtcttgacattctgaaagacaagtggagtcctgcccttcagattcgcactgtacttttgagtattcaagctcttctaagtgcacccaacccagatgaccctctctctgagaacattgccaagcattggaaaactaacgaggctgaggctgtggaaacagccaaggaatggactcggttatatgccattggcgcgtaatgctgggtggagtgggaacttctggcttcaaataactatagtggaagtgtatgctgtataactgtcaaatctaaacgcgaatttggagttatctattaaactattttggagttaatatttcccatagcttcaggttacctgtttattactttctttcacctggaaggcttgtcttggaacttgtatgaaaatatgtgatattttatctgacaaatttaaacacacttcatctcccaactcccaagtaatttgggatcctcaaacttaaatagtacaaaattttcgaataa

SEQ ID NO: 5209 - DNA, 1129 bp, Panax ginseng
cagtctcagaagcagtggtatcaacgcagagtacatggggacattttttcaagtgagaggaagtcttaaagccaccacactttctctctctgaaaacccttgttagcgtactttgtaatcgaagcttcttcaatggcgaatagcaatttacctcgaagaattatcaaagaaactcagcgtctcctcagcgaaccagctcctggaataagtgcatcgccatctgaagacaatatgcggtactttaatgtcatgattcttggtccgacacaatctccatatgaaggtggggtttttaagctggaattgttttacctgaagaatacccaatggctgctccaaaggttcggttcctcaccaaaatttaccatcctaacattgacaagcttggaaggatatgcctcgatatcctgaaggacaaatggagtcctgctcttcagattcgtactgtactattaagtattcaagccctattgagtgctcctaacccagacgaccccctctctgaaaacattgcaaagcattggaaaacaaatgaggctgaagctgttgaaacagcgaaggaatggacccgtttatatgccagtggtgcataacaaagttgtggaaactggaatctctgccaaaataacaatatatgcagtgtattctcaaagcatacttcactgatcattgtatcctgacttccaaaccttgatgttgaaattgtataatgagatgagatactcctgtcgagtgttgtctgtctttcaagtttaggaatgtgtgaaaattgtctgaaaatttgggattcacttggtaaaatcattgtgaagctaagtaaaattatatgcgtgttggggctgctgatcagcttttaacttcttttgcttcttcaaaaagagtattatactataaccgagtgtgcatttataaatcttgttcaaacttggtcttaattgttgaattcaatgatgtgattagacaacaaaaaaaaaaaaaaaaaaaaaaaaaaacaaaaaaaaaaaaaaaaacaaaaaaaacaaaaaaaacaaaaaaacaaaacaagaagagagagagagagagagagagcaccccccccccccccccccccccccccccccccccccccccccccccccccccccccccc

SEQ ID NO: 5210 - DNA, 1330 bp, Amaranthus tuberculatus
gggcctgggtagggaagtatctaataacattagcagtgtctcccctttccaaatcttcattccttcgttctctctctttccccgatctagcagacagccgtagcacaccacacccttttctgctctcaaaaatggcgaacagcaatcttcctcgaagaattatcaaggaaacacaacgtcttcttagcgagccagctcctggaattagcgcttctccctcagaagagaatatgcgctacttcaatgttatgattctcggtcctactcaatctccttatgaaggggggtcttcaagttggagttgtttcttccagaagagtatccaatggcacctccaaaggtccgcttcttgactaagatatatcatccgaatattgataagcttggaaggatatgcttagacatccttaaagataaatggagtccagccctgcagatccgaacagtactactgagtatccaggctcttttgagtgctcccaacccagatgatccgctttcggagaacgttgcaaaacactggaaaagtaatgaagctgaagcagttgaaacagcaaaggaatggacgcgcttatatgcaacaggtgcttgacaaaaagagcatatacaacaattgcatttctgcattgtaccttaaaaccaaattacagttgctagtctctttatggaaatgaaaagagtcatgttttgacaattcatctcatgacttgaaggcctccaattgctggttgtagatgattttcataacaaaactgattcagttatgtactgtattctgaatttgtaatgcttattatttctatatatgctctttcaaattctctaccccaaccccattttcttgtttttcctctgtgctatagattttgttgtgctcagcagcattttctggagatgtatttggattcctgaatcattcccctcttttgataatgattcaatatttcttactgagctagcctgatctgggtgcaaggaagaaggctctacaagtcctttgtaaatctttgaaagatcttgatgttgtccgatctaaaaaagaaagggctcaaaaatatgcgcctgagaggctcgtgggatcgtcttgatggaactgatttagactcctttgctgctctcaattctggaaatcttgaagttagttgatgattctaagatgatcttaatgttcacttcaagctgggcagctaatttcagctttggagtgctagcctaacaaatttccttctgatcaatacagtattcagcaaatcgctatctagtgtggtgaagatgtgacctctgctgactcttgctagttcgcttcgtggttgcctagaactgctggtcg

SEQ ID NO: 5211 - DNA, 632 bp, Brassica oleracea
ggatcttctccctccctctctaaaaccctaactctgatcgatcgaattcaccagcgcgagttaatggcgaacagtagtctaccacgaagaatcatcaaggaaactcaacgtctgctcagtgaaccggctcctggtataagtgcatctccatctgaggataacatgaggtacttcaacgttatggtccttggtccttcacaatcaccttatgaaggaggagtttttaagttggagctctttttgcctgaagaataccctatgtcagctcccaaggttaggtttctcaccaagatataccatcccaacattgataagcttggaagaatctgtcttgatattctgaaagacaaatggagccctgctctacaaatacgaacagtgctcctaagtattcaagctcttctgagtgcaccaaaccctgatgatccattgtctgagaacatcgctaagcattggaagagtaatgaggctgaagctgtggagacagctaaagaatggacccgtctttacgcaagcggtgcatgatggattggagagtgaaaaagatctcacattcatccaaataacattaagtttggtgaaatctatcaaacatcaaagttataaaaagcttatactttactggttctccc

SEQ ID NO: 5212 - DNA, 708 bp, Musa acuminata
ggtcgctgttgttcgtctcgtctttcctcttcctctgtcgactccaagaaacgacccaaaaccctaatctccgattgggaatggcgagcagcaatctacccccgaggatcatcaaggaaacgcagagattgctcagcgaaccggctcctgggatcagtgcatctccgtcggaagaaaacatgcgctacttcaacgtgatgatccttggcccggcacagtctccttacgaaggaggtgtttttaagcttgaattgttcttgcctgaagagtacccaatggctgcccccaaggtccgctttctaacaaaaatctaccatccgaatattgacaagcttggacgtatatgccttgatatacttaaagataaatggagtccagccctacaaattcggactgtgttgctgagtattcaagcactgctaagtgctccaaacccggatgacccgctttcggagaatattgcaaaacattggaagacaaatgaagccgaagccgtagaaacagcaagagaatggactcgtctgtacgcaactggagcataacgacatacatggagagaagttttaacatgtaagtgctggaaactgatcataaattgccaacattcgcactggtgttgatcattttcgtagttgtggcacttttttatgtatcagtgtaaaccttagttttgtcagattccaatggtttgctactacagtgttcccc

SEQ ID NO: 5213 - DNA, 735 bp, Cyclamen graecum
agtttctctctcctctcgctgcgatcgatccttcccgccatggccaacagcaacctacctcgaaggatcatcaaggaaactcagcgtcttctcagtgaacctgcaccaggaattagtgcatctccttcagaagataacatgcgttattttaacgtcatgattcttggtccatcacagtctccttatgaaggaggagtttttaagttggagttgtttttgcccgaggagtatccaatggcagctccgaaggttcggtttctctcaaaaatctaccatcctaatattgacaagctagggagaatatgccttgatattctcaaggacaaatggagccctgcccttcagattcgaactgtgcttttgagtattcaagctcttctgagtgctcctaacccagacgatcctttatccgaaaacgttgccaaacattggaaatcaaatgaagccgaggctgttgaaactgctaaagaatggacccgtctatacgcaactggagcttgaagcatgttgccttatgattatccgaaataacaaaatgtgctatatgttaatctgtggccgagatctatgaaattggagagaatacttcctaaaattgttatgttgtcaaagcttccaatatattcccataattgtttttcaacttccaaaacttgtaatgaaagtgtataattagacacaacgcctttgttggttatttcaaaattttcgtgatgctatgtcggagcactggtt

SEQ ID NO: 5214 - DNA, 915 bp, Allium cepa
agagaggaaagaacaagtaaaaaccactttttcttggcttttggtccatcaaaagggaaaattatcaaaaatttagaatatcttggcatggcaaacagcaatcttcctcgaagaatcatcaaggaaacgcagagactgttgagtgaaccagctcctggaatcagtgcatcgccatctgaggagaatatgcgatactttaatgttatgattctcggaccatctcagtctccatatgaaggtggggttttcaagcttgaattgtttttgcctgaagagtatccaatggctgctcctaaggttcggttccttacaaaaatatatcatcccaacattgacaagcttggaagaatatgcctggacattttgaaagacaaatggagtccagctttgcagattcgaactgtattgttaagtattcaagcacttttgagtgctccaaatccagatgatcctctttcggaaaacattgcaaagcactggaaaacaaatgaagctgaggctgtcgaaactgccaaggaatggacacacttgcatgccagtggtacttgaatattttacaattaatgtaactacaataagccagttatatgcaaatgcaagaatccttattattatcctatatatcaatgaaaaacctctgaattgagagcttctaactgtttgatcattatcctgtataacgacgctttcttcagggcagaacgatactgattatgtatgtaccagcatttctgtttaaaatcttcccttgggtggatgtttaacaagaaatattcagttactttttatgctttctttctgggtaccatgtactatatcaacttgatatgaatcgctatacaaattgcttagttctgattgatcataagcaaaatcaaataatgatatgtccttacaattacaagctaacatact

SEQ ID NO: 5215 - DNA, 779 bp, Gossypium raimondii
tatctctctccatttctagatccccaaaaccctcaaatacttttttttttccttcccatcgatctcgccaatggccaacactaatctccctcgaagaatcattaaggaaactcagcgtctcctcagtgaaccagcgcctggaattagtgcctcaccatcagaggataatatgcgatatttcaatgtgatgatccttggtccaacacaatctccatatgaaggaggggttttcaagttggaactatttttgcctgaagaatatcccatggctgctcctaaggttcgatttcttacaaagatataccatcctaacatcgataagcttggaagaatatgccttgatattctcaaagacaaatggagtccagctctccagattcgaactgtacttttgagcattcaagcactcctgagtgctcctaatcctgatgatccactctcggagaacattgctaagcactggaaaacaaatgaggctgaagccgtggagacagctaaggaatggacccgtttatatgcgaccggtgcataatacaagtggcggaaccgttagtgctcttaaaataacatttttatgcaatgtaagctattcaatgttaaagttaatgtttgaaagagtctgatattcgcaaagctttcagctgcaacctgagttggaagcagtgcagtctcatctctgaacttgtaagataatatacattgttctcaaaaactctgaaatgctcaaactaagggattattctctaatacagcaaaatgtttaaacgaaataattaaat

SEQ ID NO: 5216 - DNA, 832 bp, Gossypium raimondii
atcaatgtgagaacttgagacttgaaaggagtcctttttatctcaattcccagaaactgttttccctgtttatgttcacccatcgatccttgcaatggccaataccaatctccctcgaagaataattaaggaaactcagcgtctcctcagtgaaccagcacctggaattagtgcttcaccatcagaggataacatgcgatatttcaatgtgatgatccttggtcccacacagtctccatatgaaggaggcgttttcaagttggaactatttttgcctgaagaatatcccatgactgctcccaaggttcggtttcttacaaagatatatcatccgaacattgataagcttggaagaatatgccttgatattctcaaagacaaatggagtcctgctctccaaatccgaactgtacttttgagcattcaagcactcttgagtgctccaaatcccgatgatccactctccgagaacattgctaaacactggaaaacgaatgaggctgaagctgtcgagacagctaaggaatggacccgtctatacgcaagcggtgcatgacatacaagtggcggaaacatttgccttgttaaaaataacattttgtgcaatgtaagcgattgaatgtcaattctgtaaggatatttggaaggtttaaacgttagggaaagtttgatattggcaaagcttcccagttgctgtctgttaaatgtttaatcgtttccccattggaagctgtctgaacttgtatgataatatcaacattgttcttctaaaactctcaaaatgctgaactaagggattattctttaatatatccatttcagattcttatta

SEQ ID NO: 5217 - DNA, 732 bp, Raphanus sativus
ggccattcattaatctgaccgacgacgacgacgaagtgttctcgattctcggcgtcccgaaaccctaactcttatcgatcgatcgatcgatcgagcttagcagcgagcgaataatggccaacagtaatctcccccgaagaatcatcaaggaaactcaacgtctgctcagtgaacctgctcctggcataagtgcgtctccatctgaggacaacatgcgttacttcaacgttatggttcttggtccttcccaatcaccttatgaaggaggagttttcaagttggagctctttttacctgaagaataccctatgtcagctcccaaggttaggtttctcaccaagatataccatcctaacattgataagcttggaagaatttgtcttgatattctgaaagacaaatggagccctgctctacaaatacgaaccgtgcttttaagtatccaagctctgctgagtgcaccaaaccctgatgatcccttgtccgagaacatcgctaagcattggaagagtaacgaggcagaagctgtggagacagctaaggaatggacccgtctttacgcaagtggcgaatgatgcagtgtctctcgctcatccatcaaataacattacatttggttaaatcttatcctttgctggttcttccccctcattacgaagttgtaatctctctgaatgattgtatcattaacttatatgttcaagacatttactagttgcatttccaaacgca

SEQ ID NO: 5218 - DNA, 930 bp, Cycas rumphii
tggatccaaatgggagtggtgcgcctcaagtctgtagctatcacgcgagggttcgtctgtgtcctcttgattttcataaagattgaggctggtccatctgctaaatcacgcaacgcgacgttaatttcatacaagctttctgtaatcggatccattatggcaagcagtaacttgcctcgcagaatcattaaggaaactcaacgtttgcttagtgaacctgcacctggtataagtgcctctccttctgaggagaacttgcgatattttaatgtgatgattcttggacccactcaatccccttatgaagggggtgttttcaagttggaattatttttgcctgaagagtatcccatggctgcaccaaaggtccgctttttgacaaagatctaccaccccaatattgataagcttggacgcatatgcttagatattcttaaggacaagtggagtcctgctcttcaaattcgaacagttttgctgagcattcaagcattgctgagtgcacctaatcctgatgatcccctttctgagaatattgctaaacactggaaggcaaatgaagctgaggctgtagaaacagctaaagaatggacaaggctgtatgcaagtgggacctgacattgtttgtactcattcaataatacagctgcaacggctttggaagtgtattcttatttgtgggaacatgaatggatgggattcgatatgcagtttcatactgctgagctttggatgcagttgtgcagaattggtttgtctgaagtgttgaaaagatgaaccttttaatttagtattctgttggggctagcgccattttgcaatgatctggctagagccattttgaactgttgtctggtatgcctatcgaggctctgtttggaacaaatatctgattcttgtggggcattggtgcctttcatataaaatcaa

SEQ ID NO: 5219 - DNA, 732 bp, Zingiber officinale
tttgacttgccctttaccttccgctcttattcctcgcctcctcttcttccgatcgatccgcgagagaagccttgagcgcgcagcaggcgacccgattcgtgtcgtctcgatggccaacagcaacctccctcgccggatcatcaaggcaacgcaaagactccttagcgaacccgctcccggcacccgtgcatctccgtccgaggataatatgcgctacttcaatgtgatgatcctcgggccaactcagtctccttacgaaggaggagttttcaagctggagttgtttttgcctgaagaatatcccatggctgctccaaaggtccgctttctcaccaaaatataccacccaaatattgacaagcttggaagaatatgccttgacatcctgaaggacaaatggagtccagccctccaaatcagaacagtactgctcagcattcaggctcttcttagtgccccaaatccagatgaccctctctcagagaacatcgccaagcactggaagtcgaacgaagcagaagctgtggaaacagcaaaagaatggacacgtctttatgcttccggtgcataaagaattgctccagacagccgcggtgatctatttgcacttggaagtttattcatccatataaaaccttgacactgaacaaggtgcaagtgcaagtcaaggaaatgcttccttcttcctccttctcctgctgctgctgctatatatcgtgtaatcgcaaaatt

SEQ ID NO: 5220 - DNA, 795 bp, Liriodendron tulipifera
gttttcgagtctttggccgacccgacgagggttttacttacttctccacctctctctctcccaaaatctcaccttgaatggcgaacagcaatctgccccgtcggattatcaaggaaacgcaacgtctcctcagcgaaccagctcctggaattagtgcttctccttcagaagataatatgcgttacttcaatgtcatgattcttggtccaacacagtcaccttatgaaggaggagttttcaaactggaactatttttgcctgaagaatatccaatggctgccccaaaggtccgcttcctcaccaaaatctaccatcccaacattgacaagcttggaaggatatgccttgatatcctcaaagacaaatggagtccagctctccagatccgaacagtgctgctgagtatccaagcacttctcagcgctccaaatccagatgaccctctttctgataatattgccaagcattggaagacgaatgaagccgaagctgtggaaacagcaaaagaatggacccgtttatatgcaagtggcgtgtgatggggcaatggtgggcatctgctgcttctggcaaataacgtctactgtgtaagtttacgtgtcttgtctctgttttcacatggaaaacagaagtactgaacgtctgaattgccaggattaacttctcaagctcttcagttatatgcagcttgtcatttttcttcctccaaagggctgccttctgcatctgtatgattagatactggttgttgttccccctaatccacttatttctattctgtaggaatctggactt

SEQ ID NO: 5221 - DNA, 891 bp, Allium cepa
aatcatgatttcatgaattctcggacatacatggttactttatatagattcttttttgctttatctatgcgaagaacggaaaaactaagcgattataataaagcgtatacagagaggaaagaacaagtaaaaaccactttttcttggcttttggtccatcagaagggaaaattatcaaaaatttagaatatcttggcatggcaaacagcaatcttcctcgaagaatcatcaaggaaacgcagagactgttgagtgaaccagctcctggaattagtgcatcgccatctgaggagaatatgcgatactttaatgttatgattctcggtccatctcagtctccatatgaaggtggggttttcaagcttgaattgtttttgcctgaagaatatccaatggctgctcctaaggttcggttccttacaaaaatatatcatcccaacattgacaagcttggaagaatatgcctggacattttgaaagacaaatggagtccagctttgcagattcgaactgtattgttaagtattcaagcacttttgagtgctccaaatccagatgatcctctttcggaaaacattgcaaagcactggaaaacaaatgaagccgaggctgtcgaaactgccaaggaatggacacacttgcatgccagtggtacttgaatattttacaattaatgtaactacaataagccagttatatgcaaatgcaagaatccttattattatcctatatatcaatgaaaaacctctgaattgagagcctctaactgtttgatcattatcctgtataacgacgctttcttcagggcagaacgatactgattatatatgtaccagcatttctgtttaaaatcttcccttgggtggatgttcaacaagaaatattcagtta

SEQ ID NO: 5222 - DNA, 1216 bp, Phaseolus vulgaris
tgctaattaagggttttctgaattgagaattaagttataatcgttctcagcgttcttcatatatctatgccagtgagagaaattctctctccctctctttagaaaccctattgcgcgctttgcaatccagctccacaatggccaacagcaatcttcctcgaagaatcatcaaggaaactcagcgtttgctcagtgagccagctcctggaattagcgcttccccttccgaagacaatatgagatatttcaatgtgatgatccttgggccaacccagtcaccttacgaaggaggagtatttaagttagaactatttttgccagaagaatatccgatggctgctccgaaggttcggtttctaacaaaaatatatcatccaaacattgataagcttggcagaatatgtcttgatattctgaaagataagtggagtcctgctcttcagattcgtactgttctattaagcattcaagctctattgagcgcaccaaacccagatgatccactttctgaaaacattgccaagcattggaaatctagtgaggtcgaagctgttgaaacagcgaaggaatggacccgattatatgctagtgacgcctgatgataaggttcaagtatggctccataataacaattgtaaccatcattttatactggaaatctagaggatctatgaattgttggagtcaatatcccttgcagcttccagttacctgttaatttcttctcttgggagctgctatatcttgaaacttgtatgaatagatgtgtttatcttttacctatctaacaatttagaacgtgcgtcaatcatcggctgtgaagtaatttgttattctcaacatcagaggccaaaatttgcgatttagtttctgttctgtttatctcaatgaaccatgtcaagattttgttgagttagtaaccaataggattggttctgaagtgtagtcatttgtgtcctgagtgtgaataattattaccagtggccacgaagtctgaattttgagggttaaagatctgaacacgggaaccagtaatcgggaccagtgggcaaatcatgttgaatgggaacatcttgagctgaattttccaaagggttttgcaaaaatattctggtgtgatgtattttttaacaataacatttgggttggtaacgaatgtcatgatgcagcatggttgatggataaatgtatatcgtcgaaagtatgtatagaaaaa

SEQ ID NO: 5223 - DNA, 981 bp, Amaranthus tuberculatus
cccggaattctagaacaaatactaatacttcctcaacaactgagaagccaaaacaaagatcaagcatttccaaaatcttattcaaattcgtcaatggcgaacagtaatttacctcggagaattatcaaggaaactcagcgtcttctcagtgaaccagctccgggaatcagtgcttcgccatcggaagataatatgcgatacttcaatgttatgatccttgggccttcacagtctccttacgaagggggtgtttttaagttggaattatttttgcccgaggaatatccaatggctgctcctaaggtacgatttctcaccaaaatataccatcccaatattgacaagcttgggagaatatgtcttgatattctcaaagacaagtggagccctgctctccagatacggacagtactcttgagtatacaagcattgctgagtgctccaaatcctgatgatcctctgtctgagaacattgctaagcattggaaaactaacgaggcggaagctgttgaaactgcgaaagaatggactcatctatatgcttgtgaggcttgatactgctgctataccattaccctcttcgaataacaactgtgtaatgtttctattctgactacattcgaaaccaagctgctggttgcaaaatgaatatcaagggacaacttaggagaaaatatgaaaaaatggagtattgtttatcacaagtttctgctgttcacttctatatccttatgcttggaattgtattattgtatttatatgggttgcttaaattccaactgatatcgaatttctggagttctcattctaatacaaggaattcttaattttcagcatttcctaattcgtagtctttgtttttcatgactgttacaaatttgatagtaatgcctctgaccagatctgtaccgaaagtaattgctcttgtacttgctccgtttcattttacttgcaacatttaccgtttttggaagttttaag

SEQ ID NO: 5224 - DNA, 772 bp, Musa acuminata
ccgaaagcggtcgctcttttggaagaacaaaaagccctctccagacagttttaggtgccttcctctcgactccatctcctcctccattcgtcgcccccggtagttcttcgtctcctcttccctctccgccttcgttcgatcgagaatcggctgggatggccaacagcaatctccctcgtaggatcatcaaggagacgcagcggcttcttagcgaaccagctccggggataagcgcgtctccctccgaagacaacatgcgctacttcaacgtaatgattcttgggccgtcccaatctccatatgaaggaggagtattcaagcttgagctgtttctacctgaagaatatccaatggctgctccaaaggtccgctttctgaccaaaatctatcatccaaacattgacaagcttggaagaatatgcctagacattctgaaagacaaatggagtccagctctccaaattagaactgtgctcctcagtattcaagctcttctcagtgccccaaacccagacgatccactatcggacaacattgcaaggcactggaagacaaatgaagcagaagctgtggaaacagccaaagaatggacccgtctatatgctactggggcatgaaagcgaaggtggcgttctgcatgtaataacatctctactactgaacttcaattgttccaagctttaattagttcaagctcctgctgttatactatatggtgtacattggttgaaaccccctcttttttatacaatctcatccctctgagcaagtt

SEQ ID NO: 5225 - DNA, 899 bp, Chrysanthemum coronarium
cttttcaaagatcacaaaagttaggtaacttgaactcattaataaaaatggcgactaacagcaatctaccccgaagaatcatcaaggaaacacagcgattgctcagcgaaccagctccggggataagtgcatcaccatcggaagagaacatgcggtatttcaatgtcatgattcttggtccatcacagtctccttatgaaggaggagtcttcaaactggagctatttttgccggaagaatacccaatggctgcccccaaggttcggtttcttacaaaaatctaccatcccaacattgataagcttggcaggatatgtcttgatatacttaaagacaaatggagcccagctctccagattcgcacagtactcttgagcattcaagcccttttgagtgctccaaatccagatgatccgctatctgagaacgtagcaaagcactggaaagcaaatgaagctgaagctgttgaaacagcaaaggaatggacccacttgtacgccagtggcacctaaagcagacgtacactacttgcccctatgctgttgccgaaattacctgtataattggatattgatgctgaaattactgttaggatgtcttagcaaccggaaaaaagtttcctgcttgcttttagtcctggatttaatgttggttacgattgtcttcgagaatagttgttcattgcctcattgtttaggtttaatgaaacgtttatctaagcacatacagtatagtttggcagttgagtgaactagcctgccaacactttctctggtttttatgattgttttggattttgtatatgacagacgatttgcgtaaaaggcaaagccacagctataagagcatgtctaacattttcagcattagggatgtatcataggttatcaacatcgatg

SEQ ID NO: 5226 - DNA, 955 bp, Chrysanthemum coronarium
gagcgtaactgaaactcattgattcatcacaaaaatggcgactaacagcaatctccctcgaagaatcatcaaggaaacacagcgattgctcagtgaaccagctccggggataagcgcatcaccatccgaggagaacatgcggtatttcaatgtcatgattcttggtccatcacagtctccttatgaaggaggagtcttcaaactggagctatttttgccggaagaatacccaatggctgcccccaaggttcggtttcttacgaaaatctaccatcccaatattgataagcttggcagaatatgtcttgatatacttaaagacaaatggagcccagctctccagattcgcactgtactcttgagcattcaagcacttttgagtgctccaaatccagatgatccgctatctgagaacgtagcaaagcactggaaagcaaatgaagccgaagctgttgaaacagcaaaggaatggaccaacttgtacgccagtggcacctaaagcagatgtacactactcgcctgtatgttgctgcatgaaattacttgtataattggatattgatgctgaaattactgttaggatgacttagcaactgggaagaaggttcctgcttgctgatagtcctggatgataaatgttggttttcgagaatagtgttgttcattgcctcattgttaaggtttaatataacgtttatttatgcacatacagtcttgtttgaccgttacaatgaaagaagccaactgtcatggtgcctcttgaattggtaactagcctgccaacactttttctcaggcttttcgattgttttggattttgtatatgactgacattttgcataaaaggataagccacagctaagagcatgtctaacattgtcagcattagggttgtatcttaggttatcatttatcaacatcgatggaacccgtcttttatctttcttaacccgaa

SEQ ID NO: 5227 - DNA, 782 bp, Chrysanthemum coronarium
tctgttgaactgattcatcaaaatggcgactaacagcaatctaccccgaagaatcatcaaggaaacacagcgattgctcagcgaaccagctccggggataagtgcatcaccatcggaagagaacatgcggtatttcaatgtcatgattcttggtccatcacagtctccttatgaaggaggagtcttcaaactggagctatttttgccggaagaatacccaatggctgcccccaaggttcggtttcttacaaaaatctaccatcccaacattgataagcttggcagaatatgtcttgatatacttaaagacaaatggagcccagctctccagattcgcactgtactcttgagcattcaagcacttttgagtgctccaaatccagatgatccgctatctgagaacgtagcaaagcactggaaagcaaatgaagccgaagctgttgaaacagcaaaggaatggaccaacttgtacgccagtggcacctaaagcagacgtacactacctgcctgtatgatgctgcacgaaattacttgtataattggatattgatgctgaaattactgttaggatgacttagcaactgggaaaaaggttcctgcttgctgatagtcctggatgataatgttggttttcgagaatagtgttcattgcctcattgttaaggtttaatataacgtttatttatgcacatacagtcttgtttgaccgttacaagccaactgtcattgtggcacttgaattggtaactagcctgccaacactttttttaaggctttttcga

SEQ ID NO: 5228 - DNA, 878 bp, Gossypium raimondii
cacaaaagattcttattttctttttctctcaatttctaaatcccaaaaaccctctcttttttttcttgcaatcgatctcgccaatggccaacagtaatctccctcgaagaatcataaaggaaactcagcgtctcctcagtgaacctgcgcctggaattaatgcctcaccatcagaggataatatgcgatattttaatgtgatgatccttggtccaacacaatctccatatgaaggaggggttttcaagttggaactatttttgcccgaagaatatcccatggcagctcccaaggtccggtttcttacaaagatatatcatcctaacatcgataagcttggaagaatatgcctcgatattcttaaagacaaatggagtccggctctccagattcgaactgtacttttgagcattcaagcactcttgagtgctcctaatcctgatgatccactctcggaaaacattgctaagcactggaaaacaaacgaggccgaagccgtcgagacagctaaggaatggacccgtttgtatgcgaacagtgcataatacgattggtggaaatgttagctctcttgaaataacatttttatgcaacataatgcggaaattcagaagaattaatgtttgaaggagtctgatagtagcaaagcttccggttgcaacctgttataaatcatttcggtttcgagctgggagcaagtacagtctcatctctgagcttgtaagataatatatacattgttctccaaaactctgaaatgctcaaactaagggattattctcaaatgtagcaaaatgtttaaacgacataattaaatctaattgttatttcattaaattttgatgactaaagtaggtgattaattttatttcaattta

SEQ ID NO: 5229 - DNA, 985 bp, Chenopodium quinoa
atagcttcttgcataaagcccccctccattaccattttccaatatcgattccaaatttccaatcttcaattctgcctctttctctctcctgatctaccaccccttttcccctctttcatctccattaatggcgaacagcaatcttcctcgaagaatcattaaggaaactcagcggcttcttagtgaaccagctcctggaattagcgcttctccctctgaagagaatatgcggtactttaatgttatggttttgggtccatctcaatctccttatgaagggggcgtcttcaagttggagttgtttctaccagaagagtacccaatggcacctccaaaggtccgcttcttgactaagatttatcatccaaacattgataagcttggaaggatatgcttagacatcctgaaagataaatggagcccagccctgcagatccgaacagtattattaagtatccaggctcttttgagtgctcccaacccagatgatcccctttcagagaatgttgcaaagcactggaaaagtaatgaagttgaagctgtggaaacagcaaaggaatggacgcgtttatatgcaacaggagcttgacagcgggcgcttatcacacaaatgcatttccccattgtaacttaaaaccaaattacaattactactggttatttcatggaaatggaaattgaatcatgttttgatgattagtgtgataatctgaaggcctccaattgctggttgtagatgaatctcatcatgaaactaatttagtcttgagttgttgtcgaaacctgtaatgcttttttcctttaatttacatacttgggcatgttttgatgtggtatttgagagggggtggagggtttttatggctgcaaaaaatcccatggggccatactcagttactcaccatggccatgattatgtctatattggcgcatttcgtggaattaatctggtctagaaaaaatatctaggttagatattgctcca

SEQ ID NO: 5230 - DNA, 752 bp, Panax ginseng
aaaacccttgttagcgtactttgtaatcgaagcttcttcaatggcgaatagcaatttacctcgaagaattatcaaagaaactcagcgtctcctcagcgaaccagctcctggaataagtgcatcgccatctgaagacaatatgcggtactttaatgtcatgattcttggtccgacacaatctccatatgaaggtgggttttaagctggaattgttttacctgaagaatacccaatggctgctccaaaggttcggttcctcactaaaattttccatcctaacattgacaagcttggaaggatatgcctcgatatcctgaaggacaaatggagtcctgctcttcagattcgtactgtactattaagtattcaagccctattgagtgctcctaacccagacgaccccctctctgaaaacattgcaaagcattggaaaacaaacgaggctgaagctgttgaaacagcgaaggaatggacccgtttatatgccagtggtgcataacaaagttgtggaaactggaatctctgccaaaataacaatatatgcagtgtattctcaaagcatactcactgatcattgtatcctgacttccaaaccttgatgttgaaattgtataatgagataagatactcctgtcgagtgttgtctgtcttttcaaagttttaggaatgtgtgaaaaattgtctgaaagtttgggattcacttggtaaaatcattgtgaagctaagtaaaattatatgcgtgttggggctgc

SEQ ID NO: 5231 - DNA, 807 bp, Raphanus sativus
gggccatcaatccacgaaagtgttctctctatcgtcgccgtgcggatctatctccaaaaccctaactccgaccgatcgaattcagcagcgcgagatcatggccaacagcagtaatctgccaaaaagaattatcaaggaaactcaacgcctgctcagtgaacctgctccagggataagtgcatctccatctgaggataacatgcgatacttcaacgtcatggttcttggtccttctcaatcaccttatgaaggaggagttttcaagttggagctctttttacctgaagattaccctatgtcagcccccaaggttaggtttctcaccaagatttaccatcctaacattgataagcttggaagaatctgtcttgatattctgaaagacaaatggagccctgctctacaaatacgaacagtgctcttgagtattcaagctcttctgagtgcaccaaaccctgatgatccattgtctgagaacatcgctaagcattggaagagtaatgaggcagaagctgtggaaacagctaaagaatggacccgtctttacgcaagcggcgcatgatggatgggagggttaaaaaatctcattcattcccaaataacattacattcggtgataatctatctcaacgtcaaagtgataaaagttatgttttgcttcttcttattgtatcattactaataggttttcaaagtttcgttgaatcaaaaggtcttctcaactgtgtctaaataatctctctgcaacttttgtgttttgcaaatgaacaaaaggttgataaatcttaaagaaacgacattaaaaac

SEQ ID NO: 5232 - DNA, 810 bp, Daucus carota
tggtctttaaaatttttccgacatctgaagccggattcactttataattcaactcatctctctctctctctctctcgtgtttcaaactggtttgacttgctgaagacatggccaatagcaatttacctcgtagaatcatcaaggaaacacaacggcttctcagcgagccagctcctggaataagtgcttcgccttcggaagaaaacatgagatatttcaatgtcatgatacttggtccctctcaatctccttatgaaggaggggtattcaagttggagctctttctgcctgaagagtatccaatggctgcaccaaaggttcgctttctgaccaaaatataccatcctaatattgacaagttgggacggatttgcctagatattcttaaggacaagtggagtcctgccctccaaattcgcacagtgttgttgagtatccaagcacttcttagtgctccaaacccagatgatccactttctgagaatgttgctaagcactggaagacaaatgaagttgaagccgttgaaacggctaaagaatggagtcgattgtacgcaaccggggagtgaaaaggggatatgctagttgcagttatcagctctgctaatttcctgctaattaatatagctgaatggtttcatttagttatttgttaaactgtaaaaacaattgtacaaaccatcgcgcgtttcttgttcaatatatattgtatgaactacagacctaatttcttcaaggcaccattctcaaagattgttcaatatttcagaactttgaaattgagcaataaattagaagcttgatgatgac

SEQ ID NO: 5233 - DNA, 885 bp, Sorghum bicolor
caacccaagagcaagcaaacgacaattctcttctcatccccaccagcgccgccgccccccaatctttcgctgccgccgccgtgatccaaaggaccaccggaccctagtctgaatcccttcatccgttccccatggccaacagcaacctcccccgccgcatcatcaaggagacgcagcggttgctcagcgagccagctccaggaatcagtgcctcgccatcagaggagaacatgcgctacttcaatgtcatgatccttggaccatcgcagtcgccatacgagggaggagttttcaagctcgagttattcttgcctgaagaatatccaatggctccaccaaaggttcgttttctcacaaaaatttatcaccctaacattgacaagcttggtaggatatgccttgatattttgaaggacaagtggagtcctgcccttcagattcgaacagttttattgagcatccaggcattgcttagtgctccaaaccctgatgacccacttgccgacaatgtggcaaagcactggaaggctaatgaagctgaagctgtagaaacagctaaagagtggacccgtgtatatgcaagcggagcttgatctttgcatgaagcatgcttgcctggtaagaaatttcgttccgtggatctgcggaggtggaggtgaacttgatcaacgattggttgctgaaattggaaatcgaaatgattgagtgaattgtggatttccaaatatcctttgatgatgcgtgtcaagagtctgatgtacattactctagttgagctgtgatgatgaaccctcatgcatgtaaattgtttctttggtacgtctggttcctgagagacatcagacatatatgataataaatatcctagaatgatgtatgcctgcc

SEQ ID NO: 5234 - DNA, 828 bp, Echinochloa colona
cctcattctcttctccaccggcgccgcctcctttccccaatctccgccgtctccgcgatcccaaggtcgaccaaaacctagcaccaagtcccctccgctgtccgccatggccaacagcaacctcccccgccgcatcatcaaggagacgcagcggcttctcagcgagccagctccaggaatcagtgcctctccatcggaggagaacatgcgctatttcaatgtcatgattcttggcccgtcacagtctccatatgagggaggagttttcaagcttgaattgttcttgcccgaagaatatccaatggccccaccaaaggttcgctttctcacaaaaatttatcaccctaacattgacaagcttggtaggatatgccttgatattttaaaggacaagtggagtcctgcccttcagatccgaacagttcttttgagcatccaggctcttctcagtgccccaaaccctgacgatccgcttgccgacaatgttgctaaacactggaaagctaatgagactgaagctgtggaaacagccaaagagtggacccgtgcatacgcaagtggagcatgagctttgcacagtgtaatgcttgcttggtaataatcttcgtggtggagctcaactcgaacaaccattggttggtcacactcaaaactgaaggggtttagtcatctgttgaattttatccacttcatggtgcgtgtgcttgagtcaatgaatctgatgtacatcagtaaaattgagctatgacaaacccttgtgcatgtaaagtgtttctttgctatatctggcaggagaacatatgcttatatataccaaaataaatatcc

SEQ ID NO: 5235 - DNA, 1237 bp, Petroselinum crispum
agaatgttcacaaatacaagttcagacatctaaaataggcttgggattcgctttctatagttcaactcgatctctctctttgtttcttaaactctttcttgtggtttgacttgcttaagaaatggccaacaccaatctacctcgtagaataatcaaggaaacacagaggcttctcagtgagccagctccaggaataagtgcttcaccttcagaagaaaacatgagatatttcaatgttatgatacttggtccctcccaatctccttatgaaggaggagttttcaagttggagctgtttttgcctgaagagtatccaatggcagcaccaaaggttcgctttctgaccaaaatataccatcctaatattgacaagttgggacggatttgcttagatattcttaaagacaaatggagtcctgccctccaaattcgcacagtgttgttgagcatccaagctcttcttagtgctccaaacccagatgatccactttctgagaatgttgctaagcactggaaaactaatgaagttgaggcggttgaaacagctaaagaatggagtcgattgtatgcaaccggggaatgacacgaaaatatgctagttgcggcaagcagttctactaatttcctgcaaatttgtttagctgaatggttccattggttatttgttaaaatataaaaccaattgtacaaaccattacgaatctttttaatgtcctgtacacgctactgacctgatctcttcaacgaatgatttccataaattgtgcaataacctagaagcttgatgactataatatatttgatgcaaatttacatattgtgcacttgtttatgtcttcatctggacagttataatttcttggttaaccttactgatttcgttgattcctttccaaagtatcgtccgtgctcggtgcgaataaaagggctttaaaacccaccaatgattctatacgttgtttaggcatggttttatacatttgcacgggatggctatgtaaaagattaccattaaatctattttatttttaaactgctgacgacgaaatcgaatttctgggaagtaagatagtgaatcttcttgtcacaactggttgcaaagaagagagcatcaaagacactgaaggatgggagcttcttgaaaatataatctcaggctctgaggtccgtttcttaaaatttttatgctacaaaggattttgcaacaaattctgtttttcttttaaaccagaggcga

SEQ ID NO: 5236 - DNA, 840 bp, Panax ginseng
tctctctgaaaacccttgttagcgtactttgtaatcgaagcttcttcaatggcgaatagcaatttacctcgaagaattatcaaagaaactcagcgtctcctcagcgaaccagctcctggaataagtgcatcgccatctgaagacaatatgcggtactttaatgtcatgattcttggtccgacacaatctccatatgaaggtggggtttttaagctggaattgtttttacctgaagaatacccaatggctgctccaaaggttcggttcctcaccaaaatttaccatcctaacattgacaagaatgagtgtctggatgcagcttggaaggatatgcctcgatatcctgaaggacaaatggagtcctgctcttcagattcgtactgtactattaagtattcaagccctattgagtgctcctaacccagacgaccccctctctgaaaacattgcaaagcattggaaaacaaatgaggctgaagctgttgaaacagcgaaggaatggacccgtttatatgccagtggtgcataacaaagttgtggaaactggaatctctgccaaaataacaatatatgcagtgtattctcaaagcatactcactgatcattgtatcctgacttccaaaccttgatgttgaaattgtataatgagatgagatactcctgtcgagtgttgtctgtctttcaagtttaggaatgtgtgaaaattgtctgaaaatttgggattcacttggtaaaatcattgtgaagctaagtaaaattatatgcgtgttggggctgctgatcagcttttaacttcttttgcttcttcaaaaagagtattatactataaccgagtgtgca

SEQ ID NO: 5237 - DNA, 871 bp, Panax ginseng
tctctctctctctgaaaacccttgttagcgtactttgtaatcgaagcttcttcaatggcgaacagcaatttacctcgaagaattatcaaagaaactcagcgtctcctcagcgaaccagctcctggaataagtgcatcgccatctgaagacaatatgcggtactttaatgtcatgattcttggtccaacacaatctccatatgaaggtggggtttttaagctggaattgtttttacctgaagaatacccaatggctgctccaaaggttcggttcctcactaaaatttaccatcctaacattgacaagaatgagtgtctggatgcagcttggaaggatatgcctcgatatcctgaaggacaaatggagtcctgctcttcagattcgtactgtactattaagtattcaagccctattgagtgctcctaacccagacgaccccctctctgaaaacattgcaaagcattggaaaacaaacgaggctgaagctgttgaaacagcgaaggaatggacccgtttatatgccagtggtgcataacaaagttgtggaaactggaatctctgccaaaataacaatatatgcagtgtattctcaaagcatactcactgatcattgtatcctgacttccaaaccttgatgttgaaattgtataatgagataagatactcctgtcgagtgttgtctgtctttcaagtttaggaatgtgtgaaaattgtctgaaagtttgggattcacttggtaaaatcattgtgaagctaagtaaaattatatgcgtgttggggctgctgatcagcttttaacttcatttgcttcttcaaagagtatactataaccgagtgtgcatttataaatcttgttcaaacttggtcttaa

SEQ ID NO: 5238 - DNA, 921 bp, Setaria italica
aaaaaacgcaaactacagggaccagggtgcacaagcaagcaagcgaccatttctttctccacgactccaccagcgccgcctctttgcccccaatctctctccgcctccaccgcgatcccaaggaccaccaaaccctagcccgaaggcccccctcctcagtccaccatggcccacagcaacctcccccgccgcatcatcaaggagacgcagcggctgctcagcgagccagctccaggaatcagtgcctcgccaacggaggagaacatgcgctacttcaatgtcatgatccttggcccgtcgcagtcaccatatgagggaggagttttcaagcttgaactattcttgcctgaagaatatccaatggctccaccaaaggttcgatttctcacaaaaatttatcaccctaacattgacaagcttggtaggatatgccttgatattttaaaggacaagtggagtcctgcccttcagatccgaacagttcttttgagcatccaggcgctgctcagtgccccaaatcctgacgatccacttgctgacaatgttgcaaagcactggaaatctaatgagactgaagctgtggaaacagccaaagagtggactcgtctatatgccagtggagagtgagctttgcacgatgcaatgcttgcttggtaataatcttcgtggtggagctcaacttgaacaaccattggctggttacatttgaaactgaaggggtctagtgatgtgtcgaattttatcctctttatgatgtgtcctacagtctgatgtacattaatctagctgggctgtgacgaaccctcatacatgtaaagtgttcctttggcatgtctggtacttgaccttgagaggttagatgattatacatatatcataataaatatgctgagatgatgtgtgtgcctgttatttcttgaa

SEQ ID NO: 5239 - DNA, 737 bp, Lolium multiflorum
cgccggatcatcaaggagacgcagcggctgctcagcgaaccagcgccggggatcagcgcgtcgccgtcggaggagaacatgcgctacttcaatgtcatggtccttggaccggcgcagtctccttacgaaggtggagtttttaagcttgaacttttcttacccgaggaatatccgatggctgctccaaaagttaggtttctcacaaaaatataccatcccaacattgacaagctcggtagaatatgccttgacatcctcaaggacaaatggagtccagcccttcaaatacgcactgttcttttgagcattcaggcactgctgagcgctccaaacccagatgaccctctctcagaaaatgttgcaaaacactggaaatccaatgaagctgaagctgttgagacagcgaaagagtggactcgcgtgtatgccagtggtgcatgacaagctaacgctggttatggatgtaataacaccatgtcatagtcgggtctaactgaaaaccatttgcttgataagaacaaacttgaaactgtattgtgatggaagtaagtgtccatagcgataacggttcaagttaccggttgtatttgtggtgcatgttcttgcacctgtcactgctgtgccactctagccaaatctgttgctgcttatagaacatgctgtgtttcctcttgatcttcaattatttatcagttaactcgtccgctaagatcctatgtaaactgttcaaaagatgg

SEQ ID NO: 5240 - DNA, 885 bp, Setaria italica
gcaccagcaagcaagcgaccatttctttctccacgactccaccagcgccgcctctttgcccccaatctctctccgcctccaccgcgatcccaaggaccaccaaaccctagcccgaaggcccccctcctcagtccaccatggcccacagcaacctcccccgccgcatcatcaaggagacgcagcggctgctcagcgagccagctccaggaatcagtgcctcgccaacggaggagaacatgcgctacttcaatgtcatgatccttggcccgtcgcagtcaccatatgagggaagaggagttttcaagcttgaactattcttgcctgaagaatatccaatggctccaccaaaggttcgatttctcacaaaaatttatcaccctaacattgacaagcttggtaggatatgccttgatattttaaaggacaagtggagtcctgcccttcagatccgaacagttcttttgagcatccaggcgctgctcagtgccccaaatcctgacgatccacttgctgacaatgttgcaaagcactggaaatctaatgagactgaagctgtggaaacagccaaagagtggactcgtctatatgccagtggagagtgagctttgcacgatgcaatgcttgcttggtaataatcttcgtggtggagctcaacttgaacaaccattggctggttacatttgaaactgaaggggtctagtgatgtgtcgaattttatcctctttatgatgtgtcctacagtctgatgtacattaatctagctgggctgtgacgaaccctcatacatgtaaagtgttcctttggcatgtctggtacttgaccttgagaggttagatgattatacatatatcataataaatatgctgagatgatgtgtgtgcctgt

SEQ ID NO: 5241 - DNA, 789 bp, Pseudoroegneria spicata
tccttggtccttcctcccctcccctccgccgccccccgatccctcgaaaagaccacgaaaccctagccctagccccacccatctcctccatggccaacagcaacctccctcgccgcatcatcaaggagacgcagcggctgctcagcgagccagctcctgggatcagtgcttcaccatcagaggagaacatgcgctacttcaatgtcatgatccttggtccaactcagtcgccatatgaaggaggagtattcaaacttgagttgtttttacctgaagaatatccaatggctccgccaaaggttcgctttctcacaaaaatttaccatccaaacattgacaagcttgggaggatatgccttgatatcttaaaggacaagtggagtcctgcccttcagatccgaacagttcttttgagtattcaagcactcctcagcgctccaaatcctgacgatccgcttgctgacaatgtggcaaagcactggaaggccaacgagacagaagctgtggaaacagccaaagagtggacccgtgtctacgctaatgatgcatgagctctggcatgctacgactgattgctcagtagtcttggcgaggtggaggtgaaatcgactatcaagtggtttaaaatggagaggtcctgatgaactagtaaaatgtgaggtttccttgcatcgcttgtactgagtgtgatgtatattattaccctagttgggatgcgatggacccatgtgcgtgtatattatgttcgagtgttgtaccgtaataaacatcctgaagttatgtgtgcca

SEQ ID NO: 5242 - DNA, 630 bp, Avena sativa
attattgttcagtctgacgcggtgacgccgcctccttcctctcccccctcgcctgcgattgatcccacggaaagcgcaccaaaccctagcccccacccttgcacgccatggctaacagcaacctcccccgccgcatcatcaaggagacgcagcggctgctcagcgagccagctccagggattagtgcttcaccgtcagaggagaacatgcgctacttcaatgtgatgattcttggcccatctcagtcgccatatgaaggaggcgtattcaaacttgagttgtttttgcccgaggaatatccaatggctccgccaaaggttcgctttcttactaaaatttaccatccaaacattgacaagcttgggaggatatgccttgatatcttaaaggataagtggagtcctgcccttcagatccgaacagttcttttgagcatccaagcgctgctgagtgctccaaatcctgacgacccgcttgctgacaacgtggcaaagcactggaaggccaacgaaacagaagctgtagaaacagccaaagagtggacccgtgtgtatgcgaatgatggatgagatttgcatgatccagctggtaataatatccacatgatgcaggtttaaaatggaggtagat

SEQ ID NO: 5243 - DNA, 574 bp, Avena sativa
ttgatccaacggaaagcacaacgaaccctagccccgacgcttgcacgccatggctaacagcaacctcccccgccgcatcatcaaggagacgcagcggctgcttagcgagccagctccagggattagtgcttcaccatcagaggagaacatgcgctacttcaatgtgatgattcttggcccatctcagtcgccatatgaaggaggcgtattcaagcttgagttgtttttgcccgaagaatatccaatggctccgccaaaggttcgctttcttacaaaaatttaccatccaaacattgacaaacttgggaggatatgccttgatatcttaaaggataagtggagtcctgcccttcagatccgaacagttcttttgagcatccaagcactgctgagtgctccaaatcccgacgacccgcttgctgacaacgtggcaaagcactggaaggccaacgaaacagaagctgtagaaacagccaaagagtggacccgtgtgtatgcgaatgatggatgagctttgcatgatccagctggtaataatatccacatgatgcaaggtttaaaatggaggtagaag

SEQ ID NO: 5244 - DNA, 799 bp, Festuca arundinacea
agatcattgttcactctgacgccgcctccttcctctcccttcctctcccccctctgctgcgattgatctcacggacagcccaccaaaccctagctctagccccacctctcaatccatggctaacagcaacctcccccgccggatcatcaaggagacgcagcggctgctcagcgagccagctccagggatcagtgcttcaccgtcggaggagaacatgcgctacttcaacgtgatgatccttggcccatctcagtcaccatatgaaggaggcgtattcaaacttgaattgtttttgcctgaagaatatccaatggctccaccaaaggttcgttttctgacaaaaatttaccatccgaacattgacaagcttgggaggatatgccttgatatcttgaaggacaagtggagtcctgcccttcagatccgaacagttcttttgagcattcaagcactactcagtgctccaaatcccgacgatccgctcgctgacaacgtggcaaaacactggaaggccaacgaaaccgaagctgtagaaacagccaaagagtggacccgtgtgtacgcgaatgatggatgaactttgcatgatccggctgcttgcttggtaatggtagttggtttaaaattgcggtagaggggatcagttggtgaaatggggaaatttatccttgttatcgtgtgtaccgagtgtgatgtatattgttagcctagttgggctgcggtagacccaggtacatgtataatacgtaagtattaccgtgatgaacgtcctgaagttatgtgtgccttttcttgctcc

SEQ ID NO: 5245 - DNA, 1599 bp, Physcomitrella patens
gtatcgaactttctcttctggctctctccctttgctttctctctcgctctctctcctgctcttcctcgaattcgtagtttagtaggacccttcttcttcttcttcttcttcttcctcttcttcctcctccttgcccctcccctccatgccctaattgtaatcccgcccccatccccaagctccctcctcccctcccctccctcaattccattccattccgccctcgcccttccacgttgctgctgcttctgctgaaattcctcctcgctcgctatcccctccccctccctcctcgattccaccccgtccctcgtcttcctcccgcaggacattccgatttacagggggttgcgtgggccaggcactccatttgtcgcactcaacatgtctgccgctaccgccaacaccaacttgcccaggcggatcatcaaggaaacccaacgattacttagtgagccagctccgggaatcagtgcgtcaccgtcggaagagaatttgcggtatttcaatgtgatgattctgggcccatcacaatctccatatgaaggtggagtgtttaagcttgaattgtttttgccagaggagtatccaatggctgcacccaaggttcggttcttgacgaagatatatcacccaaacattgataagttgggacggatctgcttggatatcctcaaagataaatggagtccagctcttcagatccgcacggttcttctcagcattcaggctttgctaagtgcacctaacccagatgatcctctggctgaaaatatcgctaaacactggaagacaaacgaacaggaggctgtggagactgcgagggagtggactcgtttgtatgcaagcggcgcctgaagattgtttcgtactccggcccaactaataaaaagttgagatgctttataggagcgtgtttaggaaagaatttggtgcgactttgggggggataggtgccctggtcacctgtagcaagtaaggttgtggattagtcttctaacttctgaaagttattgctcattcattcaagtagggagagtgcacccaagttcttgtgatattccagtgcattataggatcacctgtctaacctctttttgcacacttatctcttagaatgttgtagtgtccaggcttagacctattttgttctatgccatatcaggcagccttgatttcaactttcttttcactagttgagcagattctggaaccgtgttcattctttatactatccccgacgaaggcactacttattttgtagcgcacacgttcagggcaattatgaaggactgaagagaagatactagggtgctgcgcatgaaaatttctccatgttttatctttagtttgagtgtttgtgtgcacagtagtttttttctcaccagaggcacttttgaaaagaaaagggactcatactgcaatggtgcatgaagggtacatttgtagggtagaatggactgttgcgcatctaatattagctgatttgattgaacatcaacgctagttttcatttttcatccactttgtttcgtgtactctgggtttccactagtagcctttattgattgtaggggtgtttcagctgacttgttttag

SEQ ID NO: 5246 - DNA, 746 bp, Avena sativa
gatttttcatactagtaatcactatgacttctttttctcaaaaataattttcttaaaccactttctgaactaccctcgtgaataccaagaacatcaaggactaaattgcacagcggcaaagatcattgttcagtctgacgccgcctccttcctctctccctcccctccgctgcgattgatcccacggaaagcacaccaaaccctagaccccacccttgcacgccatggctaacagcaacctcccccgccgcatcatcaaggagacgcagcggctgctcagcgagccagctccagggattagtgcttcaccgtcagaggagaacatgcgctacttcaatgtgatgattcttggcccatctcagtcgccatatgaaggaggcatattcaaacttgagttgtttttgcccgaagaatatccaatggctccaccaaaggttcgctttcttacaaaaatttaccatccaaacattgacaagcttgggaggatatgccttgatatcttaaaggataagtggagtcctgcccttcagatccgaacagttcttttgagcatccaagcactgctgagtgctccaaatcccgacgacccgcttgctgacaacgtggcaaagcactggaaggccaacgaaacagaagctgtagaaacagccaaagagtggacccgtgtgtatgcgaatgatggatgagatttgcatgatccagctggtaataatatccacatgatgcaggtttaaaatggaggtaga

SEQ ID NO: 5247 - DNA, 1193 bp, Physcomitrella patens
gtcgtgctcgtttgcttgttcgtacacttgcttgctcgctttgcgtttccgccgggccctgccgagctctgcagcgtgtccctcggctctgtctaagcctctttccgctccctctctctctctctcccttcattgcttgagtctccgtcctccccaccttcgctatttttttttccagtctttgtacctctccctctcggggcggacttgctgacctttgcgttgcgtagacgtttcgtttggcgcactcaccatgtctgctgctgccgccaatgcgaatctgcccaggcggatcatcaaggaaacgcaacgactgcttagtgagccagctccgggcatcagtgcatcaccatccgaggagaatttgcggtattttaatgtgatgattttgggcccatcacaatctccgtatgaaggtggagtgttcaagcttgaattgttcttgccggaggaatacccaatggctgcacccaaggttcgcttcttgacgaaaatttatcaccctaatattgataagttgggaaggatctgcttggatattcttaaggataagtggagcccagctcttcagatccgaacagttctattaagcattcaggctctattgagtgcacctaacccagatgatcctttggctgagaacatcgctaagcactggaagtctaacgaacaggaggcagttgagaccgcaagggagtggactcgttcctatgctagtggcgtctgaagactgtttaatcgtccagcccaacctttaaaaagctgagaagcataacaggagcaaatttgatgaactgtgtgtggccataggtgataggtcacctgtaggaagtatgattgtgaatgaggcactctaaaattctgaaggttatagtttgtccagttaagaatggagggtgcgagtaaccaagttcttgatttattctagatcattataaaccgtacctgtttatcttctttttcgtagtcctctcttcaaatgttgtgtccaggccagggcatcttttggtcaactcgtattaggcaggctttctttcagttttgttttaattcgactcagtcaggttctggtattgtatttgtaccatccccgaccaaggcaatgcttaatttgtagtgcatgcgttcaggataattatggactcaagagaagatatcatctacaatgaaaattctttcatgtttaacttgta

SEQ ID NO: 5248 - DNA, 716 bp, Avena sativa
ctgcgattgatcccacggaaagcacaccaaaccctagaccccacccttgcacgccatggctaacagcaacctcccccgccgcatcatcaaggagacgcagcggctgctcagcgagccagctccagggattagtgcttcaccgtcagaggagaacatgcgctacttcaatgtgatgattcttggcccatctcagtcgccatatgaaggaggcatattcaagcttgagttgtttttgcccgaagaatatccaatggctccaccaaaggttcgctttcttacaaaaatttaccatccaaacattgacaagcttgggaggatatgccttgatatcttaaaggataagtggagccctgcccttcagatccgaacagttcttttgagcattcaagcactgctgagtgctccaaatcctgacgatccgcttgctgacaatgtggcaaagcactggaaggccaacgaaacagaagctgtagaaacagccaaagactggacccgtgtgtatgcgaacgatggatgaggtttgcatgatccggctggtaataatattcgcatgatgcaggtttaaaatggaggtagaagggaccaagcagtggaatgttaaatttatgcttgcatcgtgtgtacgagtgtgatgcagcctagttgggctgtgagggacccatgtatacatgtataatgcatcctgaagttatgtgtgccttttcttgctctaaaaa

SEQ ID NO: 5249 - DNA, 1629 bp, Marchantia polymorpha
tgttgcgggtgtcgttgcaacactgttgtagctggtgctggtgtcgggcctagtgctctagtgctgggcgaaattgaagcggtcgggagctagattcctcaagattggatcggctgcagaagcgaaggattttgctgcgggatctgccagggggtgagacgagcagtacgggtgggcgggttggttggttggttggttgattgattgattgattccgagcagcacgagagaggaaggaagggagacagagagcaggacgagacggttcgaccggtggtggcagaggaagggcgaggtgcctttggtggtattgctgttgctgctgctgctgctgccgccgcctaggtgaaggagagtgacagggagtggctggcgcgctgccttgcttctggggcgagggttgagagcgaggatctttggacaagaggcgggagaagattagcgtttcgggttgggttccggggcgaccttggcgttacactgcaacatgtcgggaaccaccgccaatagcaatctacctcgcaggatcataaaggaaacgcagcgattgctaagtgaaccagcaccgggcataagtgcgtcaccttcggaggagaacctgcgttacttcaatgtcatgattttgggcccgacacaatctccatatgaagggggtgtgttcaagttggagctcttcttacctgaagagtatcctatggctgctcctaaggtgagattcttgacaaagatctatcacccaaatattgacaagttggggcgaatctgccttgatatcctgaaggacaagtggagtccagcacttcaaattcgaactgttcttctcagtatacaggcattactaagtgcacccaacccagacgatcctcttgctgagaatattgctaagcattggaagactgacgaagctcaggctgtcgcaacagcgagggagtggactcgactttacgcaactggagcgtaattcagagataatcattaaggagagcttacatggaaagtggatgcgatttagagttcccaggcaggcgcagcagtagacagagagttgatatatcacaatctatcctctgttatggctggtcacaacggaatgaagacctaacttgaagcatcatggaggttcagttgctttcagtcaaaactacacccagatactacggaggtcagaaataggcccttgaatctggaaaggacttatctatttagtgccacaaccccaaacgagcaacagacttcctcggcttcatgtccagcaacactccctgaagatgccgggccttattcatgatcatggttttgtttgctctagagttatcttcttttccaatctgatataagttagaaggtgtccaaagcgttctagacttttacttttgccacattcgaaggatgatttttctagcccgttggttctattctttcttagctggttgtggccaaagaccaggagtttgcttctcttccacatgtatatctgtgcagacgacgagtgtaaagttggtctcaacctgtcaatcaaatgctgcaccacttacagcgaactcttaaacaccacccgttgtgatgttttatgaagaagtttatacacgaggtcaagtctgaaaagtcacttcaggacatatttcaggc

SEQ ID NO: 5250 - DNA, 620 bp, Cichorium intybus
atctacctcgaagaattatcaaggaaactcagcgcttacatagcgaaccagctccggggattagcgcatcctctctgaagataacatgaggtatttcaatgtcatgatccttggtccaacacatggtccccattaaggaggagttttcaaattggagttatttttgccagaagaatatccaatggctgctcccaaggttcggtttcttacaaaaatttaccaccccaatattgacaagcttggtaggatttgtcttgatatccttaaagacaaatggagccctgctcttcagattcgcactgtcctcttgagcattcaagctcttctaagtgctccaaatccagatgatccgctctcagagaacatagcaaaacactggaaatccaatgaagctgaagctgttgaaacagcacaggaatggactcgcctgtatgctagtggtgcctaatggatgagatgtgggtcattcgtgaaaataacaatgtactttgttaggtcttcaaatttaaaaattcaaaacttgaatgattttactctgccagtccctgaaccatcaatgttggccacttccaaccttcagacctttgtgttttctgctgagcacatgagacaagctactc

SEQ ID NO: 5251 - DNA, 680 bp, Panax ginseng
aaaaaaaaaaaaaaaaaaaaaaaaaaaaaaataaaaaaaaaaaaaaacaaaaaaaaaaaaattaaaaaaaacttaacacactgatttagagagagagagagatagtcccaaaaaagccattgcaatttgctctttccctctctgaaacccttattagcgtaaatcttattcaaagcttcttcaatggcgaatagcaatctacctcgaagaataatcaaactccgggaataagtgcttcgccgtcagaagacaatatgcgctactttaacgtcatgattcttggtccgacacaatctccatacgaaggtggggtttttaagctggaattgtttttgcctgaagaatacccaatggctgctccaaaggttcggttcctaaccaaaatataccatcccaacatagacaagcttggaaggatatgtcttgatattcttaaagacaaatggagccctgctcttcagattcgtaccgtactattaagcattcaagccctattgagtgctccaaacccagacgatccactctctgagaacattgcaaagcattggaaaacaaatgagtctgaagctgttgaaacagccaaggaatggacccgtttatacgccagtggtgcatgacgaggttgtggaaactggaatctccgccaaaataacaataacaatatatatatatatatatat

SEQ ID NO: 5252 - DNA, 1040 bp, Ananas comosus
gagatagagagagaaatatagaaaccctagcgccctaatccgccatggccaatagcaacctccctcgccgcatcatcaaggagacgcagcgcctcctcagcgagccagcgccggggatcagtgcatatccttcggaagagaacatgcgctacttcaatgtgatgattctagggccgtctcagtcgccttatgaaggaggggttttcaagcttgaattattcttgcctgaggaatatccaatggctgcgcccaaggttcgtttcctcaccaaaatttaccatcccaacattgacaagcttggaagaatatgccttgatattttaaaggacaaatggagtcctgcactacagatccgcacagttcttttgagtattcaagcacttctcagtgctccaaacccagatgacccgctgtctgataacatcgcaaagcactggaaggcaaatgaagcggaggccgtagagactggtaaggcagtgacttagaccatcggatacgagattcggccccttctcaaatattttgatggaatggccctgtcaattcatcaagtcactataatacttgcaagggttattacaaacttttttggtccttcaagtttgatacagatttcagccacgaccttagcattttactgtcaataatttagtccccaaatttcatactttgtaaaagttggggtcttcccactaggaagggcgccacaaccgtgccatttttagagtttgttgatgtggtggtgttttgtggttggcacgggcagtgaatggtgcatctgtctttagacagtttactaaccttaggacttaattataacacagaacacaatccagggaataaaatgttataactggaactacgcccgtatcaaaatccggaatcaaacttcacagactaaagttgtgaataacaacaaattaacagcatttcttgttggtagcatatacttgctagtcttcctggccatgataatacttggcaaaaatattttctgttatgttgcagcgaaggaatggacacgcctatacgccagcgag

SEQ ID NO: 5253 - DNA, 506 bp, Arachis hypogaea
tctttgtgtgttcctctctttctctctttctttttctccgagactcaaaaccctattgcgtgttttgcaatcgaccctccaaaaatggcgaacagcaacctccctcgaagaatcatcaaggaaacgcagcgtttgctcagtgagccagcacctggaattagtgcttcgccttcggaagacaacatgcgatatttcaatgtgatgatccttggccctactcagtcaccctatgaaggtggagttttcaagttagaactatttttgccagaagaatatccaatggctgctccaaaggttcggtttctaaacaaaaatatatcatccaaacattgataagcttggcaggatatgtcttgatattctgaaagataagtggagccctgcccttcagatacgcactgtactcttgagtatccaggctctgttgagtgcaccaaacccagatgatccactatctgagaacattgccaagcattggaaaagtaatgaggccgaggctgttgaac

SEQ ID NO: 5254 - DNA, 684 bp, Eutrema parvulum
aggaaactcaacgtctgctcagcgaaccagctcccggtattagtgcctctccatctgaggataacatgcggtatttcaacgttatggttcttggtcctacacaatcaccgtatgaaggaggagttttcaagttggagctctttttgcctgaagaataccctatggcagctcccaaggttaggtttctcaccaagatataccaccccaacattgataagcttggaagaatctgtcttgatattctcaaagacaaatggagccctgctctacaaatacgaacagtgctcttaagtattcaagctcttctgagtgcaccaaaccccgatgatccgttgtctgagaacatcgcaaagcattggaagagtaatgaggcagaagctgtggagactgccaaggaatggacccgtctttacgcaagcggcgcatgatggatcggaggctgaaaaggtctctttcatcgaaataacattacgtttgctgaaatctccctcaacatcaaagttataaaaaaagcttatattttgctggttctcccccctcattatgataaaaatgtgttctccgcacaggaagctgtaatatctctgaattattgtatgattactaatagggtcaagactcgtttacccatatttcaaatttcgtcaagtttatttaaataaaaaaaatctcgttctctactgt

SEQ ID NO: 5255 - DNA, 814 bp, Arachis hypogaea
tgacctgagtagttgatgactgtctctctcgctgtgctctgaaaagagggaatccctattgcgtgcattgcactcgacccctgacaatggccaatcattaatctccctccaagaatcatcaaggaaacgcgacgtttgctcagtgatccagcgacgggaattattgcttccccttcggaacataatatgcgatatttctgtgtcgtgatcctcgggccgacccagtctcatgacgaaggtggattcttcaaattagagctatttttgcccgaagagtcatccaatggctgctccaaaggttaggtttctgacgaaaatatatcaacccaaacaattgacaagcttggcaggatatgtcttgatattcttaaagataagtggagtcctgcccttcagatacgcaccgttcttttgagtattcaggctcttttgagtgcaccaaacccggacgatccactttctgagaatattgcaaagcactggaaatcaaatgaggccgaggctgttgaaacagcaaaggaatggactcgattatatgcaagcggtgcctgatgattgggttcaaacttacggcttcaaacgttcaagtgtataatatgaactgtcagttttaaatggaaaatatggtcaaattgttgtctaacttgtgagtttatattccaaatagcctccagtttcctcttaatttccgtatcttggaagtcagaattcttatgtgctttacgttgatctgtctttaaaattagcgcatccttcattgagctactaaaaaaaaaggaaaaaacaaaagtactctgcgttgataccactgctt

SEQ ID NO: 5256 - DNA, 640 bp, Musa acuminata
cttccctcgttgctttttcccagccaagcattcggtcacgtttcgcctcctcacttcctccatcgatccgagagaggagtgcttcaagcgagtacgattgaagccgaggcatatcgctgtctcgatggcgaacagaaatcttcccggacggatcatcaaggaaacccagcggctccttagcgaaccagaacctggcataagtgcattgccgtccgaggacaacatgcgcagcttcagtgtgaagatcctcgggccaaatcagtctccatatgaaggaggggttttcaagcttgagttgtttttgcctgacgaatatccaatggttgccccaaaggtccgtttcctcaccaaaatttatcatcctaacattgacaagcttggaagaatatgccttgacattctgaaggacaagtggactccggccctccaaattcgaacagtactactcagtattcaagcacttcttagtgctccaaacccagatgatcctctttcagaaaatattgctaagcattggaaggcaaatgaagcagaagctctagaaacagcaaaagaatggacgcatgtttatgctagcggtgcataaaaatcattgcagacagccgtaataacatgttcacagggaggttattcatccatt

SEQ ID NO: 5257 - DNA, 422 bp, Raphanus sativus
agtaatcttccacgaaggatcatcaaggaaactcaacgtctgcttagtgaacctgctcccgggataagtgcgtctccctcagaggaaaatatgcgctacttcaatgttatgattcttggtcctacccagtctccttatgaaggaggcgttttcaagttggagctctttttgcctgaagaatatccgatggcagctcccaaggttaggtttctcaccaagatataccatcctaacattgacaagctcggaagcatctgccttgacatactgaaagacaagtggagtcctgccctccaaataagaactgtgctcttgagtattcaagctcttctaagtgcaccaaacccagacgatcccctctctgagaacatagctaagcattggaagagtaatgaagcagaagccgcggagacagctaagga

SEQ ID NO: 5258 - DNA, 672 bp, Cyamopsis tetragonoloba
cgaaatcatgtttgtgatgctaccaaattagaattacggagtgagccagctcctggaactagtgcttccccttcagaagacaatatgcgatatttcaatgtgatgatccttgggccaacccagtctccttatgaaggaggagtcttcaaattagaactattcttgccagaagaatatccaatggctgctccaaaggttcggttcttgacaaaaatatatcatccaaacattgataagcttggcaggatatgtcttgacattctgaaagataagtggagtcctgcccttcaaatacgcactgttcttttgagcattcaagctcttttaagtgcaccaaatccagatgatccactttctgagaacattgccaagcattggaaatctaatgaagccgaggctgtcgaaacagcgaaggaatggaccagattatatgcaactggtgcctgatgataggttttcaaactcttggtcctaaataacagtggtaacagtcaatctcaattagaaacatgaacgaattgatgtctgaactattaatattcctcgcagcttccagttacctgttaatttcctctctaggaagctgcttcttggagcttatatgaatacttgtattgtattgtattgattacaatatctcaatttagaacatgcttcagtctttctttccat

SEQ ID NO: 5259 - DNA, 938 bp, Brassica oleracea
tcttttgattcgtgccatagtgttgattttttgagcttagaaaattgaggttttgatcctgaaaatgtgatgaattgaaatgttggtgcagctccgggtataagtgcatctccatctgaggagaacatgcgttacttcaacgttatggttcttggtccttctcaatcaccttatgaaggaggagttttcaagttggagctctttttgcctgaagaataccctatggctgctcccaaggttaggtttctcaccaagatataccatcctaacattgataagcttggaagaatctgtcttgatattctgaaagacaaatggagccctgctttacaaatacgaactgtgctcttaagtattcaagctcttctgagtgcacccaaccctgatgatcccttgtctgagaacatcgctaagcactggaagagtaatgaggccgaagctgtggagacagctaaggaatggacccgtctttacgcaagcggcgaatgatgcagtcgagggcgaaaagatctcattcatccaaataacattacatttggtgaagtcttatcttttgttggttctttttatcattatgataaaaatgtgtgttatggcacacgaagttgtaatctctctgaatgattgtatcattaactaatagggtcaagactcgttcatccaaataacaatacattcactagttgcattccaaacgaaatagataaaggccattgtattaggacaggagtaaaaaaactaaaatagctttacagttacaaaccaaaacacaaatccatcatcctaatgtaataacaaatatttagaggcaaaaaaagaaactaccataaaaccacaaaccaaaggaatcatctcagcagagcgagcgaaaagccaccaacaaagaacacaattcagatttcatgaaaaatattttatgaagccgaagtgaaccaacc

SEQ ID NO: 5260 - DNA, 473 bp, Pteridium aquilinum
acacttctccctactgaaaaccctcactttctctctcttcgcaaaatctccggtaagcgtaaatcttccccttccatggcgaacagcaatctacctcgaagaattatcaaggaaacgcagcggttactcagcgaaccagctccggggataagcgcgtcgccgtccgaagataatatgcgttattttaatgttatgatccttggtccaacgcagtctccttatgaaggaggagttttcaagctggagttgtttttgccagaagaatatcccatggctgctcctaaggttcggtttcttacgaaaatttaccatccgaacattgacaagcttggtaggatttgtcttgacatcctcaaagacaaatggagccccgctcttcagattcgcactgtactcctgagtattcaagctcttctaagtgctccaaacccagatgatccgctctctgagaacattgcgaagcattggaaatc

SEQ ID NO: 5261 - DNA, 555 bp, Bruguiera gymnorhiza
agaaccctcaccctctttttctcttctcgcgtagcccaattctctctgcccacagagaatcaaacaaaccctactctctctctctctctctctctctctctagcgcgctctgcggttggatagaagagaagaatcgttgtagaaagaatggccaatagcaacttgcctcgaagaatcataaaggacacacagcgtcttctcagcgaaccagcccccggcattagcgcctctccccctgaagacaacatgcgatactttaatgtcatgattcttggtccaacccagtctccttatgaaggcggggtattcaagttggaactgtttctgcctgaagaatatcctatggcccctcctaaggtccgcttcctgactaagatttatcatcctaacattgacaagcttggaaggatatgccttgacattctgaacgacaaatggagcccagctctccaaatccgaaccgttttgctaagcatccaagctctgttgagtgcgccaaaccctgatgatcctctttctgagaacattgcaaagcactggaaagtaaaatgaagc

SEQ ID NO: 5262 - DNA, 672 bp, Festuca arundinacea
gcgcttcgccctcggaggagaacatgcgctacttcaacgtcatgatacttgggccggcgcagtcgccctacgaaggtggagtttttaagctggaactcttttacctgaggaatatccgatggctgccccgaaggttaggtttctgactaaaatataccatcccaacattgacaagcttggtaggatatgccttgacattctcaaggacaaatggagtccagctcttcagattagaacagttcttttgagtatccaggcactcctaagtgcaccaaacccagatgaccctctctctgagaacattgctaagcactggaaatccaacgaggcagaagctgttgaaacagcgaaggagtggactcgtctgtacgccagtggtgcatgataacccaacgctggtgttgatgtaataacccatcatattctagtcggtagttgagtgccatttgcctgataagaacgaactggagatatctgcaatggaaggaagtatctaaatgactactaccgctcgtcgctctatctggttgtacaacgtgttggttccctttaccctggggtgcctttgactgatcaatgtctgtggtagagacctttctgtgctgctccaaatgtatcggttactctatgtagaagaacttaacaagtgtccacattattgaagttgaagtt

SEQ ID NO: 5263 - DNA, 640 bp, Cynodon dactylon
cagcgcctcgccgtcggaggagaacatgcgctacttcaacgtcatgatccttgggccggcgcagtcgccctatgaaggtggagttttcaagcttgaactctttttacctgaggaatatccaatggcagcccccaaggttaggtttctcaccaaaatttaccatcccaacattgacaagcttggtaggatatgcctcgacattcttaaggacaaatggagtccagctcttcagattcgaacagttcttttgagtatccaggctctcttgagtgcacctaatccagatgaccctctctctgataacattgctaaacactggaaagccaatgaggtggaagctgttgaaacagctaaggaatggactcgcctatatgcaagtggcgcgtgacaatcaaccgctgttcttgatgtaataacccgccatacttcagtcctaatctattaccatttgcttgataagaacaaattggagacatttgcaatggaaggaagtctctaaatgactgccactcgaattatttggttgtacactcctatggtcggttccctttaccttgggtaccctgtgactaatcagtggtagaactcgccgctactcaaatatatttattactttatgtaggcgaactttgcaactgtc

SEQ ID NO: 5264 - DNA, 989 bp, Chlamydomonas reinhardtii
ttttgatttgttacagtatacatcgagcatcagcttcgcgcctcctctgagacccggctttttccaagttagcgtcgcttcgtctatataggcgctagagaggaatgaacccggatcaggcagcgcaggcggcgcagctgccgcggagaattatcaaggagactcagaaacttctcagcgagcctgcgcccggcattagcgcttctccctcggaggagaacctgcgctacttcaatgtgatgattctggggcctcagcagtccccctatgagggtggcgtgtttaagctggagcttttcctgccggaggactacccaatggcgccccctaaggttcgcttcctgaccaagatttaccatcccaacatcgacaagctgggccgcatttgcctggacattttgaaagacaagtggtcgccggcgctccagattcgcaccgtgctactgagcatccaagcgttgctctcggcccccaacccggatgacccgctggccgagcacgtggcgaagcactggaaggagaacgagaaggaggccattgcgacagcgcgccaatggactgccatgcacgctcagggctaaatgctttagcgctcacaagggcttggtgcggctcaccgcagccggtcatctggtccgcggggtggcggcagcagccggcggtgttcacatttggtgtcagggctttccttgtggttgcgcagcggcgcattccatagacgttagggtttagaacaactaggcgtgcatttgcaagggtgcttgtgccgttacggctgcgtgcatcgcgcagggacgctccgcgcatgtatgcgctatgcaggtgtcttggtgtgagggttgcaccagatgttcaggcaacggtagagagcaggatgcactttagtcaggagggttagggctcaggggtgcaaggatgttacgtgcattggaccagtctactatgagttttgtaggaagaacaggatgcaaatgtaacaagcgcgtgta

SEQ ID NO: 5265 - DNA, 906 bp, Pseudotsuga menziesii
ataagtgcttctccgtctgaggacaatctacggtattttaatgtgatgattcttggaccatctcaatctccatatgaagggggtgttttcaagctggagttatttctgcctgaagagtatcctatggcagcaccgaaggttcgttttttgacaaagatttaccacccaaacattgataagctcggccgcatttgccttgatattctcaaggacaagtggagtccagcactgcaaattcgaacagttttactgagtatacaagcactgttgagtgcaccaaatccagatgatcctctttctgaaaacattgcaaaacactggaagactaatgaagtcgaggctgtggaaacagcaaaagaatggacaaggctgtatgcaagtggggcctaacattctacatcgattctttcagtgctacttttctaatgtattcacagccagctctttgcaagtgtgttcctattggcgggcaatgaaatgatgaagtttcaagtccagtcgcagatacttgaatatggtcaggaaaactctgattgtgccgaagaatctgtttatttagtgtttgttggggctggggccttttgatatacatatggttttttttccatatatcttatatgttctatggtacatctagtaaggctctgatgcgaattttgaattcttgcctaaacaatgtttccttaacgtgaagttaagaaaatgtcaatataatatgatttcaaaaatgaacaatgctgacttggataaatcgtacatttcaggttgtacctgcaaaggctttaggcttttgaattgcagttgtgtgattgattggaatttcataagaagacgctgttttgagattgtaaaaggcattttctgggctcaaatggggcactgattgtgatttcttcctttaagggc

SEQ ID NO: 5266 - DNA, 753 bp, Curcuma longa
gcaccattccggcatcagtgcgtctccgtcggaggataatatgcgctacttcaatgtgatgatactcgggccgacacaatctccatatgaaggaggagttttcaagcttgagttgtttttgcctgaagaatatcctatggcagccccaaaggtccgctttcttaccaaaatataccaccctaacattgacaagcttggaagaatatgccttgacatcctgaaggataaatggagtccagccctccaaatcagaacagtactactcagcattcaagcacttcttagcgccccaaatccagacgaccctctctccgagaacatcgccaaacattggaagtcgaatgaagcagaagctgtggaaacagcaaaagagtggactcgtctttaaaacacgggcgcataaaaatttgatgcagaccactgcaggcagtaatctatctacccacagcggaagtttattcatccatattaagatgttgacaatgaacaaggtgtcaagaaaatgctgttatatatttatatatatatataattagcaactcttcatgtagttgcaaaatttcaagcttgtatcccctaccgtctctttacttgaaagctttatcacaccagtaacactaatttctcagctcgcacttgtggaaatgccctctgcaatgtttctctttgtttattattattattattattattatatagatctgggtagaccatccatttagcgtgatggacggctacctacatcattgaatt

SEQ ID NO: 5267 - DNA, 1481 bp, Secale cereale
tccttccgatcttacatttcttctgagaaatcagagaggaatcctgcaccggcgagaaagaatcccgagcaaagaaagatggaggccgtggagggcaatggaggagggagcgggctggtggtgacggagctgagccacatcaaggagctggtgaagcagctggacgtgcacctggggggctcgcccgacctctgcaagctcctcgcccagcagatcttcgccgtcaccgagaggtccatcggcatgatcaggtccgcccacttcaagcgctcggccgccggcgccggcctcgactcgccgccgctgtccgcgacccccagccccgtcagcggcgtctccaacacgcctttcaagcccaacaagaagaggaagacgtcggagaaagggaggcgtcagatcagggtgagctcggccgggggaggggcggatggcccggccgacgacggccacagctggaggaagtacggccagaaggacatcctcggagcgcagcacccaagggcatactaccgttgcacgtaccagaagacccagggatgtgcggcaacgaagcaggtgcagcgcgccgacgaggacccggcgctcttcgacgtgatctaccacggcgagcacacctgcgtccataaggcggcggcggccatggtgcagcaggccgggcagaacccaggcgcgcagagccttctgcagagcctgagctcgagcctgacggtgaagaccgaggggctcgcggcggcggcaacgcagggctggagcgccaccacgcccttcagcttctcctcgccggccgtgagcggcatgacgccgccggagcaccacccgttctccacgccgtcgacgccggagaactgcttcatgtcgatgcccacgtccctggagccctcgccggcgacctcaggctcgaaccacatgggcatgaacccgttccaggcccagtctgagctccaaacaatggtgttcgcgctcgcggaggcgacgagcatgccggcggccgacgcggaggaggccgccttctcctactggagcttcggcgatcctgctgccttggacgttaacaacatcgacgatgaccttaacaacttcgacatttctgccttcttcgcatgacatgtttgcatgcaaacaagaaaacagagaggatgagcagtagtagaaattagagaagcagctggaggtgactgaccaccctctgagttctggcatttgcccagggacagaggagggaagaacacacacacaccagttcttcctcagctcaagtttaaaatttaggacataagattagtgcctcctccctcacccccattcttttttccccatttcctttttgccaccagggcgttgcattgtattatattgtcgtgtcaaggaaaataaaaatctgtcattggtgttctgcgcgatcagtaactgtaacatatactcttttcttgcacagacaaaccagcaaaaataataagaacacctcttaactcaaaaaaaaa

SEQ ID NO: 5268 - DNA, 1417 bp, Pseudoroegneria spicata
cgcaaccctgaagcccacacacgtgctctgacctccatcgctgccatggcgcggccaggccactccacggcgtggctccccctcctggtcctgctcttcgcggcgggcgcgacggcgcagagctgcctctccgcgaccttcacctccggccggacgttcctcaagtgcaaccagctgcccgcgctcggcgccagcctccactggacgtaccacgcacagaacggcaccgccgacatcgcgttccgggcgacgtccggcaccgacgggtgggtcgcctggggcatcaaccccaccggcagccgcatggccggtagcaacgtcttcgtcgcctcgcagagcggcggcgccgtgtccgtgctcaccaccgtgctgaggagcacgtcccccgccctggacaacgccaccctgcagttcgacgtgcccgtcccggccagcgccgagtacgccggcggcgcctacaccatatacgccacggtggcgctgccgaacaactccacgtcgcagaacacggtgtggcaggccgggccggcctccggcggcagcatctcgccgcaccccgtgtcggggcagaacctccagtccgtccagaacctcgacttcctctccggcaccagcaccggcggctccaactccaggctgcaccgtcgtaacctccacggagtgctcaacgccgtcggatggggcatcttgatcccgctcggcgccattatcgcgaggtacctccgcgtgttcgaggccgccgacccggcctggttctacctccacatcgcctgccagatctccggctacgtgctgggcgtggccggctggggcctcgggctcaagctgggcagcgagtccaaggggctcacctacagcacccaccgcaacatcggcatcgccatcttctgcctggccacgctccaggtgttcgcgctcttcctcaggcccgacaagaagaacaagtaccgggtgtactggaacgcgtaccaccactccgtcggctactccgtcatcgtcctcgccgccgtcaacatcttcaaggggctcaacatcctcaagccggtgaccgggtggaagacgagctacatcgtcatcctggccacgctcgccggcgtcgcgctcgtcctcgaggccatcacctgggccatcgtcctgcggcgccgcaagcgcaacaaggcccacggcggcgccaacgggaccggcgtgcagctatgagcgtcgggatcggacgtgcagttttgctgctgcgatgtgtttatcgatgtgcctgagcgattccatgtttttatctttcgtcttaccgcttctgtagtagtagatcttttatttcttcttcttttttcgacttctgtggtggccattgtatacattctttcttcgagctgatgtatgattactttcatttatatgcatgtagtgtatgtggtttcgatta

SEQ ID NO: 5269 - DNA, 1476 bp, Secale cereale
cgaacctccaaccacaacccgccggaagcaaaacgtacgtgctctgacctctgtcgctgctgccatggcgcgtccaggccactccacggcgtggctccccctcctggtgctcctcttcgcggcgggcgcggcggcgcagagctgcctctccgcgaccttcacgggggggcgggcgttcctcaagtgcaaccagctgcccgtgctcggcgccagcctccactggacgtaccacgccgggaacggcacggccgacatcgcgttccgggcgccgtccggcgccgacgggtgggtcgcctggggcatcaaccccaccggcggcggcatggccggcagcaacgtcttcgtcgcctcgcagagcggcggcgccgtctccgtgctcaccaccatcctcaggaccacgaaccccaccctggacaacaccgccctctccttcgccgtgcccgtcccggccagcgccgagtacgccggcggcgcctacaccatctacgccaccgtggcgctgccgggcaacaccacgtcgcagaacacggtgtggcaggccgggccggcctccggcggcggcatctcgccgcacccagtatcgggccagaacctccagtccgtccagaacctcgacttcctctccggcaccagcaccggcggctccaactccaggctgcaccgccgtaacctccacggagtgctgaacggcgtgggatggggcgtgctgatcccgctgggcgccatgatcgcgcgctacctccgcgtgttcgaggccgccgacccggcgtggttctacctccacatcgcctgccagatctccggctacgtgctgggcgtcgccggctggggcctcggcctgaagctgggcagcgagtccaagggcctcacctacagcgcccaccgcaacatcggcatcgccatcttctgcctcgccacgctccaggtcttcgcgctcttcctcaggcccgacaagaagaacaagtaccgggtctactggaacgcctaccaccactccgtcggctactccgtcatcgtcctcgccgccgtcaacatcttcaagggcctcaacatcctcaagccggtcaccggctggaagaccagctacatcgtcatcctcgccacgctcgccggcgtcgcgctcctcctcgaggccatcacctgggccatcgtcttgcgccgtcgcaagcgcaacaaggcctacggcggcgccaacgggaccggcgtgcagctatgatcgatcatcgtgcagttttgctgctgcgatgtgtttgagcgattcactccatgtttttatctttcgtcgtacttctcctgtagcagatctttctttttctcctttgctggcccgccattgtatacattctttcttcgagctgatgtatgattactttcatttgtacgcatagtgtatgtatggtttccatttacatatggccccgtcgttgcttcaaaacgtcggcttaaaaaaaaaaaaaaaaaaaaaaaaaaaaaaaa

SEQ ID NO: 5270 - DNA, 1459 bp, Secale cereale
ctccatttcgaacctccaaccagaacccgccggaagcaaaacgtacgtgctctgacctctgtcgctgctgccatggcgcgtccaggccactccacggcgtggctccccctcctggtgctcctcttcgcgaccggcgcggcggcgcagagctgcctctccgcgaccttcacggggggccgggcgttcctcaagtgcaaccagctgcccgtgctcggcgccagcctccactggacgtaccacgccgggaacggcacggccgacatcgccttccgggcgccgtccggcgccgacgggtgggtcgcctggggcatcaaccccaccggcggcggcatggccggtagcaacgtcttcgtcgcctcgcagagcggcggcgccgtctccgtgctcaccaccatcctcaggaccacgaaccccaccctggacaacaccgccctctccttcgccgtgcccgtcccggccagcgccgagtacgccgccggcgcctacaccatctacgccaccgtggcgctgccgggcaacaccacgtcgcagaacacggtgtggcaggccgggccggcctccggcggcggcatctcgccgcaccccgtatcgggccagaacctccagtccgtccagaacctcgacttcctctccggcaccagcaccggcggctccaactccaggctgcaccgccgtaacctccacggagtgctcaacggcgtgggatggggcgtcctgatcccgctgggcgccatgatcgcgcgctacctccgcgtgttcgaggccgccgacccggcctggttctacctccacatcgcctgccagatctccggctacgtgctgggcgtcgccggctggggcctcggcctgaagctgggcagcgagtccaagggcctcacctacagcgcccaccgcaacatcggcatcgccatcttctgcctcgccacgctccaggtcttcgcgctcttcctcaggcccgacaagaagaacaagtaccgggtctactggaacgcctaccaccactccgtcggctactccgtcatcgtcctcgccgccgtcaacatcttcaagggcctcaacatcctcaagccggtcaccggctggaagaccagctacatcgtcatcctcgccacgctcgccggcgtcgcgctcctcctcgaggccatcacctgggccatcgtcttgcgccgtcgcaagcgcaacaaggcctacggcggcgccaacgggaccggcgtgcagctatgatcgatcatcgtgcagttttgatgctgcgatgtgtttgagagtttccatgtttttatctttcgtcgtacttcttctgtagcagatctttctttttctcctttgctggcccgccattgtatacattctttcttcgagctgttgtatgattactttcatttatacgcatagtgtatgttattggtttcgtatttacaacaaaaaaaaacagagtacccgacacgacacgacgaacggg

SEQ ID NO: 5271 - DNA, 1409 bp, Secale cereale
cgaacctccaacgagaacccgccggaagcaaaacatacgtgctctgcggcgtgctctgacctctatcgcggctgccatggcgcgtccaggccactccacggcgtggctccccctcctggtgctcctcttcgcggcgggcgcggcggcgcagagctgcctctccgcgaccttcacggggggccgggcgttcctcaagtgcaaccagctgcccgtgctcggcgccagcctccactggacgtaccacgccgggaacggcacggccgacatcgcgttccgggcgccgtccggcgccgacgggtgggtcgcctggggcatcaaccccaccggcggcggcatggccggcagcaacgtcttcgtcgcctcgcagagcggcggcgccgtctccgtgctcaccaccatcctcaggaccacgaaccccaccctggacaacaccgccctctccttcgccgtgcccgtcccggccagcgccgagtacgccggcggcgcctacaccatctacgccaccgtggcgctgccgggcaacaccacgtcgcagaacacggtgtggcaggccgggccggcctccggcggcggcatctcaccgcaccccgtatcgggccagaacctccagtccgtccagaacctcgacttcctctctggcaccagcaccggcggctccaactccaggctgcaccgccgtaacctccacggagtgctcaacggcgtgggatggggcgtcctgatcccgctgggcgccatgatcgcgcgctacctccgcgtgttcgaggccgccgacccggcctggttctacctccacatcgcctgccagatctccggctacgtgctgggcgtcgccggctggggcctcggcctgaagctgggcagcgagtccaagggcctcacctacagcgcccaccgcaacatcggcatcgccatcttctgcctcgccacgctccaggtcttcgcgctcttcctcaggcccgacaagaagaacaagtatcgcgtctactggaacgcctaccaccactccgtcggctactccgtcatcgtcctcgccgccgtcaacatcttcaagggcctcaacatcctcaagccggtcaccggctggaagaccagctacatcgtcatcctcgccacgctcgccggcgtcgcgctcctcctcgaggccatcacctgggttgttgtcctgcgccgccgcaagcgcaacaaggcctacggcggcgccaacgggaccggcgtgcagctatgatcgatcatcgtgcagttttgatgctgcgatgtgtttgagagtttccatgtttttatctttcgtcgtacttcttctgtagcagatctttctttttctcctttgctggcccgccattgtatacattctttcttcgagctgttgtatgattactttcatttatacgcatagtgtatgtatggtt

SEQ ID NO: 5272 - DNA, 1471 bp, Triticum aestivum
ctccgctccaccacctcctccgcctcccgctctccatttcgcacctccaaccagaacccgccggaagcaaaacatacgtgctctgccgcgtgctctgacctctatcgctgccatggcgcgaccaggccactccacggcgtggctccctctcctggtgctcctcttcgcggcgggcgcgacggcgcagagctgcctctccgcgaccttcactgggggccggacgttcctcaagtgcaaccagctgcccgtgctcggcgccagcctccactggacgtaccacgccgtgaacggcacggccgacatcgccttccgggcgccgtccggcgccgacggctgggtcggctggggcatcaaccccagcggcggcggcatggccggcagcaacgtgttcatcgcctcgcagaccagcggcgccgtgtccgtgctcaccaccatcctcaggaacacgacccccaccctcgacaacaccgccctctccttcgacgtgcccgtcccggccagcgccgagtacgccggcggcgcctacaccatctacgccacggtggcgctgccgggcaacaccacgtcgcagaacacggtgtggcaggccgggccggtctccggcggccgcgtctcacagcactccatatcggggccgaacgtccagtccgtccagagactcgacttcctctccggcaccagcaccggcggctccaactccaggctgcaccgccgtaacctccacggagtgctcaacgccgtcggatggggcatcttgatcccactcggcgccatgatcgcgcgctacctccgcgtgttcgaggcggcagacccggcgtggttctacctccacatcacctgccagatctccggctacgtgctgggcgtcgccggctggggcctgggcctgaagctgggcagcgagtccaagggcctcacctacaccacccaccgcaacatcggcatcgccatcttctgcctggccacactccaggtgttcgcgctcttcctcaggcccgacaagaagaacaagtaccgggtctactggaacgcctaccaccactccgtcggctactccgtcatcgtcctcgccgccgtcaacatcttcaagggcctcaacatcctcaagccggtcacgggctggaagacgagctacatcgtcatcctcgccacgctcgccggcgtcgcgctcgtccttgaggccatcacctgggccatcgtcctgcgccgccgcaagcgcaaccaggcctacggcggcgccaacgggaccggcgtgcagctatgatcgtcgggatcggcgtgcagttttgatgctgcgatatgttgtgtttgagagattccatgtttttatcttactttttctctagtagatctttttcttcttcttcttttccgacttctttgctggcattgtatacattctttcttcgagctgatgtatgattactttcatttgtatgcatagtgtatgtatgtatggtttcgatttaca

SEQ ID NO: 5273 - DNA, 1446 bp, Triticum aestivum
gctccaccacctcctccgcctcccgcgctccatttcgcccctccaacctcctgctctgacctccatcgctgccatggcgcggccaggccactccacggcgtggctccccctcctggtgctcctcttcgcggcgggcgcggcggcgcagagcggctgcctctccgcgaccttcacggggggccggacgttcctcaagtgcaaccagctgcccgtgctcggcgccaacctccactggacgtaccacgccgggaacggcacggccgacatcgccttccgggcgccgtccggcgccgacgggtgggtcggctggggcatcaaccccagcggcagcggcatggccggcagcaacgtgttcgtcgcctcgcagagcggcggcgccgtgtccgtgctcaccaccatcctgaggaccacggcccccaccctcgacaacaccgccctctccttcgacgtgcccgtcccggccagcgccgagtacgccggcggcgcctacaccatctacgccaccgtggcgctgccgggcaacaccacgtcgcagaacacggtgtggcaggccgggcccatctccggcggccgtatctcgccgcaccccgtatcggggcagaacctccagtccgcccagaacctcgacttcctctccggcaccagcaccggcggctccaactccaggctgcaccgccgaaacctccacggagtgctcaacggcgtgggatggggcgtcctgatcccgctgggcgccatgatcgcgcgctacctccgcgtgttcgagtccgccgacccggcgtggttctacctccacatcgcctgccagatctccggctacgcgctgggcgtcgccggctggggcctggggctgaagctgggcagcgagtccaagggcctcacctacagcacccaccgcaacatcggcatcgccatcttctgcctggccacgctccaggtcttcgcgctcttcctcaggccagacaagaagaacaagtaccgggtgtactggaatgcctaccaccactccgtcggctactccgtcatcgtcctcgccgccgtcaacatcttcaagggcctcaacatcctcaagccggtgacgggctggaagacgagctacatcgtcatcctcgccacgctcgccggcgtcgcgctcgtcctcgaggccatcacctgggccatcgtcctccgccggcgcaagcgcaaccaggcccacggcggcgccaacgggaccggcgtgcagctatgagcgtcgggatcggatcggatcggcgtgcagttttgatgctgcgacgtgtttgagcgatgaactccatgtttttatctttcgtattgcttcttctgtagtagatctttctttttcttcttcttcgacttctttggtggccattgtatacattctttcttcgagctgatgtatgattattttcatttatatgcatagtgtatgtatggtttcgatttaca

SEQ ID NO: 5274 - DNA, 1430 bp, Avena sativa
atcttcctccgctccctccaccacctcccacgctccatctcgcgcctccaaccgcagcccggaagcaaagcaagcaacacgcacgtgctctgaccatggcgcggccaggccactccacggcgtggctccccgtcctggtgctgctcttcgcggcgggcgcggcggcgcagagctgcctgtccgcgaccttcacctccggccgcacgttcctcaagtgcaaccagctgcccctgctcggcgccagcctccactggacgtaccacgcccagaacggcaccgccgacatcgccttccgggcgacgtctggcgccgacgggtgggtcgcctggggcatcaaccccaccagcggcggcatgcccggcagcaacgtcttcgtcgcctcgcagagcggcggcgccgtgtccgtgctcaccaccgtcctcaggaccctcacccccgccctggacaacgccaccctccagttcgacgtgcccgtcccggccagcgccgagtacgccggcggcgcctacacgatatacgccaccatcgcgctgccgaacaactccacgtcgcagaacacggtgtggcagcggggccgctcagcggcggggccatattgccgcacccgacgtccggggcgaacatgcagagcgtccagagactcgatttcctctccggcaccagcaccggcggctccaactccaggctgcaccgccgtaacctccacggagtgctgaacgcgtgggatggggcgtctgatccctctgggcgccatgatcgcgcgctacctccgcgtgttcgaggcggcggacccggcctggttctacctccacatcacctgccacatctccggctacgtcctcggcgtcgccggctggggcctcgggctgaagctgggcagcgagtccaaggggctcacctacagcacccaccgcaacatcggcatcgccatcttctgcctggccacgctgcaggtgttcgcgctcttcctcaggcccgacaagaagaacaagtaccgggtgtactggaacgcctaccaccactccgtcggctactccgtcatcgtcctcgccgccgtcaacatcttcaagggcctcaacatcctcaagccggtcaccgggtggaagacgagctacatcgtcatcctcgccacgctcgccggcgtcgcgctcctcctcgaggccatcacctgggtcatcgtcctgcgccggcgcaagaggaacaaggcccacggaggcgccaacggcaccggcgtgcagctatgatcgtcgtcgggatcgatcagatcggcgtgcagttttgctgctgcgatgtgtttatgcgtttgagcgattccatgtttttatcttactttctctctagtagatctttttcttcttctttggtggcattgtatacattctttcttcgagctgatgtatgattactttcatttatatgcatagtatatg

SEQ ID NO: 5275 - DNA, 1222 bp, Triticum aestivum
ccgcctcccgcgctccatttcgcacctccaacctcctgctccgacctccaccgctgctgccatggcgcggccagggcactccacggcgtggctccccctcctggtgctgctcttcgcggcgggcgcggcggcgcagagcggctgcctctccgcgaccttcacggggggccgcacgttcctcaagtgcaaccagctgcccgtgctcggcgccagcctccactggacgtaccacgccgggaacggcacggccgacatcgccttccgggcgccgtccggcgccgacgggtgggtcggctggggcatcaaccccggcagcagcggcatggccggcagcaacgtgttcatcgcctcgcagagcgccggcgccgtctccgtgctcaccaccatcctccggaacacggcccccaccctcgacaacaccgccctctccttcgacgtgcccgtcccggccagcgccgagtacgccggcggcgcctacaccatctacgccaccgtggcgctgccgggcaacgccacgtcgcacaacacggtgtggcaggccgggcccatctccggcggccgcgtctcgcagcactccatatcggggcccaacgtccagtcactccagaggctcgacttcctctccggcaccagcaccggcgcctccaactccaggctgcaccgccgtaacctccacggagtgctcaacggcgtgggatggggcgtgctgatcccgctgggcgccatgatcgcgcgctacctccgcgtgttcgaggcggccgacccggcctggttctacctccacatcgcctgccagatctccggctacgcgctgggcgtcgccggctggggcctgggcctcaagctgggcagcgagtccaagggcctcacctacaccacccaccgcagcatcggcatcgccatcttctgcctcgccacgctccaggtcttcgcgctcttcctccggcccgacaagaagaacaagtaccgcgtctactggaacgcctaccaccactccgtcggctactccgtcatcgtcctcgccgccgtcaacatcttcaagggcctcaacatcctcaagccggtcacgggctggaagacgagctacatcgtcatcctcgccacgctcgccggcgtcgtgctcctcctcgaggccatcacctgggccgtcgtcctgcgccgccgcaagcgcaaccaggcctacggcggcgccaacgggaccggcgtgcagctatgatcgtcg

SEQ ID NO: 5276 - DNA, 1173 bp, Avena sativa
atcttcctccgctccctccaccacctcccacgctccatctcgcgcctccaaccgcagcccggaagcaaagcaagcaacacgcacgtgctctgaccatggcgcggccaggccactccacggcgtggctccccgtcctggtgctgctcttcgcggcgggcgcggcggcgcagagctgcctgtccgcgaccttcacctccggccgcacgttcctcaagtgcaaccagctgcccctgctcggcgccagcctccactggacgtaccacgcccagaacggcaccgccgacatcgccttccgggcgacgtctggcgccgacgggtgggtcgcctggggcatcaaccccaccagcggcggcatgcccggcagcaacgtcttcgtcgcctcgcagagcggcggcgccgtgtccgtgctcaccaccgtcctcaggaccctcacccccgccctggacaacgccaccctccagttcgacgtgcccgtcccggccagcgccgagtacgccggcggcgcctacacgatatacgccaccatcgcgctgccgaacaactccacgtcgcagaacacggtgtggcagcggggccgctcagcggcggggccatattgccgcacccgacgtccggggcgaacatgcagagcgtccagagactcgatttcctctccggcaccagcaccggcggctccaactccaggctgcaccgccgtaacctccacggagtgctgaacgcgtgggatggggcgtctgatccctctgggcgccatgatcgcgcgctacctccgcgtgttcgaggcggcggacccggcctggttctacctccacatcacctgccacatctccggctacgtcctcggcgtcgccggctggggcctcgggctgaagctgggcagcgagtccaaggggctcacctacagcacccaccgcaacatcggcatcgccatcttctgcctggccacactccaggtgttcgcgctcttcctcaggcccgacaagaagaacaagtaccgggtgtactggaacgcctaccaccactccgtcggctactccgtcatcgtcctcgccgccgtcaacatcttcaagggcctcaacatcctcaagccggtcacgggctggaagacgagctacatcgtcatcctcgccacgctcgccggcgtcgcgctcgtccttgaggccatcacctggg

SEQ ID NO: 5277 - DNA, 1261 bp, Secale cereale
tctggcctctccgcgaaccttcaacggggggggccggcgttcctcaagtgcaaccggctgcccgtgctcggcgccagcctccactggacgtaccacgccgggaacggcacggccgaaacaatacgacgttaccgggcaccggtccggcgccgacggggtgggtcgccgtgggggccaagtccgaaacccccgaccgggcggcggcagtggccggcagcaacgtcttcgcgcctcgccagagcggcggcgccgtctccgtgctcaccaccatcctcaggaccacgaaccccaccctggacaacaccgccctctccttcgccgtgcccgtcccggccagcgccgagtacgccgccggcgcctacaccatctacgccaccgtggcgctgccgggcaacaccacgtcgcagaacacggtgtggcaggccgggccggcctccggcggcggcatctcaccgcaccccgtatcgggccagaacctccagtccgtccagaacctcgacttcctctctggcaccagcaccggcggctccaactccaggctgcaccgccgtaacctccacggagtgctcaacggcgtgggatggggcgtcctgatcccgctgggcgccatgatcgcgcgctacctccgcgtgttcgaggccgccgacccggcctggttctacctccacatcgcctgccagatctccggctacgtgctgggcgtcgccggctggggcctcggcctgaagctgggcagcgagtccaagggcctcacctacagcgcccaccgcaacatcggcatcgccatcttctgcctcgccacgctccaggtcttcgcgctcttcctcaggcccgacaagaagaacaagtaccgggtctactggaacgcctaccaccactccgtcggctactccgtcatcgtcctcgccgccgtcaacatcttcaagggcctcaacatcctcaagccggtcaccgggtggaagaccagctacatcgtcatcctcgccacgctcgccggcgtcgcgctcctcctcgaggccatcacctgggccatcgtcttgcgccgccgcaagcgcaacaaggcctacggcggcgccaacgggaccggcgtgcagctatgatcgatcatcgtgcagttttgctgctgcgatgtgtttgagagattccatgtttttatctttcgtcctacttcttctgtagcagatctttcctttcctcctttgctggcccgccaccattgtatacattctttcttcgagctcatgtatgattactttcattt

SEQ ID NO: 5278 - DNA, 1592 bp, Triticum aestivum
tcccatcaccatatcatacactcatcactcatacacatacatgggctgagtacatgatcagtcgacttcgactcgatcgaccagtttgctagcgggtgatcgatatggggaaggtggtcgtcgcggaggccacggcgcggcaggtggcgtccttcgtcctcggcgccgccgcggcgctcaccgtcgtcatgctcgtccagtaccgggcgccggccgccgggctcagccgcgccaggacgccgggccacttctccggcttgaagttatcatccgacgaacagcaccaccgccgtaacgggacggcagcagcgcgcgccgttgtgcatcatcgggcgccaccggtcgccggcagtgctgcccgagacgacgatcgtcgccgtccggcgaacgccacaacagtcacaaagcccaattctacctccacaagtcatcttcccagcacgcatcgccatgaagaaaagggagggaaggaggagtcggcggagttccgggggctggcggcggcggtggcacgcgcggcgatggacgaccggacggtgatcatcacgtgcgtgaaccaggcgtgggcggcgccgggctccctgctggacctgttcctggagagcttccgcatcggcgacggcacggcgcggctcctcccacacgtgctcgtcgtggccatggaccctggcgcccacgcgcggtgccttgccgtgcaccggcactgctaccactacaccatcccggggctcaacatcgacttcgccgcccacaagtacttcctctccaaggactacctggagctggtgtggagcaagctgaagctgcagcgccgcatcctggagcttggctacggcttcctcttcaccgacgtcgacatcgtgtggctgcgcgacccgttcaagcacgtgacggcgtacgccgacatgacggtctccagcgacgtctacttcggcgaccccgacaacctgggcaacttccccaacacggggttcttccacgtgaagcccaacgcgcggaccatcgccatgacgaagctgtggcacggcggtagggacaagtaccccggcgccaacgagcagccggtgttcaacatgatgaagaagcagatggtggcggagctcgggctccgggtgcagtacctcaacccggcctacgtcggcgggttctgcagctacgggaaggatttggggaagatcgtcaccatgcacgcgaattgctgcgtggggattgggaacaagattagggatttgaagggcgtgctgggtgattggaggaactataccaggatgccgccctgggagaggcaccgggccaagtggaccgtgcccggcgcctgcatccgagccgagaaacaagtttgatccatcaattttggttgatggattttgcagtcgtctgttgcttatagagtagtttaattctacatatatactccctgtggggatggagagatagactatagagtatttgtttgatatacctgtaaaatgctctacaatgaaaacatatactgtatctacttatttcctggtttttcctgttttaccactttcattcttatgtttacatataaatatgtctgaaccaatacaccaaatttctaattgaat

SEQ ID NO: 5279 - DNA, 1650 bp, Triticum aestivum
ttacggtgctagctagcggctaccgcgctcgtcgccgtcggtttcgcaataccaaaggaccggcgggatggccggagccgcctatttaagtgcccgcagcaactcacacactccatttagcccctccctccgtgctggctaatcgcatcacaatatcatatactcgttcatcactcatcactcatacacatacatgggctgagtacatactcgatcagttagcttgctggcgatcgatatggggaaggtggtcgtcgcggaggccacggcgcggcaggtggcgtccttcgtcctcggcgccgccgccgcgctcaccgtcgtcatgctcgtccagtaccgggcgccggccgccgggctcagccgcgccaggacgccggcccacttctccggcttgagattatcatccgacgaccagcaccaccgccgcaacgccacaacaacagcgcgtcccgttgttcatcatcaggcgccaccggtcgccggcagtgctgcccgagacgacgatcgtcgccgtccggcgaacgccacaacaatcacaaagcccaattctaccaccacaagtcatcttcccagcacgcgtcggcatgaagaaaagggagggaaggaggagtcggcggagttccgggggctggcggcggcggtggcacgcgcggcaacggacgaccggacggtgatcatcacgtgcgtgaaccaggcctgggcggcacaaggctccttactggacctgttcctggagagcttccgcatcggcgacggcacggcgcgcctcctcccacacgtgctggtcgtggccatggatcccggcgcccatgcacggtgcctcgccgtgcaccagcactgctaccactacaccatcccgggcctcaacatcgacttcgccgcgcacaagtacttcctctccaaggactacctggagctggtgtggagcaagctgaagctgcagcgccgcatcctggagctcggctacggcttcctcttcaccgacgtcgacatcgtgtggctgcgcgacccgttcaagcacgtgacggcgtacgccgacatgacggtgtccagcgacgtgtacttcggcgaccccgacaacctgggcaacttccccaacacgggcttcttccacgtgaagcccaacgcgcggaccatcgccatgacgaagctgtggcacggtggtaggggcaagtacccgggcgccaacgagcagccggtgttcaacatgatgaagaagcagatggtggcggagctcgggctccgggtgcagtacctgaacccggcctacgtgggcgggttctgcagctacggtaaggatttggggaagatcgttaccatgcacgcgaactgctgtgtggggattgataacaaaattagagatttgaagggtgttcttgatgactggaagaactataccaggttgccgcattgggagaagcaccgggccaagtggaccgtgcccggcgcctgcatccgcgctgagaaacaagcttgatccatcaattagtcagtcgatttcctggtcatattctacttacagtgtactcccttttcaaatatagtagttgtagtttaattcactccacaccggcgtgaggagatagacgatcgagtacttgttatatacctgtaaaagaaaatacaatgtatatttatttaatatgttag

SEQ ID NO: 5280 - DNA, 1992 bp, Triticum aestivum
ggcgacccgcgccccctccccgccccaccccacacgtctccggcggcgagggcacccggccgtctccggttttctggggccgctcgtggctggcgccgggatggagccggtcggggcgcgccggtcgcccggatctcgccgtcggggcgtcgtctccctcaggggcagcctttgaacctctgaacttttgtgtccttgggtctgcggtgataagtcagagaaaacaatggaagatttacaagattgcaactccaaaagccttgttgctgttcctggttctctggttctgcacctcttcaggctgttaggtcagcaggataattcctggcagaagtacgccttggcttactttctcttggtcaggaatgagtacttcccgagggagccaaggaaaagctctgctgtgaatgggcaacttgttccctgctgtgatagttcagatttgggcagtaatgaactggaagtggagaagcagaatgctgttgtcaagagccaatcaggaggtgattccagttccaatggatcaaatgattgtttccttccaggccttcatgatgatctggctcaagactgccttgcctggacaagcagatcagactatccctcactctcttgtctgaacaagaaattcaatacattggttaacggtggatatctgtacaagctgcggaggaaatatggcattgttgagcattgggtgtatctggcctgtagcgctatgccctgggaagcattcgatccgtcgcgaaaccgatggatgaggctcccaagaatgccatgtgatgactgcttctcctgtgcagacaaggagtcacttgctgttgggacacagctgcttgtctttggccgagaatatacaggccttgctatttggatgtacaatttactgacacgccattggtctcgctgcactccgatgaattttcctcgctgtctgtttgcctcaggaagttctggtgagattgccattgttgctggtgggtgtgataggaacgggcaggtgctgagatctgtggagctgtacaattcagaggctggccagtgggagaccttgccagacatgaacttgcccaggagactctcctcaggtttcttcatggatggcaagttctatgtcatcgggggtgtgacaagtgagaggcattctctgacttgtggagaggaattcgatctcgacaccaggacatggagaagaatacatgatatgtaccccggaggaaccagcgcctcccagtcgcctccgctcatcgccgttgtaaataaccagctctacgcggctgaccagtccacaaacgtggtgaagaagtacgacaaggcaagcaacacatggaacatagtgaagcccttgcccgtcagagcggactcttccaacggctggggcctggctttcaagggatgcggcgatagactgctggtcatcggcggccacagaggacctcgcggcgaggtgatactgctgcattcctggtgccccgaagatgggaacggcgccgcctccgactccgactgggaggtgctctcggtgaaggagcgcgccggcgtcttcgtctacaactgtgcaataatggggtgctgagttagcagcaccttggcttcagtacatgccgccacttgtttagcaaaacccaccgattcgttgctgccattttagctgctgccacttcttataatgacttgtaattcagaaatgacacccccttttcgcggagctgtcgattaaaatgtcgggtcgagagcatagagagcattcagttcagtttacctggaacttctcttttaacactcttcattcaaaagtccttattcttgttgtctggcatgaatcttttttccacgcagtattctttgttcatcatccttgctgaacgaacacttgttattctgctgggccgagccgaatcgcatctttcagttgcatatattgtctgtatcccatacgtatagatcagtagattctgctctactaaagagtatgtgtgtgtgtatctattg

SEQ ID NO: 5281 - DNA, 1698 bp, Secale cereale
gccggtcgcccggatctcgccgtcggggcgtcgtctccctgaggtgcagcctttgaacttttgtgcccttgggtttgcgcaataagtcagagaaaacaatgggagatttacaagattgcaactccaaaggccttgttgctgttcctggttctctcgttctgcacctcttcaggctgttaggtcagcaacagcaggataattcctggcagaagtacgccttggcttacttccttttggtcaggaatgagtacttcccgagggagccaaggaaacactccgctgtgaatgggcaacttgttcactgctgtgatagttcagatttgggcagtaatgaactggaagtggagaagcagaatgctgttgtcaagagccaatcaggaggtgactctagttccaatggatcaaatgattgtttccttccaggtcttcatgatgatctggctcaagactgccttgcctggacaagcagatcagactacccctcactctcttgtctgaacaagaaattcaatacgttggttaacggtggatatctgtacaagctgcggaggaaatatggcattgttgagcattgggtgtatctggcctgtagtgctatgccctgggaagcattcgatccgtcgcggaaccgatggatgcggctcccaagaatgccttgtgatgactgcttctcctgtgcagacaaggagtcacttgctgttgggacacagctgcttgtctttggccgagaatatacaggccttgctatttggatgtacaatttactgacacaccgttggtctcggagcactccgatgaatcttcctcgctgcctgtttgcctcaggaagctctggtgagattgccattgttgctggtgggtgtgatagggatgggcaggtgctgagatccgtggagctgtacaattcagaggctggccagtgggagaccttgccagacatgaacttgcccaggagactctcctcaggtttcttcatggacggcaagttctatgtcattgggggtgtgacaagtgagaggcattctctgacttgtggagaggaatacgatctcgacaccaggacatggagaagaatacataatatgtaccccggaggaaccagcgcctcccagtcgcctcctctcatcgccgttgtaaataaccagctctacgcggctgaccagtccacaaacgtggtgaagaagtacgacaaagcaagcaacacatggaacatagtgaagcctctgcctgtcagagcagactcttccaacggctggggcctggctttcaaaggatgcggcgatagattgctggtcatcggcggccacagagggcctcgcggcgaggtgatactgctgcattcctggtgccccgaagatgggaacggcgccgcctccgactgggaggtgctctcggtgaaggagcgcgccggcgtcttcgtctacaactgtgcaataatggggtgctgagttcagtaccttggcttgagtatatgccaccacttgtttagcaaaaccaccgattcgttgctgccattttagctgccacttcttataatgacttgtaattcagaaatgacacccccattttcatggagctgtcgattaaaatgtcgggtcgagagcattcagttcagtttacctggaacttccatcttaacactcctcaaaagtcccttgttcttgttttctagcatgaattttttttcacgcaaaaaaa

SEQ ID NO: 5282 - DNA, 1911 bp, Festuca arundinacea
ggcacgaggaccggccgcgctcctcgtcgtcggcgacccgcccagccccgcttctccggccaagtcaaccggccgtctcgggtttctgggagccgctggtgtctgggcgccgggatggggccggtcggcgcgcgccggtggcctggatctcgccgtcggggcgtctccgtcagggttactctctgaaccatcgaacttttttgtcctctgtttggttgacctgttagagcaaacaatggaggatttacaagattgcaactccaaaagccttgttgctgttcctggatctctggttctgcacctctttaggctgttcagtcagcaggataattcctggcagaagtacgccttggcttactttcttttggtcaggaatgagtatttctcaagagagccaaggaaacattcagctgggaatgtgcaaccggttcgctgctgtgatagttcagttctaggcagtaaagaactggaactgaaggagcagactgctgctgttaagacccaatcaggaggtggttctagtgccaatggatcaaatgattgtctccttcctggccttcatgatgacctggctcaagactgccttgcttggacaagcagatcagactacccttcactctccggtctgaacaagaaattcaatatgctgattaacagtggatacctgtacaaactgcggaggcaatacggcattgttgagcattgggtatatctggcctgtagcttgatgccctgggaagcatttgatccatcacggaatcgatggatgaagctccctaggctgccatgtgatgagtgcttctcctgtgcagacaaggaatcacttgctgttgggacacagctgcttgtctttggccgagaatatgcaggtcttgctatttggatgtacaatctagtgacacgtcgttggtctcgtaacactccgatgaatcttccccgctgtctctttgcctcgggaagctctggtgagattgccattgttgctggtgggtgtgataggaacggccaggtgctgagatctgccgagctgtacaattcggaggctggccactgggagactttaccagacatgcacttagccaggagactctcatcaggtttcttcatggatgggaagttttatgtcattggaggtgtgacaagtgagagggtttctctgacctgtggagaggaatacgatcttggcacaaggacatggagaaggatacatgatatgtaccctggaggaaccagtgcatctcagtcaccccctcttattgccattgtaaataaccagctctatgcggctgaccagtcgacaaacgtcgttaagaagtacgacaaagcaaataacacatggaacatagtgaagcctttgcccgtcagagcggactcttccaatggctggggcctagctttcagggcgtgcggtgatagattgctggtcattggtggccatagaggacctcgtggtgaagtcataatgctgcattcttggtgccctgaagatgggaacggcggcggtgctgactgggaggtgctgtcggtgaaggagcgtgccggcgttttcgtccacaactgtgcaataatggggtgctgatgaatttacgttggctgcttcagtacatgcccgcttgtttagcaaaaccagcaaattccttgctgcccatttagctaccattataatgacttgtaattcagaaatgacaccccccttttcgtggagctgtcgattaaatgtctggtcgagagcatagagagcattcagttcagtttatctggaacttcctttttattaacactttttcaaagttcgttgttcttgtttagcacgaagtttatgctgtattcctttattcatcatccttgctgaagagttgttattctcgcagctgcatctaacgtgtttgttgtcccaaaaaaaaaaaaaaa

SEQ ID NO: 5283 - DNA, 1667 bp, Avena sativa
ccgctcgtgcctggcgccgggatggaggcggtcggcgcgcgccggtggcctggatctcgccgtcggggcgtctgcgggaggggtaacctctgaacctgcaaacttttctgtcctcgggtttgcctgaccagataaaagaaaacaatggaagatttacaagattgcaactccaaaagccttgttgctgttcctggctctctggctctgcacctgtttaggctgttgggtcagcaggataactcctggcacaagtatgccttagcttactttcttttggtcaggaatgagtacttctcgagggagccgaggaaacattcatctgggaatgtgcaacaggttctctgctgtgatagttcagttttgggcagtaaagaagtggaactgaaggagcagaatgctgttgttaagacccaatcagggggtggttctagttccaatggatcaaatgattgtctccttccgggccttcatgatgacctggcgcaagactgccttgcttggacaagcagatcagactacccttcactctccggtctgaacaagaaatttaatatgttgattaacagtggctatctgtacaaactgcggaggcaatacggcattgttgagcattgggtatatctggcatgtagcttgatgccctgggaagcattcgatccatcacgcaaaagatggatgaagctccctagactgccatgtgatgagtgcttctcctgtgcagacaaggaatcacttgccgttgggacacagctgcttgtctttggccgagaatatgcaggtcttgctatttggatgttcaatttagtgacacgtcgttggtctggttgcactccgatgaattttccccgctgtctctttggctcgggaagctctggtgagattgccatcgttgctggtgggtgtgacaggaacggccaggtgctgagatctgccgagctgtacaactcagaggctggccactgggagactttaccagagatgaacttgccgaggagactctcatcgggtttcttcatggatgggaagttttatgtcattgggggtgtgacaagtgatagggtttctctgacttgtggagaggaatacgatcttggcacaaggacatggagaaggatacatgatatgtaccctggaggaaccagtgcctctcagtcacctcctcttatcgctgttgtaaataaccagctctatgcggctgaccagtcaacaaacgtcgttaagaagtacgacaaaacaaataacacatggaatgtagtgaaggctttgcctgtcagagcagactcttccaatggctggggcctagctttcagggcctgtggtgatagattgctggtcattggtggccatagaggacctcgtggtgaagtaatactgctgcattcttggtgccccgaagatgggaatggcggcgccgctgactgggaggttctgtcggtgaaggagcgtgccggtgttttcgttcacaactgtgcaataatggggtgctgatgaattaccttcgctgcttcagtatatgctgcttgtttagcaccaaattccttgctgcccatttagctaccatttataatgacttgtaattcagagatgacacccccttttcgtggagctgtcgattaaatgtctcgtcgagagcatagagagcattcagttcagtttatctggaactt

SEQ ID NO: 5284 - DNA, 1975 bp, Oryza sativa
gctctccatgccctccccgtctcactgacggtggtccccaccgccccacgctccccccccgtgggccccgttcgtcggcgaccgaccgctagctccggcgaccccctccccgccgacgagatccggccgtctccggttttcttggagccgctcgtcgtggctggggtggcgccggggggaatggaggcggccggcgctcgcgcgggcggtggcggccgggatctcgccggcggcgcgcctcggtgagatgtgatctgtgatctgtccaacctttgtgtactcgggctcattccacagttaacaaaaaagatggaagatttacaagattgtgactgcaaaagccttgttgctgttcctggttctgtggttctgcacctctttaggctgtttaatcagcaggataattcctggcagaagtacacattagcctactttcttttggtcaggaatgagtacttctctagggattcaaggaagcattcagatgggaagaaccaacttcttgactgctgtgatgattcagaattagatttggatgtgctgtatgctgatttggatagtaaagaactggagcttaagttgcagaaacctgttgtcaagactcaatcaaaaggtgactcaagtgccagtggatcaaatgattgcttctttcctggccttcacgacgacctggctcaggactgccttgcttgggcgagcagatcagactacccatcgctttcttgtttgaataagaagttcaatttgttaatcaacagcgggtatctgtacagactcagaagaaaatatggcattgttgaacactgggtgtatctagcgtgtagcttgatgccctgggaagcatttgatccttcacgcaagcgatggatgaggctcccaagaatgccatgcgacgagtgcttctcttgtgcagacaaggaatcgcttgccgtcgggacacaactgcttgtgtttggccgtgaatatacaggtcttgctatttggatgtacaatttactggcccgtggttggtcccgatgcactccaatgaacctgcctcgctgcctctttgcctcaggaagctttggtgagattgctattgttgctggtgggtgtgataagaatggacaggtgctgaaatctgccgagctgtacaattcagagactggtcattgggagactttgccagacatgaacttgccgaggaggctctcatccggtttcttcatggatggaaagttttatgtcattgggggtgtgtcaagtcagagggattctttgacttgtggagaggaatacaatcttgaaacaaggacatggagaagaatacatgatatgtaccctggagggactagtgcctctcaatctcctcccctagttgctgttgtgaataatcagctttatgcagctgatcaggcaacaaatgtggtaaagaagtacgacaaaggaaataacacctggaacatagtgaagccattgccagtcagagctgactcttccaatggttggggcctagctttcaaggcatgtggtgatagattgcttgttattggtggccatagagtaccccgtggtgaagtaatattgctgcattcttggtgccctgaagatgggaatggtggtgctgactgggaagtgctctcggtgaaggagcgtgctggtgtattcgtttataactgcgcaataatggggtgctgaattacatttctttcggtataatccgtatatgcctcttgtttagcaacccacccatttcttgctgctgcttagctaccccctataatgacctgtaattcagaaaaatgacaccccccttttcgtggagctctcaatgaaatgtttgggagagagcatagagcattcagttcagtttacctggaacttcttttaactcgttcaaaatttgttcttcttgtccagtatgaaatttatgcagtattctttattcatcatccttgctggaaagtgtgcctgttttattgtcctgagttcaatc

SEQ ID NO: 5285 - DNA, 2347 bp, Brachypodium distachyon
gccctttccccaagcccacccttcttcctcctctccaaatctcgctccccatgccctccccgtcccactgacggtggtccccaccgccccgacctcgcctcccttccccggccggcgaccctacggccaagagacccggcaccccgtcgtctccggttcctgggaggccctcgtgcctggatggaggcggtcgccgcgcgccgctggcccggatctcgccgtcggggcgtccccgtcaggtgaggagtcggctccggttctcatgttaccttccctccctgtgcttgcgttgggaaggggggaagcgatccttttcccccttctccttttttttttctgtgcgagggggctttaccaaactctatgactcgtcagtcaggtgacattataccggaaattttttagttccgttttgtgggcggcgacagtgattgctgaattggttggggatatgtctttgtcaactttcctgttagtgacgtgagatggttcggggcggtttctggagcattttttatttatggtttcaacagccacaccggatgtgtgttctcttttgcttgtgcattaatggtttgcggtgagaatagagaggggtggtctctgaaccttcaaacttttgtgtcctcggttttttgtgtcaagtcagagaaaacaatggaagatttacaagattgcaactccaaaagccttgttgctgttcctggttctctggttctgcacctctttaggcagtttggtcagcaggataattcctggcataagtacaccttagcttactttcttttggtcaggaatgagtacttctcaagggagccaaggaaacactcaactgtgagtgggcaacatgttgactgctgtgatagttcaaaattagatctggccagtaaagcactgccactgaaggagcagaatgctgttgtgaagactcaatctggaggtgattccagttccaatggatcaaatgatggtttccttccaggccttcatgatgacatggctcaagactgccttgcttggacaagcagatcagactacccctcactctcttgtctgaacaagaaattcaatatgttgattaacggtggatatctgtacaaactgcggaggaagtatggcattgttgagcattgggtatatcttgcttgcagcttgatgccatgggaagcatttgatccttcgagaaatcgttggatgaggctcccaagaatgccatgcgatgactgcttctcctgtgcagacaaggaatcacttgcagttgggacacagctgcttgtctttggccgagaatatactggccttgctatttggatgtacaatttactgacacgtcattggtctaggtgcactccaatgaatcttcctcgctgtctctttgcctctggaagctctggggagattgccattgttgctggtgggtgtgatagtaccggtcaggtgctgatatctgctgagctgtacaattcagaggctgggcattgggagactttaccagacatgaacttacctagaagactttcatcaggtttcttcatggatggcatgttttatgtcattgggggggtgtcaagtgagaggaattctctgacttgtggagaggaatacaatcttcagacaaggacatggagaaggatacctgatatgtaccctggaggaaccagtgcctcgcaatcacctcctcttattgctgttgtgaataaccagctctatgcggctgaccagtccacaaacgtggttaagaagtacgacaaggaaaataacatttggaacatagtgaagccattgcctgtcagagctgactcttccaatggctggggcctagctttcagggcatgtggtgatagattgctggtcattggtggtcatagagtaccccgtggcgaggtaatactgctgcattcttggtgccccgaaggcgggaacggcggtgctgactgggaggtgctctcaatgaaggagcgcgccggcgtgttcgtttacaactgtgcaataatggggtgctgaattgcctttgcttcagtatatgccgcttgtgtagcaaaaccaccgatttgtagctgccgtctcgctaccctttataatgacttgtaattcagaaatgacaccccctctcctttcgtggagctctcgattaaatctttggacgagagcatagagcattcagttcagattacctggaacttcgtttttaacactcttctaaattcgttgttcagtatgaagtctatgcaatattctttattcaccatctatgatgaagagttgttagtctattgtacccgagcattatcccatctcgccattggattccctcaactgttttgaaagatcaattacattttacata

SEQ ID NO: 5286 - DNA, 2355 bp, Brachypodium distachyon
acgccctttccccaagcccacccttcttcctcctctccaaatctcgctccccatgccctccccgtcccactgacggtggtccccaccgccccgacctcgcctcccttccccggccggcgaccctacggccaagagacccggcaccccgtcgtctccggttcctgggaggccctcgtgcctggatggaggcggtcgccgcgcgccgctggcccggatctcgccgtcggggcgtccccgtcaggtgaggagtcggctccggttctcatgttaccttccctccctgtgcttgcgttgggaaggggggaagcgatccttttcccccttctccttttttttttctgtgcgagggggctttaccaaactctatgactcgtcagtcaggtgacattataccggaaattttttagttccgttttgtgggcggcgacagtgattgctgaattggttggggatatgtctttgtcaactttcctgttagtgacgtgagatggttcggggcggtttctggagcattttttatttatggtttcaacagccacaccggatgtgtgttctcttttgcttgtgcattaatggtttgcggtgagaatagagaggggtggtctctgaaccttcaaacttttgtgtcctcggttttttgtgtcaagtcagagaaaacaatggaagatttacaagattgcaactccaaaagccttgttgctgttcctggttctctggttctgcacctctttaggcagtttggtcagcaggataattcctggcataagtacaccttagcttactttcttttggtcaggaatgagtacttctcaagggagccaaggaaacactcaactgtgagtgggcaacatgttgactgctgtgatagttcaaaattagatctggccagtaaagcactgccactgaaggagcagaatgctgttgtgaagactcaatctggaggtgattccagttccaatggatcaaatgatggtttccttccaggccttcatgatgacatggctcaagactgccttgcttggacaagcagatcagactacccctcactctcttgtctgaacaagaaattcaatatgttgattaacggtggatatctgtacaaactgcggaggaagtatggcattgttgagcattgggtatatcttgcttgcagcttgatgccatgggaagcatttgatccttcgagaaatcgttggatgaggctcccaagaatgccatgcgatgactgcttctcctgtgcagacaaggaatcacttgcagttgggacacagctgcttgtctttggccgagaatatactggccttgctatttggatgtacaatttactgacacgtcattggtctaggtgcactccaatgaatcttcctcgctgtctctttgcctctggaagctctggggagattgccattgttgctggtgggtgtgatagtaccggtcaggtgctgatatctgctgagctgtacaattcagaggctgggcattgggagactttaccagacatgaacttacctagaagactttcatcaggtttcttcatggatggcatgttttatgtcattgggggggtgtcaagtgagaggaattctctgacttgtggagaggaatacaatcttcagacaaggacatggagaaggatacctgatatgtaccctggaggaaccagtgcctcgcaatcacctcctcttattgctgttgtgaataaccagctctatgcggctgaccagtccacaaacgtggttaagaagtacgacaaggaaaataatatttggaacatagtgaagccattgcctgtcagagctgactcttccaatggctggggcctagctttcagggcatgtggtgatagattgctggtcattggtggtcatagagtaccccgtggcgaggtaatactgctgcattcttggtgccccgaaggcgggaacggcggtgctgactgggaggtgctctcaatgaaggagcgcgccggcgtgttcgtttacaactgtgcaataatggggtgctgaattgcctttgcttcagtatatgccgcttgtgtagcaaaaccaccgatttgtagctgccgtctcgctaccctttataatgacttgtaattcagaaatgacaccccctctcctttcgtggagctctcgattaaatctttggacgagagcatagagcattcagttcagattacctggaacttcgtttttaacactcttctaaattcgttgttcagtatgaagtctatgcaatattctttattcaccatctatgatgaagagttgttagtctattgtacccgagcattatcccatctcgccattggattccctcaactgttttgaaagatcaattacattttacatattcctg

SEQ ID NO: 5287 - DNA, 1697 bp, Echinochloa colona
gcgagctgggcgccgggatggaggcggccggcgcgcgccggtggcccggatctcgccggcggcgcgtctcggcgaggtgagaggcatcctgtgaactttgcgatttaggtgccctcgattttgagtcatagatcagagaaagaatggaagacatacaagattgcaactcgaaaagcctggttgcccttccaggctctctggttctgcatctctttaggctgtttggtcagcaggatcagagttcatggcagaagtacatactagcttactttctgttggtcaggaatgaatacttctctggggagtcgaagagacactcggatgtgttctgtgatatttcagaattagatgtctttccatatgctacagatctggacagtgaagaacttgaactgaatgagcaggaacctgtggtgaaggctcagtcaggaggtgattcaagtggcagcagatcaaatgattgctactttccaggccttcatgatgacctgtctcaagactgccttgcttggtcaagcagatcagactacccttccctttcttgtctgaacaaaagattcaatttgttaattaacagtggatatctgtacaaactgcgaaggaaatatggcattgttgagcattgggtatatcttgcttgtagcttgatgccctgggaagcatttgatccctcgcgaaagcggtggatgaggctcccgagaatgccatgcgacgagtgcttctcctgtgcagacaaggaatcacttgccgtcgggacacagctgcttgtttttggccgtgagtatactggccttgctatttggatgtacaacttactgactcgcagttggtcccgatgcactccaatgaatctgccccgctgtctttttgcctcgggaagctcaggtgagattgctatcgttgctggtggatgtgataagaatggacaggtgctgagatctgccgagttgtacaactcagagattggccactgggagactatcccagacatgaacttggcaaggaggctctcttcaggtttcttcatggatggcaagttctacgtcattgggggtgtatcgagtcagagagattcattaacttgtggagaggagtataaccttgaaacaaggacctggagaagaatacttgatatgtaccctggtggaaccagtgcttctcaatcacctcctcttgttgctgttgtgaataaccagctctatgccgctgaccagtcaacaaatgtggtcaagaagtatgacaaggcaaataacacctggaacatactgaagccattgcctgttagagctgactcatccaatggttggggcctggctttcaaggcttgcggcgacagattgctggtaatcggcggccacagagggcctcgtggtgaggtaatattgctgcattcctggtgccccgaaggtggggaagatggtgctgactgggaggtgctctcggtgaaggagcgggcgggcgtcttcgtttacaactgtgcaataatggggtgctgagttaccttccgcttcagtacatgctgctggtttagcaagccaaccatttcttgctgcctttagctaccctttataatgacttgtaattcagaaatgacacaccccttttcgcggagctctcgattgattgaatgtttggtagagagcatagagcattcagttcagtttacctggaacttcttctttctgttaaactcgttg

SEQ ID NO: 5288 - DNA, 2001 bp, Setaria italica
ccccgtctcactgacggtggcccccaccgcccgacgcccgcccggccccgctcgtcggcgacccccgccctcccccctccctccaccgcaccggcgaggagatccggccgactccggttcgcttggaggccgtcgagccgcgcgggctgggcgccgggatggaggcggccggcgcgcgccggtggcccggatctcgtcggcggctcgtctcggcgagagggggcctgtgaactttgcgactttggtgtcatcaattttgagtaatatatcagagaaagaatggaagatttacaagattgcaactcgaaaagcctggttgcccttccaggctctttggttctgcatctgtttaggctgtttggtcagcaggatcagagttcatggcagaagtacatactagcttactttctgttggtcaggaatgaatacttctctggggagtcaaagggacactcagatgagttctgtgatatttcagaattagatgtttttccatatgctacagatttgggcagtgaagaacttgaacttaagaagcagaaacctatcctgaaggttcagtcgggaggtgattcaagtagcagcagatcaaatgattgctactttccaggccttcatgatgacctgtctcaagactgccttgcttggtcaagcagatcagattacccttccctttcttgtctgaataaaagattcaatttgttgatcaacagtggatatctgtacaaactgcgaaggaaatatggcattgttgagcattgggtgtatctcgcttgtagcttgatgccctgggaagcattcgatccctcgcgaaagcggtggatgaggctcccgagaatgccatgcgacgagtgcttctcctgtgcagacaaggaatcgcttgccgtcgggacacagctgcttgtctttggccgtgagtatactggccttgctatttggatgtacaacttactgactcgcagttggtcccgatgcactccaatgaatctgccccgctgtctttttgcctcgggaagctcaggtgagattgctattgttgctggtgggtgtgataagaatggacaggtgttgagatctgctgagttgtacaactcggagattggccactgggagactatcccagacatgaacttggccaggaggctctcttcaggtttcttcatggatggcaagttctatgtcatcgggggcgtatcaagtcagagggattcattgacttgtggagaggaatacaaccttgaaacaaggacctggaggagaatacttgatatgtaccctggtggaaccagtgcttctcagtcacctcctcttgttgctgttgtaaataaccagctctatgccgctgaccagtcaacaaatgtggtcaaaaagtatgacaaggcaaataacacctggaacatactgaagccattgcctgttagagctgactcatccaatggttggggcctggctttcaaggcttgcggcgacagattgctggtaattggcggccacagaggacctcgtggtgaggtaatattgctgcattcctggtgccccgaaggtggggaagatggtgctgactgggaggtgctctcggtgaaggagcgtgctggcgtcttcgtttacaactgtgcaataatggggtgctgagttaccttcgcttcagtacatgccgctggtttagcaagccaactgtttcttgctgccctttagctaccctttataacgacttgtaattcagaaatgacacacccccttttcgcagagctctcgattgattgaatgtttggtagagagcctagagcattcagttcagtttacctggaacaacttcttttttctgttaaactcgttcagaattctttgttcttgtccagtatgaattttatgcagtattcgttattcatcatccttgttgcgaagtttcctgtctattgccctgagataaaatctcagacctcgattttcaatgtaccgtacttccgtacctatgttcagatatcttgcagtctgctcaga

SEQ ID NO: 5289 - DNA, 1919 bp, Setaria italica
gacgcccgcccggccccgctcgtcggcgacccccgccctcccccctccctccaccgcaccggcgaggagatccggccgactccggttcgcttggaggccgtcgagccgcgcgggctgggcgccgggatggaggcggccggcgcgcgccggtggcccggatctcgtcggcggctcgtctcggcgagagggggcctgtgaactttgcgactttggtgtcatcaattttgagtaatatatcagagaaagaatggaagatttacaagattgcaactcgaaaagcctggttgcccttccaggctctttggttctgcatctgtttaggctgtttggtcagcaggatcagagttcatggcagaagtacatactagcttactttctgttggtcaggaatgaatacttctctggggagtcaaagggacactcagatgagttctgtgatatttcagaattagatgtttttccatatgctacagatttgggcagtgaagaacttgaacttaagaagcagaaacctatcctgaaggttcagtcgggaggtgattcaagtagcagcagatcaaatgattgctactttccaggccttcatgatgacctgtctcaagactgccttgcttggtcaagcagatcagattacccttccctttcttgtctgaataaaagattcaatttgttgatcaacagtggatatctgtacaaactgcgaaggaaatatggcattgttgagcattgggtgtatctcgcttgtagcttgatgccctgggaagcattcgatccctcgcgaaagcggtggatgaggctcccgagaatgccatgcgacgagtgcttctcctgtgcagacaaggaatcgcttgccgtcgggacacagctgcttgtctttggccgtgagtatactggccttgctatttggatgtacaacttactgactcgcagttggtcccgatgcactccaatgaatctgccccgctgtctttttgcctcgggaagctcaggtgagattgctattgttgctggtgggtgtgataagaatggacaggtgttgagatctgctgagttgtacaactcggagattggccactgggagactatcccagacatgaacttggccaggaggctctcttcaggtttcttcatggatggcaagttctatgtcatcgggggcgtatcaagtcagagggattcattgacttgtggagaggaatacaaccttgaaacaaggacctggaggagaatacttgatatgtaccctggtggaaccagtgcttctcagtcacctcctcttgttgctgttgtaaataaccagctctatgccgctgaccagtcaacaaatgtggtcaaaaagtatgacaaggcaaataacacctggaacatactgaagccattgcctgttagagctgactcatccaatggttggggcctggctttcaaggcttgcggcgacagattgctggtaattggcggccacagaggacctcgtggtgaggtaatattgctgcattcctggtgccccgaaggtggggaagatggtgctgactgggaggtgctctcggtgaaggagcgtgctggcgtcttcgtttacaactgtgcaataatggggtgctgagttaccttcgcttcagtacatgccgctggtttagcaagccaactgtttcttgctgccctttagctaccctttataacgacttgtaattcagaaatgacacacccccttttcgcagagctctcgattgattgaatgtttggtagagagcctagagcattcagttcagtttacctggaacaacttcttttttctgttaaactcgttcagaattctttgttcttgtccagtatgaattttatgcagtattcgttattcatcatccttgttgcgaagtttcctgtctattgccctgagataaaatctcagacctcgattttca

SEQ ID NO: 5290 - DNA, 1882 bp, Saccharum officinarum
tgccctccctgtctcactgacggtggccccccaccgcccgacgcacgcccgaccccgctcgcctccgctccaccgctgtcccggcctagagatccggccgactccggttgctcggaggccggcaagccgctcgtgctgggcgccgggatgcaggcggccggcgccagccggtggcccggatctcgccggcggcgcgtctcggcgagagggggcctctgaactttctgaccttgagtcctcggttttgtcatagatcggacaaataatggaagagttacaagattgcaactcgaaaagcctggttgcccttccgggctctttggttctgcatctctttaggctgtttggccagcaggatcaaagttcatggcagaagtacatactagcttactttctgttggtcaggaatgactacttctctggggagtcgaagaaacactcagatgtgttctgtgatatttcagaattagatttctttccatatgctacagatttggatagtgaagaacttgaactgaaggagcagaaacctatttcgaaggctcaatcaggaggtgattcaagtagcaacagatcgaatgattgctacttcccaggccttcatgatgacctgtctcaagactgccttgcttgggcaagcagatcagactacccttccctttcttgtctgaacaaaagattcaatttgttaattaacagtggatatctgtacaaactgagaaggaaatatggcatcgttgagcactgggtgtatctcgcttgtagcttgatgccctgggaagcatttgatccttcgcggaagcggtggatgaggctcccgagaatgccatgcgacgagtgcttctcctgtgcagataaggaatcacttgccgtcggaacacagctgcttgtctttggccgtgaatatactggccttgctatttggatgtacaacttactgactcgcagttggtccccatgcactccaatgaatctgccccgctgcctttttgcctcgggaagctcaggtgagattgctattgttgctggtgggtgtgataagaatggacaggtgctgagatccgttgagttgtacaactcagagattggccactgggagactatcccagacatgaacctgcccaggcggctctcttcaggtttcttcatggatggcaagttttatgtcattgggggcgtatcgagtcagagggattcattgacttgtggagaggaatataaccttgaaacaaggacctggagaagaatacttgatatgtaccctggtggaaccagtgcatctcaatcgcctcctcttgttgctgttgtgaataaccagctctacgccgctgatcagtcgacaaatgtggtcaagaagtatgacaaggtaaataacgcctggaacatagtgaagccattgcctgttagagctgactcatccaatggttggggtctagctttcaaggcttgtggcgatagattgctggtaattggagggcatcgaggacctcgtggcgaggtaatactgctgcattcctggtgccccgaaggtggggaagatggtgctgactgggaggttctctcggtgaaggaacgtgcaggcgtcttcgtttacaactgtgcaataatggggtgctgagttacctttgcttcagtacatgccgctggtttagcaagccaaccatttcttgctgccatttagctactctttataatgacttgtaattcagaaatgacacaccccccatttcgcggagctctcaattgatgaatgttttgtagagagcatagagcattcagttcagtttacctggaactactctttttctgttaaactcgttcagaattctttgtttttgtccagtatgaattttatgcagtattctttattcaccattgttgg

SEQ ID NO: 5291 - DNA, 2507 bp, Pennisetum glaucum
gcgggtcgccgacgagcggggccgggcgggcgtcgggcggtgggagccaccgtcagtgagacggggagggcatgcggggcgccggtggcccggatctcgtcggcggctcgtctccgcgagagggggcctgtgaactttgcgacttcggtgtcctcaattttgattaatatatatcagagaaagaatggaagatttacaggattgcaactcgaaaagcctggttgcccttccaggctctttggttctgcatctgtttaggctgtttggtcagcaggatcagagttcgtggcagaagtacatactagcttactttctgttggtcaggaatgaatacttctctggggagtcgaagggacactcagatgagttctgtgatatttcagaattagatgtttttccgtatgctacagatttggacagagaggaacttgaaccgaaggagcagaaacctattctgaaggttcagtccggaggtgattcaagtggcagcagctcaaatgattgctactttccaggccttcatgatgacctgtctcaagactgccttgcttggtcaagcagatcagactacccttccctttcttgtctgaataaaagattcaatttgttaatcaacagtggatatctgtacacactgcgaaggaaatatggcattgttgagcattgggtgtatctcgcttgtagcttgatgccctgggaagcatttgatccctcgcgaaagcggtggatgaggctcccgagaatgccatgcgacgagtgcttctcctgtgcagacaaggaatcgcttgccgtcgggacacagctgcttgtctttggccgtgaatatactggccttgctatttggatgtacaacttactgactcgcagttggtccccgtgcactccaatgaatctgccccgctgtctttttgcctcgggaagctcaggtgagattgctattgttgctggtggatgtgataagaatggacaagtgttgagatctgctgaattgtacaactcggagattggtcactgggagactctcccagacatgaacttgccgaggaggctctcttctggcttcttcatggatggcaagttctacgtcattgggggcgtatcaagccagagggattcattgacttgtggagaggaatacaaccttgaaacaaggacctggagaagaataattgatatgtaccctggtggaacaagtgcttctcagtcacctcctcttgttgctgttgtaaataaccagctctatgccgctgaccagtcaacaaatgttgtcaagaagtatgacaaggcaaacaacacctggaacatactgaagcctttgcctgttagagctgactcatccaatggttggggcctggctttcaaggcttgtggcgacagattgctggtaatcggcggccacagaggaccccgtggggaggtaatattgctgcattcctggtgccccgaaggtggggaagatggtgctgactgggaggtgctctccgtgaaggagcgtgctggcgtcttcgtttacaactgtgcaataatggggtgctgagttaccttcgcttcagtacatgccgctggtttagcaagccaaccgtttcttgctgccctttagctaccctttataacgacttgtaattcagaaatgacaccccttcttttcgcagagctctcaattgattgaaagtttggtagagagcatagagcattcaattcagatccaaccattgatgtacttctgttaacaacccatgttggcgggcttggcttgaatttgacatctgcggacacattggtcttcatggaacatgattggaatccgatgaaggatcttcaggcgatggacagagcacaccgcttgggtcaaaggaaagtggttaatgttcaccgtcttatcatgcgtggtactcttgaggagaaggtgatgagtctccagaggttcaaggtgtcagttgccaatgctgtcatcaatgctgagaactctagcttgaagaccatgaacactgaccaactgcttgatctgttcacatccacccctgcttcgagaaaagcatctgtccttccacggggctcgagtgatgaccaaaacaaagattcgaagaaatctggtggcaaaggcttgaaatccatgcttaatgggttggatgagctttgggatcagtcacagtatgctgacgagtatgatctcaaccagttccttgcaaagctcaatggctgaacatagaggatcaccagcccgtgtacagtgtaaagtaaattgggaggtgcgatttaggtggttcgcagattttgttgccaacctcaggaatttttttgttgtttgataggggaaggaaaagagaagatcgcaagatcaaatgcgacatggctaacatataggtggttgaggtcacgacctcaatttttgttttcatcttttgttaggggcttaggtctgctcgtcagaggctgtaaagattttgaggagttgtacatactctctaggcttacctattaattaatcaagctgcagctccttacaa

SEQ ID NO: 5292 - DNA, 2819 bp, Panicum virgatum
ttcgggagccatttggcacttgaaccaccacccccggggtgatgaagcacatgggcatatatatatatacgccttaccccccaccgctccaggcctcgccctccatgccctccccgtctcactgacggtggtccccaccgcccgtcgcccgcccggccccgctcgtcggcgacccctgcccatccgctccctcccctccaccgcaccggcggggagatccggccgacaccgggttcgcttggaggccggcgagccgcgcgggctgggcgccgggatggaggcggccggcgcgcgccggtggcccggatctcgccggcggcgcgtctcggcaagagctggcctgtgaactttgtggtttcggtaccctcgattttgactcatagatcagagaaagaatggaagagttacaagattgcaactcgaaaagcctggttgcccttccaggctctttggttctgcatctctttaggctgtttggtcagcaggatcagagttcatggcagaagtacatactagcttactttctgttggtcaggaatgaatacttctctggggagtcgaagagacactcagacgtgttctgtgatatttcagagttagatgtctttccatatgctacagatctgggcagtgaagaacttgagctgaatgagcagaaacccattctgaaggctcagtcgggaggtaattcaagtggcaacagatcaaatgattgctattttccaggccttcatgatgacctgtctcaagactgccttgcttggtcaagcagatcagactacccttccctttcttgtctgaataaaagattcaatttgttaattaacagtggatatctgtacaaattgcgaaggaaatatggcattgttgagcattgggtgtatctcgcttgtagcttgatgccctgggaagcatttgatcccaaccgaaagcggtggatgaggctcccgagaatgccatgcgacgagtgcttctcctgtgcagacaaggaatcgcttgccgttgggacacagctgcttgtcttcggccgtgaatatactggccttgctatttggatgtacaacttactgactcgcagttggtcccgatgcactccaatgaatctgccccgctgtctttttgcctcaggaagctcaggtgagattgctattgttgctggtgggtgtgataagaatggacaggtgctgagatctgctgagttgtataactcagagattggccgctgggagactatcccagacatgaacttagccaggaggctctcttcaggtttcttcatggatggcaagttctatgtcattgggggcgtatcaagtcagagggattctttgacttgtggagaggaatacaaccttgagacaaggacctggagaagaatactggatatgtatccttgtggaaccagtgcatctcagtcacctcctcttgttgctgttgtgaataaccagctctatgccgctgaccagtcaacaaatgtggtcaagaagtatgacaaggcaaataacacctggaacatactgaagccattgcctgttagagctgactcatccaatggttggggcctggctttcaaggcttgtggtgacagattgttggtaatcggcggccacagagggcctcgtggtgaggttatattgctgcattcctggtgccccgaaggtggggaggatggtgctgactgggaggtgctctcggtaaaggagcgcgcaggcgtcttcgtttacaactgtgcaataatggggtgctgagttaccttcgcttcagtatatgccgctggtttagcaagccaacaatttcttgctgccctttacctaccctttataatgacttgtaattcagaaatgacacacccccttttcgcggagctctcaattgattgaatgtttggtagagagcatagagcattcagttcagtttacctggaactttttttccccctgttgaactcgttcggaattctttgttcttgtccagtatgaattttatgcagtattcgttattcatcatccttgttgcgaagtttgtctggctgctgttgtcctgagataaatctcttacctcaattttcaatgtactgtacttccgtactgatgttcagaaatctcgcagtcagctcgaacagttctggttgccagtcagaacttagctgtatcttactttcagattattctgtactgcctaatagccatctaataatgtcattgtgaatgagatgcacaatttttcagtgaaagagtttgaccggtgttccccagaataagaataaagggtttgtcaacatcgtttccttcgctgattcgtcagacaatttgtcagcttcgtttacttcgatgatggttttgccgcctctgcagaacatcgtcctgagtagctggcagcaggtacaattgctagcgacagacgttgaattgaactgaaactctgctaaaagaatacgcgctgatgtgaatgcgattatgtgatctctgaatattgcatcgggtcaatcacactttaaagggttgaaggagcatgattctgacagcatatataggagtattttgctgggcacattttgcaacgttcttggcgataattgatgtcggcgacgcgtttatcgtcagagatctcgtccattgttgtccagggaaatcgagctttgatcggttctttgattcttttcaactgcctgtcagcatcctgcatccgtgcaaaaactaggagccacttgaccgttcctccactttaccggtgagatgtgcgaaacttggacatcttctttcctaccgacatcaccgtgatgtactggcaacgtcaaaaacaccattagaactaaattt

SEQ ID NO: 5293 - DNA, 2050 bp, Panicum virgatum
cggggtgaagcacatgggcatatatatacgcctttcccctccaccgctccaggcctcgccccccatgccctccccgtcctactgacggtggtccccaccgcccgaccccgctcgtcggcgacccccgcccgcccgctccctcccctccaccgcaccggcggagagatccggccgacaccggttttcgcttggaggccggcgagccgcgcgggctgggcgccgggatggaggcggccggcgcgcgccggtggcccggatctcgccggcggcgcgtctcggcaagagctggcctgtgaactttgtggtttcggtaccctcgattttgactgatcagagaaagaatggaagagttacaagatagcaactcgaaaagcctggttgcccttccaggctctttggttctgcatctctttaggctgtttggtcagcaggatcagagttcatggcagaagtacatactagcttactttctgttggtcaggaatgaatacttctctggggagtcgaagagacactcagatgtgttctgtgatatttcagagttagatgtctttccatatgctatagatctggacagtgaagaacttgaactgaatgagcagaaacctattctgaaggctcagtcgggaggtgattcaagtggtaacagatcaaatgattgctactttccaggccttcatgatgatctgtctcaagactgccttgcttggtcaagcagatcagactacccttccctttcttgtctgaataaaagattcaatttgttaattaacagtggatatctgtacaaattgcgaaggaaatatggcattgttgagcattgggtgtatctcgcttgtagcttgatgccctgggaagcatttgatcccaaccgaaagcggtggatgaggctcccgagaatgccatgcgacgagtgcttctcctgtgcagacaaggaatcgcttgccgttgggacacagctgcttgtctttggccgtgaatatactggccttgctatttggatgtacaacttactggctcgcagttggtcccggtgcactccaatgaatctgccccgctgtctttttgcctcgggaagctcaggagagattgctattgttgctggtgggtgtgataagaatggacaggtgctgagatctgctgagttgtacaactcagagaatggctgctgggagactatcccagacatgaacttagccaggaggctctcttcaggtttcttcatggatggcaagttctacgtcattgggggtgtatcaagtcagagggattcattgacttgtggagaggaatacaaccttgagacaaggacctggagaagaatactggatatgtatcctggtggaaccagtgcttctcagtcacctcctcttgttgctgttgtgaataaccagctctatgccgctgaccagtcaactaatgtggtcaagaagtatgacaaggcaaataacacctggaacatactgaagccattgcctgttagagctgactcatccaatggttggggcttggctttcaaggcttgtggcgacagattgttggtaatcggcggccacagagggcctcgtggtgaggtaatattgctgcattcctggtgccctgaaggtggggaggatggtgctgactgggaggtgctctcggtgaaggagcgtgcgggcgtcttcgtttacaactgtgcaataatggggtgctgagttaccttcgcttcagtacatgccgctggtttagcaagccaacaatttcttgttgccctttacctaccctttataatgacttgtaattcagaaatgacacacccccttttcgtggagctctcgattgattgaatgtttggtagagagcatagagcattcagttcagtttacctggaacttctttttccccctgttaaactcgttcagaattctttgttcttgtccagtatgaattttatgcagtattcgttattcatcatccttgttgcgaagtttgtctggctgctgctgtcctgagataaatctcgtacctcaaatttcaatgtaccgtacttccgtactgatgttcagaaatc

SEQ ID NO: 5294 - DNA, 2693 bp, Zea mays
caagtcctcgattttgtcatagatcagacaaataatggaagagttacaagattgcaactcaagaagcctggttgcccttccgggctctttggttctgcgtctctttaggctgtttggccagcaggatcagagttcatggcagaagtacatacttgcttactttctgttggtcaggaatgactacttctctggggagtcgaagaaacactcagatgtgttctgtgatatttcagaattagatttctttccatatgctacagatttggatagtgaagaacttgaactgaaggagcagaaacccattacgaaggctcaatcaggaggtgattcaagtggcaacagatcgaatgattgctacttcccaggccttcatgatgacctgtctcaagactgccttgcttgggcaagcagatcagactacccttccctttcttgtctgaacaaaagattcaatttgttaattaacagtggatatttgtacagactgcgaaggaaatatggcattgttgagcactgggtgtatcttgcttgtagcttgatgccctgggaagcatttgatccttcgcgaaagcgctggatgaggctaccgagaatgccatgcgacgagtgcttctcctgtgcagacaaggaatcacttgccgtcggaacacagctgcttgtcttcggccgtgaatatactggccttgctatttggatgtacaacttactgactcgcagttggtccccatgcactccaatgaatctccctcgctgcctttttgcctcgggaagctcaggtgagattgctattgttgctggtggatgtgataagaatggacaggtgctgaggtctgctgaattgtacaattcagagattggccactgggagactatcccagacatgaacctgcccaggcggctctcttcaggtttcttcatggatggcaagttttatgtcattgggggcgtgtccagtcagagggattcattgacttgtggagaggaatataaccttgaaacaaggacctggagaagaatacttgatatgtaccctggtggaaccagtgcgtctcaatcgcctccttttgttgctgttgtgaataaccagctctacgccgctgaccagtcgacaaatgtggtcaagaagtatgacaaggcaaacaatgcctggaacatactgaagccattgtctgttagagctgactcatccaatggttggggtctagctttcaaagcttgtggcgatcgattgctggtaatcgggggccatagagggcctcgtggcgaggtaatattgctgcattcctggtgccctgaaggtggggaagatggtgctgactgggaggttctctcggtgaaggaacgtgcaggcgtcttcgtttacaactgtgcaataatggggtgctgagttacctttgctacagtacatgccactggtttagcaagccaaccatttcttgctgccatttagctaccctttataatgacttgtaattcagaaatgacacccccttccctcatttcgcggagctctcaattgattgaatgttttgtagagagcaaagagcattcagttcagtttacctggaactacttttttttcttcttctgttaaactcgttcagaattctttgttgttgtccattacgaattttatgcagtattcgttattcatcatttttgcaaagcttgtctgccccattgttctgagacaaatctaaggcctcgattttcaatgcaccgtacttgcgtactgatgttcagagatcttgggtcagctcaaacagttcaggaataatggaagagcacaagattgcaactcaagaagcctggttgcccttctgggctctttgcttctgcatctctttaggctgtttggccagcaggatcagagttcatggcagaagtacatacttgcttactttctgttggtcaggaatgactacttctctggggagtcgaagaaacactcagatgtgttctgtgatatttcagaattagatttctttccatatgctacagatttggatagtgaagaacttgaactgaaggagcatgtggaatatcttcctggagcacgcctagctcctatagatgggcttcggatcatcggcctgtacgggaaggccgggatgccaggccacgcgctacggactttccaggagatggggatgtacgggtgcccgcgcaccgcaaagtcgctcaatgccaccatgaaggtcctgctgcgggcacggatgtttgatgaggctctgtcgctgtttgaggagggcccagagaagtacgacgtcgaggtggatgacatctcgtgtaacacggtggtgaagatgttctgcgacatgggggacttgcgtgcggcgtaccgggtcatgcaggggatggagagggctggtgtgcggccggatgtcatcacatcaagagcaggacaacttgtaatgaaaccgctaacagaatgcatcacaaagggtccaaggatgagagagccccttttagcagacactgtccaagcagaggatattaaggagatatgcaagcttttagtggtggtatcaagagaagctgtaaaagcatatgttggatcagatcagccggggagtcgcaacaagtgttttggtgctattattcttcaggatcagatcagccggggttgggaggatgcaataaatctgcttggtgacagggcaattccagcagacatcaaaggattaaaatga

SEQ ID NO: 5295 - DNA, 2842 bp, Sorghum bicolor
atgcggttgttgcacttgctgccgtgccatgccgcttggtacaccgcgcgccgagaccaaaggcaacaaatgaaacgggggacggaggagcaagcagagcagagggccggggcgtggcaaagctcgatggggcccgccgcctccgcacgtctcgcggggtggtactacgcggctacggaccgcatggggccgcgaataattaagcgcgacctgccactggcaaggctcacatgggcgggattattagcccgccaccgccacgcctcctccggcccccgcgcacctacacgagcacgagtaatggccacgcgccgccaccacctcaccacctggccttgcctgcctgcctgccgagctgaggccccgccccgccccggttccttccgtttcctcacttcgcggccagggctgctgccgcttcacctcgcttgtccgctccgctccgcctcgtctcgtgcagtgccgggccgtggtgcgtgcgaaaaaggcaaaagccgctcgtcgtcgtccggtccagctgcggcgcgcatggggcccgggcccgtgccgatcaggggacgggatgggcccaggcccagcaccggcgctgtcaccgccaccaacgcctccaccaccacccgatccatccatccatccatcagggcgggcgggcgaggcgtgcatatgcagctggccagccggccggtggcagatcgatggatcccgggcggaacggaaggatcatcggaagacgggaagagcttttcgcggtcggtcggtcgcgcggccgaccaccatgatctcgacgcgatggttccttcggtgctagctagggcggggcgggcctcgcgcggcacagtttggctcgtcgcttgggcccggccggacggccggcagggcggcggcggctttcgtgctgaggtcaaagcaaaagggacgctcgatcgaatcaaacgcctcgccccccatgccctccccgtctcactgacggtggccccccacccgcccggccccgctcgtcggcgagccccttcccttccttccccctcgctccatcggaccaccgctgtcccgggcaagagatccggccaactcaggttgctcggaaggccggcgagccgcgcgtgctgggcgccgggatgcaggcggccggcgccagccggtggcccggatctcgccggcggcgcgtctcggcgagacaaataatggaagagttacaagattgcaactcgaaatgcctggttgccctcccgggctctttggttctgcatctctttaggctgtttggccagcaggatcagagttcatggcagaagtacatactagcttactttctgttggtcaggaatgactacttctctggggagtcgaagaaacactcagatgtgttctgtgatatttcagaattagatttctttccatatgctacagatttggatagtgaagaacttgaactgaaggagcagaaacctatttcgaaggctcaatcaggaggtgattcaagtagcaacagatcaaatgattgctacttcccaggccttcatgatgacctgtctcaagactgccttgcttgggcaagcagatcagactacccttccctttcttgtctgaacaaaagattcaatttgttaattaacagtggatatctgtacaaactgagaaggaaatatggcatcgttgagcactgggtgtatctcgcttgtagcttgatgccctgggaagcatttgatcctttgcggaagcggtggatgaggctcccaagaatgccatgcgacgagtgcttctcctgtgcagataaggaatcacttgccgtcggaacacagctgcttgtctttggccgtgaatatactggccttgctatttggatgtacaacttactgactcgcagttggtccccatgcactccaatgaatctgccccgctgcctttttgcctcgggaagctcaggtgagattgctattgttgctggtgggtgtgataaggatggacaggtgctgagatctgttgagttgtacaactcagagattggccactgggagactatcccagacatgaacctgcccaggcggctctcttcaggtttcttcatggatggcaagttttacgttattgggggtgtatcgagtcagagggattcattgacttgtggagaggaatataaccttgaaacaaggacctggagaagaatacttgatatgtaccctggtggaaccagtgcatctcaatcgcctccccttgttgctgttgtgaataaccagctctatgctgctgatcagtcaacaaatgtggtcaagaagtatgacaaggtaaataacgcctggaacatagtgaagccattgcctgttagagctgactcatccaatggttggggtctagctttcaaggcttgtggcgatagattgctagtaattggagggcatagaggacctcgtggcgaggtaatactgctgcattcctggtgccccgaaggtggggaagatggtgctgactgggaggttctatcggtgaaggaacgtgcaggcgtcttcgtttacaactgtgcaataatggggtgctgagttacctttgcttcagtacatgccgctggtttagaaagccaaccatttcttgctgccatttagctaccctttataatgacttgtaattcagaaatgacacaccccccatttcgccgagctctcagttgatgaatgttttgtagagagcatagagcattgagttcagtttacctggaactactctttttctgttaaactcgttcagaattctttgttcttgtccagtatgaattttatgcagtattctttattcaccattgttggaaaatttatctgcgtcattgtcctgagacaaatcttaggcc

SEQ ID NO: 5296 - DNA, 1866 bp, Zea mays
ctcgcccccccgtgccctcccccgtcccactgacggtggcccccaccgcccggccccgctcgtcggcgagcgccccttccccacgctgcaccgctgtcctgggcttcctgcccaagagatccgcccgactccggtcgctcggaggccggcgagccgcgcgtgctgggcgccgggatgcaggcggccggcgccagccggtggcccggatctcgctggcggcgcgtctcggcgagacaaataatggaagagttacaagattgcaactcaagaagcctggttgcccttccgggctctttggttctgcgtctctttaggctgtttggccagcaggatcagagttcatggcagaagtacatactagcttactttctgttggtcaggaatgagtacttctctggggagtcgaagaaacactcagatgtgttctgtgatatttcagaattagatttctttctatatgctacagatttggatagtgaagaacttgaactgaaggagcagaaacccattacgaaggctcaatcaggaggtgattcaagtggcaacagatcgaatgattgctacttccccggccttcatgatgatctgtctcaagactgccttgcttgggcaagcagatcagactacccttccctttcttgtctgaacaaaagattcaatttgttaattaacagtggatatttgtacagactgcgaaggaaatatgacattgttgagcactgggtctatcttgcttgtagcttgatgccctgggaagcatttgatccttcacgaaagcgctggatgaggctaccgagaatgccatgcgacgagtgcttctcctgtgcagacaaggaatcacttgccgtcggaacacagctgcttgtcttcggccgtgaatatactggccttgctatttggatgtacaacttactgactcgcagttggtccccatgcactccaatgaatctgccccgctgcctttttgcctcgggaagctcaggtgagattgctattgttgctggtggatgtgataagaatggacaggtgctgaggtctgctgaattgtacaattcagagattgggcactgggagactatcccagacatgaacctgcccaggcggctctcttcaggtttcttcatggatggcaagttttatgtcattgggggcgtgtccagtcagagggattcattaacttgtggagaggaatataaccttgaaacaaggacctggagaagaatacttgatatgtaccctggtggaaccagtgcatctcaatcgcctcctcttgttgctgttgtgaataaccagctctacgccgctgaccagtcgacaaatgtggtcaagaagtatgacaaggcaaacaatgcctggaacatactgaagccattgcctgttagagctgactcatccaatggttggggtctagctttcaaagcttgtggcgatcgattgctggtaatcgggggccatagaggacctcgtggcgaggtaatattgctgcattcctggtgccctgaaggtggggaagatggtgctgactgggaggttctctcggtgaaggaacgtgcaggcgtcttcgtttacaactgtgcaataatggggtgctgagttacctttgcttcagtacatgccactggtttagcaagccaaccatttcttgctgccatttagctgccctttataatgacttgtaattcagaaatgacaccccctcccctcatttcgcggagctctcaattgattgaatgttttgtagagagcaaagagcattcagttcagtttacctggaactacttttttttcttcttctgttaaactcgttcagaattctttgttcttgtccagtacgaattttatgcagtattcgttattcatcatttt

SEQ ID NO: 5297 - DNA, 1452 bp, Zea mays
agaagtcctcgattttgtcaagtcctcgattttgtcatagatcagacaaataatggaagagttacaagattgcaactcaagaagcctggttgcccttccgggctctttggttctgcgtctctttaggctgtttggccagcagaggatcagagttcatggcagaagtacatacttgcttactttctgttggtcaggaatgactacttctctggggagtcgaagaaacactcagatgtgttctgtgatatttcagaattagatttctttccatatgctacagatttggatagtgaagaacttgaactgaaggagcagaaacccattacgaaggctcaatcaggaggtgattcaagtggcaacagatcgaatgattgctacttcccaggccttcatgatgacctgtctcaagactgccttgcttgggctagcagatcagactacccttccctttcttgtctgaacaaaagattcaatttgttaattaacagtggatatttgtacagactgcgaaggaaatatggcattgttgagcactgggtgtatcttgcttgtagcttgatgccctgggaagcatttgatccttcgcgaaagcgctggatgaggctaccgagaatgccatgcgacgagtgcttctcctgtgcagacaaggaatcacttgccgtcggaacacagctgcttgtcttcggccgtgaatatactggccttgctatttggatgtacaacttactgactcgcagttggtccccatgcactccaatgaatctgccccgctgcctttttgcctcgggaagctcaggtgagattgctattgttgctggtggatgtgataagaatggacagatgctgaggtctgctgaattgtacaattcagagattggccacttggatactatcccagacatgaacctgcctaggcggctctcttcaggtttcttcatggatggcaagttttatgtcattgggggcgtgtccagtcagagggattcattgacttgtggagaggaatatacccttgaaacaaggacctggagaagaatatttgatatgtaccctggtggaaccagtgcgtctcaatcgcctccacttgttgctgttgtgaataaccagctctacgccgctgaccagtcaacaaatgtggtcaagaagtatgacaaggcaaacaatgcctggaacatactgaggccattgcctgttagagctgacccatccaatggttggggtctagctttcaaagcttgtggcgatcgattgctggtaatcgggggccatagaggacctcgtggcgaggtaatattgctgcattcctggtgccctgaaggtggggaagatggtgctgactgggaggttctcttggtgaaggaacgtgcaggcgtcttcgtttacaactgtgcaataatggggtgttggtgtgcgaccggatgtcatcacgtacatgacgctcatggctgcttt

SEQ ID NO: 5298 - DNA, 2236 bp, Sorghum bicolor
ggggctgcgctgactgctgacacagccgcacaaacatgtccgcgcgcacacacgcacaaagacatgcgccatcgccacccagggccactccggtcacaggcgcttggatgcatccatggccgacgatacagagaacggtgaccaggcgaatgccgccaaagcacgccagcccatgcccaccttccgtcccggctccatcttcttcgacctgcacaagcacgagcacggctggcatttcgtcgaacacacccgtgccggacatggcaacgagatcgacccaccgccgtcctctgctgctcatcctcctgttcctcctcctcttcgccgccgtcaacggcagcgcccgccccagcaccagcccgataaagaacgtggtggtgctggcgctggagaaccggtcgttcgaccacatgctgggctggatgcgccgcctgctgggcctccccgtcgacgggctcaccggcgccgagtgcaacccaaactccaccaactccaccacctcctccatctgcgtgtccgccgacgccgacctcgtcgtccccgacgacccgggccactccttcgaggacgtcctggagcaggtcttcggcaacggcaacatctccgccgcgcagccctccatgtcgggcttcgtccgcagcgcgctctccgtcaacgcgctcctctcctccgccgtcatgcgcgccttccgcccctccctcctcccggccttctccgcgctggcccccgccttcgccgtcttcgaccgctggttctcctccatcccgggccccacgcagcccaaccggctgttcctctactccgccacctcccgcggcgccgtcgcgcacgacaagctcgacctcctcctcggctacccgcagcgcaccatcttcgagtccctcgccgccgacggccacgacttcgccgtctacttcaagaccatccccaccgtgctcttctaccgccgcctccgcgcgctccgctacgccgcgcgcagcttccaccgctacgacgccgccttcaaggaccacgcccgccgcggggtcctcccggcgctctccgtcatcgagcccaggtacttcgacctcacggggacccccgccgacgacgaccacccggcgcacgacgtcgccaacggccagcgcctcgtcaaggacgtgtacgaggcgctccgggccagcccgcagtggaaccagacgctgctcatcgtcacctacgacgagcacggcggcttctacgaccacgtcgccacgcccaccgccggcgtgcccagccccgacggcatccggggcccgccgcccttcttcttcaagttcgaccgactcggcgtcagggtgcccaccatcatggtctcgccgtggatcaagaagggcaccgtcgtcggccgcgccgtcgggcctacggacacctccgagttcgagcactcctcgatcccggccaccatcaagaagatcttcaacctctcctccgatttcctcaccaagagagacgcgtgggccggtaccttcgagcacatcttcactgaactcgaccaaccaagaacagattgcccagagacattgccagaagtgccatttgtgagaccaacgccacccaaagaacacggctggctctcggatttccagcgggagctcgtcgagctcgcgagcttcctgaacggcgactacatgctgacgagccttgcgcaagagagccggaagaagaagatgacagtgaagcaggccgatgcgtacgtgcggcgagccatcacgagctttctgcaggcgagcaagcaggcggtgcggctgggcgcaaacgaatctgccattgtcaccatgaggtcgtctctgacaagtaagagcagcagctcatcaaacccttgaactgattcagtctgctaatacacatatagctagtgaagagatggatttgaatccacagtataatgtatattgcctctgaaatgtttatagctgaatagggaactgctagtgctagaacctttaaatatagcttttgtttctcttacttaccccttattattaccaatgtagtataagagtttcatgttgaaatgttgagcttaaatgtagattggcaacctcattttgatcttgggttatgggtttacgttttagaggaacacatggaagtattacatatatgttttttttattagaacaatgaaatggaacatggagtgttatatatcacatattgaatacctttggtgatctgatcttttgccttgttggttaacttgcttttaaagagt

SEQ ID NO: 5299 - DNA, 2590 bp, Panicum virgatum
aacgatgcgtgagaagactagtggtggagtattaagctaagagactaagagagagaaggagcctgccatggtcggcacaagagaccaagccgacacggtgtgtgttgcaaccgagcttgtgatgcacgtcgactcgtgaacttgtgcaatgtgccacgcaccgataatccgagtccgaactgtccaaagtagctccttcttcctcattcctgtcaaagtctccaacgaggtcattcgtgcctctgaattagaggttagagttagacgttggaacggggaatgccatggtggtgccggcgaggcgctgcaaacacacaattactggagcttttgatgctctctgagccgtcgatgctcaccggagaagagctagctagaaagatctccggcggaggcacccacatggcacatgtccacgtgcaccgcgcggggcacgacaggacgcgacacgtcgcccgcgcgtcacccacccaccacctccgtccccctcggccgaggtccaccccagtcacaggtgcttggacgcatccatggccgccgaaaccgggagcggcggcgaccaggcgcgtgccgccaaaggccgccagcccatgcccctcccgccccggctccatccatctgccgcactcgcacggcgtttcgtcgagcacgagccatggcaacgggatcgcggcggcagcctctgccgctcctcctcctcctccccctgatcctcctcgccggccgcggcgaggccggcgccgcccggccgagccccataaagaacgtggtggtgctggcgctggagaaccggtcgttcgaccacatcctcgggtggacgcgccgcctgctggggctccccgtcgacgggctcaccggcgccgagtgcaaccccaactcctcccccaacagctccgccatctgcgtgtccgccgacgccgacctcgtcgtccccgacgacccgggccactccttcgaggacgtcctcgagcaggtcttcggcaacgtctccgccgccgccgcgcagccctccatgtcgggcttcgtccgcagcgcgctctccgtcaacgccctcctctcctccgccgtcatgcgcgccttccgccccgccctcctcccggccttctccgcgctcgcgccggccttcgccgtcttcgaccgctggttctcctccatcccggggcccacccagcccaaccgcctcttcctctactccgccacctcccgcggcgccgtcgcgcacaacaagctcgacctcctcctcggctacccgcagcgcaccatcttcgactccctcgccgccgacggccgcggcttcgccgtctacttcaagaccatccccaccgtcctcttctaccgccgcctccgcgcgctccgccacgccgcgcggagcttccaccgctacgacgccgccttcaaggaccacgcccgccgcggcgtgctcccggcgctctccgtcatcgagcccaggtacttcgacctcacggggacccccgccgacgacgaccacccggcgcacgacgtcgccaacggccagcgcctcgtcaaggacgtgtacgaggcgctccgggcggggccgcagtggaaccagacgctgctcgtcgtcacctacgatgagcacggcgggttctacgaccacgtcgccacgcccaccgccggcgtgcccagccccgacggcatccggggcccgccgccattcttcttcaagttcgaccgcctcggcgtcagggtgcccaccatcatggtctcgccgtggatcaagaagggcaccgtcgtcggccgccccgccgggcccaccgacacctccgagttcgagcactcctccatcccggccaccctcaagaagatcttcaacctctcgtcggatttcctcaccaaacgggatgcgtgggccggcacattcgagcacatcttcactgagctcgacgaaccaagaacagactgcccagagacattgccggaggtgccattcgagaggccgaccccgcccaacgagcacggctggctctcggatttccagcgcgagctcgtggagctcgcgagctttctgaacggcgactacatgctgacgagcctcgcgcaggaggcccggacgaagaagatgacggtgaagcaggccgacgcgtacgtgcggcgagccatcacgggctttctgcgggcgagcaagcaggcgctgcggctgggcgcgaacgagtccgccatcgtcaccatgaggtcgtctctgacgagtaagagcaccggctccagcccctgattgaagtctggctgctattacacctagctaattaacagatctgaagaacagatggtcttgcatctgaattcttaaagataaatgtacatcgtctctgaagttttagcgtaaccgaatagtagtgaactctgaattgagagtctttatatatatatagcttctgcttctgcttctgcttctgcttctgcttctgtctcccttagcgaagttgctataccaatgtactcatcaaatgtacaagagtctgaatgtctgatcttgaaacctcgagctcaaatgtagattgaacagttctgcaggatcattttgtttgttctcttgtctgtcaacaagtctgctttgctttcgatgacttta

SEQ ID NO: 5300 - DNA, 2010 bp, Panicum virgatum
gtcccggctccatctcccgcactcgcacgagcgcggccgcagaccgcgccccgcggcacggcgtttcgtcgagcacgcgccatggcaacgggatcgccgcggcggcagcctctcctcctcctcctcctcctgatcctcctcgccgacagcggcgaggccagtgccgcccggccgagcccgataaagaacgtggtggtgctggcgctggagaaccggtcgttcgaccacatgctggggtggacgcgccgcctgctggggctccccgtcgacgggctcaccggcgccgagtgcaaccccaactcctcctccccctccgccgccaacagctcctcctccatctgcgtgtccgccgacgccgacctcgtggtccccgacgacccgggccactccttcgaggacgtcctggagcaggtcttcggcaacatctccggcgccgccgcgcagccctccatgtcgggcttcgtccgcagcgcgctctccgtcaacgcgctgctctcctccgccgtcatgcgcgccttccgccccgccctcctcccggccttctccgcgctcgccccggccttcgccgtcttcgaccgctggttctcctccatcccggggcccacgcagcccaaccggctgttcctctactccgccacctcccgcggcgccgtcgcgcacgacaagctcgacctcctcctcggctacccgcagcgcaccatcttcgactcgctcgccgccgacggccgcggcttcgccgtctacttcaagaccatccccaccgtcctcttctaccgccgcctccgcgcgctccgccacgcggcgcgcagcttccaccgctacgacgccgccttcaaggaccacgcccgccgcggcgtgctcccggcgctctccgtcatcgagcccaggtacttcgacctcacggggacccccgccgacgacgaccacccggcgcacgacgtcgccaacggccagcgcctcgtcaaggacgtgtacgaggcgctccgggccagcccgcagtggaaccagacgctgctcatcgtcacctacgacgagcacggcgggttctacgaccacgtcgccacgcccaccgccggcgtgcccagccccgacggcatccggggcccgccgccgttcttcttcaagttcgaccgcctcggcgtcagggtgcccaccatcatggtctcgccgtggatcaagaagggcaccgtcgtcagccgccccgtcgggcccaccgacacctccgagttcgagcactcctccatcccggccaccctcaagaagatcttcaacctctcgtcggatttcctcaccaaacgggatgcgtgggccggcacattcgagcacatcttcactgagctcgacgaaccaagaacagactgcccagagacattgccagaggtgccattcgagaggccgacccctcccaaagaacacggctggctctcggatttccagcgcgagcttgtggagctcgcgagcttcctgaacggcgactacatgctgacgagcctcgcgcaggaggcccggacgaagacgatgacggtgaagcaggccgacgcgtacgtgcggcgagccatcacgggctttctgcaggcgagcaagcaggcggtgcggctgggcgcgaacgagtccgccatcgtgaccatgaggccgtctctcacaagtaactaagtaagagcaccggctcgagcccctgattgaagtctgctaatacacgtagctaattaacagatctgaagaacagatggtcttgcatctgaaaggtaaatgtacatcgtctctgaagtcttagcgtaaccgaatagtagtgaattctgaactgagtttttatatatatagcttctgcttctgtttctgcagtttcccttagcaaaattgctataccaatgtactcatcaaatgtataagagtctgaatatctgatcttgaaacctcgagctcaaatgtagattgggcagctgtgcagcatcattttaatgtgaaatactatatggattattagtatatcaaaaattctttgtttgttct

SEQ ID NO: 5301 - DNA, 2291 bp, Setaria italica
gaactgtgctcgtgagcttgtgcaatgtgccgctggtgtcgacgcccaccgaacaagtgctagaaagatctttggcggagcgacgaggtggcccgtggccgcacacacatgcccgcagcccacgcgtacttgcacgacaagacgcgacacgtcgcctgtgcgtcactcgctcgacggaggtccaccccagtcacaggtgcttggcggcatccatgggccatggccgccgaaattgagagcggagaccaggaggatgccgccaaggccgccagcccacgcgccctcccatcttccacttgcacgagcacggccgcacgagacgcaccccccacggcgcggcattccgtcgagcacgggccatggcaatgggatcgccccgccgccgtgctccgcggccgatgcccctgccgctcctcctcctgctgttcttcctcgtcgccggcagcggcgaggccaatgccgccgtgaggggggcggacgacggcgcccggcccagccccataaagaacgtggtggtgctggcgctggagaaccggtcgttcgaccacatgctggggtggacgcgccgcctgcttggcctccccgtcgacgggctcaccggcgccgagtgcaaccccaactccgccaactccaccaccacctcgtcctcctcctccatctgcgtgtccgccgacgccgacctcgtcgtccccgacgacccgggccactccttcgaggacgtcctggagcaggtcttcggcaacatctcctccggcgccggcgccgccgcggcgcagccctccatgtcgggcttcgtccgcagcgcgctctccgtcaacgcgctgctctcctccgccgtcatgcgcgccttccgcccctccctcctgcccaccttctccgcgctcgccccggccttcgccgtcttcgaccgctggttctcctccatcccggggcccacccagcccaaccgcctcttcctctactccgccacctcccgcggcgccgtcgcgcacgacaagctcgacctcctcctcggctacccgcagcgcaccatcttcgactccctcgccgccgacggccggggcttcggcgtctacttcaagaccatccccaccgtcctcttctaccgccgcctccgcgcgctccgctacgccgcccgcagcttccaccgctacgacgccgccttccgggaccacgcccgccgcggcgtcctcccggcgctctccgtcatcgagcccaggtacttcgacctcacggggacccccgccgacgacgaccacccggcgcacgacgtcgccaacggccagcgcctcgtcaaggacgtgtacgaggcgctccgggcgagcccgcagtggaaccagacgctgctcatcgtcacctacgacgagcacggcggcttctacgaccacgtctccacgcccaccgccggcgtgcccagccccgacggcatccgcggcccgccgccattcttcttcaagttcgaccgcctcggcgtcagggtgcccaccatcatggtctcgccgtggatcaagaagggcaccgtcgtcggccgacccgccgggcccaccgacacctccgagttcgagcactcctccatcccggccaccctcaagaagatcttcaacctctcgtcggatttcctcaccaagagggacgcgtgggccggcacattcgagcacatcttcaccgagctcgaccaaccaagaacggactgcccagagacactgccagaggtgccattcgagaggccaaccccgcccaacgaacacgggtggctctcggacttccagcgggagctcgtggagctcgcgagcttcctgaacggcgactacatgctgacgagcctcgcgcaggagacccggaggaagaagatgacggtgaagcaggccgatgcttacgtgcggcgcgccatcaccggcttcctgcaggcgagcaagcaggcggtgcggctgggcgccaacgagtccgccatcgtgaccatgcggtcgtccctgacgagtaagacgacgaccagctcaagcccttgattgttgatgagtatgctaatatacatagctagttaacagatctgaaaagataaatgtatatcgtctttgaagtattaaccgaatagcgaactgcgctggagtctttatatatataggttttgtttccctttgcgaagttgtaataccttaccaatgtataagagtcaaatttctgaaactctgaatgtctgatcttgaaacgtttgagctcaaatgtaggttgaacatttgtgcctcattttgatctgaaatatatggagtatagctgcggtgctttgtttgttc

SEQ ID NO: 5302 - DNA, 2309 bp, Setaria italica
gctgaagcgaacaggtccgaacttgtgaactgtgctcgtgagcttgtgcaatgtgccgctggtgtcgacgcccaccgaacaagtgctagaaagatctttggcggagcgacgaggtggcccgtggccgcacacacatgcccgcagcccacgcgtacttgcacgacaagacgcgacacgtcgcctgtgcgtcactcgctcgacggaggtccaccccagtcacaggtgcttggcggcatccatgggccatggccgccgaaattgagagcggagaccaggaggatgccgccaaggccgccagcccacgcgccctcccatcttccacttgcacgagcacggccgcacgagacgcaccccccacggcgcggcattccgtcgagcacgggccatggcaatgggatcgccccgccgccgtgctccgcggccgatgcccctgccgctcctcctcctgctgttcttcctcgtcgccggcagcggcgaggccaatgccgccgtgaggggggcggacgacggcgcccggcccagccccataaagaacgtggtggtgctggcgctggagaaccggtcgttcgaccacatgctggggtggacgcgccgcctgcttggcctccccgtcgacgggctcaccggcgccgagtgcaaccccaactccgccaactccaccaccacctcgtcctcctcctccatctgcgtgtccgccgacgccgacctcgtcgtccccgacgacccgggccactccttcgaggacgtcctggagcaggtcttcggcaacatctcctccggcgccggcgccgccgcggcgcagccctccatgtcgggcttcgtccgcagcgcgctctccgtcaacgcgctgctctcctccgccgtcatgcgcgccttccgcccctccctcctgcccaccttctccgcgctcgccccggccttcgccgtcttcgaccgctggttctcctccatcccggggcccacccagcccaaccgcctcttcctctactccgccacctcccgcggcgccgtcgcgcacgacaagctcgacctcctcctcggctacccgcagcgcaccatcttcgactccctcgccgccgacggccggggcttcggcgtctacttcaagaccatccccaccgtcctcttctaccgccgcctccgcgcgctccgctacgccgcccgcagcttccaccgctacgacgccgccttccgggaccacgcccgccgcggcgtcctcccggcgctctccgtcatcgagcccaggtacttcgacctcacggggacccccgccgacgacgaccacccggcgcacgacgtcgccaacggccagcgcctcgtcaaggacgtgtacgaggcgctccgggcgagcccgcagtggaaccagacgctgctcatcgtcacctacgacgagcacggcggcttctacgaccacgtctccacgcccaccgccggcgtgcccagccccgacggcatccgcggcccgccgccattcttcttcaagttcgaccgcctcggcgtcagggtgcccaccatcatggtctcgccgtggatcaagaagggcaccgtcgtcggccgacccgccgggcccaccgacacctccgagttcgagcactcctccatcccggccaccctcaagaagatcttcaacctctcgtcggatttcctcaccaagagggacgcgtgggccggcacattcgagcacatcttcaccgagctcgaccaaccaagaacggactgcccagagacactgccagaggtgccattcgagaggccaaccccgcccaacgaacacgggtggctctcggacttccagcgggagctcgtggagctcgcgagcttcctgaacggcgactacatgctgacgagcctcgcgcaggagacccggaggaagaagatgacggtgaagcaggccgatgcttacgtgcggcgcgccatcaccggcttcctgcaggcgagcaagcaggcggtgcggctgggcgccaacgagtccgccatcgtgaccatgcggtcgtccctgacgagtaagacgacgaccagctcaagcccttgattgttgatgagtatgctaatatacatagctagttaacagatctgaaaagataaatgtatatcgtctttgaagtattaaccgaatagcgaactgcgctggagtctttatatatataggttttgtttccctttgcgaagttgtaataccttaccaatgtataagagtcaaatttctgaaactctgaatgtctgatcttgaaacgtttgagctcaaatgtaggttgaacatttgtgcctcattttgatctgaaatatatggagtatagctgcggtgcttt

SEQ ID NO: 5303 - DNA, 1719 bp, Hordeum vulgare
gccaggccagcccaacttcccttcctctccggcaccgctcgtccactccctcactcactcactcaccggaaccgccacggcaatgccgccgccgatgggaatgcgggcgctgctgctgctgctgctcctgccgctcgccttcgccgccgccggcaatgccagcgccggccctagagaagcaagcccgatcaagaacgtggtggtgctggcgctggagaaccggtcgttcgaccacatgctgggctggatgcgccgcctgctcggcctccccatcgacggcctcaccggcgccgagtgcaacgtcggccccaccaactccaccctcccgcccgtctgcgtctccgccgacgccaccctcgtcgtccccgacgaccccggccactccttcgaggacgtgctggaccaggtcttcgggttccgccccaactccaccgccgccgaccagccggctcccccgaccatgtcgggcttcgtgcgctccgcgctctccgtcaactccctgctctcctccgccgtcatgcggggcttcaccccgtccctcctcccggccttctccgcgctcgccgccgacttcgccgtcttcgaccgctggttctcctccctgccgggccccacgcagcccaaccgcctcttcctctactccgccacctcccacggcgccgtcgcccacgacaagtggaacctcctccgcggctacccgcagcgcaccatcttcgactccctcgccgccgacggccgccgcttcaacgtctacttcaagaccatccccaccaccctcttctaccgcaacctccgcaccgtgcgcgccgccgcacagagcttccacttctacgactccgcattcagggaccacgcccggagggggcggctgccggcgctgtccgtcatcgagcccaggtacttcgacctcaccggcacccccgccgacgacgaccacccggcccacgacgtcgccaacggccagaggctcgtcaaggacgtctacgagacgctgcgggccagcccgcagtggaacgacaccctgctcatcgtcacctacgacgagcacggcggcttctacgaccacgtcgccacgcccgtcgccggcgtgcccagccccgacggcctcagggggccagtgccattcttcttcaagttcgaccggctcggggtcagggtgccgacaatgatggtgtcgccgtggatcaagaaggggatggtggtggggcggccgccgaacggaccgacggccacatccgagtacgagcactcctccatcccggcgaccatcaagaagatcttcaacctcagatctgatttcctcaccaaaagagacgaatgggcgggcacatttgagcacatcttcacccaactcgaccaaccaaggacagattgcccagagactttgccagaagtgccatttgagagaacaacaccagcgaaagaacatggaattctctcagatttccagcgtgagctcgttgaattagcaagcttcttgaacggcgactacatgttgacgagttttgctcaggagacgcagaaaaagatgaccgtgaagcaggccgacacgtatgtgagacgagccatcaaaggttttctgcacgcaagcaggcaggccagacggttaggtgcaaatgagtctgcaattgtaaccatgagatcatctctgacaagtaagagtaccacctcaagaccttaactagataatactccctccgtcccaaaaattttgtctta

SEQ ID NO: 5304 - DNA, 2515 bp, Setaria italica
gcaggcaggcagtcacacctcccctctcctcttctctttccctggcctggcttccctccacctgactataataagctcagcggagtcgacagccgaattcgccacattccgtcggtactagctagcaggcggcaagatccaggcaccatctttctgctgcaggggtaggcttggcaggcaggcgccagagatctctcggttcccgtgccaatgcagctcttccaaggggagaagccggcccacgacttcctctcgctccacaccggaggaggctcgtcgtcgccggtgcagcactccacccaaggatacgatctgggggtgcaatcttcgctgaagcctctgaagatgggcaagcggcgcggcggcggcggcggcggcggcgacggagcgatcggcatggcgccgttgggtctggaggcggactcggagaagcatgccctgccgggcggtgtcgggacgttcagcatcaggcaggtgccatcgactacccagccgagggggcaaggcgtcgtcagggatgcatttgcgcccgtgcttcatggctccagaacggagggcacgcccggagcagaatctggagccagggctcacagtggcccggccacaatgtggcaagattcgggcaccgatcaaagatccagagcaacgagaggagaggggagaagcagcggcagcagcggtgatcaggggccaagcactccgagatcgaagcattccgcgaccgagcagcggaggaggaccaagataaatgacaggcttgaaatacttcgtgaacttctgccacacggtgaccagaagagggacaaagcgtctttccttctcgaggttatcgaatacataaggtttttgcaagagaaagtccaaaagtacgagtcaggccacccacaaaagaatcacgaggattcctccatgccatgggcgaaagtttactacagatcatgctggaaaaacacagagaacattagtcaagtccagggaggaggattatcagcccccacgcaagatctaaacaacgaacagtactgttccgagaaaagtacagtagcacctactgctcatttcagcacacaaagtgctggagaaactagtatagacgacatttcctcccaaaaggcaacaagcacaccaaaaaactgggcagatgacagcacacctagcaaacagccaccatggttgagcatgtcaacctctgattcaggcgatagaacactaagcaagaatgagaacaacactcttcatgaggatactcgtagtctttctaatgcttactctcaagggttactaaacagattgacacaagcactaaaaaggtcgggagtagacccatctcaagctagtatatctgtagagatcaatatggacaaaagagagcctagtaacatgcacgacaatttgaaggacaatgaatgtgaagaaacaatccatgtgcacaagaagctccggtgctgacagaccactccccaaaactaaaaaagtaaaactccccccccccccccccccccacccaagtccagaccaggacttcacagaagcaaaccacaattgatgcaattcttttatttatattgtcatcacatttactgacctaggcttccattccaatatagaggaagctgcttagggagggtagccagaaaccttccccattcattcattcctcatttgtaaatgcaattcagattgtaaaaacagtgtatatgtattgctctctcaaaatttgtcaattcaacaaatatggtagtagactaggttgcaacgtcactgtgtcaaccttccacaattcatccattaaattggtagctagagctatggacaatgtaaactatactaagcttgtgatttgcagcaagcgccagcaaccgtggcgtcttcccgagcaggcacgcgcccccgccgtagaccaagcagacgagcaggaagaggaacaccgtgctctccatgctctggaagatctcgaatccgaccccgccggatggcgcgaaggactgcgcgagcaggtcggggaagatgagcagcacgtcgagcacgacggcctgcatggcgttgaagcggacgaagcgggagaaggcctgctggttccgcacgacggcgaagtagagcgtgaggaagaggaggaagggcgtgagcggcgaggagtggaagaggcgcgccgcggggcccagcgggcggagcagcgcgctgaagaaggggaactgcgcgaggaggaagcggccgtggtgcgcgccgtcgaggaacgggtagaggtaggcgaccgcggccacgaggcggtcgggagcctccacggccccgctgttgtcgttgttgttggaggcgcgcggcggggcggcgaggaggcggcgcggggatcgggcggggcacggtggaggtgggagggcgcggcggcgggggctgcagaggaggtggccggatgtgcggtggagcgggcgcggggacgagaggaggaggagcgaaacggcggatgccatgggggccgcgcgtttcggttgtccgctgctcggcgcgggtagggagtgga

SEQ ID NO: 5305 - DNA, 1343 bp, Panicum virgatum
tcctctccactacaccaaccaaccaatcaatcctctccgtctcccacccactcggccacggccacatcccccggaactccacaaaaatctccactcccacccgcgcggaggaggcagcagccgccggcgcccgcgcggcgccactgcccccacccaaactcctcgcctcgcccgcccccgcgccgcacccccaaaaatctccaccccctacccgcgccgaccagcggaaagaagaagccacacccgccgccgcccatcccgaccgaccgaaacgcgcggccccccatggcatccgccgtttcgctcctcctcctctcgtccccgcgcccgctccaccgcaccggcctcctccgcgtcccgcgccgcggcggcctcctgccgctaccggggcccgcccaggccccgcgccgcctcctcgcggcggccccgccgccgcgcgcctccaacaacaacgacaacagcggggccgtgggggcgccggaccgcctcgtggccgcggtcgcctacctctacccgttcctcgacggcgcgcaccacggccgcttcctcctggcccagttccccttcttcagcgcgctgctccgcccgctggcccccgccgcgcgcctcttccactcctcgccgctcacgcccttcctcctcttcctcacgctctacttcgccgtcgtgcggaaccagcaggccttctcccgcttcgtccgcttcaacgccatgcaggccgtcgcgctcgacgtgctgctcatcttcccggacctgctcgcgcagtccttcgcaccatccggcggggtcggattcgagatcttccagagcatggagagcacggtgttcctcttcctgctcgtctgcttcgtgtacggcgggggcgcctgcctgctcggcaagacgccacggttgcccatcgtcgctgatgcggcagagcgccaggtgatgtgactgcacggtccccttgaatcttgctgatggaaagggaaagggggatctgtgattcacagtaacatctcgttttctcaacgattcactggtgcttgctgcaaatcacaagcttagtatagtttacattgtccatagctctagctaccaatttaatggatgaattgtggaaggttgatacagtgatgttgcaacctagtgtgctcccatctttatggaattgacaaattttgagagagagcagtacatatacactgttttgcaatctgaattgcgtttacaaatgaggattggatgaagcaggaggtttctgattgctcaccctaagcagttcctctgcatccgaatggaagcctaggtcattaaacgtgtttgcaatatatataaataaaagaattgcatcatttgtggtt

SEQ ID NO: 5306 - DNA, 950 bp, Echinochloa colona
agcacccgccggcacccgcgccgcgccacgccacctccaaatcccccaaaaatctccattccctacccgcgccgagccccggaaagagaccacgctcgccgcgccacgccgccacccctccatcccctaccaaccgaatcgcgtcgccccccatggcatccgccgtctcgctcctcctcctctcgtccccgcgcccgctccaccgcaccggcctcctctgcagcccccgtcgcggcgccgtcctgccggtaccgggccccgcccaatccccgcgcaggctcctcgccgcggcgccgcgcgcctccaacaacaacgacaacagcgaggccgtggaggcgccggaccgcctcgtggccgccgtcgcctacctctacccgttcctcgacggcgcgcaccacggccggttcctcctcgcgcagttccccgtcttcagcgcgctgctccgcccgctgggccccgcggcgcgcctcttccactcctcgccgctcacgcccttcctcctcttcctcacgctctacttcgccgtcgtgcggaaccagcaggccttctcccgcttcgtccgcttcaacgccatgcaggccgtcgcgctcgacgtgctgctcatctccccgacctgctcgcgcagtccttcgcgccctcggcggggtcgggttcgaggtctaccagagcctggagagcacggtcttcctcttcctgctcgtctgcttggtgtacggcgggggcgcctgccttctcgggaagacgccgcggctgcccatcgtcgctgatgcagctgagcgccaggtgatgtgactacagttcacttgaatcgtgctgatggaaaggtagaggggatctgtgattcacagtaacatctcaaatcctagatgattcattgggcttgctgcagatcacaagcttagtgtagtttacattgtctatagttctagctgccaattaatggatgaatt

SEQ ID NO: 5307 - DNA, 3417 bp, Sorghum bicolor
gttggatcgatcggttgcttttgcttattacgctatcgtctctgccgcaattagcggtgtggtaacgtcagtcgtcagctgtcatcgaacacgcgctagccgttaattcattagtaggatcattattcatcccgggcagacatgtttatgtttgtagtattactttgccgacagccacgtagcagccccgcgtgctagacacgctaaaagccttcacataatcacatccgacctgcttcctgttatgtttgtacactagtataaaatttcgaaggtacttcaaatttcaagagataaaaacactgaagacacaatcagacagactgacagatagcaggcttaccggccatcttcgatctcatcccccctggcctgctggctccctcctccacctgactataataagctccgcggagtcgacagccgaattcgccacacattccgtcgggcgtcgtcggtactagccagcacgcagcccgcaagatccaggcaccatctttctgctgcagcggcagccttggcaggcaggcgccagagatctctcggttcccgtgctcgcccgcgtgccaaaatgcagctcttccaaggagagaagccggctcacgatttcctctcgctccacaccggaggaggctcgtcgtcgccgtcgccggtgcagcattccacccaaggatacgaattgggggtgcacaattcactgaagccactgaagctgggcaagcggcgcggcggcggcggcggcgagggaggagcgatcggcgtggcaccgtcgtcggggttggaggcggactcggaggagcgtgtcttaccgggcggcgtcgggacgttcagcatcaggcaggtggcatctgctgcgactcagtcgaggggtggcgaagccgccagccatggcgtcgtcgtcgtcaggggtgccgccgcctttcctcctgccgttcatgtttccagaacggagggcccgccgcacggaacagaatcgggagccagggctcacagcggtccggccacaatgtggcaagattctggcatggaccaaagatccagaggggcgagaggaggggaggggagaagcagaagcagtggcagcagcgctgatcaggggcccagcacgccgagatccaagcactccgctacagagcagcggagaaggacaaagataaatgacaggctcgaaatacttcgggaactcctgccacacggtgatcagaagagggacaaagcatcttttcttcttgaggttattgaatacataaggttcttgcaagagaaggtccaaaagtacgagtcagcccacccacaaaagaatcacgaggactcctccatgccatgggcaaaagtttactacagatcatgctggaaaaacacagagaatatcaaccaaggaggaggattagcagcttccacacaagatacgaacaaagaacagtatggttccaagcaaactacagtggcatcgtctgctctctttgacacacaaagcgctagagaagctagtgcaaacgacatttcctcccaaaagccaacaagcacagcacaaagcagggcagacaacaacatagctagcaaacagctaccatggttgagcatgtcaacctctgattcagacaacaacagaacactgagcaagaacgagaaacaaactctccatgaggacactcaaagtctttcggatgcttactctcaagggctactaaatagattgacgcaagcactgaaaaggtcgggagtagacccatctcaagctagtatatctgtagagatcagtatggacagaagaggaacagaacctaacaatatacgtgacgatctgaaggataatgaatgtgaagatactatccatgtgaccaagaagcttcggtgcgaaagaagctagatctctacctcaaactgaaattcaaacaatggcgacaacaggccaggacctcaccaatcaaattcacaattgatgcaattcttttatttatattgcaatcacaattaaattactgacctaagcttccattcggatacaagggaagctgcttggggagggggtagtcagaaagctccccgattcagacattcctcaatcctcctcatttgtaaatgcgattcggattgtaaaacagtgtacatgtattgctctctcaaaatttgtcaattcaacaaatatggtagtacactaggctgcaacgtcattgtatcaaccttgcacagttcatccattgaagtggtaactagacctatataaacagcaaggcaattgtaaactatactaagcttgtgatttgctgcaagcaccaacgagccattccgatgtttctgcataatcatcagatcccctttccatcagcatgattcgagggaaaggaattgtagtcacatcacctggcgctcggctgcatctgcgacaatgggcagccgcggcgtcttcccgagcaggcaggcgccgctgccatagaccaaggagacgagcaggaagaggaagaccgtgctctccatgctctggaagacctcgaacccaaccccaccagagggcgcgaacgactgcgcgagcaggtcggggaagatgagcagcacgtcgagcacgacggcctgcatcgcattgaagcggacgaagcgggagaaggcctgctggttccgcacgacggcgaagtagagcgtgaggaagaggaggaagggcgtgagcggcgacgagtggaagagccgagccgcggggcccagcgggcggagcagcgcgttgaagaaggggaactgcgcgaggaggaagcggccgtggtgcgcgccgtcgaggaacgggtagaggtaggcgaccgcggccacgaggcggtcgggcgcctccacggccccgctgttgtcgttgttgttggaggcgcgtggcggcggcgcagcgaggagccgacgaggggtcgcgctggtgggggcggcgaggaggacccgccggtgcggggtgctgaggaggcgggatgtgacgtcgcggtggagatggcgcgggggcgagaggaggagaagcgaaacggcggatgccatgtgatcctctctctgctcggcgcggtcggggagtggagatgtttgaggggtgtggccgtgtgggggtgcggcgagggggcggccaaggcgaggcgttcgggtgagggaagtggcgccgcgcggctgcggctgcggctgctggctgctgccccctccgcgcgggttggaggggagatttttgtggagctcctgggggatgtggccgagggcgagacgaggggattggttggtggtgcctgcggcgtcgtgggggaggaaggacgggcgggtgggcgacgcgcggggagtgtctcgtgggccgccttgccggccggccattgcagcgtggcccgctgttcatatgggcctttctgtgcgatgaaggtccgaagaagccgggtggtttcctacctttccattacgggagattag

SEQ ID NO: 5308 - DNA, 1336 bp, Panicum virgatum
caacaaaccaaccaatcctctccgtctcccattcggccacatccccggaactccacaaaaatctccactcccacccgcgcggaggaggcagcagccgccggcgcccgcgcggcgccactgcccccacccaaactcctcgcctcgcctcgcctcgaccgcccccgcgccgcgccccccaaaaatctccaccccctacccgcgccgagcagcggaaacaagccacacccgccgccgcccatcccgaaacgcgcgggcccccatggcatccgccgtttcgctcctcctcctctcgtccccgcgcccgctccgcggcgccggcctcctccgcgtcccccgccgcggcgccctcctgccgctaccgggccccgcccaggcggccccgccgccgcgcgcctccaacaacaacgacaacagcggggccgtggaggcgccggaccgcctcgtcgccgcggtcgcctacctctacccgttcctcgacggcgcgcaccacggccgcttcctgctcgcccagttccccgtcttcagcgcgctgctccgcccgctggcccccgcggcgcgcctcttccactcctcgccgctcacgcccttcctcctcttcctcacgctctacttcgccgtcgtgcggaaccagcaggccttctcccgcttcgtccgcttcaacgccatgcaggccgtcgcgctcgacgtgctgctcatcttcccggacctgctcgcgcagtccttcgcgccgtccggcggggtcggcttcgagatcttccagagcatggagagcacggtgttcctcttcctgctcgtatgcttgctgtacggcgggggcgcctgcctgctcggcaagacgccacggttgcccatcgtcgctgatgcggcagagcgccaggtgatgtgactacacggttcccttgaatcatgctggtggaaagggaaagggggatctgtgattcacagtagcatctcgatttctcaacgattcaccggtgcttgctgtaaatcacaagcttagtatagtttacattattgtccatagctctagctaccaatttaatggatgaattgtgggaggttgatacagtgatgttgcaacctagtgtactcccatctttatggaattgacaaattttgagagggagcagtacatatacactgttttacaatctgaattgcatttacaaatgaggattggatgaagcagtaggtttctgactactctccctaagcagttcctctgcatccgaatggaagcctaggtcattaaacgtgtttgcaatatataaataaaagaattgcatcaattgtggtttgcttctgttcctgatctggactatagacaatgtttgat

SEQ ID NO: 5309 - DNA, 1309 bp, Sorghum bicolor
aatcccctcgtctcgccctcggccacatcccccaggagctccacaaaaatctcccctccaacccgcgcggagggggcagcagccagcagccgcagccgcagccgcgcggcgccacttccctcacccgaacgcctcgccttggccgccccctcgccgcacccccacacggccacacccctcaaacatctccactccccgaccgcgccgagcagagagaggatcacatggcatccgccgtttcgcttctcctcctctcgcccccgcgccatctccaccgcgacgtcacatcccgcctcctcagcaccccgcaccggcgggtcctcctcgccgcccccaccagcgcgacccctcgtcggctcctcgctgcgccgccgccacgcgcctccaacaacaacgacaacagcggggccgtggaggcgcccgaccgcctcgtggccgcggtcgcctacctctacccgttcctcgacggcgcgcaccacggccgcttcctcctcgcgcagttccccttcttcaacgcgctgctccgcccgctgggccccgcggctcggctcttccactcgtcgccgctcacgcccttcctcctcttcctcacgctctacttcgccgtcgtgcggaaccagcaggccttctcccgcttcgtccgcttcaatgcgatgcaggccgtcgtgctcgacgtgctgctcatcttccccgacctgctcgcgcagtcgttcgcgccctctggtggggttgggttcgaggtcttccagagcatggagagcacggtcttcctcttcctgctcgtctccttggtctatggcagcggcgcctgcctgctcgggaagacgccgcggctgcccattgtcgcagatgcagccgagcgccaggtgatgtgactacaattcctttccctcgaatcatgctgatggaaaggggatctgatgattatgcagaaacatcggaatggctcgttggtgcttgcagcaaatcacaagcttagtatagtttacaattgccttgctgtttatataggtctagttaccacttcaatggatgaactgtgcaaggttgatacaatgacgttgcagcctagtgtactaccatatttgttgaattgacaaattttgagagagcaatacatgtacactgttttacaatccgaatcgcatttacaaatgaggaggattgaggaatgtctgaatcggggagctttctgactaccccctccccaagcagcttcccttgtatccgaatggaagcttaggtcagtaatttaattgtgattgcaatataaataaaagaattgcatcaattgtgaatttgattggtg

SEQ ID NO: 5310 - DNA, 1753 bp, Zea mays
caagcaggcaggcaggcagaagcaggcaccaccaaccaatctcctcgtctcccactcggctacccacatcccccggagctccacaaaaatctccgctcccaggctcccacccgcgcggagggggcaagcagccagcagccgcgcggcgccactgccttgccctcaacccctcacccaaacgcctcgctttggccgccccccacaaggccactcacccaaaaaatctccactcctcgaccgcaccgagcagaggatcacatggcatccgccgtttcgcttctcctctcgcccccgcgcctgctccaccgcgacggcacatcccgcctcctcagcatcccgcaccggcgggtcctcctcgccgcccccaacaacgcgacccctcgtcggctcctggcccccgcgccgcgcgcctccaacaaaaacgacaacagcggggccgtggaggcgcccgaccgcctcgtggccgcggtcgcctacctatacccgttcctcgacggcgcgcaccacgggcgcttccttctcacgcagttccccttcttcggcgcgctgctccgcccgctggcccccgcggctcggctcttccactcatcgccgctcacgcccttcctcctcttcctcacgctctacttcgccgttgtgcggaaccagcaggcgttctcccgcttcgtccgcttcaacgcgatgcaggccgtcgtgctcgacgtgctgctcatctttcccgacctgctcgcgcagtcgttcgcgccctccggtggggttgggttcgagatcttccagagcatggagagcacggtcttcctcttcctgctcgtctccttggtgtacggcggtggcgcctgcctgctcgggaagacaccacgtctgcccattgtcgcagatgcagcggagcgccaggtgatgtgactacaattcgtttcctgcggaccatgttgatggaaagggaatctgatgatatgcagaaaacatcccaatggttcgttggcgcttgcagcaaatcacaagcttagtataatttacaattgccttgctgtttatataggtctagttgccgattgaatgcatgtactgtggaaggttgatacaaaaacgttgcaatactaccatatttgttgaattgacaaattttgagagagcagtacatgtacactgttttacaatctgaattgcatttacaaatgaggaggaatgtctgaattggggagctttatgactaccctcccctgagcagcttcctttgtacctgaatggaggcttaggtcagtaattgtgatttcaatataaataagagcattccatcaattgtcaatttcgtcgacaaagtcctggtctgttgtcggcttgtcgccacagtttgaatttcagtttgagctggagatcttgcttctctcgccccgaagcttcttggtcacatgtataatatcttcacattcatgatcctgtcaggtaaggttaaaaagaagtggtaaagaaatggctgattctgtgaataagccatgacataagtctagcaactttgcaagcattaacgtgctgatatactttcatgtgctgttattaccttcaaattgtcatgtatattattaggttctgttgctcttctgtccatactgatctctacagatatactagcttgagatgggtctactcccgacctttttagagcttgtgtcaatctatttagaagcctgatgtaaataatgttttctcttgttagttgcagatatagcaaaattaccatcataaacaacagtag

SEQ ID NO: 5311 - DNA, 2842 bp, Brachypodium distachyon
cctccccgactactctctctgcccagactataataagctctctgtcacagccgaacccgcgctgaacattccaccgatcagtactaccagctgctgcagcaaagatccaggcaccgtcattctgctgccgaggcaacgtacggcaggcagctccgacagatctcccgagtcccaagtcatcccggccgtgtcccaatggagctcttccaaggtaattaaacatgccaatcaagagataactccacagcgcggtcgtgatgcctctcttctctgctacgtgcatgctcgaatgaatactcatctgtttttctctcttccgtggatgcgtggtgtgtgttcatgtgtaattctgcaggggaggagccggcccatgatttcctctcgctccgcgcaggaggaggctcgtcgccgttccagcacaggctgcagtccgcccaacaagcaggatatggcttggggccgcacagcctcgtgaagccggctgagccagtcaagcagtctagcagccacggcggcgatggagcggtcagtgcggcggcagatttgggggagcaagtgttgccgggcggcgttggcacgttcagcatcaggcaagtgcctgacgcccggccgagggaagaagctggcatgggcagggatgcatctgttgctgctgtccatcagggctccagaatggagattgcacatgaagcacgatccggagctatggttcgcagtgctcctccatctacaatgtggcaggattctggcattgataagagatctagagacactgattgctatgaacattcagcggcgagaagcagcggcagcagcgccgaccaggagcccagcagtccgagatcaaagcattccgctaccgagcagcggcggaggaccaagataaatgacaggcttgatatacttcgggaactcctgccgaactgcgatcagaagagggataaagcttctttccttctggaggttattgaatacatacggctcttgcaagagaaatgccaaaaatatgagtcagccattcctgaaaaggatcccacggattccaaatccatggcatgggacaaagtgtactgcagatcacggtggaggaacacacagaacattagtcaaggccaaggaggaggtttatcagctgccacagaagacatgaacaatgagcagcattgcagtcccaagggcattacagttgcacccacttctctcttcactacacaaagtgtcaaagaaactagtacaacagccagttcctcccaaaacattatagagaacaacatgcctaacaatcagctatcatggctgagtatgtcaaccatgaaccaaaacagtaatgcaagcaacagcaagctaagcaagcaggagacgcagagtctccgcaatgatactcagagtctttccagtgcgtactcacaagggttgttgcataaactgaaagaagctctacagaagtcaggagtagacccatctcaagcaaatatatctgtggagatcaatatggataaacgggcaagagccaatgctcatatacatgacaattcaaaggctaatgaaggcaaagaaccaatgcacataaccaagaggctccggtgcgactgaagctacatctctgtcccaaactcgacaattcattcaacgcgaagttcagaaggggactttgcaaaccacaactgatgcaattattttatttatgttgcaattacatttcactaaccaaagcttcattcatataccgaggaaggtgcttttgcgagagcagctcccattttcttttctttagttttgtaaatgcagttcagattctaaaatgtgtgtatttctacatgtaaaggtctcaattaaactcaattcttttctatatagaagaagtcgtaacatgcagcttgtattggaagttaaaataacaattcaaactcatttgaacatacactggattggattgtaatgccattgtatcaaccttccatgattccatccattaaattgataagtaataaaaccgtaaacatctgctgtactatactaaacttgtgaatgatgatttgaaacatcaacgaaccgtgggtatgtttgcatatatcatcagactatgtttccctttttcatgggtaagattggagctgggttacatcacctggcgctcggctgcatctgcaactatgggcagccgtggcgtcatcccgagcatgcacgcgcccccgccgtagacgaggcagacgagcaggaagaggaagacggtgttctccaagctctggaagatgtccagcccgatcccggcgcctgagggcgcgaaggactgtgcgaggaggtcggggacgatgagcagcacgtcgagcgcaacggcctgcatggcgttgaagcggacgaagcgggagaaggcctgctggttgcgcacgacggcgaagtagagggtgaggaagaggaggaagggcgtgagcggcgaggagtggaagaggcgcgcggcgggggcgagcgggccgagcagggcgttgaagaaggggaactgggccacgaggaagcggccgtggtgcgcgccgtcgaggaacgggtagaggtaggcgaccgccgccaccaggcggtcgggcgcccccaccgcgtcgctgttgtcgttgttggcgcgcggtggcggggcgaggagacggagcgagcgcgggcgcgggcgcagcgcggtcacgcccacgccggcggtgggggtcgcgccgaggaggggaaagcgtggcgcgggggacttgaggagggacggggctgcgcggtggagcgggcgaggggaggagaggaggagcgagacggtggacgccatgggggagcggcgcggccggtgcgagcctcggcgccgaaggggagtggg

SEQ ID NO: 5312 - DNA, 2716 bp, Brachypodium distachyon
ttaccctcccactttgttaatcccctcctctcctccccgactactctctctgcccagactataataagctctctgtcacagccgaacccgcgctgaacattccaccgatcagtactaccagctgctgcagcaaagatccaggcaccgtcattctgctgccgaggcaacgtacggcaggcagctccgacagatctcccgagtcccaagtcatcccggccgtgtcccaatggagctcttccaaggggaggagccggcccatgatttcctctcgctccgcgcaggaggaggctcgtcgccgttccagcacaggctgcagtccgcccaacaaggatatggcttggggccgcacagcctcgtgaagccggctgagccagtcaagcagtctagcagccacggcggcgatggagcggtcagtgcggcggcagatttgggggagcaagtgttgccgggcggcgttggcacgttcagcatcaggcaagtgcctgacgcccggccgagggaagaagctggcatgggcagggatgcatctgttgctgctgtccatcagggctccagaatggagattgcacatgaagcacgatccggagctatggttcgcagtgctcctccatctacaatgtggcaggattctggcattgataagagatctagagcggcgagaagcagcggcagcagcgccgaccaggagcccagcagtccgagatcaaagcattccgctaccgagcagcggcggaggaccaagataaatgacaggcttgatatacttcgggaactcctgccgaactgcgatcagaagagggataaagcttctttccttctggaggttattgaatacatacggctcttgcaagagaaatgccaaaaatatgagtcagccattcctgaaaaggatcccacggattccaaatccatggcatgggacaaagtgtactgcagatcacggtggaggaacacacagaacattagtcaaggccaaggaggaggtttatcagctgccacagaagacatgaacaatgagcagcattgcagtcccaagggcattacagttgcacccacttctctcttcactacacaaagtgtcaaagaaactagtacaacagccagttcctcccaaaacattatagagaacaacatgcctaacaatcagctatcatggctgagtatgtcaaccatgaaccaaaacagtaatgcaagcaacagcaagctaagcaagcaggagacgcagagtctccgcaatgatactcagagtctttccagtgcgtactcacaagggttgttgcataaactgaaagaagctctacagaagtcaggagtagacccatctcaagcaaatatatctgtggagatcaatatggataaacgggcaagagccaatgctcatatacatgacaattcaaaggctaatgaaggcaaagaaccaatgcacataaccaagaggctccggtgcgactgaagctacatctctgtcccaaactcgacaattcattcaacgcgaagttcagaaggggactttgcaaaccacaactgatgcaattattttatttatgttgcaattacatttcactaaccaaagcttcattcatataccgaggaaggtgcttttgcgagagcagctcccattttcttttctttagttttgtaaatgcagttcagattctaaaatgtgtgtatttctacatgtaaaggtctcaattaaactcaattcttttctatatagaagaagtcgtaacatgcagcttgtattggaagttaaaataacaattcaaactcatttgaacatacactggattggattgtaatgccattgtatcaaccttccatgattccatccattaaattgataagtaataaaaccgtaaacatctgctgtactatactaaacttgtgaatgatgatttgaaacatcaacgaaccgtgggtatgtttgcatatatcatcagactatgtttccctttttcatgggtaagattggagctgggttacatcacctggcgctcggctgcatctgcaactatgggcagccgtggcgtcatcccgagcatgcacgcgcccccgccgtagacgaggcagacgagcaggaagaggaagacggtgttctccaagctctggaagatgtccagcccgatcccggcgcctgagggcgcgaaggactgtgcgaggaggtcggggacgatgagcagcacgtcgagcgcaacggcctgcatggcgttgaagcggacgaagcgggagaaggcctgctggttgcgcacgacggcgaagtagagggtgaggaagaggaggaagggcgtgagcggcgaggagtggaagaggcgcgcggcgggggcgagcgggccgagcagggcgttgaagaaggggaactgggccacgaggaagcggccgtggtgcgcgccgtcgaggaacgggtagaggtaggcgaccgccgccaccaggcggtcgggcgcccccaccgcgtcgctgttgtcgttgttggcgcgcggtggcggggcgaggagacggagcgagcgcgggcgcgggcgcagcgcggtcacgcccacgccggcggtgggggtcgcgccgaggaggggaaagcgtggcgcgggggacttgaggagggacggggctgcgcggtggagcgggcgaggggaggagaggaggagcgagacggtggacgccatgggggagcggcgcggccggtgcgagcctcggcgccgaaggggagtgggctggagatttttgt

SEQ ID NO: 5313 - DNA, 1130 bp, Brachypodium distachyon
actcggccacatccccccaaaactccacaaaaatctccgctccaaagtcccctccctcggaggcagcagcagcagcagccttgcccgcgccacgctgccactgccaagccaaacgccaccgccgtgcccctccgctcaaactccacacaaaaatctccagcccactccccttcggcgccgaggctcgcaccggccgcgccgctcccccatggcgtccaccgtctcgctcctcctctcctcccctcgcccgctccaccgcgcagccccgtccctcctcaagtcccccgcgccacgctttcccctcctcggcgcgacccccaccgccggcgtgggcgtgaccgcgctgcgcccgcgcccgcgctcgctccgtctcctcgccccgccaccgcgcgccaacaacgacaacagcgacgcggtgggggcgcccgaccgcctggtggcggcggtcgcctacctctacccgttcctcgacggcgcgcaccacggccgcttcctcgtggcccagttccccttcttcaacgccctgctcggcccgctcgcccccgccgcgcgcctcttccactcctcgccgctcacgcccttcctcctcttcctcaccctctacttcgccgtcgtgcgcaaccagcaggccttctcccgcttcgtccgcttcaacgccatgcaggccgttgcgctcgacgtgctgctcatcgtccccgacctcctcgcacagtccttcgcgccctcaggcgccgggatcgggctggacatcttccagagcttggagaacaccgtcttcctcttcctgctcgtctgcctcgtctacggcgggggcgcgtgcatgctcgggatgacgccacggctgcccatagttgcagatgcagccgagcgccaggtgatgtaacccagctccaatcttacccatgaaaaagggaaacatagtctgatgatatatgcaaacatacccacggttcgttgatgtttcaaatcatcattcacaagtttagtatagtacagcagatgtttacggttttattacttatcaatttaatggatggaatcatggaaggttgatacaatggcattacaatccaatccagtgtatgttcaaatgagtttgaattgttattttaacttccaatacaagctgc

SEQ ID NO: 5314 - DNA, 1130 bp, Brachypodium distachyon
ctcggccacatccccccaaaactccacaaaaatctccgctccaaagtcccctccctcggaggcagcagcagcagcagccttgcccgcgccacgctgccactgccaagccaaacgccaccgccgtgcccctccgctcaaactccacacaaaaatctccagcccactccccttcggcgccgaggctcgcaccggccgcgccgctcccccatggcgtccaccgtctcgctcctcctctcctcccctcgcccgctccaccgcgcagccccgtccctcctcaagtcccccgcgccacgctttcccctcctcggcgcgacccccaccgccggcgtgggcgtgaccgcgctgcgcccgcgcccgcgctcgctccgtctcctcgccccgccaccgcgcgccaacaacgacaacagcgacgcggtgggggcgcccgaccgcctggtggcggcggtcgcctacctctacccgttcctcgacggcgcgcaccacggccgcttcctcgtggcccagttccccttcttcaacgccctgctcggcccgctcgcccccgccgcgcgcctcttccactcctcgccgctcacgcccttcctcctcttcctcaccctctacttcgccgtcgtgcgcaaccagcaggccttctcccgcttcgtccgcttcaacgccatgcaggccgttgcgctcgacgtgctgctcatcgtccccgacctcctcgcacagtccttcgcgccctcaggcgccgggatcgggctggacatcttccagagcttggagaacaccgtcttcctcttcctgctcgtctgcctcgtctacggcgggggcgcgtgcatgctcgggatgacgccacggctgcccatagttgcagatgcagccgagcgccaggtgatgtaacccagctccaatcttacccatgaaaaagggaaacatagtctgatgatatatgcaaacatacccacggttcgttgatgtttcaaatcatcattcacaagtttagtatagtacagcagatgtttacggttttattacttatcaatttaatggatggaatcatggaaggttgatacaatggcattacaatccaatccagtgtatgttcaaatgagtttgaattgttattttaacttccaatacaagctgca

SEQ ID NO: 5315 - DNA, 979 bp, Leymus cinereus x Leymus triticoides
ccgctccgtccggaggcaagcagccgtccgcactcgcccgcgccgcgctgccgctgccaagccaccaccgccaagccaaacgccctgcccccgccgccccgcaaaaatccccagccctcccgtgccgagcccgcccgcgcgccatggcctccgccgtctcgctcctcctctcgtccccgcgcccgctccaccgcgcggccccgtccctcctcaggtcccccgcgccccgcgggcgcctccccttcctcggtccctcttcggccaccgcgctgctcccccgccgcccccacggcctcctcgccccgccgccgcgcgctaacaacgacaacagcgacgcggtgggggcgcccgaccgcctggtggccgccgtcgcctacctctacccgttcctcgacggcgcgcaccacggccgcttcctcgtcgcgcagtaccccgtcttcaacgccctgctcagcccgctcggccccgccgcgcgcctcttccattcctcgccgctcacgcccttcctcctcttcatcaccctctacttcgccgtcgtccgcaaccagcaggccttctcccgcttcgtccgcttcaacgccatgcaggccgtcgcgctcgacgtgctgctcatcgtccccgacctcctcgcgcagtccttcgcgccctcgggcggcggcatcgggctggacatcttcacgagcttggagaacaccgtcttcctcttcctgctcgtctccctcgtctacggcgggggcgcgtgcctgctcgggatgacgccgcgcctgcccatcgttgcagatgcagccgagcgccaggtgatgtgagcttgctccaatcttgcccatgacaagggaaacggaatctgatatacccgaacatctccatggttcattgatgtttttggatcttaaatcacaagcttagtctagtacagtcgttgtaaattcaatggatggaatcatggaaggctgatacaatggcattatagttcactcca

SEQ ID NO: 5316 - DNA, 1217 bp, Saccharum officinarum
agggactgacttttattttattcaatcaacgaccaaaaacctaaaaaagaattagaaacggaagaagaacagcaggcgaagcttcgccaggttggtatattgatcgattgattgatcggtggcggaggaaggggaggagggcggcagatggcggcgtgccggggcttcttcgagtgcctgctcaggctgctcaacttcatcctcaccgtcgccggcctcgccatggtcggctacgggatctacctgctcgtcgagtggatgaagatatccgaggacggcagcggcgggggattgacggcggaggtgctcgtctccggccggccgttgttgggtgctgtcgctctcggtgacagcttcctcgacgagctacccaaagcatggtttatttatttgttcattggtgttggtgctatcgtcttcctcgtgtctctgtttggctgcattggagcagggacaagaaacacctgctgtttgtgtttctatgctttcttggtcatattgttgatccttgctgaagctggagctgctgcattcatcttctttgaccaaagctggaaagatgtaattccagtggacaagacacataactttgatgttatgtatgactttctgaaggaaaactgggagattgcaagatgggttgctcttggtgttgttgtttttgaggcagtgctctttctgttagctctggttgtcagggcaatgaacaaacctgctgagtatgacagtgatgatgaaattattgcaattggacgaagccctaccatgcggcagccattgatccatgcccaaaatgtgcctgccactggtgttcctgtcccaacactcgatcagcgtgcaagtagaaatgatgcctggagccaaaggatgcgagagaagtatggtctggacacgagccagttcacgtacaacccttcagacccaagcaggtaccagcagaatggcacaccacaggctgaagaaaggagtcgatgcactgtaatgtgaagaatccttcatgaggtcctacgagataatggttttcttgaacgggggctacctcagcttgtgtagtttggtgttacggtgttgttcagacttcatagcggtgtgtggaataaaagaattccgacaatattgtttgtcacgcttgatatgtcttctctgcaaatgttctatgcacctgtaattttattgtgaatgaagaactgttaaccattgacatcatctattttgta

SEQ ID NO: 5317 - DNA, 1217 bp, Zea mays
gaacggcaggcgaagcatcgccagattggtatatcgatcgattgatcggtggcggagggaggggaggagggcggcagatggcggcgtgccggggcttcttcgagtgcctgctcaggctgctcaacttcatcctcaccgtcgccggcctcgccatggtcggctacgggatctacctgctcgtcgagtggatgaagatatctgaggacggcagcagcggggggttgacggcggaggtgctggtctccggccggccgttgttgggggctgtcgctctcggtgacagcttcctcgacatgctacccaaagcatggtttatttatttgttcattggtgttggtgctactgttttcctcgtgtctctgtttggctgcattggagcagggacaagaaacacctgctgtttgtgtttctatgccttcttggtcatattgttgatccttgctgaagctggagctgctgcattcattttctttgaccatagctggaaagatgtaattccagtggacaagacacataactttgatgttatgtatggctttctgaagaaaaactgggagattgcaagatgggttgctcttggcgttgttgtttttgaggcagtgctctttctattagctctggttgtcagggcaatgaacaaacctgcggagtatgacagtgatgatgaaattattgcaattggccgaagccctaccatgcggcagccattgatccatgcccaaaatgtgccggccaccggtgttcctgtcccaacactcgatcagcgttcaagtagaaatgatgcctggagccaaaggatgcgagagaagtatggtctggacacgagccagttcacgtacaacccctcagacccaagcaggtaccagcagaatggcgctccacaggctgaagaaaggagtcgatgcactataatgtgaagaattcttcatgacgtcctacgtcataatggttttcttgaacgggctacctcagcttgtgtagtttggtgttgttcagacttcatagctgtgtgtgtggaatgcaaaaatcccgaccatattgtttgtcacgcttgatgtcttctctgcaaatgttctatgcacttgtaattttaccgtgaatgacgaactgttagccattgacatcatctattttgtattttaggggggttgtttcttcttgccagtcctaccattttcatgtagctctgtttaatcatgatgctttactcaaatata

SEQ ID NO: 5318 - DNA, 1256 bp, Zea mays
gccctcctcacgccacctggcgggctcccccgtcgactccactccacctcctcctttcccccaatccaccctagtgatcttattttattcacgcgcaaaaacctaaaaaagatttagaaacggaagaacaaacagcaagcgaagcatcgccagattggtatatcgatcgattgatcggtggcggaggaaggggaggacggggggcagatggcggcgtgccggggcttcttcgagtgcctgctcaggctgctcaacttcatcctcaccgtcgccggcctcgctatggttggttacgggatctacctgctcgtcgagtggatgaagatatccgaggacggcatcggcggggcttcgacggcggaggtgctcgtctctggccggccgttgttgggggctgtcattctcggtgacagcttcctcgacaatctacccaaagcatggtttatttatttgtttattggtgttggcaccatcgtcatcttggtgtctctgtttggctgcattggagcagggacaagaaacacctgctgtttgtgtttctatgctttcttggtcatattgttgatccttgctgaagctgcagctgctgcattcattttctttgaccatggctggaaagatgtaattccagtggacaaaacacataactttgatgttatgtatgactttctgaaggaaaactgggagattgcaagatgggtcgctctgggcgttgttgtttttgaggcagtgctcttgctgttagctctggctgtcagggcaatgaacaaacctgctgagtatgacagtgatgacgaaattatagcaattggccgaagccctaccatccggcagccactgatccatacccaaaatgttcctgccactggtgttcctgtcccaacacttgatcaacgtgcaagtagaaatgatgcctggagccaaaggatgcgagagaagtatggtctggacacgagccagttcacatacaacccttcagacccaagcaggtaccagcaaaatggcacgccacgggctgaagaaaggagtcgatgcactataatgtgaagaattcttcatgaggtcctacgagataatagactttcttgaaggggctactgtagtttggtgttaccagtgttgttcagactttacacagcggtgtgtggaatagaagaatcccgaccatattttttgtcacgctcgatatgacttctcagcaaatgctctatgcacctaattttactgtgaatgaggaactgctagccgttgacatc

SEQ ID NO: 5319 - DNA, 1291 bp, Echinochloa colona
ggggagatggcggcgtgccggggcttcttcgagtgcctgctcaggctgctcaacttcgtcctcaccgtcgccggcctcgccatggtcgggtacgggatctacctgctggtcgagtggatgaagatatccgagggcggcggcggcggatcgtcggcggaggtgctcgtcctcggccggccgttgctcggggccgtcgcgctcggtgacagcttcctcgacaagctacccaaagcatggtttatttatttattcattggtattggcgctattgtcttcctcgtgtctctgtttggctgcatcggagcagggacaagaaacacctgctgcttgtgtttttacgctttcttggtcttattgttgatccttgctgagggcggagctgcagcgttcattttctttgaccatagctggaaagatgtaattccagtggacaagacacataacttcgatgttatgtatgactttctgaaggaaaactgggagattgcaagatgggttcctcttggtgttgttgtttttgaggcactgcttttcctgttagctctggtcgtcagggcaatgaacaaacccgctgagtatgacagcgatgacgaaatcattgcaattggccgaagccctaccatgcggcagccattgatccattcacaaaatgttcctgccactggtgttcctgtcccaacacttgatcaacgtgcaagcagaaacgatgcatggagccaaaggatgcgagagaagtatggtctggacacgagccagttcacctacaacccttcagatgcaagcaggtatcagcagaacggtgctcctcaggccgaagaaaggagtcgttgcactataatgtgaagaattctccatcagatcttctgagatatgggttttcttgaatggaacgggctatgcagcttctgtaatttggtgttacagtgttggccagagtgtcgctaccataatgtttatcctgcctgataagtcttctctgcaaatgccctacacacatgtaattttcttgtgaatgaggaactgttagccattgacatctccttattgggttttgtttgttgtttgcatttcgtcccctttcacacttgcaaatccattcccagattgttgagcagctctgtttaatttagctgctgtactcaagtttgtaagatttagttgtgctatatgaggaacgtggactaggaaggaatctcagagtatttgggaaatgagtccaattcagttctcattgttgttagctattgaagcgattaattagtcgtggtgtggtcggcgtctctcaaggcac

SEQ ID NO: 5320 - DNA, 1575 bp, Panicum virgatum
gacggcccccctcgcgccacttggtgggtcccatggccactcccctccgccgcccgcttttccccagtcgacccgaaataattttgtccacgcgcaaaaaagcgaaaaggaattagaaacgccaaacgggagaaggagaagaagaactgcacccccggatagattggtattgggagatcgattggttgatcggaggcggaggaagggggaggccgggaggaggaggaagggagatggcggcgtgccggggattcttcgagtgcctgctgaggctgctcaacttcttcctcaccgtcgccggcctcgccatggtcgggtacgggatctacctgctcgtcgagtggatgaagatatccgggggcggcggcggcggggggtcgccggcgcacgtgctcgtcctcggcaggccgttgctcggggccgtcgcgctcggtgacagcttcctcgacaagctgcccaaagcatggtttatttatttgttcatcggtgttggtgcggtcgtcttcctcgtgtctctgtttggctgcatcggagcagggacaagaaacacctgctgcttgtgtttctatgctttcttggtcttattgttgatccttgctgaggctggagccgccgcgttcatcttctttgaccatagctggaaagatgtaatcccaaaggataagacacataacttcgatgttatgtatggctttctgaaggacaactgggagattgcaagatgggttgctctcggcgttgttgtttttgaggcagtgcttttcctgttagctctggttgtcagggctatgaacaaacctgctgagtatgacagtgatgacgaaatcattgcaattggccgaagcccgaccatgcggcagccattgattcatgcacaaaatgttcctgccactggtgttcctgtcccaacacttgatcaacgtgcaagcagaaacgatgcatggagccaaaggatgcgagagaagtacggtcttgacacgagccaattcacctacaacccttcagacccaagcaggtatcagcagaatggtgcgcctcaggctgaagaaaggagtcgttgcaccatcatgtgaagaatcattcatgaggtcctgagataatgaattttcttgaacgggctatctcagcttgtgagtttggtgttaccgtgttgttcagagtggtgtatgggatagagtcgctaccagaacattggtccttcatgatacatcttctctctgcaaatgctctatgcacctgtaaccttcttgtgagtgaggaactgttagccattgacatctccttatcggggtttgtttcttgtctgcatttccccccatttcacacttccaagtccgtttccagattgtcgagcagctctgtttaatttagatgttgtactcaagtttgtaaggtttggttgtgcagtgtagtaagatgggttagaagaaatctttgagtattatggaaatgagttatattcagttctcattgtcattcagaagcgattgattgtggttgtttagatcttcaaaaatagatttgtttttatttatacaagttttcagaggatttgtggaaaaatctgttttactt

SEQ ID NO: 5321 - DNA, 1370 bp, Setaria italica
aaaaacgaaaaaaggaattagaactgcacccgaagcatcgccagattggtattggtcgatcgatcggttggttgatcggaggcggaggaaggagagggaggaggaggaggcggaggtggtggggagatggcggcgtgccggggattcttcgagtgcctgctcaggctgctcaacttcgtcctcaccgtcgccggcctcgccatggtcgggtacgggatctacctgctcgtcgagtggatgaagatatccaagggcggcggcgggggaacgccggcggaggtgctcgtcctcggcaggccgttgctcggggccgttgcgctcggtgacagcttcctcgacaagctgcccaaagcatggtttatttatttgttcattggtgttggtgctattgtcttcctcgtgtctctgtttggctgcattggagcagggacaaggaacacctgctgcttgtgcttctacgctttcttggtcttgttgttgatccttgctgagggtggagctgctgcgttcattttctttgacaatagctggaaagatgtaattccaaaggacaagacacataacttcgatgttatgtatgactttctgaaggacaactgggagattgcaagatgggttgctcttggtgttgttgtttttgaggcagtgcttttcctcttagctctggttgtcagggcaatgaacaaacctgctgagtatgacagcgatgacgaaatcatcgcaattggccgaagccctaccttgcggcagccattgatccatggacaaaatgttcctgccactggtgttcctgtcccaacacttgatcaacgtgcaagcagaaacgatgcatggagccaaaggatgcgagagaagtacggtctggacacgagccagttcacctacaacccttcagacccaagcaggtatcagcagaacggtgctcctcaggctgaagaaaggagtcgttgcaccatactgtgaagaatcatccttcatcaggtcctctgagataatggatttcttgaacgggctatctcaggttgtgtagtttggtgttaccgtgttggtcatagtggtgcgggtgatagagtcggcgagtcgataccataatgtgtaccctgcctgatacgtcttctctgcaaatgctctacgcatctgtaattttcttgtgaatgacgaactgttagccattgacatctccttatcagggtttgtttcttgtttgcatttcgtcccgtttcacccttgcaagtccagttccagattgttgagcagctcgatttggcgagcattgttattttaaactttgtcaactcatatctttctaagtgtattctttaacgtgcggaaagatgttgggataaatttgaaactggcactatttttta

SEQ ID NO: 5322 - DNA, 1346 bp, Setaria italica
gaaaaaaggaattagaactgcacccgaagcatcgccagattggtattggtcgatcgatcggttggttgatcggaggcggaggaaggagagggaggaggaggaggcggaggtggtggggagatggcggcgtgccggggattcttcgagtgcctgctcaggctgctcaacttcgtcctcaccgtcgccggcctcgccatggtcgggtacgggatctacctgctcgtcgagtggatgaagatatccaagggcggcggcgggggaacgccggcggaggtgctcgtcctcggcaggccgttgctcggggccgttgcgctcggtgacagcttcctcgacaagctgcccaaagcatggtttatttatttgttcattggtgttggtgctattgtcttcctcgtgtctctgtttggctgcattggagcagggacaaggaacacctgctgcttgtgcttctacgctttcttggtcttgttgttgatccttgctgagggtggagctgctgcgttcattttctttgacaatagctggaaagatgtaattccaaaggacaagacacataacttcgatgttatgtatgactttctgaaggacaactgggagattgcaagatgggttgctcttggtgttgttgtttttgaggcagtgcttttcctcttagctctggttgtcagggcaatgaacaaacctgctgagtatgacagcgatgacgaaatcatcgcaattggccgaagccctaccttgcggcagccattgatccatggacaaaatgttcctgccactggtgttcctgtcccaacacttgatcaacgtgcaagcagaaacgatgcatggagccaaaggatgcgagagaagtacggtctggacacgagccagttcacctacaacccttcagacccaagcaggtatcagcagaacggtgctcctcaggctgaagaaaggagtcgttgcaccatactgtgaagaatcatccttcatcaggtcctctgagataatggatttcttgaacgggctatctcaggttgtgtagtttggtgttaccgtgttggtcatagtggtgcgggtgatagagtcggcgagtcgataccataatgtgtaccctgcctgatacgtcttctctgcaaatgctctacgcatctgtaattttcttgtgaatgacgaactgttagccattgacatctccttatcagggtttgtttcttgtttgcatttcgtcccgtttcacccttgcaagtccagttccagattgttgagcagctcgatttggcgagcattgttattttaaactttgtcaactcatatctttctaagtgtattctttaacgtgcggaaagatgttgggataaatttga

SEQ ID NO: 5323 - DNA, 1880 bp, Panicum virgatum
cacggggataatggcgggtaggacccgtccccgcgtacagcgtcagcacggccgccgatgggataaaaaaataaactaaaatccgcgccggaactccaagttcagcaggcccgatcgatccgggccgtcgatcgcagccgctgacggtccccctcgcgccacttggtgggtcccatggccactccgctccgtcgcctgcttttcccgaaataattttattcacgcgcaaaaaacgaaaaggaattagaaacgggagaagaaggagaagaactgcacccgaagcatcgccaggtagtcaccaccctcctcttgtccgcttctttccttcctccctccctcctcacccgccgcgcgagaattcggctggactcgttggcgctcccctgagaatcggagcttttttttttgactggtggatagattggtattgggcgatcgattggtcgatcgggggcggaggaagggggaggcccgggaggaggcggggagatggcggcgtgccggggattcttcgagtgcctgctcaggctgctcaacttcttcctcaccgtcgccggcctcgccatggtcgggtacgggatctaccttctcgtcgagtggatgaagatatccggcggcgggggctcgccggcgcacgtgctcgtcctcggccggccgttgctcggggccgtcgcgctaggtgacagcttcctcgaccatctaccaaaagcatggtttatttatttgttcatcggtgttggtgctatcgtcttcctcgtgtctctgtttggctgcatcggtgcagggacaagaaacacctgctgcttgtgtttctatgctttcttggtcttattgttgatccttgctgaggctggagctgccgcgttcatcttctttgaccatagctggatagatgtaataccaaaggacaagacacgtaacttcgatgttatgtatgactttctgaaggataactgggagattgcaagatgggttgctctcggcgttgttgtttttgaggccgtgcttttcctgttagctctgactgtcagggctatgaacaaacctgctgagtatgacagtgatgatgaaatcattgcaattggccgaagcccaaccatgcggcagccattgattcatgcacaaaatgttcctgccactggtgttcctgtcccaacacttgatcaacgcgcaagcagaaacgatgcatggagccaaaggatgcgagagaagtacggtcttgacacgagccaattcacctacaacccttcagacccaagcaggtatcagcagaatggtgcacctcaggctgaagagagaagtcgttgcaccataatgtgaagaatcattcatgaggtcctgagataatgaattttcttgaacgggctatctcagcttgtgtagtttggtgttaccgtgttgttcagagtggtgtatgagatagagagtcgctaccagaacatttacccttcatgatacgtcttctctccgcaaatgctctatgcacctgtaacattcttgtgaggaactgttagccattgaaatctcctctgcatttccctccatttcacacttccaagtccgtttccagattcgagcagctctgtttaatttagatgttgtactcaagtttgtaaggtttggttgtgcagtgtagtaagatggggtagaagaaatctttgagtattttggaaatgagttcaattcagttgtcattgtcattcagaagcgattgattgtggttgtttagatcttcaaaaatagattgtttttagttacacaagttttcagaggatttgtagaaaaatctgttttactttgttgctttgctaactccagctttgagaaaacttcgttgtgtttgggacacagatggtaaaaggtagagttttatcttcccc

SEQ ID NO: 5324 - DNA, 1433 bp, Pennisetum glaucum
accctcctccgcctcctccatcctgccctcctccttcgtcccctcctcctcgtccgccgcgcggattcgttggaactcccctgagaatcggagctttttttttgactggtatagatagattgggtattggtcgatcgatcggttggttggtcggaggcggaggaaggagagggagggagggagggagggaggaggaggtgggggagatggcggcgtgccggggattcttcgagtgcctgctcaggctgctcaatttcgtcctcaccgtcgccggcctcgccatggtcggctacgggatctacctgctcgtcgagtggatgaagatatccaagggcggcggcggcgggggatcgcccgcggaggtgctcgtcctcggcaggccgttgctcggagccgtcgcgctcggtgacagcttcctcgataagctgcccaaagcatggtttatttatttgttcattggtgttggtgccatcgtcttcctcgtgtctctgtttggctgcatcggagcagggacaagaaacacctgctgcttgtgcttctacgctttcttggtcttgttattgatccttgctgaggctggagctgctgcattcattttctttgacaatagctggaaagatgtaattccaaaggacaagacacataactttgatgttatgtatgactttctgaagggcaactgggagattgcaagatgggttgctcttggtgttgttgtttttgaggcagtgcttttcctcttagctctggttgtcagggcaatgaacaaacctgctgagtatgacagtgatgatgaaatcatcgcaattggcagaagccctaccttgcggcagccattggtccatggacaaaatgctcctgccactggtgttcctgtcccaacacttgatcaacgtacaagtagacatgatgcatggagccaaaggatgcgagagaagtacggtctggacacgagccagttcacctacaacccttcagacccaagcaggtatcagcagaatggtgcgcctcaggctgaagaaaggggtcgttgcaccataatgtgaagaattcttcatcaggtcctctgagataatggatttcttgaatgggctatctcagcttgtgtagcttgatgttattgtgttggtcgtagtggtgcttgtgatagggagttgctaccataatgtttactctgcctgatacgtcttctctgcaaatgctcgatgcacctgtaattttcttgtgaatgatgaactgttagccattgacatctccttatcgggggttatttcttgtttgtattttgcccctttccacccttgcaaatccatttccagattgctcacctcgttttaatttcgatgctgtacttgagtttgtaagaattggttgtgctgggaagtaagattgattagaaggaatcactgattaattttgcaattagttcaaag

SEQ ID NO: 5325 - DNA, 1043 bp, Cynodon dactylon
gcgaattccgaagaggaattaggaacgggaagaacggcaccagggggaatcgcctgccagattggttctcgattgattgatcggaggaggaacagaggaggagatggcggcgtgcagggggttcttcgagtgcctgctcaagctgctcaatttcttcctcaccgccgccggcctcgccatggtcggatacgggatctatctgctcgtcgagtggatgaagatatccggcggcggcggggactcgccggcggatgtgctcgtcttcggccgaccgttgctcaccaccgtgcccctcggtgacgccggcgacttcttcgacaacctgcccaaagcatggtttatttatttgttcattggtgtgggagctatcgtcttcctcgtgtctctgtttggctgcatcggagcagggacaagaaacacctgctgcttgtgtttctatgccttcttggtcatattgttgatccttgctgaagctggagctgctgcattcattttctttgaccatagctggaaagatgtaattcctgtggacaagacacataactttgatgttatgtataactttatgaaggaaaattgggagattgcaagatgggttgccttgggtgttgttgtttttgaggcattgcttttcctgttagctctggttgtcagggcaatgaacaaacctgctgagtatgacagtgatgatgaaatcattatcggttatggccgaaaccctgggcgaagcacaagcattcggcaaccgttggtccattcccaaaatgttccagccactggggttcctgtgccacaacttgatcagcgtacaagcagacatgatgcatggagccaaaggatgcgagagaagtatggcttggacacgagccagttcacctacaacccttcagactcaagtaggtaccagcagaacggagcaacagcatctgaagaaaggagccgttgtaccataatgtgaataattcttctggatgtcatcctctgacgatggatcttcttgattggctttgttcggagtggtgtatgaaagagagctccgtatc

SEQ ID NO: 5326 - DNA, 1189 bp, Festuca arundinacea
aatcaatcaatccacagattggtccgagatggcggcgtgccgggggttcttcgagtgcctgctcaggctgctcaacttcgtcctcaccgtcgcgggcctcgccatggtcggctacggggtctacctgctggtggagtggatgaagatctccgggggcggcggcggcggcgcaccgccctctccggccccgccggtggagttgcttctgttcggccgcccgatgctcacggccgttgccctcggcgatggcgctagtatcttcgacaagctgcccagagcatggttcatctatttgttcattggtgttggtgccgttgtcttcctcgtctctctgtttggctgcatcggaacagggacaaggaatacttgttgcttgtgtttctattctttcttggtcctattgctgatccttgttgaggctggagctgctgcattcatattcttcgaccatagctggaaagatgtaattccagtggataagacacagaactttgatgaaatgtatgactttctcaaagataactgggagattgcaagatgggttgctcttggtgttgttgtttttgaggtattgcttttcttgttagctctgattgtcagggcaatgaacaaacctgctgagtatgacagtgatgatgaaatcattggaaatgcccgaaacagtggcatccgtcagcctcttatccattcccagaatgctccggctactggtgttcctgtcccaacgcttgatcaacgtgcgagcagaaacgatgcgtggagccaaaggatgcgagagaagtatggtctggacacgagccagtttacatacaacccatcagatggaaacagatatcagcaaaatggggcacctcaagctgaagaaaggagccgttgcaccataatgtgaaaagtctttcgcgatgttttccaaatcgatggttcttcttgaacaatctatctcagcttgcacagtttggttgtaccatgttgttgagagttgctgttccaaaaaagatcttgttcggagtgtgttatggaagtaagagtattgtaccttagtgcttatcttacccgcgtcttctaaacaatgctccatgcacctgtaatttcctgtgaatggggactgcccatcaaattgtcattacattacgtaacttaaaaaaaaaaaaaaaaacaaaaaaaaaaacaaaaaaacaaaaaacaaaac

SEQ ID NO: 5327 - DNA, 1500 bp, Oryza sativa
tgtaaactaggcccaaacaaaagtcgcaccataatcgtgtaaaatagaaaaaaaaatcccagcttaattgaccctatgatctgacgcccttctccaatcgatctctccccgtccatcccctcgatcgccctcgacccccctcgcccgccgcctccgccgatccccatccgtcgagcaccgccgccgccgccgccgccgccgccggcgtcccgccacatccccgcctcgctgcccgattatatcattattacaccttgctgcggcttttattgattcgtgaatcgtgatggcgtgccggggcttcttcgaatgcctactgaagctgctcaactttgtcctcacggtcgccggcctcgccatggtcggatatgggatttacctgctcgtcgagtggatgaggatttccggcggcggcggcggggcaccaccgtcgcccgcgccgcctgctgagttgcttatgtttggccgcccgatgctcacggctgttgccctaggtgacggtggcagtttcttcgacaagctccctaaagcatggttcatctatttgttcattggtgttggtgcaattatctttgtgatctctctgtttggttgcattggagctgcaacaaggaacacctgctgcttgtgttgttacgctttcttggtcatattgttgatccttgttgaggctggagctgctgcattcatattcttcgacgaaagctggaaagacgtaattccggtggacaagactgagaattttgatgtaatgtatgactttctcaaggaaaactgggagattgcaagatgggttgctcttggtagtgtcattttcgaggtattgcttttccttttagcactggttgtcagggcaatgaacaaacctgctgaatatgacagcgatgatgagatcatcgcaacttctagaagcactagcatccggcagccactaattcattcacaaaatgttcctgctactggtgttcctgttgcaacccttgagcaacgcgctagcagaaacgatgcatggagccagaggatgcgtgagaagtatggtctggacacaagccagttcacctacaatccgtcagacccaagcagatatcagcaaaatggtgcccctccagctgaagaaaggaaccgctgtgttatactgtgaaaaattactccatgacgtactccggtatggtgtttttttcatgggcaggcttgtgcagttggttgcaccgagtaattaattattcagagtgtcgtgtgtaaagagggctattgcattgtcgttttgacatattgatgtgttctctgaatgttctatgcaccggtaaatcttctcatgtggagaagctgctattagatacgccattttatttgcctgtttttgggtgtatcttttcgtatttttctctcgactagctttcatcctcaattcctcattgtacagccgttgtattcagtttggcgttataatcatgtttgtggtggttggtttgtgctatgaaggccagtattctttttgtt

SEQ ID NO: 5328 - DNA, 1492 bp, Triticum aestivum
caacggcgcaccgtccgtccgcactaggtggaccctttcgcacccgtccacccctaagcatctcccctctctttccctcgtcctcttcctccttcgatctccacggcaaaggaaaagaaaatcccgtattaatcaatttacagattgtgcctgggggcttgattagattgtttcgagatggcggcgtgccggggattcttcgagtgcctgctcaggctgctcaactttttcctcaccgtcgccggccttgccatggtcggctacgggatctacctgctcgtggagtggatgaggatctccggcggtggcgaaggggcaccgccgtctccggccccgccggctgagttgcttacgtttggccgcccgatgctcacggtcgtggcccttggagaaggaggcagtttcttcgacaagctacccaaagcatggttcatctatttgttcattggtgttggtgctgttatcttcatcgtttctctatttggctgcattggagcagggacaaggaatacgtgttgcttgtgttgttattctttcttggtcatattattaatccttgctgaggctggaggtgctgcattcatattctttgaccatagctggaaagatgtaattccagtggataagacacaaaactttgatgccatgtatgactttctgaatgaaaactggaagattgcaagatgggttgctcttggtgttgttgtttttgaggtattgcttttcttgttagctcttgctgtcagggcaatgaacaaacctgccgagtatgacagtgatgatgaaatcattggaactgctcgaagcactagcatccgtcagcctcttatccattcccagaatgctccggctactggtgttcccgtcccaacacttgatcaacgtgcgagcagaaatgatgcatggagccaaaggatgcgagagaagtatggtctggacacaagccaatttacttacaacccatcagatgcaaccagatatcagcaaaatggggcacctccagctgaagaaaggagccgttgcaccgtaatgtgaagatccttcacgacgttatccaaattgatggttcttgaacaggccatctcagcttgcacagtttggctataccgtgttgttcagagtggtgtatgaatagaggtctttttaccttaatgctcatcttatctgctgtcttctgaacaactccatgcacctgtaatttttgtgtgaacgagtattggccattgatatctcattatatttcatgttttcctcagattccttttgttggcattccatttttgccttgtttaccctttcaacttgtatcatgaactagagtaaatggtgaacttcgcctcgcagattggtcaatgtgtgcttgatgcggttggtgtttaatttgtttatgggtgagagagtgtgcctggtggagtatgtatgttgacaattgagatccgtgatggcaaattgtcactccatcgtcaattgttatctatctgttaatacaata

SEQ ID NO: 5329 - DNA, 1348 bp, Secale cereale
gactggtggacccttttgcacccgtccacctaagcatctcccctctctttccctcgtcctctttctccttcgatctccacagcaaagaaaaagaaaaccccgtattaatcaatttacagattgtgcctaggggcttgattagattgtttcgagatggcggcgtgccggggattcttcgagtgcctgctcaggctgctcaactttttcctcaccgtcgccggccttgccatggtcggctacgggatctacctgctcgtggagtggatgaggatctccggcggtggcggagggccaccgccgtctccggccccgccggttgagttgcttacgttcggccgcccgatgctcacggtcgtggcccttggagaaggcggcagtttctttgacaagctacccaaagcatggttcatctatttgttcattggtgttggtgctgttatcttcatcgtttctctatttggctgcattggagcagggacaaggaatacgtgttgcttgtgttgttattctttcttggtcatattattaatccttgctgaggctggaggtgctgcattcatattctttgaccatagctggaaagatgtaattccagtggataagacacaaaactttgatgccatgtatgactttctgaaagaaaactggaagattgcaagatgggttgctcttggtgttgttgtttttgaggtattgcttttcttgttagctcttgctgtcagggcaatgaacaaacctgctgagtacgacagtgatgatgaaatcattggaacttctcgaagcactagcatccgtcagcctcttatccattcccagaatgctgcggctactggtgttcctgtcccaacacttgatcaacgcgctagcagaaatgatgcgtggagccaaaggatgcgagagaagtatggtctggacacaagccaatttacttacaacccatcagatgcaaccagatatcagcaaaatggggcacctccagctgaagaaaggagccgttgcaccttaatgtgaagatccttcacgacgttatccaaattgatggttcttgaacaggccatctcagcttgcacagtttggctataccgtgttgttcagagtggtgcatgaatagaggtctttttaccctaatgctcttcttatctgctgtcttctgaacgactccatgcacctgtaatttttgtgtggacgagtgttggccatcaatatctcattatatttcatgttttcctgagattccttttgttggcattccatttttgctttgtttaccctttcaacttgtattatgaattagagtaaatggtgaactttgcctcgcaggttggccaaatgtgtgcttgatgcggtt

SEQ ID NO: 5330 - DNA, 1526 bp, Secale cereale
tcctacaggtctcgaccgccaacggcgcaccgtccgtccgcagtaggtggacccttttgcacccgtccacctaagcatctcccctctctttccctcgtcctctttctccttcgatctccacagcaaagaaaaagaaaaccccgtattaatcaatttacagattgtgcctaggggcttgattagattgtttcgagatggcggcgtgccggggattcttcgagtgcctgctcaggctgctcaactttttcctcaccgtcgccggccttgccatggtcggctacgggatctacctgctcgtggagtggatgaggatctccggcggtggcggagggccatcgccgtctccggccccgccggttgagttgcttacgttcggccgcccgatgctcacggtcgtggcccttggagaaggcggcagtttctttgacaagctacccaaagcatggttcatctatttgttcattggtgttggtgctgttatcttcatcgtttctctatttggctgcattggagcagggacaaggaatacgtgttgcttgtgttgttattctttcttggtcatattattaatccttgctgaggctggaggtgctgcattcatattctttgaccatagctggaaagatgtaattccagtggataagacacaaaactttgatgccatgtatgactttctgaaagaaaactggaagattgcaagatgggttgctcttggtgttgttgtttttgaggtattgcttttcttgttagctcttgctgtcagggcaatgaacaaacctgctgagtacgacagtgatgatgaaatcattggaacttctcgaagcactagcatccgtcagcctcttatccattcccagaatgctgcggctactggtgttcctgtcccaacacttgatcaacgcgctagcagaaatgatgcgtggagccaaaggatgcgagagaagtatggtctggacacaagccaatttacttacaacccatcagatgcaaccagatatcagcaaaatggggcacctccagctgaagaaaggagccgttgcaccttaatgtgaagatccttcacgacgttatccaaattgatggttcttgaacaggccatctcagcttgcacagtttggctataccgtgttgttcagagtggtgcatgaatagaggtctttttaccctaatgctcttcttatctgctgtcttctgaacgactccatgcacctgtaatttttgtgtggacgagtgttggccatcaatatctcattatatttcatgttttcctgagattccttttgttggcattccatttttgctttgtttaccctttcaacttgtattatgaattagagtaaatggtgaactttgcctcgcaggttggccaatgtgtgcttgatgcggttggtgtttaacttgtttatgggtgagagtgtgcctgatggagtatgtatgtcgacaattgagatccgtgatggacaaattgtcactccatcgtcaattgtcatctaatctgttaatactaatttaaccaaccaaaaaaa

SEQ ID NO: 5331 - DNA, 1604 bp, Triticum aestivum
attcggacgagggaagaaccgcgaatcgcgcgggctcacacgcttgctaaggtagctgtaggcgatggcttttctcaagtctggaggtctcgacccgccaacggcgcaccgtccatccgcagtaggtggaccctttcgcacccgtccaccactaagcatctcccctctctttccctcgtcctcttcttccttcgatctccacggcaaaggaaaagaaaatcccgtattaatcaatttacagattgtgcctggattgtttcgagatggcggcgtgccggggattcttcgagtgcctgctcaggctgctcaactttttcctcaccgtcgccggccttgccgtggtcggctacgggatctacctgctcgtggagtggatgaggatctccggcggtggcggaggggcaccgccgtctccggccccgccggctgagttgcttacgttcggccgcccgatgctcacggtcgtggcccttggagaaggaggcagtttcttcgacaagctacccaaagcatggttcatctatttgttcattggtgttggtgctgttatcttcgtcgtttctctatttggctgcattggagcagggacaaggaatacgtgttgcttgtgttgttattctttcttggtcatattattaatccttgctgaggctggaggtgctgcattcatattctttgaccatagctggaaagatgtaattccagtggataagacacaaaactttgatgccatgtatgactttctgaatgaaaactggaagattgcaagatgggttgctcttggtgttgttgtttttgaggtattgcttttcttgttagctcttgctgtcagggcaatgaacaaacctgccgagtatgacagtgatgatgaaatcattggaactgctcgaagcactagcatccgtcagcctcttatccattcccagaatgctccggctactggtgttcccgtcccaacacttgatcaacgtgcgagcagaaatgatgcatggagccaaaggatgcgagagaagtatggtctggacacaagccaatttacttacaacccatcagatgcaaccagatatcagcaaaatggggcacctccagctgaagaaaggagccgttgcaccgtaatgtgaagatccttcacgacgttatccaaattgatggttcttgaacaggccatctcagcttgcacagtttggctataccgtgttgttcagagtggtgtatgaatagaggtctttttaccttaatgctcatcttatctgctgtcttctgaacaactccatgcacctgtaatttttgtgtgaacgagtattggccatcgatatctcattatatttcatgttttcctcagattccttttgttggcattccatttttgccttgtttaccctttcaacttgtatcatgaactagagtaaatggtgaacttcgcctcgcagattggtcaatgtgtgcttgatgcggttggtgtttaatttgtttatgggtgagagagtgtgcctggtggagtatgtatgttgacaattgagatccgtgatggcaaattgtcactccatcgtcaattgttatctatctgttaatacaatacaattaaaagacatattttttattgg

SEQ ID NO: 5332 - DNA, 1392 bp, Lolium multiflorum
aacaaggaaaggaccacccaagcaatcacggccgtccatcgcagccgacaacggcgccccgtccgaccgctctgccacctaagcaactcgcctctcgtcccctcgtcctcttcctccttccacccatctcacaaacttctcttctctcctccaaaacaacagccagccggggtccattaatcaaatcaatccacagattggtccgagatggcggcgtgccgggggttcttcgagtgcctgctcaggctgctcaacttcgtcctcaccgtcgcgggcctcgccatggtcgggtacggcgtctacctgctggtggagtggatgaagatctccgggggaggcggcggcggcgcaccgccctctccggccccgccggcggagttgcttctcttcggccgtccgatgctcacggccgttgccctcggcgatggcggtagtatcttcgacaagctgcccagagcatggttcatctatttgttcattggtgttggtgccgttgtcttcctcgtctctctgtttggctgcattggaacaggaacaaggaatacttgttgcttgtgtttctattctttcttggtcctattgctgatccttgttgagtctggagctgctgcattcatattcttcgaccatagctggaaagatgtaattccagtggataagacacagaactttgatgaaatgtatgactttctcaaagataactgggagattgcaagatgggttgctcttggtgttgttgttttcgaggtattgcttttcttgttagctctgattgtcagggcaatgaacaaacctgctgagtatgacagtgatgatgaaatcattggaaatgcccgaaacagtagcatccgtcagcctcttgtccattcccagaatcctccggctaatggcgttcctgtcccaactcttgatcaacgcgcgagcagaaacgatgcatggagccaaaggatgcgagagaagtatggtctggacacgaaccagtttacatacaacccatcagatggaaccagatatcagcaaaatggggcaccagcagctgaagaaaggagccgttgcaccataatgtgaaaaatctttcgcaatgttgtccaagtcgatggttcttcttgaacaatctatctcatcttgcacagtttggttgtaccatgttcagagtggtgtatggagtagaggtattgtaccttagttattatcttacccgccgtcttcagatgaaatcctccatgcacctgtaatttccttgtgaatgaggactgcccagcaacttgtcattatattccgagcttatcggaggttccttttgtttgcattatatttttccttgataggccttttaaattgtattatgaacgtggagcatttatgttaattttgacattgtaatcatgttta

SEQ ID NO: 5333 - DNA, 1392 bp, Pseudoroegneria spicata
cacccttttgcacccgtccacctaagcatctcccctctctttccctcgtcctcttcctccttcgatctccacagcaaaggaaaagaaaatcccgtattaatcaatttacagattgtgcctgggggcttgattagattgtttcgagatggcggcgtgccggggattcttcgagtgcctgctcaggctgctgaactttttcctcaccgtcgccggccttgccatggtcggctacgggatctacctgctcgtggagtggatgaggatctccggaggtggcggaggggcaccgccgtctccggccccgccggctgagttgcttacgttcggccgcccgatgctcacggtcgtggtccctggagaaggaggcagtttcttcgacaagctacccaaagcatggttcatctatttgttcattggtgttggtgctgttatcttcatcgtttctctatttggctgcattggagcagggacaaggaatacgtgttgcttgtgttgttattctttcttggtcatattattaatccttgctgaggctggaggtgctgcattcatattctttgaccatagctggaaagatgtaattccagtggataagacacaaaactttgatgccatgtatgactttctgaaagaaaactggaagattgcaagatgggttgctcttggtgttgttgtttttgaggtattgcttttcttgttagctcttgctgtgagggcaatgaacaaacctgctgagtatgacagtgatgatgaaatcattggaactactcgaagcactagcatccgtcagcctcttatccattcccagaatgctccggctactggtgttcccgtcccaacaattgatcaacgtgcgagcagaaatgatgcgtggagccaaaggatgcgagagaagtatggtctggacacaagccaatttacttacaacccatcagatgcaaccagatatcagcaaaatggggcacctccagctgaagaaaggagccgttgcaccgtaatgtgaagatccttcacgacgttatccaagttgatggttcttgaacaggccatctcagcttgcacagtttggctataccgtgttgttcagagtggtgtatgaatagaggtcttttaaccttaatgctcatcttatctgctgtcttctgaacaactccatgcacctgtaatttttgtgtgaacgagtattggccatcaatatctcattatatatcatgttttcctgagattctttttgttggcattccatttttgccttgtttaccctttcaacttgtattatgaactagagtaaatggcgaactttgcctcgcaggttggccaatgtgtacttgatgcggttggtgtttaatttgtttatgggtgagtgtgcctggtagagtatgtatgtcgaca

SEQ ID NO: 5334 - DNA, 1289 bp, Avena sativa
cctccttcaatctccacaacttctcttctcgcacgcaggaaaaggaaaataaaaaaggattaatcaatcggcagattgcgtctgggggggtttcattgtttcgagatggcggcatgccgggggttcttcgagtgcctgctcaggctgctcaactttgtcctcaccgtcttgggccttgccatggttggctacggggtctacctgctgctggagtggatgaagatttctggaggcggcagcggggcaccgccctctccggccccgccggctgagttgcttctgttcggccgcccgatgctcacggccgttgccctcagcgatggcggtagtttcttcgacaagctacccagagcatggttcatctatttgttcatcggtgttggtgttgttgtctttctcgtctctctatttggctgcattggagcagggacaaggaatacttgttgcttgtgttgttattctttcttggtcctattgttgatccttgttgaggctggagctgctgcattcatattcttcgaccgtagctggaaagatgtaattccagtggataagacacagaactttgatgaaatgtatgactttctgaaacataactgggagattacaagatgggttgctcttggtgttgttgtttttgaggtattgcttttcttgttagctctgattgttagggcaatgaacaaacctgctgagtatgacagtgatgatgaaatcattggaactgcccgaaacaatagcatccgtcagcctcttgtccattcccagaatgctccggctactggtgttcctgtcccaacacttgaccaacgtgcgagcagaaatgatgcatggagccaaaggatgcgagagaagtatggtctggacacgagccagtttacgtacaacccatcagatggaaccagatatcagcaaaatggggcacctccagctgaagaaaggagccgttgcaccataatgtgaaaaacccctcaggatgttgtccagtggttcttcttgaacaatctatgtcagcttgcacagtttggttgtaccatgttgctcagagtggtgtatggagtagaggtattgtaccttagtgtttatcttggctgccgtcttctgaacaaatgatccgtgcacctgtaatttccttgtgaatgaggactggccattaacttgtcattatattccgacattgtcggaggttgtttttgtttgcactatatattttttccttattatcccatttaaattgtatcttttgacattgtaatcatgtttatagttcttttggtaagaatggtggt

SEQ ID NO: 5335 - DNA, 1360 bp, Avena sativa
gccgacaacggcgccccgtccgaccgctctgtgggcctgggccccacacgtccacctaagcagctcgcctctcgtcccctcgcatcttcctccttcaatctccacaacttctcttctcgcacgcaggaaaaggaaaataaaaaaggattaatcaatcggcagattgcgtctggggggtttcattgtttcgagatggcggcatgccgggggttcttcgagtgcctgctcaggctgctcaactttgtcctcaccgtcttgggccttgccatggttggctacggggtctacctgctgctggagtggatgaagatttctggaggcggcagcggggcaccgccctctccggccccgccggctgagttgcttctgttcggccgcccgatgctcacggccgttgccctcagcgatggcggtagtttcttcgacaagctacccagagcatggttcatctatttgttcatcggtgttggtgttgttgtctttctcgtctctctatttggctgcattggagcagggacaaggaatacttgttgcttgtgttgttattctttcttggtcctattgttgatccttgttgaggctggagctgctgcattcatattcttcgaccgtagctggaaagatgtaattccagtggataagacacagaactttgatgaaatgtatgactttctgaaacataactgggagattacaagatgggttgctcttggtgttgttgtttttgaggtattgcttttcttgttagctctgattgttagggcaatgaacaaacctgctgagtatgacagtgatgatgaaatcattggaactgcccgaaacaatagcatccgtcagcctcttgtccattcccagaatgctccggctactggtgttcctgtcccaacacttgaccaacgtgcgagcagaaacgatgcatggagccaaaggatgcgagagaagtatggtctggacacgagccagtttacgtacaacccatcagatggaaccagatatcagcaaaatggggcacctccagctgaagaaaggagccgttgcaccataatgtgaaaaacccttcaggatgttgtccagtggttcttcttgaacaatctatgtcagcttgcacagtttggttgtaccatgttgctcagagtggtgtatggagtagaggtattgtaccttagtgtttatcttggctgccgtcttctgaacaaatgatccgtgcacctgtaatttccttgtgaatgaggactggccattaacttgtcattatattctgacattgtcggaggttgtttttgtttgcactatatattttttccttattatcccatttaaattgtatcttttgacattgtaatcatgtttatagttcttt

SEQ ID NO: 5336 - DNA, 1196 bp, Leymus cinereus x Leymus triticoides
agattgtgcctggggcttgattagattgttttgagatggcggcatgccggggattcttcgagtgcctgctcaggctgctcaactttttcctcaccgtcgccggccttgccatggtcggctacgggatctacctgctcctggagtggatgaggatctccggcggtggcggaggggccccgccgtctccggccccaccggctgagttgcttatgttcggccgcccgatgctcacggtcgtggcccttggagaaggcggcagtttcttcgacaagctacccaaagcatggttcatctatttgttcattggtgttggtgctgttatcttcatcgtttctctatttggctgcattggagcagggacaaggaatacgtgttgcttgtgttgttattctttcttggtcatattattaatccttgctgaggctggaggtgctgcattcatattctttgacgatagctggaaagatgtaattccagtggataagacacaaaactttgatgccatgtataactttctgaaaaaaaactggaagattgcaagatgggttgctcttggtgttgttgtttttgaggtattgcttttcttgttagctcttgctgtcagggcaatgaacaaacctgctgagtatgacagtgatgatgaaatcattggaactgctcgaagcactagcatccgtcagcctcttgtccattcccagaatgctccggctactggtgttcccgtcccaacacttgatcaacgtgcgagcagaaatgatgcgtggagccaaaggatgcgagagaagtatggtctggacacaagccaatttacttacaacccatcagatgcaaccagatatcagcaaaatggggcacctctagctgaagaaaggagccgttgcaccgtaatgtgaagatcctccacgacgttatccgaattgatggttcttgaacagaccgtctcagcttgcacagtttggctataccgtgttgttcagagtggtgtatggaaatatggaatagaggtctttttaccttaatgctcatcttatctgctgtcttctgaacaactccatgtacctgtatttttcttgtgaacgagtattggccatcaatatctcattatatttcatgttttcctgagattcgttttgttggcattccattttgccttgtttaccctttcaacttgtattatgaactagagtaaatggtga

SEQ ID NO: 5337 - DNA, 1269 bp, Avena sativa
cctccttcaatctccccaacttctcttctcgcacgcaggaaaaggaaaataaaaaaggattaatcaatcggcagattgcgtctgtgggggtttcattgtttcgagatggcggcatgccgggggttcttcgagtgcctgctcaggctgctcaactttgtcctcaccgtcttgggccttgccatggttggctacggggtctacctgctgctggagtggatgaagatttctggaggcggcggcggggcaccgccctctccggccccgccggctgagttgcttctgttcggccgcccgatgctcacggccgttgccctcagcgatggcggtagtttcttcgacaagctacccagagcatggttcatctatttgttcatcggtgttggtgttgttgtctttctcgtctctctatttggctgcattggagcagggacaaggaatacttgttgcttgtgttgttattctttcttggtcctattgttgatccttgttgaggctggagctgctgcattcatattcttcgaccgtagctggaaagatgtaattccagtggataagacacagaactttgatgaaatgtatgactttctgaaacataactgggagattacaagatgggttgctcttggtgttgttgtttttgaggtattgcttttcttgttagctctgattgttagggcaatgaacaaacctgctgagtatgacagtgatgatgaaatcattggaactgcccgaaacaatagcatccgtcagcctcttgtccattcccagaatgctccggctactggtgttcctgtcccaacacttgaccaacgtgcgagcagaaatgatgcatggagccaaaggatgcgagagaagtatggtctggacacgagccagtttacgtacaacccatcagatggaaccagatatcagcaaaatggggcacctccagctgaagaaaggagccgttgcaccataatgtgaaaaacccctcaggatgttgtccagtggttcttcttgaacaatctatgtcagcttgcacagtttggttgtaccatgttgctcagagtggtgtatggagtagaggtattgtaccttagtgtttatcttggctgccgtcttctgaacaaatgatccgtgcacctgtaatttccttgtgaatgaggactggccaataacttgtcattatattccgacattgtcggaggttgtttttgtttgcactatatattttttccttattatcccatttaaattgtatcttttgacattgtaatcatgtttatagtt

SEQ ID NO: 5338 - DNA, 1234 bp, Avena sativa
aaaggattaatcaatcggcagattgcgtctggggggtttgaccagattgtttcgagatggcagcgtgccgggggttcctcgagtgcctgctcaggctgctcaactttgtcctcaccgtcttgggccttgccatggttggctacggggtctacctgctgctggagtggatgaagatctctggaggcagcggcggggccccgccgtctccggccccgccgtctgagttgcttctgttcggccgcccgatgctcacggccgttgcactcggcgatggcggtagtttcttcgacaagctacccagagcatggttcatctatttgttcatcggtgttggtgttgttgtctttctcgtctctctatttggctgcattggagcagggacaaggaatacttgttgcttgtgttgttattctttcttggtcctattgttgatccttgttgaggctggagctgctgcattcatattcttcgaccgtagctggaaagatgtaattccagtggataagacacagaactttgatgaaatgtatgactttctgaaacataactgggagattacaagatgggttgctcttggtgttgttgtttttgaggtattgcttttcttgttagctctgattgttagggcaatgaacaaacctgctgagtatgacagtgatgatgaaatcattggaactgcccgaaacaatagcatccgtcagcctcttgtccattcccagaatgctccggctactggtgttcctgtcccaacacttgaccaacgtgcgagcagaaacgatgcatggagccaaaggatgcgagagaagtatggtctggacacgagccagtttacgtacaacccatcagatggaaccagatatcagcaaaatggggcacctccagctgaagaaaggagccgttgcaccataatgtgaaaaacccttcaggatgttgtccagtggttcttcttgaacaatctatgtcagcttgcacagtttggttgtaccatgttgctcagagtggtgtatggagtagaggtattgtaccttagtgtttatcttggctgccgtcttctgaacaaatgatccgtgcacctgtaatttccttgtgaatgaggactggccattaacttgtcattatattctgacattgtcggaggttgtttttgtttgcactatatattttttccttattatcccatttaaattgtatcttttgacattgtaatcatgtttatagttcttttggtaagaat

SEQ ID NO: 5339 - DNA, 2068 bp, Zea mays
agcgtaccagtggcgcagaagtcgaccggcatcacagttcacatccgacaactaatcagtccatcgcgttcgcgtccacggtcagttgccggcgccatccctgcccctgctcacccctccccgcctggcgtccacgatcggcgacggcatgtctcgcgacgcccatctcggagtcggagtcgagggagacgcagccgaggaaaagaacgccgccgctgacggcggcgaaggagtcgggttcaggtcaggcggcggcggcgggcacaagctgtccctggtgccgctcatcttcctcatcttcttcgaggtggcggggggtccctacggcgcggagccggcggtgcaggccgcgggcccgctgtacgcgctgctgggcttcctcatcttccccttcatctgggccatcccggaggcgctggtcaccgcggagctctccacggcgatgccgggcaacggcggcttcgtgctgtgggccgaccgcgccttcggcccgttctcgggctccctcatgggcacctggaagtacgtgtccagcgccatcaacggcgccgcgttcccggcgctgtgcgccgactacctggcccgcgtcgcgcccgccgtgtccgggggcggggcccgcgtcgccaccatcgtcgccttcaacgtggcgctcacgttcgtcaactacacggggctcaccgtcgtgggctggtccgcggtggggctcggcgtcgcctcgctctcgccgttcctggtcatgtccggcgccgcgctgcccaagatccgcccgcggcggtggcgcgtcgtcgccgccgagagggactggaagctcttcttcaacacgctcttctggaacctcaactactgggacagcgtcagcaccatggccggcgaggtggagcggcccgggaagacgctccccaaggcgctcgtgtccgccgtctccatgacgtcgctcggctacctgctgccgctcatggcggccaccggcgccatcgacgtcgcgcctgaaagctgggggaacggcttcttcgcagatgccgcaggcatgatcggtgggcgttggctcaagtactggatagaggtgggcgcggtgctgtcctccatcggcctctactcggcgacgctgagcagcgcggcgttccagctgctggggatggcggacctgggcctgctcccgcgcgcattcgcggcgcgcgcccccgtcttccgcacgccctgggtcagcatcttggccaccagcgccatcatcctcggcatgtccttcctcagcttcaacagcatcgtggcggccgccaacttcctctacagcctgggcatgctcctcgagttcgccgccttcgtctggctccgcgtcaagcggcccgcaatggcccgcccgtaccgcgtccccgcgcgcctgcccgccgccgtcgcgctctgcctcgtcccctccgcgttcctcgtcttcgtcatggccatcgccggctggaaggtgtacgccatcagcgccgcgttcaccgccgcgggggtggccgtgtactacctcatgcgcttctgcaaggccagggggtgcctcaggttcagcgacggcggcgaccaagggaccacggcggtgtaccaggacggcagcaacgcgggcgatgtctgaatgatagatagactctttgtgccaaaagcactatacgaatttgtattgtaggctagtgttttgtgattaggaattagtggttccggggaaaaggattcatgctccctccagtttctgctcgtgacatcttgcttacgtgtgtgctccaactctccatacttgttggcaacatcaaagacgactccctcaagtctgacgtaactgtttggttgaacgttgaaatggtgtgataaccatttcgcggtcgcatatatacccgtactaatgtgcagatgctgacttagggcctgtttgtttaaccctatggattatataatctagattatttttggaggattatataatctggattatataatctgtattatataatctgagtagtcccgtttgtttatccagattatttgagttgttaataggattcttttgtatgatgaagacaataatgtcaatggtggg

SEQ ID NO: 5340 - DNA, 3071 bp, Panicum virgatum
gtaatttgtgctcaaacaattcgacgtgattccatttcccatttcctttttttattcgtctaacttgtttcctgaccattttggtttcctctgcacacctaacgtactgcaggcataggcgcaggagaaggaagaggtagcgttagcgacgccaccacccacgcggacggcagtaatggacggccaccacttgccgccctcccaccaatcgccgccggcgcagccggagcggcgcggcagcttcaactacgacatcgagagcacggacgccgcatggcgcggcgcgcacacggcgtcggaggcgctgatgcggtatgacgacgacggcacgcgggagccgctgctgcggaagcgcaccacgaacactacctcccagatcgccatcgtcggcgccaacgtctgccccatcgagagcctcgactacgaaattgtggaaaacgaccttatcaagcaagattggcgatcaagaaagaagaagcaaatattccagtatattgttctgaaatggtccttagttcttctcattggcttgtgtacgggacttgttggcttcttcaacaaccttgcagttgaaaacattgctgggttcaaactgttgctcacaggtgatctaatgctccagaagaggtacttcacagcctttttggcatatggaggctgcaatttagtcttggcggccagtgctgcagcaatctgcgcttacatagctcctgctgctgctgggtctggtatccctgaagttaaagcataccttaatggaattgatgcttacgctatactagctcctagtacactctttgtgaagatatttggttcaatacttggagtttcagctggatttgtacttggaaaggaaggtccgatggtacatacaggagcatgcattgccaacttgcttggtcagggggggtcacgcaagtatcatcttacatgtaactggcttagatattttaagaatgacagagataggcgggatttgattacttgtgggtctgctgctggtgttgcagcagcattccgtgcacctgttggtggtgtgctctttgctcttgaggaagcagcatcatggtggcgaagtgctctcctgtggagaacattctttacaactgctgttgttgctgttgtattgaggggcttgatcgggttctgccgtagtggaaaatgtggtctctttggtcaaggggggttgattatgtttgatcttagcgcaaccatacctacttacagtacccaagatatcgttgcaattattgttcttgggatcattggaggggtctttggaggcctgttcaactttctcttggataggattctccgcgcctacagttttatcaatgagaaaggtgctccatacaagatccttcttacaatcacaatatcgattatcacatcagcatgctcctatgggctcccttggctcgctccatgcactccatgcccagctgatgccgtggagcaatgcccaaccatcggacgctctgggaattataagaattttcagtgcccaccaggtcactacaatggtcttgcatcacttttcttcaacacaaatgatgatgccatccgcaatctgttcagcagtggtaccgagaaagaattccacatgtccactctttttgtatttttcactgccatttactgccttggtcttgtgacatacggtattgctgtcccatccggtcttttcatccctgttatacttgctggggctacatatgggcgcatagtggggacactgcttggtccaatatcagaccttgatcctggactctttgcacttctcggtgcggcatctttccttggtggaacaatgaggatgaccgtctcagtttgcgtgatacttctagagctcacaaatgacctccttatgctcccattggtcatgctcgttcttctaatatcgaagactatagccgacagcttcaacaaaggagtttatgaccagatcatagtgatgaaaggcatgccgttcctggaggctcatgccgaaccatacatgaggcacttggttgctggtgatgttgtatctgggccactgatctccttttcaggcgttgagagagtggggaacattgttcaggcgttgaggatcacaggccacaatggatttccagtggtggatgaaccacctctatcagaggctccagagctcgttggactcgtgcttaggtcccatctgctggtcctactgaaaggcaagggcttcatgaaagataaggtgaaaaccagtggtagcttcgtgctgaaaaagtttggtgcctttgattttgccaaggctgggtctggaaaaggtccgaagattgaggacctggatttcacagatgaggaaatggatatgtatgttgatctccatccaattacaaatacctcgccgtacacagtggttgagaccatgtcacttgcgaaggctgcggtcctttttagggcactaggattgagacacctgttggttgtgccaaagaccccagggagaccacctatcgttggaatcctgacgaggcacgatttcatgccggagcacattcacgagctgttcccgaatctccacaagtcacactgagcaagtattcagttgatgtttgtttgctatttcttgccttgtagcttagctgtatgcagagaaagctgccttgtgcaatttggtgcccccaactggcattttgtttgcccttttgtatttattacagagtactccaaaatcttaaaaccgtggaataatattgttttcgttgtaaagagctgatcccccacaccagcaattgaatggatttttgcagcccatcaattgtagattttcaacaataacctggcaatatagctgtgtgcttctcacgctcctgcacggagctgaggaccggcccttcctttgttctgcccccttacaactctgtcaaattcttttttttttaagacgaactctgtcaaattctgttagtcttttttgtgcacaaaattcagagtttaagtactttgttgtgcatgttaactgacacgttgatctccagagttaaagtatctgtcacaaaaatgctgttgcatgttgagcaaacggatcggctgtcgacatgccg

SEQ ID NO: 5341 - DNA, 2877 bp, Panicum virgatum
gccaggaagtcgccgccgacgcgggagcgaggagccgacccgcgcgcgcgcgcgcccgggtggttggttgatccctcggcctccatccatgcccgtggcggccggaccagttcgtccgtcgagccgggatcgctgctgctaagaggcgcagaaggaagcggaagcgttagccacgccaccacccacgcggacggcagtaatggacggcaaccacttgcccccctcccaacaaccgccgccggcgcagccggagcggcgcagcagcttcaactacgacatcgagagcacggacgccgcatggcgcggcacgcacacggcgtcggaggcgctgatgcggtatgacgacgacggcccgcgcgagccgctgctgcggaagcgcaccacgaacactacctcccagatcgccatcgtcggcgccaacgtctgccccatcgagagccttgactacgaaattgtggaaaacgaccttatcaagcaagattggcgatcacgaaagaagcagcaaatattccagtatattgttctgaaatggtccctagttcttctcattggcttgtgtacgggacttgttggcttcttcaacaaccttgcagttgaaaacattgctgggttcaaactgttgctcacaagtgatctaatgctccagaagaggtacttcacagcctttctggcatatggaggctgcaatttagtcttggcagccagtgctgcagcaatctgcgcttacatagctcctgctgctgctgggtctggtatccctgaagttaaagcataccttaatggaattgatgcttacgctatattagctcctagcacactctttgtgaagatatttggttcaatacttggagtttcagctggatttgtacttggaaaggaaggtccgatggtacatacaggagcatgcattgctaacttgcttggtcaaggggggtcacgcaagtaccatcttacatgtaactggctcagatattttaagaatgacagagataggcgggatttgattacttgtgggtctgctgctggtgttgcagcagcattccgtgcacctgttggtggtgtgctctttgctcttgaggaagcagcatcatggtggcgaagtgctctcctatggagaacattttttacaactgctgttgttgctgttgtattgaggggcctgatcgggttctgccgtagtggaaaatgtggtctctttggtcaaggagggttgattatgtttgatcttagtgcaaccatacctacttacagtgctcaagatgtcgttgcaattattgttcttgggatcatcggaggggtctttggaggcctgttcaactttctcttggataagattctccgtgcctacagttttatcaatgagaaaggtgctccatacaagatccttcttacaatcacaatatcgattatcacatcagcatgctcgtatgggctcccttggctcgctccatgcactccatgcccagctgatgctgtggagcaatgcccctccattggacgctctacaaactataagaattttcagtgcccaccaggtcactacaacggtcttgcatcacttttctttaacacaaatgacgatgccatacgcaatctgttcagcagtggtaccgagaaagaattccaaatgtcaactctttttgtctttttcactgccatttactgccttggacttgtgacgtacggtattgctgtcccatctggtcttttcatccctgttatacttgctggggctacatatgggcgcatagtggggacgctgcttggtccaatatcagaccttgatcctggactctttgcacttctcggtgcggcatctttccttggtggaacaatgaggatgaccgtctcagtttgtgtgatacttctggagctcacaaatgacctccttatgctaccgttggtcatgctcgttcttctgatatcgaagactatagcggacagcttcagcaaaggagtttatgaccaaatcatagtgatgaaaggaatgccgttcctggaggctcatgccgaaccatacatgaggcacttggttgctggtgatgttgtatctggaccactgatctccttttcaggcgttgagagagtgggtaacattgttcaggcgttgaggatcacaggccacaatggatttcctgtggtggatgaaccacctctatcagaggctccagagctcgttggactcgtgcttaggtcccatctgctggtcctgctgaaaggcaagggcttcatgaaagataaggtgaaaaccagtggtagcttcgtgctgaaaaagtttggtgcctttgattttgccaaggctgggtctggaaaaggtccgaagatcgaggacctggatttcacagatgaggaaatggatatgtatgttgatctccatccaattacaaatacctcgccgtacacagtggttgagaccatgtcactcgcgaaggctgcggtccttttcagggcactaggattgagacatctgttggttgtgccaaagaccccagggagaccacctatcgtcggaatcctgacgaggcacgatttcatgccggagcacattcacgggctgttcccgaatgtccacaagtcacactgaggaagtatcaagcatatgttttgtttgctatttcttgccttgtagcttagctgtatgcagagaaagctgccttgtgcaatatttggtgcccccatctggcattttgtttgccatctgtcattttgttttcccttttgtatttattacagagtactccaagatcttaaaactgtggaataatattgtattcgttgtaaagagctgatctcacacatcagcaattgaatggatttttgcagtccatcttatagattttcaataataacctggcaaacatactagtgttgtcttca

SEQ ID NO: 5342 - DNA, 3446 bp, Sorghum bicolor
atgcatggcatttgtttaactgtagctcccacatttatcacctacggtattcggccggtgagccgggcgtcccacgtgtccgcgtccggactgggctccccagcatcaggttgcctgacgcgaggttcgaccgttcgactcgagcgggtgcgagtgcgaccaaccgcgaaggccgagcgagagcccacacgagacgacgagcgcgggacgatctcgatcggactgcacgggtggcgtgcgccctgcccgcccctgcgccgcatcgaatccacctcatttaaagcgagcgaagcgagcgcggcgtgcgctctccgtcccaccatctctcgcaccgcccccatcatcctcttctcttctctttgtatttggattggatttggaagcttctccagttgtccaggcgacgcacgcccacccctcacctggtgtctgccgtgcggggctctcggcggcgagcgggccgagctcgacggaggagaaagcggccaactgccggcggagcgagcgcgtggagttccccgacggatcaggaagaggatctcggtcgcggagaggacctggcggccggagcagttcgtccgtccagccgggattgctagcagtgcaggcagaagcgcaggaggaggagcgcgccgcggcagcgtgagcgacgccaccacccaagcggacgggcggtaatggacgccgcccaccactcgccgccggacgcgcagccggagaggcacggcagcttcaactacgacatcgagagcacggacggcccgtggcgcggcgcgggggcggggcaggaccggtcgtccgaggccctgctgcggtacgacgaccggtacgacgacgacgggccccggcagccgctgctgcggaagcgaaccatgaacaccacctcccagattgccatcgtcggcgccaacgtctgccccatcgagagcctcgactacgaaattgtggaaaatgaacttttcaagcaagattggcgatcaagaaagaagaagcagatattccagtatattgttctcaaatggtccttggttcttcttattggcttgtgtactggacttgttggcttcttcaataaccttgcagttgaaaacattgctgggttcaaactgttgcttacaagtgatctaatgctcaagcataggtacttcacagcatttctggcatatggaggttgcaatctagtcttggcagctactgctgcagcgatctgcgcttacatagcacctgctgctgctgggtctggtatccctgaagttaaagcataccttaacggagttgatgcttatgctatattagctccaagtacactgtttgtgaagatatttggttcaatacttggagtttcagctggatttgtacttggaaaggaaggtcccatggtacatacaggagcatgcattgccaacttacttggtcaaggggggtcacgcaagtaccatctgacatgtaactggctcagatactttaagaatgatagagataggcgggatttgattacttgtggctctgctgctggggttgcagcagcattccgtgcgcctgttggtggtgtgctctttgctcttgaagaagcagcatcatggtggcgaagtgctcttctgtggagaacattctttacaactgctgttgttgctgttgtgttgaggggcctgatcgagctctgtcgtagtggaaaatgtggtctctttggtcaaggagggttgattatgtttgatcttagctcaaccgtcccgagttacagtacccaggatatcattgcaattattgtccttggaataattggtggggtattcgggggcctgttcaactttctcttggataggattctccgagcctatagttttatcaacgagaaaggtgctccatacaaaattcttcttaccattacaatatcgatcatcacatcagcatgctcttatgggctaccttggcttgctccatgcactccatgccctgctgatgcggtggaggaatgcccgaccataggccgctctggaaattttaagaattttcagtgcccaccgggctattacaatggtcttgcatcattattcttcaacacaaatgatgatgccatccgcaatctattcagcagtggcaccgagaatgagttccacatgtccactcttttcgtattcttcactgctatttactgccttggccttgtgacatacggtattgctgttccatctggtctctttatccctgttatacttgctggggctacatacgggcgcatagtggggacccttcttggcccgatatcagaccttgatcctggactatttgcacttcttggtgcggcatctttcctcggtggcacaatgaggatgactgtatcagtctgtgtgatacttctggagctcaccaatgacctccttatgctcccgttagtcatgctcgttcttctgatatcgaagactatagccgacagctttaacaaaggggtttatgatcagattgtagtgatgaaaggtttgccattcctggaagctcatgccgaaccacacatgaggcacttggttgctggcgatgttgtgtctgggccactgatctccttttcaggcgtcgagagagtggggaatatcgttcaggcgttgaggatcacaggccacaacggatttccagtggtcgatgagccacctctgtcagaggctccagaacttgttgggcttgtgcttagatcccatctgctggtcttgttgaaaggcaagggcttcatgaaagagaagatgaaaaccagcggtagcttcgtgctgcaaagatttggtgccttcgattttgccaagcccggctcaggaaaaggcctgaagattgaggacctggacttcactgatgaggaaatggacatgtacgtcgatctccatccaatcacaaacacatcgccgtacacggtggttgagaccatgtcacttgcaaaggccgccgtccttttccgggcactgggactaaggcacctgctcgttgtgccaaagaccccagggagacctccaattgttggaatcctgacgaggcacgatttcatgccggagcatattcatgggctgttcccaaatatacacaagtcgcactaatggagcactcattcagtaccatattttctttgccgtcgtcgccttgtagctagctgtacgaaaacgaagctgcttttgtccaatatatttgctatcagccatctgccttttgttttccattttattctcttctggagtactccgaaatcatataatcactgaataatattgtatttgttgtaaagagcctgtccccatgcaataatctggcagtactccagaaggaacttattctacgttccattttgttttcttgtagagcatatcaatatgttgatttgcaacctgcaaaaaaaagaccatgttggtttgcaaccaaagatattatgctttcgtgcagaagagagatgtctaattcccaaaccttgtctg

SEQ ID NO: 5343 - DNA, 3046 bp, Zea mays
cacgcccacatcctctcttcttttctccccctcccgcttccttgtttcccctcgttctatttggattggaagcttctccgcggccaaggtcacgcacacccacccacctggacctggtgcccgccgtgtaggcctctcggccttcgtcgtcctccagccccaggcggaacacgaggcggcggacgtacgggctcgacggaggcgagctgccggccgagcgaccaggaagacgcattcagaagaggacatcgatcgatcgcggagagttccccgggtagctgacgacgatccatgcttgtggcggccggatcagttcgcccgtccaaccgggattgctaggcagaagcgcaggacggggcagcggcagcgtgagcgacgccaccacccaagcggacggcaataatggacgctaaccactcgccgccggcgcagccggagaggaatcatggcagcttaaactacgacatcgagagcacggacggcacgtggcgcggcgcgggggcgtggcaggagcaggacccatcgtcggaggccctgatgcggtacgacgacgacgggccccgggagccgctgctgcgaaggcgcaccatgaacaccacctcccagattgccatcgtcggcgccaacatctgccccatcgagagcctcgactacgaaattgtggaaaatgaccttttcaagcaggattggcgatcaagaaagaagcagcagatattccagtatattgttctgaaatggtcattagttcttcttattggcctgtgtactggacttgttggcttcttcaataaccttgcagttgaaaacattgctgggttcaagttgttgcttacaagtgatctgatgctcaagcaaaggtacttcacagcatttctggcatatggaggttgcaatctagtcttggcagctgctgctgcagcgatctgcgcttacatagcacctgctgctgctgggtctggtatccctgaagttaaagcataccttaatggagttgatgcttatgctatattagctccaagcacactgtttgtgaagatatttggttcaatacttggagtttcagctggatttgtccttggaaaggaaggtcccatggtacatacaggagcatgcattgccaacttacttggtcaaggggggtcacgcaagtaccatctgacatgtaactggctcagatactttaagaatgatagagataggcgggatttgattacttgtggctctgctgctggagttgcagcagcattccgtgcgcctgttggtggtgtgctctttgctcttgaagaagcagcatcatggtggcgaagtgctctcctgtggagaacattctttacaactgctgttgttgctgttgtactgaggggtctgatccagttctgtcgtagcggaaaatgtggtctttttggtcagggagggttgattatgtttgatcttagctcaaccgtaccgagttacagtacccaggatatcattgcaattattgtccttggaataattggtggggtcttcgggggcctgttcaactttctcttggataggattctccgagcttatagttttatcaacgagagaggtgctccatacaagatccttctcaccgtcacaatatcaatcatcacatcagcatgctcctatgggctaccttggctcgccccatgcactccgtgccctgctgatgctgtggaggaatgccctaccattggccgctctgggaattttaagaactttcagtgcccgccgggctattacaatggtcttgcgtcgttgttcttcaacacaaatgatgacgccatccgcaatctattcagcagtggcaccgagaatgagttccacatgtccactcttttcgtgttcttcactgcgatttactgccttggccttgtgacatacggtattgctgttccatctggtctcttcatccctgttatacttgctggggctacgtacgggcgcatagtggggacccttcttggtccaatttcagaccttgatcctggactattcgcacttcttggcgcggcatctttcctcggtggaacaatgaggatgactgtgtcagtctgcgtgatacttctggagctcaccaatgacctccttatgctcccgttagtcatgctcgttcttctgatatcaaagaccatagccgacagctttaacaaaggggtttatgatcagattgtggtgatgaaaggcttgccattcctggaagctcatgccgaaccatacatgacgcacttggttgctagcgatgttgtgtctgggccactgatctccttttcaggcgtcgagagagtggggaatatcgttcaggcgttgaggatcacaggccacaacggatttccagtggtcgatgagccacctctatcagaggctccagaacttgttgggcttgtgctcagatcccatctgctggtcctgctgaaaggtaagggcttcatgaaagagaagatgaaaaccagcggtagcttcgtgctggaaagatttggtgccttcgattttgccaagccaggctcagggaaaggcctgaagattgaggacctggatttcactgatgaggaaatggacttgtatgtcgatctccatccaattacaaatacatcaccgtacacggtggtagagaccatgtcacttgcgaaggctgccgtccttttccgggcactgggactcaggcacatgctcgttgtgccaaagaccccagggagacctccaattgttggaatcctgacgaggcacgatttcataccggagcatattcatgggctgtttccaaatatacacaagtcacactaatggaacactcaatcagtccatatcttttcttttcttttttgccgtcgccttgtaggttgtagctagctgtacgaaaacgaagctacttttgtccaatatttgctatcggccatctggccttttcttttccattttgtttcttcaggagtactccagaatcatataatcactggataatattgtatttgttcaagagctggttccctggcagaacactccataagtgatatttctgtctttttctcaaatacgcaga

SEQ ID NO: 5344 - DNA, 3006 bp, Brachypodium distachyon
ggcgttgctcctttcctcttctcttctcttgtccgactcgtcccgccggccctccgctttctccacaagcttccccaccctcaccacacctatcgccgcggttatcttcttaattcctagtccccatctctgccataattggtaaggaggagcaggggattgatcggaacaggaggagaaggctctctgtttctgacgggatcaagatcgccagcccatcataaaaactgaagggcattggaggagaagggagagcaaggaagttcgcgaagaatggacggcgaccacgcgccgccgccgctgtcggagcgtgacggcagcttcaactacgacatagagagcatggacggcggcgggtggcgcggcgccgcggcggcggggaggttcgggtcgtcggaggcgctgctgcggtacgacgacggcgaaggcccgcgcgagccgctgctgcggaagcgcaccatgaacaccacctcccagatcgccatcgtcggcgccaacgtcttccccatcgagagcctcgactacgaaattgtggagaatgatcttttcaagcaagattggcgatcaagaaagaagaagcaaatattccagtacattgttctgaaatgggcattggttcttcttattggtgtgttgaccggacttgttggcttcttcaacaaccttgcagttgagaatattgctggattcaaattgttgctcactggcgatctcatgctccaggagaggtacttcacagcatttttggcatatgggggctgcaatctagtcttgggagccactgctgcagcaatctgcgcttacatagcacctgctgctgctgggtccggtatccctgaagttaaggcatatcttaatggagttgatgcttactctattttagcgcccagcacactctttgtgaagatattcggttccatacttggagtttcaggtgggtttgtacttgggaaagaaggtcccatggtacatacaggggcatgcattgcgaacttgctaggccaggggggatcacgcaagtaccatcttacttgtaattggctgaagtattttaagaacgatagggataggcgagatttgattacatgtggggcagcagctggggtggcagcagcattccgtgcgcctgtcggtggtgtactctttgctctcgaggaagcagcgtcatggtggcgaagtgctcttctgtggagaacattctttacaactgctgttgttgctgtagtgttgaaggccctgattgagatctgccgtagtggaaaatgtggtctctttgggcagggagggttgattatgtttgatcttagctcaaacatcccgacatacggcacacaagatgtcattgcaataatggtcctcggaataattggtggcgtctttggaggccttttcaactttctcttggataggattctccgtgtctacagtattataaatgagaaaggtcccccattcaagatccttctcaccatcacagtgtctatcatcacatcagcatgctcttacggactcccttggcttgctccatgtactccgtgccctgttggatccatggaggagtgccctaccattggtcgttctggaaattttaagaacttccagtgcccggctggtcattacaatggtcttgcatcactcttctttaatacaaatgacgatgccatccgcaatcttttcagcagaggcacagaaaatgagttccacatgactagtcttttcgtattcttcactgctatatactgccttggtctcgtgacttatggtattgctgtcccatctggtctcttcatccctgttatacttgctggggctacatatggacgtattgtagggacacttcttggccccatatctgaccttgatcctggtctctttgcactgcttggtgccgcatctttccttggtggcacaatgagaatgaccgtctcagtctgtgtgatccttctggagctcaccaatgaactccatatgctccctttggtcatgctcgtccttctgatatcaaagaccatagctgattgctttaacaaaggggtctatgatcagattgtagtgatgaaaggtttaccattcatggaggctcatgctgaaccatacatgaggcacttggtagctggtgatgttgtgtctgggccactgatatccttttcaggtgttgagaaggtgggcaacattgttcaagcattaaggatcacgggccacaatggatttccggttgttgatgagccaccaatatcagaagctccagagctggttgggctggtgcttagatcacatctgttggttctgctgaaaggcaagaccttcatgaaggagaaggtgaaaacaagtggcagctttgtgctgcaaagatttggtgcctttgactttgccaaggccggttctgggaaaggtatcaaaatcgaggatctggatttcactgatgaagaaatggagatgtatgtcgatctccatccggtcacaaatacttcaccttacacagtggttgaaacaatgtcacttgcaaaggctgcagttcttttcagggcattaggactaagacacctgttggttgtgccaaagaccccagggagacctcccattgttgggattctcacaaggcacgatctcatgccggagcatatccatgggctgttcccaaatctccgcaagtcacattgatgggcaaaatgggagaacatccagcaggccctacaatttttcccagcttgttatttcttgtgaaggtgcttggacgatgaaataatctggtattgttgtaaagagttgatttcccccaatcagcaattcatcggatttccttgtggtagtttatgctcttgtgtaacaaacagcaatgctcttggcagtgtgtgctctcctcctcttttcctcagctgtgccttgctgtttggttctcatctgctcttcctgcaacttcgatagcaccattctgtcgagataccgacatgctaacttgaatttctgaaccaaaagatgcagacaaggctctgaaatctgaatcgt

SEQ ID NO: 5345 - DNA, 3465 bp, Brachypodium distachyon
aggcgttgctcctttcctcttctcttctcttgtccgactcgtcccgccggccctccgctttctccacaagcttccccaccctcaccacacctatcgccgcggttatcttcttaattcctagtccccatctctgccataattggtaaggaggagcaggggattgatcggaacaggaggagaaggctctctgtttctgacgggatcaagatcgccagcccatcataaaaactgaagggcattggaggagaagggagagcaaggaagttcgcgaagaatggacggcgaccacgcgccgccgccgctgtcggagcgtgacggcagcttcaactacgacatagagagcatggacggcggcgggtggcgcggcgccgcggcggcggggaggttcgggtcgtcggaggcgctgctgcggtacgacgacggcgaaggcccgcgcgagccgctgctgcggaagcgcaccatgaacaccacctcccagatcgccatcgtcggcgccaacgtcttccccatcgagagcctcgactacgaaattgtggagaatgatcttttcaagcaagattggcgatcaagaaagaagaagcaaatattccagtacattgttctgaaatgggcattggttcttcttattggtgtgttgaccggacttgttggcttcttcaacaaccttgcagttgagaatattgctggattcaaattgttgctcactggcgatctcatgctccaggagaggtacttcacagcatttttggcatatgggggctgcaatctagtcttgggagccactgctgcagcaatctgcgcttacatagcacctgctgctgctgggtccggtatccctgaagttaaggcatatcttaatggagttgatgcttactctattttagcgcccagcacactctttgtgaagatattcggttccatacttggagtttcaggtgggtttgtacttgggaaagaaggtcccatggtacatacaggggcatgcattgcgaacttgctaggccaggggggatcacgcaagtaccatcttacttgtaattggctgaagtattttaagaacgatagggataggcgagatttgattacatgtggggcagcagctggggtggcagcagcattccgtgcgcctgtcggtggtgtactctttgctctcgaggaagcagcgtcatggtggcgaagtgctcttctgtggagaacattctttacaactgctgttgttgctgtagtgttgaaggccctgattgagatctgccgtagtggaaaatgtggtctctttgggcagggagggttgattatgtttgatcttagctcaaacatcccgacatacggcacacaagatgtcattgcaataatggtcctcggaataattggtggcgtctttggaggccttttcaactttctcttggataggattctccgtgtctacagtattataaatgagaaaggtcccccattcaagatccttctcaccatcacagtgtctatcatcacatcagcatgctcttacggactcccttggcttgctccatgtactccgtgccctgttggatccatggaggagtgccctaccattggtcgttctggaaattttaagaacttccagtgcccggctggtcattacaatggtcttgcatcactcttctttaatacaaatgacgatgccatccgcaatcttttcagcagaggcacagaaaatgagttccacatgactagtcttttcgtattcttcactgctatatactgccttggtctcgtgacttatggtattgctgtcccatctggtctcttcatccctgttatacttgctggggctacatatggacgtattgtagggacacttcttggccccatatctgaccttgatcctggtctctttgcactgcttggtgccgcatctttccttggtggcacaatgagaatgaccgtctcagtctgtgtgatccttctggagctcaccaatgaactccatatgctccctttggtcatgctcgtccttctgatatcaaagaccatagctgattgctttaacaaaggggtctatgatcagattgtagtgatgaaaggtttaccattcatggaggctcatgctgaaccatacatgaggcacttggtagctggtgatgttgtgtctgggccactgatatccttttcaggtgttgagaaggtgggcaacattgttcaagcattaaggatcacgggccacaatggatttccggttgttgatgagccaccaatatcagaagctccagagctggttgggctggtgcttagatcacatctgttggttctgctgaaaggcaagaccttcatgaaggagaaggtgaaaacaagtggcagctttgtgctgcaaagatttggtgcctttgactttgccaaggccggttctgggaaaggtatcaaaatcgaggatctggatttcactgatgaagaaatggagatgtatgtcgatctccatccggtcacaaatacttcaccttacacagtggttgaaacaatgtcacttgcaaaggctgcagttcttttcagggcattaggactaagacacctgttggttgtgccaaagaccccagggagacctcccattgttgggattctcacaaggcacgatctcatgccggagcatatccatgggctgttcccaaatctccgcaagtcacattgatgggcaaaatgggagaacatccagcaggccctacaatttttcccagcttgttatttcttgtgaaggtgcttggacgatgaaataatctggtattgttgtaaagagttgatttcccccaatcagcaattcatcggatttccttgtggtagtttatgctcttgtgtaacaaacagcaatgctcttggcagtgtgtgctctcctcctcttttcctcagctgtgccttgctgtttggttctcatctgctcttcctgcaacttcgatagcaccattctgtcgagataccgacatgctaacttgaatttctgaaccaaaagatgcagacaaggctctgaaatctgaatcgtaatgtccatgaaagaagtgtcgttgcttccaaacaaacctgctgtccacatgtcagcagagaggcatctcatcgttgctgtcacatgcctgtgttagttggttcttgcaggttccactgaaattcgccaggatccttccacggggaccccggtgggcggtggcacctactgctgacctagtcaccaaaagtccatggccgacatgccaggggctgggcgccccccagacatgaacagaaagggcgaaggaacagtgacaggcgaggcaccatgatgctgctcctatagattccagcatgtgtggtcattgcttgccactgtctctcgcctctcactagtcaccagtgtgccgtagccttttctttttctgtgtgaggcatgcatgccaaatgccaagaactttatgcagaaactcctcggtcaaactttggcattattaaacttagatttgtgtctgg

SEQ ID NO: 5346 - DNA, 2489 bp, Avena sativa
cgccgccggagcgggacggcagcttcagctacgacatagagagcatggacggcagcgggcgcggcacgggcttggcgccggcggcggcgtggaacggctcgtccgaggcgctgccgcggttcgaagacgacgacggcggcgcgcgcgaggcggcgctgctgcggtacgacgacgacggcggcggcccgcgagagccgctgctgcggaagcgcaccatgaacaccacatcccagatcgccatcgtcggggcaaatgtcttccccatagagagcctcgactacgaaattgtggagaatgatcttttcaagcaagattggcgatcaagaaagaagaagcagatatttcagtatattgttctgaaatgggcactggttcttcttattggcttgttgactggacttgttggtttcttcaacaaccttgcagtcgaaaatattgctggattcaaattgttgctcacaggtgatccgatgctccagcagaggtacttcacagcatttttggcatatggaggctgcaatcttgtcttgggagctactgctgcagcaatctgcgcttacatagcacctgctgctgctggttctggtatccctgaagttaaggcatatcttaatggagttgatgcttactctattttagctcccagcacactctttgtgaagatatttggttcaatccttggagtttcagctggatttgtacttgggaaagaaggtcccatggtacatacaggggcatgcattgccaacttgcttggtcagggaggatcacgcaagtaccatcttacctgcaattggctgaaatattttaagaacgatagggataggcgagatttgattacatgtggtgcagcagctggagtggcagcagcatttcgtgcacctgttggtggtgtactctttgctctcgaggaagcagcatcatggtggcgaagtgctcttctgtggagaacattctttacaactgctgttgttgctgtcgtgttgagggccctgatcgaggtctgtcgtagtggaaaatgtggtctgtttgggcagggagggttgattatgtttgaccttagctcaaacgtcccgacatacggcacccaagatgtcattgcaatagtagtccttggaataattggcggcgtcttcggaggcctcttcaactttctcttggataggattcttcgtgtctacagtattatcaatgagagaggtgctccactaaagatccttctcaccatcacaatatcaattatcacgtcggcatgctcctatgggctcccttggcttgcttcatgcactccatgccctgttggttccatggaggaatgccccactattggccgttctggaaattttaaaagcttccagtgtccgcctggtcattataatggtctggcatcacttttcttcaacacaaatgatgatgccatccgcaatctcttcagccgtggcaccgcgaacgagttccacatgtctagccttttcatattcttcatcgctatttactgcctcggtctggtgacatatggtattgctgtcccatctggtctctttatccccgtaatacttgctggggctacctatggacgcatagttgggacacttcttggccccgtctctgatcttgatccgggcctctttgcgctgcttggtgctgcatctttccttggtggaacaatgaggatgaccgtgtcagtctgcgtaatccttctggagctcactaacgaactccatatgctccctctggtcatgctcgtccttctgatatcaaagaccatagccgattgcttcaacaaaggggtttatgaccagattgtggtgatgaaaggtttgccattcatggaggctcatgctgagccatacatgaggcacctggtagctggtgatgtcgtgtctgggccactgatctccttttcaggtgtcgagagggtgggcaacatcgtacaagcgttgaagatcacgggccacaacggatttccagtggtcgatgagccgcctctaacagaatctccagagctggttgggctggtgcttagatcacacctgttggttctactgaaaggcaggaccttcatgaaggataaggcgaaaacaagcggtagctttgtgttgcgaagattcggtgcgtttgactttgccaagcccggttccgggaaaggtccgaagatcgaggacctggatttcactgatgaagaaatggagatgtatgtggatctccacccgatcacgaatacttcaccttacacggtggttgagacaatgtcacttgcaaaagctgcggtccttttcagggctctagggctaagacacctcctggttgtgccgaagaccccagggagacctcccattgttgggattctcacaaggcacgacctcatgccggagcatatccacgggctgttccccgatctccgcaagtcgcattgaggtgcgaaatcagagcactcatagcagatcatacaatttttcttcgtctccgtcatttctcatgaagatgcc

SEQ ID NO: 5347 - DNA, 3596 bp, Hordeum vulgare
cctcgtctctagcgtctctttcttttataccgccacctgacttgtcccgcccgcctccttcttctacctccctccctccctccactttttccacggccttccgttttccgtacgccctgtgccttgcgggactcgtactcttccatttccgcctccgtcggcgtttcccaggggaggaggccgctcttgatcacgagaggagcacagcaggcgcagggggattcagggccgtcagggacccgaggagaggagaggagaggagaggaggcaggcgtcagcaagcagcaaagggagaggagaatggacggcgaccacgcgccgcattccaaccagcacccgccgccgccgccgatgccggagcgggaaagcagcttcaactacgacatcgagagcatggacggcggcgggtggcgcggcgccgggaggtacgcctcgtccgacgcgctgctgcggtacgacgacgacggcccgcgggagccgctgatgcggaagcgcaccatgaacaccacctcccagatcgccatcgtcggcgccaacgtcttcgccatcgagagcctcgactacgagattgtggagaatgatcttttcaagcaagactggcgatcgagaaagaagaatcagatatttcagtatgttgttctgaaatgggcattagttcttcttattggcttgttgactggacttgttggcttcttcaacaaccttgcagtcgagaatattgctggattcaaattggtgctcacaggtgatcttatgctccagaagaggtacttcacagcatttctggcatatggaggctgcaatctattcttaggagccactgctgcagcactatgcgcttacatagcaccagctgctgctgggtctggtatccctgaagttaaagcatatcttaatggagttgatgcttactctattttagctcccagcacactctttgtgaagatatttggttcaatacttggagtttcaggtggatttgtacttgggaaagaaggtcccatggtgcatacaggggcatgcattgccaacttgcttggtcaggggggatcacgcaagtaccatctcacatggaattggctgaaatatttcaagaatgacagggatagacgagatttgattacatgtggtgcagcagctggagtggcagccgcatttcgtgcacctgttggtggtgtactctttgctctggaggaagcagcatcatggtggcgaagtgctcttctatggagaacattctttacaactgctgttgttgctgtagtgttgagggccctgattgagttctgtcgtaaaggaaaatgtggtctctttgggcaaggagggttgattatgtttgatcttagctcgaacatcccatcatatggtacccaagatctcattgcgattattattcttggagtaattggtggcgtcttcggaggcctttttaactttctcttggataggattcttcgtgtctacagtattatcaatgagagaggtgccccatccaagatccttctcaccatcacaatatcgatcatcacttcggcgtgctcctatgggctcccttggcttgctgcatgctctccgtgccctgttggttcaatggaggaatgccccaccattggccgctctggaaatttcaagagcttccagtgcccgcctggtcattacaatggtctggcatcactcttcttcaacacaaatgacgatgccatccgcaatctcttcagccgtggtaccgaaaatgagttccacatgtctagccttttcgtgttcttcatcgctatctactgccttggtctcgtgacatatggcattgctgtcccatctggtctctttatcccggtaatacttgccggcgctacatatggacgcattgtggggacacttcttggtcccatgtctgatatcgaccctggcctctttgcactgctgggtgccgcatctttccttggtggaacaatgagaatgacggtgtcagtctgcgtgatccttctggagctcacaaatgagctccatatgctccctttggtcatgctcgtcctcctgatatcaaagaccatagccgattgcttcaacaaaggggtgtatgatcagattgtggtgatgaaaggcttgccattcatggaggctcatgctgaaccgtacatgaggcacttggtagctagtgatgttgtgtctgggccactcatctccttttcgggtgttgagaaggtgggcaacattgttcatgcgttaaggatcacgggccacaacgggtttccagtggtcgatgagccgcctgtatcagaagctccggagctggttgggctcgtgcttagatcacatctgttggttcttctgaatggaaggaacttcatgaaggagaaggtgaaaacaagtggtagctttgtgctaagaaggtttggtgcatttgactttgcaaagcctggttccgggaaaggtatgaaaatcgaggacctagatttcactgaggaagaaatggagatgtacgtcgatctccatccaatcacaaacacttcgccgtacacggtggtcgaaacaatgtcgcttgcaaaggccgcagtcctgttcagggcactagggctaagacacctgctggttgtgccaaagaccccagggagatttcctatcgttgggattctcaccaggcacgatctcatgccggagcatatccatgggctgttccccaatctccgcaagtcacactgagaagcaaaatcagcagaccatgcacaattttcttgtacgtgttgttatttctcatgaaaggtgctgcttcattggatcatggaataatcaatctgatatgtctattgtaaagagttgattccctatcagcagttgagtgggtttcattttggcagcttgtgatctttgtgtaacaaaaacaatcctctccttgtcagtacatgttctctttctctcttgcttcaccgtgtggttcttctcatctgcacctcctgtaacttggaccgcaacaccttgtcggtagtagagtagcatgttatccatagcgatctctgaacaaaatgatgccgacatggcactgaaatctgaatctcagtattcatggccagccaaaggaaatgccgttgcttctgaacacactgtctggctgtccacagtccacacgtcggtgggaggcgcctcgtttgttgctgccacatgcctgccggtgggcgttggtttttgcagcagcatcggcagaagttcgccgggatccctttccacggtgactggtggcacctactgctgacctgactaccagaaatccgctggcccacacgccagacatgaacggaaagggggaacagtgacaggcaaggcaccatgatgctgcctctatagattccagcagcaggtgtgctcattgcttttcctccttttcttttatttgtgcgaggcatcaggcatggcaaatggcaacaactttatgcacaaactcctcatcagctttggcaccagtattgaattagattttgtgcgtgtggaaaccttttggtcggtttgttctctcccatctttgtgtcagctgcaaaggattgttggctgcagtgcaggccatcatatttgtcgtgagattgtacatacactgatacacatgt

SEQ ID NO: 5348 - DNA, 2816 bp, Avena sativa
ctctctaccggaggaggggaaagggccatcgctagtgctcttggcccgccggatcgactgctacaccggccgggtcaaagccgtcaggcaggcaccccaaggagggccaccgcgacagcagcggaaaaaatggatggcaaccacgcgccgccggagcgggacggcagcttcagctacgacatagagagcatggacggcagcgggcgcggcacgggcttggcgccggcggcggcgtggaacggctcgtccgaggcgctgccgcggttcgacgacgacgacggcgcgcgcgaggcggcgctgctgcggtacgacgacgacggcggcggcccgcgagagccgctgctgcggaagcgcaccatgaacaccacatcccagatcgccatcgtcggggcaaacgtcttccccatcgagagcctcgactacgaaattgtggagaatgatcttttcaagcaagattggcgatcaagaaagaagaagcagatatttcagtatattgttctgaaatgggcactggttcttcttattggcttgttgactggacttgttggtttcttcaacaaccttgcagtcgaaaatattgctggattcaaattgttgctcacaggtgatccgatgctccagcagaggtacttcacagcatttttggcatatggaggctgcaatcttgtcttgggagccactgctgcagcaatctgcgcttacatagcacctgctgctgctggttctggtatccctgaagttaaggcatatcttaatggagttgatgcttactctattttagctcccagcacactctttgtgaagatatttggttcaatccttggagtttcagctggatttgtacttgggaaagaaggtcccatggtacatacaggggcatgcattgccaacttgcttggtcagggaggatctcgcaagtaccatcttacctgcaattggctgaaatattttaagaatgatagggataggcgagatttgattacatgtggtgcagcagctggagtggcagcagcatttcgtgcacctgttggtggtgtactctttgctctcgaggaagcagcatcatggtggcgaagtgctcttctgtggagaacattctttacaactgctgttgttgctgtcgtgttgagggccctgatcgaggtctgtcgtagtggaaaatgtggtctgtttgggcagggagggttgattatgtttgaccttagctcaaacgtcccgacatacggcacccaagatgtcattgcaatagtagtccttggaataattggcggtgtcttcggaggcctcttcaactttctcttggataggattcttcgtgtctacagtattatcaatgagagaggtgctccactaaagatccttctcaccatcacaatatcaattatcacgtcggcatgctcctatgggctcccttggcttgcttcatgcactccatgccctgttggttccatggaggaatgccccactatcggccgatctggaaattttaaaagcttccagtgtccgcctggtcattataatggcctggcatcacttttcttcaacacaaatgatgatgccatccgcaatctcttcagccgtggcaccgcgaacgagttccacatgtctagcctcttcatattcttcatcgctatttactgccttgggctcgtgacatatggcattgctgtcccatctggtctctttatccctgtaatacttgctggggctacctatggacgcatagttgggacacttcttggccccatctctgatcttgatccgggcctctttgcgctgcttggtgccgcatctttccttggtggaacaatgaggatgaccgtgtcagtctgcgtaatcctcctggagctcaccaatgaactccatatgctccctctggtcatgctcgtccttctgatatccaagaccatagctgattgcttcaacaaaggggtttatgaccagattgtggtgatgaaaggtttgccattcatggaggctcatgctgagccatacatgaggcacctggtagctggtgatgtcgtgtctgggccactgatctccttttcaggtgtcgagagggtgggcaacatcgtacaagcgttgaagatcacgggccacaacggatttccggtggtcgatgagccacctctaacagaatctccagagctggttgggctggtgcttagatcacacctgttggttctactgaaaggcaggaccttcatgaaggataaggcgaaaacaagcggtagctttgtgttgcgaagattcggtgcgtttgactttgccaagcccggttccgggaaaggtccgaagatcgaggacctggatttcactgatgaagaaatggagatgtatgtggatctccacccgatcacgaatacttcaccttacacggtggttgagacaatgtcacttgcaaaagctgcggtccttttcagggctctagggctaagacacctcctggttgtgccgaagaccccagggagacctcccattgttgggattctcacaaggcacgacctcatgccggagcatatccacgggctgttccccgatctccgcaagtcgcattgaggtgcgaaatcagagcactcatagcagatcatacaatttttcttcgtctccgtcatttctcatgaagatgcctcattggatcgtggaataatcagcagtttgagtggatttccttttggtagttttatcatacccttgtgtaacaaacaatagagtcttgtcagtacatgcgctctcttttcctcagctgtgccttgctttgtcggtagtaaatctgttctgaacgaaatgatgacgcagacaaggtcctgaaatct

SEQ ID NO: 5349 - DNA, 2865 bp, Secale cereale
gtacgccctgcgtcttgcggttgcgggtcgcctactcttccatctccgccaaccttcgccaccagagaagcaggggaggggagaggagcagagcagagcaggcggttcttcgcggccaaggggcgcctacccgaatcaagagcgtcaggggcccaaggagagagaggaggcaagcgtcagcaagcagcaagcaagggcggagggccgccgcagcgcggacgcccaacaatggacggcgaccacgcgccgtattccaactccaaccagcacccgccgccgccgccgtcgccgtcgccgctgccggagcgggaaggcagcttcaactacgacatagagagcatggacggcggcgggtggcgcggcgcggggaggtacgcctcgtccgacgcgctgctgcggtacgacgacgacggcccgcgggagccgctgctgcggaagcgcaccatgaacaccacctcccagatcgccatcgtcggcgccaacgtcttcgccatcgagagcctcgactacgaaattgttgagaatgatcttttcaagcaagactggcgatcgagaaagaagaatcagatatttcagtatgttgttctgaaatgggcattagttcttcttattggcttgttgactggacttgttggcttcttcaacaaccttgcagtcgagaatattgctggattcaaattggtgctcacaggtgatcttatgctccagaagaggtacttcacagcatttttggcatatggaggctgcaatctagtcttaggagccactgctgcagcactatgtgcttacatagcaccagctgctgctgggtctggcatccctgaagttaaagcatatcttaatggagttgatgcttactctattttagctcccagcacactctttgtgaagatatttggttcaatacttggagtttcaggtggatttgtacttgggaaagaaggtcccatggtgcatacaggggcatgcattgccaacttgcttggtcaggggggatcacgcaagtaccatctcacgtggcattggctgaaatatttcaagaacgatagagatagacgagatttgattacatgtggtgcagcagctggagtggcagccgcatttcgtgcacctgttggtggtgtactctttgctctcgaggaagcagcatcatggtggcgaagtgctcttctttggagaacattctttacaactgctgttgttgctgtagtgttgagggccctgattgagttctgtcgtaaaggaaaatgtggtctctttgggcaaggagggttgattatgtttgatcttagctcggacgtcccatcatatggtacccaagatctcatcgcgattataattcttggagtaattggtggcgtcttcggaggtcttttcaactttctcttggataggattcttcgtgtctacagcattatcaacgagagaggtgctccatccaagatccttctcaccatcacaatatcgatcatcacttcggcgtgctcctatgggctcccttggcttgctgcgtgctctccgtgccctgttggttcaatggaggaatgccccaccattggccgctctggaaattttaagagcttccagtgcccgcctggtcattacaatggtcttgcatcactcttcttcaacacaaatgacgatgccatccgcaatctcttcagccgtggtaccgaaaatgagttccacatgtctagccttttcgtgttcttcatcgctatctactgccttggtctcgtgacgtatggtattgctgtcccatctggtctctttatcccggtaatacttgccggggctacatatgggcgcatcgtggggacacttcttggtcccatgtctgatatcgaccctggcctctttgcactgctcggtgcggcatctttccttggtggaacaatgagaatgaccgtgtcagtctgcgtgatccttctggagctcacaaatgagctccatatgctccctttggtcatgctcgtcctcctgatatcgaagaccatagcagattgcttcaacaaaggggtgtatgatcagattgtggtgatgaaaggcttgccattcatggaggctcatgctgaaccgtacatgaggcaccttgtagctagtgatgttgtgtctgggccactcatctccttttcgggtgttgagaaggtgggcaacattgttcatgcgttaaggatcacgggccacaacgggtttccggtggtcgacgagccgcctgtatcagaagttccggagctggttgggctggtgcttagatcacatgtgttggttcttctgagtggaaagaacttcatgaaggagaaggtgaaaacaagcggtagcttcgtgcttagaagatttggtgcatttgattttgcaaagcctggttccgggaaaggtatgaagatcgaggacctggatttcaccgaggaagaaatggagatgtatgtggatctccatccaatcacaaacacttcgccgtacacggtggtcgaaacaatgtcacttgcaaaggccgcagtcctgttcagggcgctagggctaagacaccttctggttgtgccaaagaccccagggagatttcctattgttgggattctcaccaggcacgatctcatgccggagcatatccatgggctgttccccaatctccgcaagtcacattgagaagcaaaatcagcagaccatgcaaaattttcttgtacgtattgttatttctcatgaaggtgccgcttcactggatcatggaataatcaatcagatatatttattgtaaaaagagctgattccccaatcagcagtcgagtggatttgattttggcagcctgtgatctttgtgtaacaaaacaatcctcttcttgtcagtacatgttctctcttttgctt

SEQ ID NO: 5350 - DNA, 3071 bp, Panicum virgatum
ttaggctccgcttggacatggcgcaagcggagaccgggatggcaaggcaagaactgtagcatctccagggaccagagcagaggaggcgctccatggacggcggctccccgcggccgccccgcagtccggagcgggaggggagctacaactacgacattgagagcatggacggctccgtggccgggggcgggccaccgtggcggccgcagaacggctccgccgaggccctgctccgctacgacgaggggggtgacggcgaccgcgggagcgcgcgcgagccgctgctgcggaagcgcaccatgaacaccacatcccagatcgccatcgtgggcgccaacgtctgccctatcgagagcttggattacgaagttgtggagaacgacctcttcaagcaagattggcgatcaagaaagaagaagcagatatttcagtacattgttctcaagtggagcttggtgcttcttattggcttgttaactggacttgttggcttcttcaacaaccttgcggttgaaaacattgctggattcaagttgctgcacacgagtcgtctgatgctcaaggagagatatttcaaagcatttttggtgtatggaggttgcaatttagtcttggcggcatctgcagcagcaatctgtgcttatgttgcacctgctgctgctggatccggtattcctgaagttaaagcatatcttaatggggttgatgcttattctatattggctcctagtacactttttgttaagatatttggttcaatacttggagtttcagctggatttgtactaggaaaagaaggccctatggtacacacaggagcatgtattgccaacttgcttggtcagggaggatcacgcaagtatcatcttacatgcaactggctaagatactttaagaatgacagggataggagagacttaattacatgtggatctgcagctggagtggcagctgccttccgtgcacctgttggcggtgttctgtttgctcttgaagaagcagcatcatggtggcgaagtgcacttctgtggagaacattctttacaactgctgttgttgctgtggtattgaggggactgattgaattctgtcgcagtggaaaatgtggtctatttgggcaaggtggattgatcatgtttgatctcagttcaactattgcaacctacagtactccagatctgattgcaatcatagtccttggtataattggtggcatctttggaggcctcttcaactttctcttggacaagatcctgcgagtttatagtatcatcaatgagaggggtgctccattcaagatccttctcaccataacaatatcaataatcacatcaatgtgttcctatggtcttccttggcttgctgcatgcactccatgcccagttgatgctgtggagcagtgtccaactattggccgttctgcaaattacaaaaacttccaatgcccacaaggatattacaatgatcttgcatcactcttcttcaacaccaatgatgatgccatccgcaacctcttcagcaacggcaccgcgaatgagttccgcatgtccagtcttttcattttcttcactgctatttactgccttggacttgtgacttacggggttgctgtcccctctggcctcttcatccctgttattcttgctggagccacttatgggcgcattgtgggaacacttcttggatctatatccgatcttgatccaggcctttttgcccttcttggtgccgcatcttttctcggtggaacaatgagaatgactgtttccgtttgtgtgatccttctagagctcaccaatgatcttcccatgctccctttggtcatgcttgtacttctcatatccaagaccatagcagataacttcaacaagggggtttatgatcagatagtggtgatgaaaggtttgccatacatggaggctcatgctgaaccatacatgagacatttggttgctggtgatgtggtttctggcccactaatcaccttttcaggtgttgagaaggtgggaaacattgttcacgcgttgaggataacgggccacaatgggtttcctgttgttgatgagccgcctataacggaaaccccagagctggttgggcttgtgactaggtcccatctattggttttactgaacagcaagaatttcatgaaggggcaggtgaaaactagtggtagctttgttctgcgaagatttggtgcctttgactttgcaaagccaggatcagggaaaggtttgaaaattgaggacctggatttcactgatgaggagatggacatgtatgtggatctccatccgattacaaacacctcaccttatacggtagttgagacaatgtcactggcgaaagccgcaatccttttccgggaactagggttgaggcacctcttggttgtgcccaagacaccagacaggcctcccatagttggaattctgacaaggcatgatttcatgcctgaacacattcacagtctgtttccaaatctcaaccctcacaagtaccattcagcgtctatggcaggttgatcatgaagctttttgctacttctcacctgtgtaaattatttgggtgctggttgtatgtaaattacaaaggtgtatctggtattgaattggagagagctcatcttctttacatggtatgatttgagtgaattttgtagcctatactcttctgcaataaaaatgtggcagttatttggttggagactgcccgctgtaagaaaagctctgcaaattctagagtgaacgttccaaattccagaatatggagcaaaagtatgaagtgtaaggcgaagcatgtttgagaattgagactctttaaggtttattttagtgaacttgggcctaaacactatgccactggcacttgtaatgcagatttattctttctaattgtaagatctacttggcttttgattctagacatttctgctttgatctgttactgtacccacctgtcaaaaattgtgtgaacatgctaactttggttcgtgcacaactggggcatgggcctagtttttttttctctgaatgaaatggagataaggatgtctgattcctgtttaaaac

SEQ ID NO: 5351 - DNA, 3117 bp, Echinochloa colona
cctgttactctgtcagtaggggctctctctcttcagccccttgtattttctgttctcttcagaagcttcccatatccgcacctggttctcttcatcttcctctgatgctatataagcagcccgggagcgagcgagagggggagaaagagaggtctcccaactcccaaggaggaactgttgatgtgttagcagttcatccatcagcggcaatcttcaagctaagacatctgaattttccttttgggctctttgcgcaagcttagaccgggacggcaagcaaggcagggacaagagcatcttcagagttcagagcagaggaggcggcggctcgagctcgatggacggcggctccccgaggctgccccgccggccggagcgggaggggagccacaactatgacatcgagagcatggacggctccgggtacgggggcgggccgccgtggcggccgcagaacggctcctccaaggccctgctccgctacgacgacggcgaccgcgggagcacgggcgagccgctgctgcggaagcgcaccatgaacaccacctcccagatcgccatcgtcggcgccaacgtctgccccatcgagagcttggattacgaagttgtggagaatgaccttttcaaacaagactggcgatcaagaaagaagaagcagatatttcagtacattgttctcaagtggaccttggttcttcttattggcttggcaactggagctgttggcttcttcaacaaccttgcggttgaaaacattgctggacgcaaattgctgctcacgagtgatcttatgctcaaggagagatatatcaaagcattttttgtgtatggaggttgcaatttagtcttggcggcatctgcagccgcaatctgtgcttatattgcgcctgctgctgctgggtccggtattcctgaagttaaagcatatcttaatggggttgatgcttattctatattggctcctagtacactttttgttaagatatttggttcaatacttggagtttcagctgggtttgtactagggaaggaaggccctatggtacatacaggagcatgtattgccaacttgcttggtcagggaggatcacgcaagtatcgtcttacatgtaactggctaagatactttaagaatgacagggataggagagacttgattacatgtggatctgcagctggagtagcagctgccttccgtgcacctgttggcggtgttctgtttgctcttgaagaagcagcatcatggtggcgaagtgctcttctgtggagaacattctttacaactgctgttgttgctgtggtattgaggggactgatcgaattctgtcgcagtgggaaatgtggtctctttgggcaaggtggattgatcatgtttgatctcagttcaactgttgcaacctacagtactccagatctaattgtaatcatagtccttggcataattggtgggatctttggaggcctcttcaactttctcttggacaagatcctgcgagtttatagtatcattaatgagaggggtgctccattcaagatccttctcaccattacaatatcaataatcacatcaatgtgttcctatggtcttccttggcttgctgcatgcactcaatgccctgttgatgctgtggaggagtgtccaactgttggtcgttctggcaattacaagaacttccaatgcccaccaggatattacaatgatcttgcatcgctcttcttcaacacaaatgatgatgccatccgcaatctcttcagtaatggcacatcgactgagttccgaatgtccagtcttttcatcttcttcactgctatttactgccttggacttgtgacttacggggttgctgtcccctctggtctctttatccctgttattcttgctggagccacatatgggcgcatagtgggaacacttcttggatctatatccgatcttgatcctggcctttttgctcttcttggtgcagcatcttttcttggtggaacaatgagaatgactgtgtcagtttgcgtgatccttctagagctcaccaatgatcttcccatgctccctttggtcatgcttgttcttctcatatccaagaccatagcagataacttcaacaagggggtttatgatcagatagtggtgatgaaaggcttgccattcatggaggctcatgctgaaccatacatgaggcatttggttgctggtgatgtggtttctggcccactaatcaccttttcaggagttgagaaggtggggaacatcgttcatgcattgaggataacgggccacaatgggtttcccgtggttgatgagccgcctataacggaaaccccggaactggttgggcttgtgagtaggtctcatctattggttttactgaacagcaagaatttcatgaaggggcgggtcaaactagtggtagctttgttctgcgaagatttggtgcctttgactttgcaaagccagggtcaggtaaaggtttgaaaattgaggacctggatttcactgatgaggagatggacatgtatgtggatctccatccgattacaaacacgtcaccttatacggtagttgagacaatgtcactagcgaaagccgcaatccttttccgggaactcgggttgaggcaccttttggttgtgcccaagacaccagacaggcctcccatagttggaattctgacaaggcatgatttcatgcccgaacacattcacagtgtgttccctaatctcaaccctcacaagtaccattcagcgtcaatggcaggctgaccatgaggcattttgctacttctcatctgtgtaaattatttgggtactggctgtatgtaaattgcaaaggtgtatctagtgctcaattggagagaactcatctgtatatggtttggtttgaggggattttgtagcatatcgtcttctgcaacaaaaatatggcagttatttggctggtgactgcctgcagcaagaaatgctctgcaaattgtcgagtgaacatttcgaactcccgaatatggagcaaaagtacgcatttcttctttctaattgtaagatttacttggcttgaaattcttgacatttctgctgtgatctgttactgtacccacctgtcaaaatcgtgtgaacacatga

SEQ ID NO: 5352 - DNA, 2946 bp, Echinochloa colona
cctgttactctgtcagtaggggctctctctcttcagccccttgtattttctgttctcttcagaagcttcccaaatccgcacctggttctcttcatcttcttctgatgctatataagcagcccgagagcgagggagcgagcgagagagggagaaagacaggtctcccaaggaggaaatgttgatgtgttagcatcatccatcagcggcaatcttcaagctaaggctctgctacttgttcgtttcgcaagcttagaccggggcggcaagcaaggccaggaacaagagcatctacagagttcagagcagaggaggcggcggctcgagctcgatggacggcggcggctcgccgaggccgccgcgccgcccggagcgggaggggagccacaactacgacatcgagagcatggacgggtccgggtacgggggcgggccgccgtggcggccgcagaacggctcctccgaggcactgctccgctacgacgacggcggtgccggcgaccgcgggagcacgggcgagccgctgctgcggaagcgcaccatgaacaccacctcccagatcgccatcgtcggcgccaacgtctgccccatcgagagcttggattacgaagttgtggagaatgaccttttcaaacaagactggcgatcaagaaagaagaagcagatatttcagtacattgttctcaagtggagcttggttcttcttattggcttggcaactggagctgttggcttcttcaacaaccttgcggttgaaaacattgctggacgcaaattgctgctcacgagtgatcttatgctcaaggagagatatatcaaagcattttttgtgtatggaggttgcaatttagtcttggcggcatctgcagccgcaatctgtgcttatattgcgcctgctgctgctgggtccggtattcctgaagttaaagcatatcttaatggggttgatgcttattctatattggctcctagtacactttttgttaagatatttggttcaatacttggagtttcagctgggtttgtactagggaaggaaggccctatggtacatacaggagcatgtattgccaacttgcttggtcagggaggatcacgcaagtatcatcttacatgtaactggctaagatactttaagaatgacagggataggagagacttgattacatgtggatctgcagctggagtagcagctgccttccgtgcacctgttggcggtgttctgtttgctcttgaagaagcagcatcatggtggcgaagtgctcttctgtggagaacattctttacaactgctgttgttgctgtggtattgaggggactgatcgaattctgtcgcagtgggaaatgtggtctctttgggcaaggtggattgatcatgtttgatctcagttcaactgttgcaacctacagtactccagatctaattgtaatcatagtccttggcataattggtgggatctttggaggcctcttcaacttcctcttggacaagatcctgcgagtttatagtatcattaatgagaggggtgctccattcaagatccttctcaccattacaatatcaataatcacatcaatgtgttcctatggtcttccttggcttgctgcatgcaccccatgccctgttgatgctgtggagcagtgtccaactgttggccgttctggcaattacaagaacttccaatgcccaccaggatattacaatgatcttgcatcgctcttcttcaacacaaatgatgatgccatccgcaatctcttcagtaatggcacatcgactgagttccgaatgtccagtcttttcatcttcttcactgctatttactgccttggacttgtgacttacggggttgctgtcccctctggtctctttatccctgttattcttgctggagccacatatgggcgcatagtgggaacacttcttggatctatatccgatcttgatcctggcctttttgctcttcttggtgcagcatcttttcttggtggaacaatgagaatgactgtgtcagtttgcgtgatccttctagagctcaccaatgatcttcccatgctccctttggtcatgcttgttcttctcatatccaagaccatagcagataacttcaacaagggggtttatgatcagatagtggtgatgaaaggcttgccattcatggaggctcatgctgaaccatacatgaggcatttggttgctggtgatgtggtttctggcccactaatcaccttttcaggagttgagaaggtggggaacatcgttcatgcattgaggataacgggccacaatgggtttcccgtggttgatgagccgcctataacggaaaccccggaactggttgggcttgtgagtaggtctcatctattggttttactgaacagcaagaatttcatgaaggggcgggtcaaaactagtggtagctttgttctgcgaagatttggtgcctttgactttgcaaagccagggtcaggtaaaggtttgaaaattgaggacctggatttcactgatgaggagatggacatgtatgtggatctccatccgattacaaacacctcaccttatacagtagttgagacaatgtcactagcgaaagccgcaatccttttccgggaactcgggttgaggcaccttttggttgtgcccaagacaccagacaggcctcccatagttggaattctgacaaggcatgatttcatgcccgaacacattcacagtgtgttccctaatctcaaccctcacaagtaccattcagcgtcaatggcaggctgaccatgaggcattttgctacttctcatctgtgtaaattatttgggtactggctgtatgtaaattgcaaaggtgtatctagtgctcaattggagagagctcatctgtacatggtttggtttgaggggattttgtagcatatcgtcttctgcaattaaaaatatggcagttatttggctggtgac

SEQ ID NO: 5353 - DNA, 2967 bp, Oryza sativa
atatatataagcacccagacataaagcaatagtttgagagagagattcagagtttcagagtttcagagaggcagtagaagagaaaggaggatcatcatcttgatctgaatctcgggaagtttttactgtggcctgatgatctgagttcaaccaaggctcgaattttgtaagagaagccaagcaaagaaagtctcgcggagaagagaagaagaagaagaagaagaagaagaagaagagctctctgaccaaagcggcggcggcggcgagcggcggcggaatggaggggcagtcgcagcaccgggcgccggagagggaggggagccacaactacgacatcgagagcacggacgggtccggcgggctgtggcggcggaacggctcgtcgtcgggggcgctgctccgctacaacgacagcggcggcggccgcagcgggagcgccggggagccgctgctgcggaagcgcaccatgaacaccacctcccagatcgccatcgtcggcgccaacgtctgccccatcgagagcctcgactacgaagttgttgagaacgaccttttcaagcaagactggcgatcaagaaagaagaagcagatatttcagtacattgttctgaagtggaccttggtgcttcttattggcctgttgactggacttgttggcttcttcaacaatcttgcagttgaaaacattgctggattcaaactgttgctcacgggtaatcttatgctaaaggaaaggtatttaactgcatttttcgcttatggaggttgcaatttggtcttagcagctgcagcggcagcaatatgtgcttacattgcacctgctgctgctgggtctggtattcccgaagttaaagcatatcttaatggagttgatgcatattcaatattggcccccagtacgctctttgtgaagatatttggttcaatacttggagtttcagctggatttgtacttggaaaggaaggtcctatggtacatacaggggcatgtattgccaacttgcttggtcagggaggatcccgcaagtaccggcttacatgtaattggctaagatattttaagaatgacagggataggcgggatttaattacatgcgggtctgcagctggagtggcagctgccttccgtgctcctgttggtggtgtcctatttgctcttgaggaagcagcatcatggtggcgaagtgctcttttgtggagggcgttctttacaacggctgttgttgctgtcgtgttgagatctcttattgagttctgtcgtagtggaaaatgcggtctctttgggcaaggtggattaattatgttcgatctcagttcaactgttgcaacctacagtactccagatctaatagcaataattatccttggaataattggtggaatctttggaggcctttttaattttctcttggacaaggttctccgtgtttacagtatcataaacgagagaggtgctccattcaagatccttctcactataacaatatcaattatcacatcaatgtgctcttatggtctcccttggcttgctgcgtgcactccatgtcccgtggatgctgtggagcaatgtcccaccattggacgctctggtaacttcaagaactttcaatgtccaccagggcattacaatgatcttgcatcactctttttcaatacaaatgatgatgccatccgcaacctctttagcaatgggactgaatctgagttccacatgtccacccttttcatctttttcactgctgtgtactgccttggaattctgacgtacggtgttgccgtcccatccggtctcttcatccctgttattctcgctggtgcaacatacgggcgcatagtggggacacttcttggatccatatccgaccttgatcctggtctttttgcccttcttggtgcagcatcttttcttggtggaacaatgagaatgaccgtgtcagtctgcgtgatccttctagagctcaccaacgacctggccatgctccctctggtcatgcttgttcttctcatatcgaagactatagcagataactttaataaaggagtttatgatcagatagtggtaatgaaaggcttgccatacatggaggctcatgctgaaccatacatgaggcacttggttgctggcgatgttgtgtctggcccacttattacgttttcaggtgtcgagaaggtgggaaacattgtccatgcgttaaggttcacaggccacaatggattcccagtggttgatgagccacctctaacggaagcacctgaattggtcgggctcgtgacaaggtctcatctgttggttttgctgaatggcaagatgttcatgaaagaccagctgaaaactagtggtagctttgtccttcaaagattcggtgcctttgattttgccaagccagggtcagggaaaggcttgaaaattcaggacctggacttcactgatgaggagatggaaatgtatgtggatctccatcccgttacaaacacctcaccttatacggtggttgagacaatgtcactcgcaaaagctgcaatcctattccgtgcactaggattgaggcaccttttggttgtgccaaagacaccagataggccacccattgtcggaattctcacgaggcatgatttcgtcgaagaacatatccacgggctgttcccaaatctcaatcctcacaagttccactcgacatcgatgggaggctgatttttaagcgttttgccgccactcgttttatgtgaagtataggaagtgttcattatatgtaatttacaaaattgtgtctgtcatttgttggagagagctcatcatctgtacatcggttgtagcatatcctcttttacaggattcatcttgtagcgtattttgtctcagcttgcttattttgagtctgacaggaagcgctctgtaaatgtagagcaaacattcggaacaccgaaattttatatcataaagttgtgctaaggcatatttgaaagttg

SEQ ID NO: 5354 - DNA, 3130 bp, Panicum virgatum
tttttttcccttccagttggaatagataacgcgatcctaatcatgttcaactttatcatccgaattttcctttaggctccgcgtggagattgcgcaagcggagaccgggacggcaaggtaggaacacgagcaggagcatctcttctccggagcagagcagccggctcaatcactcaatggacggcggctccccgcggccgccccgccgcccggagcgggaggggagctacaactgcgacatcgagagcatggacggctccgtggccgggggcgggccgccgtggcggtcgcagaatggctccgccgaggccctgctccgctacgacgacggcggtgccggcgaccgcgggagcacgcgcgagccgctgctgcggaagcgcaccatgaacaccacgtcccagatcgccatcgtcggcgccaacgtctgccccatcgagagcttggattacgaagttgtggagaacgaccttttcaagcaagattggcgatcaagaaagaagaagcagatatttcagtacattgttctcaagtggagcttggtgcttcttattggcttgttaactggacttgttggcttcttcaacaaccttgcggttgaaaacattgctggactcaagttgctgcacacgagtcgtctgatgctcaaggagagatatttcaaagcattttttgtgtatggaggttgcaatttagtcttggcggcatctgcagcagcaatctgtgcttatgttgcacctgctgctgctggatccggtattcctgaagttaaagcatatcttaacggggttgatgcttattctatattggctcctagtacactctttgttaagatatttggttcaatacttggagtttcagctggatttgtactaggaaaggaaggccctatggtacacacaggagcatgtattgccaacttgcttggtcagggaggatcacgcaagtatcatcttacatgcaactggctaagatactttaagaacgacagggataggagagacttaattacatgtggatctgcagctggagtggcagctgccttccgtgcacctgttggcggtgttctgtttgctcttgaagaagcagcatcatggtggcgaagtgcacttttgtggagaacattctttacaactgctgtcgttgctgtggtattgaggggactgattgaattctgtcgcagtggaaaatgtggtctctttgggcaaggtggattgatcatgtttgatctcagttcaactattgcaacctacagtactccagatctgattgcaatcatagtccttggtataattggtggcatctttggaggccttttcaactttctcttggacaagatcctgcgagtttatagtatcatcaatgagagaggtgctccattcaagatccttctcaccataacaatatcaatagtcacatcaatgtgttcctatggtcttccttggcttgctgcatgcactccatgcccagctgatgctgtggagcagtgtccaactatcagccgttctggaaattacaaaaacttccaatgcccacaaggatattacaatgatcttgcatcactcttcttcaacaccaatgatgatgccatccgcaatcttttcagcaacggcaccgcgaatgagttccgaatgtccagtcttttcattttcttcactgctatttactgccttggacttgtgacttatggggttgctgtcccctctggcctctttatccctgttattcttgctggagccacttatgggcgcatagtgggaacacttcttggatctatatccgatcttgatcctggcctttttgcccttcttggtgccgcatcttttcttggtggaacaatgagaatgactgtttcagtttgtgtgatccttctagagctcaccaatgatcttcccatgctccctttggtcatgcttgtacttctcatatccaagaccatagcagataacttcaacaagggagtttatgatcagatagtggtgatgaaaggttttccatacatggaggctcatgctgaaccatacatgagacatttggtcgctggtgatgtggtttctggcccactaatcaccttttcaggtgttgagaaggtggggaacattgttcatgcgttgaggataacaggccacaatgggtttcctgtggttgatgagccgcctataacggaaaccccagagctggttgggcttgtgactaggtctcatctattggttttactgaacagcaagaatttcatgaagggccaggtgaaaactagtggtagctttgttctgcgaagatttggtgcctttgactttgcaaaaccagggtcagggaaaggtttgaaaattgaggacctggatttcactgatgaggaaatggacatgtatgtggatctccatccaattacaaacacctcaccttatacggtagttgagacaatgtcactggcgaaagctgcaatccttttccgggaactcgggttgaggcacctcttggttgtgcccaagacaccagacaggcctccaatagttggaattctgacaaggcatgatttcatgcctgaacacattcacagtctgtttccaaatctcaaccctcacaagtaccattcagcgtctatggcaggttgatcatgaagctttttgcaaattttcacctgtgtaaattatttgggtgctggttgtatgtaaattacaaaggtgtatctggtgttcaattggagagagctcatcttctttacatggtatgatttgagtggattttgtagcatatgctcttctgcaataaaaatgtggcagttatttggttggagactgcccgctgtaagaaaagctctgcaaattgtagagcgaacattccaaagtatgaaatgtaaggtgaagcatgtttgagaattgagactcttgaaggtttatttagtgaacttgggcctaaacactatgccactggcacttgtaatgcagatttattctttctagttgtaagatctacttcgctttcgattcttaacatttctgctttgatctgttactgtacccgcctgtcaaaattgtttgaacatgctaattttggttcgtgcacaactggggcatgggctaattttttttttctgaatgaaatggagataaggatgtctctgattcctgtttac

SEQ ID NO: 5355 - DNA, 3185 bp, Zea mays
ctcgcttccacagccagctctccccaggctcaggcctcttctccccagttgcgttttctttggaagcttccatacacaactcgcatcgttcatcttccactgatgctatataaggagagagagagagagagatagagagagagagagagagagagagagagagagagagaagatctgatgatgcatgctgtaacagctcctgaactgcacaagttgtagtttggctgctggataataagttcatccatccatcaacgctacaaatcaaggctctgctcggacattgcgtaatccaagagaccgtcaaggcaaggcaaagccaacaccagacgagtcgagaacaccgcagcagagcgcggcgtccaatggacatggacggcaactccccgcggccaccccgccggccggagcgggaggggagctacggctacgacatcgagagcatggacggctccggggccgggggcccgccgccgtggagcgcgcaccacaacggctcctccgaggccctgctccgctacgacgacggcggcgccgaccgcgggagcacgcaacagccgctgctgcggaagcgcaccgtgaacacgacctcgcagatcgctatcgtcggtgccaacgtctgccccatcgagagcttggactacgaagtcgtggagaatgaccttttcaagcaggactggcgatcaagaaagaagaagcagatatttcagtacatcgtactcaagtggagcttggtgctccttattggcctattaactggatttgtcggcttcttcaacaatcttgcagttgagaacattgctggattcaaattgctgctcacgagcgatcttatgctcaaggggaggtatattagagcattttttgtgtatggaggttgcaatttagttttggcagcagctgcagcagcaatctgtgcttatattgcacctgctgctgctgggtctggtattcctgaagtcaaagcttatcttaatggggttgatgcctattctatattagctcctagcacactctttgttaagatttttggttcaatacttggagtttcagctggattcgtgctaggaaaggaagggcccatggtacatacaggggcatgcattgccaacttgcttggtcagggtggatcacgcaagtatcatcttacttgtaactggctacgctactttaagaatgacagagacaggagagatttgatcacatgtggatctgcagctggtgtggcggctgccttccgtgcacctgttggcggtgttctgtttgctcttgaagaagcagcatcatggtggcgaagtgctcttttgtggagaacattctttacaactgctgttgttgcggtggtattgagggggctgattgagttctgtcgtagtggaaaatgtggtctctttgggcaaggtggattgatcatgtttgatctcagttcaactgttgcagtctacagtactccagatctaattgcaattatagtccttgggataattggtggaatctttggaggcctcttcaactatctgttggacaagatcctccgagtttatagtattatcaacgagagaggtgctccattcaagatccttctcactataacaatatcaataatcacatcaatgtgttcctatggtcttccttggcttgctgcatgcactccatgccctgttgatgctgtggagcagtgtcccactgttggccgctccggaaattataagaacttccaatgcccaccaggacattacaatggtcttgcatcactcttcttcaacacaaatgatgatgccatccgcaatctcttcagcaacggcacatcgactgagttccaaatgtcatctcttttcatcttcttcactgctatttactgccttggactagtgacttacggtattgctgtcccatctggtctctttatccctgttattcttgctggagccacgtatgggcgcatagtgggaactcttcttggatccatatctgatcttgatcctggcctttttgccctacttggcgcagcatcttttcttggtgggacaatgagaatgactgtgtcagtctgtgtgatccttctagagctcaccaacgatctccccatgctccctttagtcatgcttgttcttctcatatccaagaccatagcagatagctttaacaagggagtttatgatcagatagtggtgatgaaaggcttgccgtacatggaggctcatgctgaaccatacatgaggcacttggttgctggtgatgtggtgtctggcccactaatcaccttttctggggttgagaaggtggggaacattgttcatgcattaaggttaacgggccacaatggtttccctgtgcttgatgagccacccataacggaaaccccggaactggttgggcttgtgactaggtctcatttattagttttgctgaacagcaagaatttcatgaagggacgggttaaaactagtggtagcttcgttctgcgaagatttggtgcatttgactttgcgaaaccaggttcaggtaaaggtttgaaaattgaggacctggatttcactgatgaggagatggacatgtatgtggatctccacccgatcacaaatacatcaccttacacagtggttgagacgatgtcactggcaaaagcagcaatccttttccgggaacttggtttgaggcaccttttggttgtgccaaagacaccagacaggcctcccatagtcgggattctcacaaggcatgacttcatgcctgagcacattcacagtctgttcccaaacctcaatcctcacaagtaccattcagcatcaatggcaggttgacaaggagactctttctgcttctcatctatttggcattattcgggtgctggctgtatgtaaattgcaaaggtgtatgcgtatctggttttcaattggatccatctcatcttctctacatagttttgtttgtgtggattttgtagcatatgctctttttgcaataaaaaaaatgtggcagttgtttggctggtgactgcctattatgagcctgcggcaataaatgttcagcaaattgcggagtaaacattgagagctccagaacatggagagaaagtgtgtattgtatatttgcgttgttcctgtaaagcatgtttagtcaaactcgaatattgtctataatacggagtaaatctcaggcggaaacatgggcgagctttctaa

SEQ ID NO: 5356 - DNA, 3153 bp, Sorghum bicolor
gagagagagagagagagagagagaggctctgatgatgctgtagcagctcctgaactgaacaagttttagcttgcttggctgctggataagtcgatcgatccatcagcgccaataatctacaaattaaagcaaggctctacttggacattgcgtaagccgagagaccgtcaaggcacggcacggcacggcaacagcaaacaccaccacaggtccgtccacagcagagcagagcagaggcgcggcggcgtccaatggacatggacggcaacggcaactccccgcggccgcctccgcgccggccggagcgggaggggagctacaacaactacgacatcgagagcatggacggcggctccggggccgcgccgccgccgtggcgccagcacaacaacggctcctccgaggccctgctccgctacgacgacggcggcgccgaccgcgggagcgaggcgcgccagccgctgctgaggaagcgcaccatgaacaccacctcccagatcgctatcgtcggcgccaacgtctgccccatcgagagcttggattacgaagtcgtggagaatgaccttttcaaacaagactggcgatcaagaaagaagaagcagatatttcagtacattgtcctcaagtggagcttggtgctccttattggcctattaactggagttgttggcttcttcaacaatcttgcggttgagaacattgctggattcaaattgctgctcacgagtgatcttatgctcaaggggaggtatattggagcattttttgtgtatggtggttggaatttagtcttggctgcagcagcagcagcaatctgtgcttatattgcacctgctgctgctgggtctggtattcctgaagttaaagcatatcttaatggggtcgatgcctattctatattagctcctagtacactctttgttaagatttttggttcaatacttggagtttcagctggatttgtgctaggaaaggaagggcccatggtacatacaggggcatgtattgccaacttgctcggtcagggtggatcacgcaagtatcatcttacttgtaactggctacgatactttaagaatgacagggataggagagatttgatcacatgtggatctgcagctggtgtggcagctgccttccgtgcacctgttggcggtgttctgtttgctcttgaagaagcagcatcatggtggcgaagtgctcttttgtggagaacattctttacaactgctgttgttgcggtggtattgaggggactgattgagttctgtcgcagtggaaaatgtggtctctttgggaaaggtggattgatcatgtttgatctcagttcaactgttgcaacctacagtactccggatctaattgcaattatagtccttgggataattggtggaatatttggaggcctcttcaactttttgttggacaagatcctccgagtttatagtattatcaacgagagaggtgctccattcaagatccttctcactataacaatatcaataatcacatcgatgtgttcctatggtcttccttggcttgcagcatgcactccatgccctgttgatgctgtggagcagtgtcctactgttggtcgctcgggcaattataagaacttccaatgcccgccagggcattacaatgatcttgcgtcactcttcttcaatacaaatgacgatgccatccgcaatctcttcagcaacggcacatcaactgagttccaaatgtcatctcttttcatcttcttcactgctatttactgccttggactagtgacttacggtgttgctgtcccatctggtctctttatccctgttattcttgctggagccacgtatgggcgcatagtgggaactcttcttggatccatatctgatcttgatcctggcctttttgcccttcttggcgcagcatcttttcttggtggaacaatgagaatgactgtgtcagtctgtgtgatccttctagagctcaccaatgatctccccatgctccctctactcatgcttgttcttctcatatccaaaaccatagcagataactttaacaagggagtttatgatcagatagtggtgatgaaaggcttgccattcatggaggctcatgctgaaccatacatgaggcacttggttgctggtgatgtggtgtctggcccactaataaccttttctggtgttgagaaagtggggaacattgttcatgcattgaggttaactggccacaatggttttcctgtggttgatgagccacccataacggaagccccggaactggttgggcttgtgactaggtctcatctattagttttgctgaacagcaagaatttcatgaaggaacggttcaaaactagtggtagctttgttctgcgaagatttggtgcatttgactttgccaaaccaggttcaggcaaaggtttgaaaattgaggatctggatttcactgatgaggagatggacatgtatgtggatctccacccgatcacaaatacatcaccttacacagtggttgagacaatgtcactagcaaaagcggcaatccttttccgggaactcgggttgaggcaccttttggttgtgccaaagacaccagacaggcctcccatagtcggcattctcacaaggcatgatttcatgcctgagcacattcacagtctgttcccgaacttgaatcctcacaagtaccattcagcatcaatggcaggttgataatgaggcttttttttctgcttcccatctatgtacattatttggatgcggatgctggctgtatgtaaattgcaaaggtgtatctggtgttcaattggatagagctcatcttctctacatggtttggcttgtgtggatttttagcatatgctctttttgcaataaaaagatgtggcagttattttgttggtgactgcctattatgagcctgcggcaagaaatgagtaaacattcaaagctccagaatatggagagaaagtgtgtattgcatatttgcattgttcctgtaaagcatgtttagagaactgaaactcttaagatttatatcttatctttaaatagtacggagtatatatctaaggcagaaacatgggcgattgggactgcgaagtgcaggtttcttcttgtgattgtaagatctatttggattgagattggtaacattcct

SEQ ID NO: 5357 - DNA, 3244 bp, Setaria italica
gaatacaaacaaaacaccaatccaactacccaagcaagcacgcaacacgttagttacatgactgtatacacacagtacatagtaccaaacaaaaaattgtatatacgcggaccaaaatgtgggttgcgtaagggcaatgatgagtttaagagatggcttttcatccgtatcattcagtcgccgcttctcctgtcaccacgtcatcagcttctgccccttgcattttctgttttcttccgaagctttcattttctcttcgcctcctgctggtgctacataagcgcggagagagagggagagagagagatcccaactggacaagttccagcttggccggctggatcagttcagtcaccagcggcaatctacaagctaaggctctctgcttggacattgcgcaagcttagagaagaccaggacgccaaggcaagaacgaacgagagcatcttcagagcagaggaggcggcggcaccaatggacggcggctccccgcggccgccccgccgtccggagcgggaggggagctacaactacgacatcgagagcatggacggctccggggccgggggcgtgccaccgtggcggccgcagcacaacggctcctccgaggccctgctccgctacgacgacggcggcgccggcgaccgcgggagcacgcacgagccgctgctgcggaagcgcaccatgaacaccacctcccagatcgccatcgtcggcgccaacgtctgccccatcgagagcttggattacgaagttgtggagaatgaccttttcaagcaagactggcgatcaagaaagaagaagcagatatttcagtacattgttctcaagtggagcttggtgcttcttattggcttgttaactggagttgttggtttcttcaataaccttgcggttgaaaacattgctggattcaaattgctgctcacgagtgatcttatgctcaatgagagatatatcaaagcattttttgtgtatggaggttgcaatttagtcttggcggcatctgcagcagcaatctgtgcttatattgcacctgctgctgctgggtccggtattcctgaagttaaagcatatcttaatggggttgatgcttattctatattggctcctagcacactgtttgtaaagatatttggttcaatacttggagtttcagctggatttgtactaggaaaggaaggccctatggtacatacaggagcatgtattgccaacttgcttggtcagggaggatcacgcaagtatcatcttacctgtaactggctaagatactttaaaaatgacagggataggagagacttgattacatgtggatctgcagctggagtagcagctgctttccgtgcacctgttggcggtgttctgtttgctcttgaagaagtagcatcatggtggcgaagtgctcttttgtggagaacgttctttacaaccgctgttgttgctgtggtattgaggggactgattgaattctgtcgcagtggaaaatgtggtctgtttgggaaaggtggattgatcatgtttgatctcagttcaactgttgcaacttacagtactccagatctaattgcaatcatagtccttggcataattggcggcatttttggaggcctcttcaactttctcttggacaagatcctgcgagtttacagtatcatcaatgagagaggtgctccattcaagatccttctcaccataacaatatcaataatcacatcaatgtgttcctttggtcttccttggcttgctgcatgcactccatgccctgctgatgctgtggagcagtgtccaactgttggtcgttctggcaattacaagaacttccaatgccaaccaggatattacaatgatcttgcatcactcttcttcaacacaaacgatgatgccatccgcaatctcttcagcaatggcaccgaaaatgagttccgaatgtccagtcttttcatcttcttcactgctatttactgccttggacttgtgacttacggggttgcagtcccctctggcctctttatccctgttattcttgctggagccacatatggccgcatagtgggaacacttcttggatctatatccgatcttgatcctggcctttttgccctccttggtgcagcatcttttctcggtggaacaatgagaatgactgtgtcagtttgtgtaatccttctagagctcaccaatgatcttcccatgctccctttggtcatgcttgttcttctcatatccaagaccatagcagataacttcaacaagggggtttatgatcagatagtggtgatgaaaggcttgccatacatggaggctcatgctgaaccatacatgagacatttggttgctggtgatgtggtttctggcccactaatcaccttttcaggtgttgaaaaggtggagaaaattgttcatgcattgaggataacgggccacaatgggtttcccgtggttgatgagccgcccataacggaaaccccggaactggttgggcttgtgactaggtcccatctattggttttactgaacagcaagaatttcatgaaggggcaggtgaaaactagtggtagctttgttctgcgaagattcggtgcctttgactttgcaaaaccagggtcaggaaaaggtttgaaaattgaggatctggattttactgatgaggagatggacatgtatgtggatctccatccgattacaaacacctcaccttatacggtggttgagacaatgtcactggcgaaagccgcaatccttttccgggaactcgggttgaggcaccttttggttgtgcccaaggcaccagataggcctcccatagttggaatcctgacaaggcatgatttcatgcctgaacacattcacagtctgttcccgaatctcaaccctcacaagtaccactcagcttcaatggcaggctgatcatgaggctttttgctacttctcatctgtgtaaattatttgcgtgctggctgtcaaaatgggatggacctgctagctctggttcctgcacaactaggacatgtgtaatgttcgtgggccaagtttttcttttcctgaatgaaatggacataagggtgtgtctgattgctgtttacaactctacctggtgccacccttgttccttctttcgtgaacaaggagactgatgtggttgtaccatcaaatcatccaaggtgtaaaataaatttgagcaaccactggtttgagtggttagacctataaataccacctcattcggccatttgaatgaact

SEQ ID NO: 5358 - DNA, 3060 bp, Setaria italica
attcagtcgccgcttctcctgtcaccacgtcatcagcttctgccccttgcattttctgttttcttccgaagctttcattttctcttcgcctcctgctggtgctacataagcgcggagagagagggagagagagagatcccaactggacaagttccagcttggccggctggatcagttcagtcaccagcggcaatctacaagctaaggctctctgcttggacattgcgcaagcttagagaagaccaggacgccaaggcaagaacgaacgagagcatcttcagagcagaggaggcggcggcaccaatggacggcggctccccgcggccgccccgccgtccggagcgggaggggagctacaactacgacatcgagagcatggacggctccggggccgggggcgtgccaccgtggcggccgcagcacaacggctcctccgaggccctgctccgctacgacgacggcggcgccggcgaccgcgggagcacgcacgagccgctgctgcggaagcgcaccatgaacaccacctcccagatcgccatcgtcggcgccaacgtctgccccatcgagagcttggattacgaagttgtggagaatgaccttttcaagcaagactggcgatcaagaaagaagaagcagatatttcagtacattgttctcaagtggagcttggtgcttcttattggcttgttaactggagttgttggtttcttcaataaccttgcggttgaaaacattgctggattcaaattgctgctcacgagtgatcttatgctcaatgagagatatatcaaagcattttttgtgtatggaggttgcaatttagtcttggcggcatctgcagcagcaatctgtgcttatattgcacctgctgctgctgggtccggtattcctgaagttaaagcatatcttaatggggttgatgcttattctatattggctcctagcacactgtttgtaaagatatttggttcaatacttggagtttcagctggatttgtactaggaaaggaaggccctatggtacatacaggagcatgtattgccaacttgcttggtcagggaggatcacgcaagtatcatcttacctgtaactggctaagatactttaaaaatgacagggataggagagacttgattacatgtggatctgcagctggagtagcagctgctttccgtgcacctgttggcggtgttctgtttgctcttgaagaagtagcatcatggtggcgaagtgctcttttgtggagaacgttctttacaaccgctgttgttgctgtggtattgaggggactgattgaattctgtcgcagtggaaaatgtggtctgtttgggaaaggtggattgatcatgtttgatctcagttcaactgttgcaacttacagtactccagatctaattgcaatcatagtccttggcataattggcggcatttttggaggcctcttcaactttctcttggacaagatcctgcgagtttacagtatcatcaatgagagaggtgctccattcaagatccttctcaccataacaatatcaataatcacatcaatgtgttcctttggtcttccttggcttgctgcatgcactccatgccctgctgatgctgtggagcagtgtccaactgttggtcgttctggcaattacaagaacttccaatgccaaccaggatattacaatgatcttgcatcactcttcttcaacacaaacgatgatgccatccgcaatctcttcagcaatggcaccgaaaatgagttccgaatgtccagtcttttcatcttcttcactgctatttactgccttggacttgtgacttacggggttgcagtcccctctggcctctttatccctgttattcttgctggagccacatatggccgcatagtgggaacacttcttggatctatatccgatcttgatcctggcctttttgccctccttggtgcagcatcttttctcggtggaacaatgagaatgactgtgtcagtttgtgtaatccttctagagctcaccaatgatcttcccatgctccctttggtcatgcttgttcttctcatatccaagaccatagcagataacttcaacaagggggtttatgatcagatagtggtgatgaaaggcttgccatacatggaggctcatgctgaaccatacatgagacatttggttgctggtgatgtggtttctggcccactaatcaccttttcaggtgttgaaaaggtggagaaaattgttcatgcattgaggataacgggccacaatgggtttcccgtggttgatgagccgcccataacggaaaccccggaactggttgggcttgtgactaggtcccatctattggttttactgaacagcaagaatttcatgaaggggcaggtgaaaactagtggtagctttgttctgcgaagattcggtgcctttgactttgcaaaaccagggtcaggaaaaggtttgaaaattgaggatctggattttactgatgaggagatggacatgtatgtggatctccatccgattacaaacacctcaccttatacggtggttgagacaatgtcactggcgaaagccgcaatccttttccgggaactcgggttgaggcaccttttggttgtgcccaaggcaccagataggcctcccatagttggaatcctgacaaggcatgatttcatgcctgaacacattcacagtctgttcccgaatctcaaccctcacaagtaccactcagcttcaatggcaggctgatcatgaggctttttgctacttctcatctgtgtaaattatttgcgtgctggctgtcaaaatgggatggacctgctagctctggttcctgcacaactaggacatgtgtaatgttcgtgggccaagtttttcttttcctgaatgaaatggacataagggtgtgtctgattgctgtttacaactctacctggtgccacccttgttccttctttcgtgaacaaggagactgatgtggttgtaccatcaaatcatccaaggtgtaaaataaatttgagcaaccactggtttgagtggttagacctataaataccacctcattcggcc

SEQ ID NO: 5359 - DNA, 3164 bp, Brachypodium distachyon
actaggcagcagctagctacgtatataagcaaagagatagaggggctcgggagagaggtactgacacagggagccaagggagacatcgagtagcctccaaattgcagatcgatgtccagaagtcctccttaatttggcttcatcaccgccaaattttctacctagatgtagagagggaatcaaagcttagaccagacgactgggtaaaaaaaaagattagaccagaagacggccagacgcaagaggcgacggcaaaatggacggccactcgccgcggcctcagcagcgcctccgcacgctggagcgggaggggagccacaacttggacatcgagagcatggacggtggcggaggaggggattggcggcagaacggctcggcggcggcgctgctccgctacgacgacagcggcagtggccgcgggagcgtgcgggagccgctgctgcggaagcgcaccctgaacaccacctcccagatcgccatcgtcggcgccaacgtctgccccatcgagagcctcgactacgaagtagtggagaataaccttttcaagcaagactggcgatcgagaaagaagaagcagatatttcaatacattgttatgaagtggactttggtgcttcttatcgggctcttgactgggattgttggcttcttcaataacctcgcggtagaaaacattgctggattaaaactgttgcttacaagtgatcttatgctcaaacaaaggtattttactgcattttttgcatatggaggttgcaatctagtcttagcatctgctgcagcggcaatatgtgcttatattgcacctgcagcagctggatctgggattcctgaagtcaaagcatatcttaatggagttgatgcttattctatattggctcctagtacactctttgtgaagatatttggctcaatacttggagtttcagctggatttgtacttggaaaggaaggcccgatggtgcatacaggggcatgcattgccaacttgcttggtcagggagggtcacgcaagtatcatcttacatgcaattggctaagatattttaagaatgacagggataggcgagatctaattacatgtgggtgtgcggctggagtggcagctgccttccgtgcacctgttggcggtgtcctgtttgctcttgaagaagcagcatcatggtggcgaagtgctcttttatggagaacattctttacaactgctgttgttgctgtggtgttgaagggtctgattgagttctgtcgaagtggaaaatgtggtctctttgggcaaggtggattgattatgtttgatctcagctcaactgttgcaacttacagtactccggatttgattgcaataattctccttggagtaattggtggcatcttcggaggcctctttaactttctcttggataaaattctccgtgtttatagtattatcaatgagagaggtgctccgtccaagatccttctcactatgacaatatcagttatcacatcaatgtgctcctatggtctcccttggcttgctgcttgcaccccatgccctgtggatgccatggagcaatgtcccaccatcggtcgctctggcaactataagaacttccagtgcccaccagggcattacaatggtcttgcatcactgttcttcaacacaaatgatgatgccattcgcaatctcttcagcaatggaactgagactgaattccatatgtctagtcttttcatctttttcatcgctatttactgcctcggtcttgtgacttacggcattgccgtcccatctggtctctttatccctgttattcttgctggagccacatatgggcgaatagtgggtacgcttcttggatccatatccgatcttgatcctggcctttttgcgcttcttggtgcagcatcttttctcggtggaacaatgagaatgactgtgtcagtctgtgtgattcttctagagctcaccaatgatctgcaaatgctccctttggtcatgcttgttcttctcatatccaagaccatagcagataactttaacaaaggggtttatgatcagatagtggtaatgaaaggtttgccgtacatggaggcccatgctgaaccatacatgaggcacttggttgctggtgatgttgtgtctggccctctaatcaccttttcaggtgttgagaaggtagggaacattattaccgcattgaggatcacaggccacaatggttttcctgtggttgatgagccacctctagcagaagcacctgagttggttgggcttgtgatcagatctcacctattagttttgctgaaaggcaagatgttcatgaaggagcgggtcaaaaccagtggtagctttattctggaaagatttggtgcctttgactttgccaagccagggtcagggaagggtttgaaaattgaggacctaaatttcactgatgaagagatggaaatgtatgtggatctccatccgattgcaaacacctcaccatatacagtggttgagacaatgtcactagcaaaagctgcaatcctattccgagcactaggattgaggcatctattggttgtgccaaagaccccagacaggcctcccattgttggaattctcacaaggcatgatttcgtgccagaacatattcacgggctgttcccgagtctcaatcctcacaaattccattcaacctcgatgggaggttgactgtgaaaaggttttgtctcctctcatttacaaaaattggactgtgctggcgtcatgtaaattacaaaaacgtacctggtatctgttggacagagcttgtcttctctacatttagcatgcatgctctttcgcagtgataataatttggctgcgtggttggttcagttgcctattgtgagcctatgacaggagttgctcggcaaactgcagagtaaacattcaaaactcatgaaattggaagataagcatctatacaatgtaaagttgctgtaaagcatgtttgagaactgagcgctgagggtttatttacagcgaacttttgatactcctgtcaactgtgttattcacattttctcattctcatgtgcaagtatttactatttactgatagtcttttcctttcaactgtgttattcacattttctagctcattgttgtagtactcaatggcctttcaccaggttccaagtgtcacctgtca

SEQ ID NO: 5360 - DNA, 3247 bp, Brachypodium distachyon
cttgtaggacccatcttgttctgtctctgaagtcatcgacaactaggcagcagctagctacgtatataagcaaagagatagaggggctcgggagagaggtactgacacagggagccaagggagacatcgagtagcctccaaattgcagatcgatgtccagaagtcctccttaatttggcttcatcaccgccaaattttctacctagatgtagagagggaatcaaagcttagaccagacgactgggtaaaaaaaaagattagaccagaagacggccagacgcaagaggcgacggcaaaatggacggccactcgccgcggcctcagcagcgcctccgcacgctggagcgggaggggagccacaacttggacatcgagagcatggacggtggcggaggaggggattggcggcagaacggctcggcggcggcgctgctccgctacgacgacagcggcagtggccgcgggagcgtgcgggagccgctgctgcggaagcgcaccctgaacaccacctcccagatcgccatcgtcggcgccaacgtctgccccatcgagagcctcgactacgaagtagtggagaataaccttttcaagcaagactggcgatcgagaaagaagaagcagatatttcaatacattgttatgaagtggactttggtgcttcttatcgggctcttgactgggattgttggcttcttcaataacctcgcggtagaaaacattgctggattaaaactgttgcttacaagtgatcttatgctcaaacaaaggtattttactgcattttttgcatatggaggttgcaatctagtcttagcatctgctgcagcggcaatatgtgcttatattgcacctgcagcagctggatctgggattcctgaagtcaaagcatatcttaatggagttgatgcttattctatattggctcctagtacactctttgtgaagatatttggctcaatacttggagtttcagctggatttgtacttggaaaggaaggcccgatggtgcatacaggggcatgcattgccaacttgcttggtcagggagggtcacgcaagtatcatcttacatgcaattggctaagatattttaagaatgacagggataggcgagatctaattacatgtgggtgtgcggctggagtggcagctgccttccgtgcacctgttggcggtgtcctgtttgctcttgaagaagcagcatcatggtggcgaagtgctcttttatggagaacattctttacaactgctgttgttgctgtggtgttgaagggtctgattgagttctgtcgaagtggaaaatgtggtctctttgggcaaggtggattgattatgtttgatctcagctcaactgttgcaacttacagtactccggatttgattgcaataattctccttggagtaattggtggcatcttcggaggcctctttaactttctcttggataaaattctccgtgtttatagtattatcaatgagagaggtgctccgtccaagatccttctcactatgacaatatcagttatcacatcaatgtgctcctatggtctcccttggcttgctgcttgcaccccatgccctgtggatgccatggagcaatgtcccaccatcggtcgctctggcaactataagaacttccagtgcccaccagggcattacaatggtcttgcatcactgttcttcaacacaaatgatgatgccattcgcaatctcttcagcaatggaactgagactgaattccatatgtctagtcttttcatctttttcatcgctatttactgcctcggtcttgtgacttacggcattgccgtcccatctggtctctttatccctgttattcttgctggagccacatatgggcgaatagtgggtacgcttcttggatccatatccgatcttgatcctggcctttttgcgcttcttggtgcagcatcttttctcggtggaacaatgagaatgactgtgtcagtctgtgtgattcttctagagctcaccaatgatctgcaaatgctccctttggtcatgcttgttcttctcatatccaagaccatagcagataactttaacaaaggggtttatgatcagatagtggtaatgaaaggtttgccgtacatggaggcccatgctgaaccatacatgaggcacttggttgctggtgatgttgtgtctggccctctaatcaccttttcaggtgttgagaaggtagggaacattattaccgcattgaggatcacaggccacaatggttttcctgtggttgatgagccacctctagcagaagcacctgagttggttgggcttgtgatcagatctcacctattagttttgctgaaaggcaagatgttcatgaaggagcgggtcaaaaccagtggtagctttattctggaaagatttggtgcctttgactttgccaagccagggtcagggaagggtttgaaaattgaggacctaaatttcactgatgaagagatggaaatgtatgtggatctccatccgattgcaaacacctcaccatatacagtggttgagacaatgtcactagcaaaagctgcaatcctattccgagcactaggattgaggcatctattggttgtgccaaagaccccagacaggcctcccattgttggaattctcacaaggcatgatttcgtgccagaacatattcacgggctgttcccgagtctcaatcctcacaaattccattcaacctcgatgggaggttgactgtgaaaaggttttgtctcctctcatttacaaaaattggactgtgctggcgtcatgtaaattacaaaaacgtacctggtatctgttggacagagcttgtcttctctacatttagcatgcatgctctttcgcagtgataataatttggctgcgtggttggttcagttgcctattgtgagcctatgacaggagttgctcggcaaactgcagagtaaacattcaaaactcatgaaattggaagataagcatctatacaatgtaaagttgctgtaaagcatgtttgagaactgagcgctgagggtttatttacagcgaacttttgatactcctgtcaactgtgttattcacattttctcattctcatgtgcaagtatttactatttactgatagtcttttcctttcaactgtgttattcacattttctagctcattgttgtagtactcaatggcctttcaccaggttccaagtgtcacctgtcaagactgaagacatactaacatactgatattgtgtttaacatt

SEQ ID NO: 5361 - DNA, 3326 bp, Triticum aestivum
ttgccaagaggacgacaagaggcgggggcaaatggacggaggccagtcgccgcggcctcagcagcaccaccgcacgccggagcgggaggggaacaacaaccacgacattgagggcatggacggtgcagcagaaggggattggtggcagaacagttcttctaacgcgctgctccggtatgacgaccgcgggagcatatgcgagccgctcatgcggaagcgcaccatcaacaccacctcccagatcgccattgtcggcgccaacatttgccccatcgagagcctcgactacgaagttgtggagaacaaccttttcaagcaagactggcggtcaagaaagaagaagcaaatatttcagtacattgttatgaagtggactttggtgcttctaatcggcctattgactggacttgttggcttcttcaataaccttgcagtcgaaaacattgctggattaaaattgctaatcacaagtgatcttatgctcaagcaaaggtatttcactgcatttttggcatatggaggttccaatctagtcttggcagcagctgctgcagcaatatgtgcttacattgcacctgcagctgctggatctggtattcctgaagttaaagcatatcttaatggagttgatgcttattctatactggcccctagtacactctttgtgaagatatttggttcaatacttggagtttcagctggatttgtacttggaaaggaaggtccaatggtacatacgggggcgtgcattgcaaacttacttggtcagggagggtcacgcaagtaccatcttacatgcaattggctgaggtatttcaagaacgacagggataggcgggatttgattacgtgtgggtgcgcagctggagtggccgctgccttccgcgcacctgttggtggcgtcctgtttgctcttgaggaagcagcatcatggtggcgaagtgctcttttatggagagcattctttacaactgctgttgttgctgtcgtgttgaggactctgattgagttctgtcgcagtggaaagtgtggcctctttgggcaaggtggattgattatgtttgatctcagttcaactgttgcaacctatagtagtccggatctacttgcaataattctccttggaataattggtggtatattcggaggcctcttcaactttctcttggataaaattcttcgtgtttacagtattatcaacgagagaggtgctccatccaagatccttctcactataatagtatcagttatcacatcaatgtgttcctatggcctcccttggcttgcttcgtgcactcaatgccccgaggatgccgtggagcaatgtcctaccgttggtcgctctggaaactataaaaactttcagtgcccaccagggtattacaatggtatggcatcacttttcttcaatacaaacgatgatgccatacgcaatcttttcagcactggaactgcaactgagtaccacatgtctagtcttttcatcttcttcgtcgcaatttattgccttggacttgtaacttatggaattgctgtcccatctggtctcttcatccctgttatccttgctggagccacatacggtcgaatagtgggcactctcttgggatccatatcaagtcttgaccctggactttttgcgcttcttggtgcggcgtcttttctcggtggaacaatgagaatgactgtgtcagtctgcgtgatccttctagaactcaccaatgatctacaaatgctccctttggtcatgcttgttcttctaatatcgaagaccatagcggataactttaacaaaggggtttatgatcagatagtggtaatgaaaggtttgccgtacatggaggctcatgctgaaccgtacatgagacatttggttgctggtgatgtcgtgtctggcccactaatcaccttttcaggtgttgagaaggtaggggacattgttactgcgttgaggatcacgggccacaatgggtttccagtggttgatgagccacctctaacagaagtgcctgagttggttgggcttgtgatcaggtctcatctattggttttgctgaaaggcaagatgttcatgaaggagccagtgaaaatgagtggtagctttgttatggaaagatttggtgcctttgattttgctaaggcagggtcagggaagggtttgaaaattgaggatctatatttcactgatgaggagatgcaaatgtatgtggatctccatgcaattgcaaacacctcaccatatacggtggttgagacaatgtcactagcaaaagctgcactcctattccgagaactaggattgaggcatctcttggttgttccaaagaccccatacaggcctcccattgttggaattctcacaaggcatgattttgtggcggaacatatccacgacctgttcccaagtctcaatcctcacaactttcattcagcctcaatgggaggttgattgtgaatttttttatgtttcttcccattcacaaaaatcatacgagtcttgtgtacatcaatcagattgcgcttttgtaataataatgtggcaacatggttggacgtctgcctagtgccagaaggtcaaggaagtgggtgaactgatgacagggaagccggcaaccctagttttctattatgagcctatgacaggaatcgttgtgccaactatagactaaacattcaaaaccttggaactcaaaagataaacatacatgctaaagtttctaaaaagcatgtttgagtatgagattttagttacattgaacttctgacaatatttaaacaagtatggttctcatttgcaagtatttgcttggcctcttgactctatttgcctttcaattgctctccgaccattcacatttgcatctcatcgtagtgtattgtgacttgttgtggtgctaactgccttgcatcacatccacgtatcaatataagggccagctcataagtgggcgcgagatcaagagaccaggacgtggttatctccctaagaaacgcctcgatttcggatgacagtaaaggtaagagtccgttgcggatctggcggtaagtaaaaacgggtcttaagtggaagatgacgtcctaggcggattaatcccgggagttcgaggtaggatacggacgtcgaccggccgggtttaaccggaccttacacgtaacctaattaggtaaggtcccgggtaaggtttttcgtggttacggaaacggaaagtgggtaaagtacgtttagaacctaagttagggacgtacccggggtcttaccgaggtaactactaaagttccgtacggggtaccttaacgtttaggttacgaagtaagtaagttaacgg

SEQ ID NO: 5362 - DNA, 2752 bp, Avena sativa
ccggtcaagcgaagcaagaggcggcgggcggacgggcgcgaaatggacggcggccagcagtcgccgcggcctcagccgccccgccgcgcgccggagcgggaggggagccacaactacgacatcgagcgcatggacaacggcgcaggggaaggggagtggtggcagaacgcctcgtccgacgcgctgctccgctacgacgaccgcgggagcgtgcacgagccgctgatgcggaagcgcaccgtcaacaccacctcccagatcgccatcgtcggcgccaacgtctgccccatcgagagcctcgactacgaagttgtagagaataacttcttcaagcaagactggcggtcgagaaagaagaagcagatatttcagtacattgtcatgaagtggaccttggtgcttcttattggcgtgttgactggacttgtcggcttcttcaataacctcgcggtggagaacattgctggattaaaattgctgcacacgagtgaacttatgctcgagcaaaggtattttactgcatttttggtgtatggaggttccaatctagtcttggcaacggctgcagcagcaatatgtgcttacattgcacctgcagcggctggatctggtattcctgaagttaaagcatatctcaacggtgttgatgcttattctatattggctcctagtacactctttgtaaagatatttggttcaatacttgccgtctcagctggatttgtacttggaaaggaaggtccaatggtacatacaggagcgtgtattgccaacttgcttggtcagggagggtcacgcaagtaccgtctcacatggaattggctaagatatttcaagaacgacagggataggcgtgatttgattacttgtgggtgtgctgctggagtggctgctgccttccgtgcacctgttggtggtgttttgtttgctcttgaggaagcagcatcatggtggcgcagcgctcttttatggagaacattctttacaactgctgttgttgctgtggtgttgaaggctttgattgagttctgtcgcagtggaaaatgtggtctctttgggcaaggtggattgattatgtttgatctcagttcaacagttgcggcctacagtacttcggacctaattgcaataattctccttggaataattggtggcgtcttcggaggcatcttcaactttctcttggataagatcctccgtgtttacagtattgtcaatgagagaggtgctccatccaagatccttctcactgtagccatatcaattatcacatcaacgtgctcctatggcctcccttggcttgctgcgtgcactcaatgccctgaagatgctgtggagcaatgtcccaccgttggtcgctctggaaacttcaagaactttcagtgcccaccagggtattacaacggtcttgcatcactattcttcaacacaaatgatgatgccatccgcaatctcttcagcaatggaaccgagactgagttccacatgtatagtcttttcatcttcttcatcgccatttattgccttggacttttgacttacggaattgccgtcccatctggtctctttatccctgttattcttgctggagccacatacggtcggatagtgggtacacttttgggatccatatcaaatcttgatcctggcctttttgcactgcttggtgcagcttcttttctcggtggaacaatgaggatgactgtgtcagtctgtgtgatcctcctagagctcaccaatgacctgcaaatgcttcctttggtcatgcttgttcttctcatatccaagaccatagcagatacctttaacaagggggtttatgatcagatagttgtaatgaaaggtttgcccttcatggaggctcatgctgaaccatacatgaggcacttggtagctggtgatgttgtgtctggcccactaatcaccttttcaggcgtcgagaaggtagggaacattgttactgcgttgaggatcacaggtcacaatggatttccagtggttgatgagccacctctaacagaatccgctgagttggtcgggcttgttatcaggtctcacctattggttttgctgcaaggcaaaatgttcatgaaagagcctgtgaaaaccagtggtagctttctgctggacgggtttggtgcctttgattttgccaaggcagggtcagggaagggcttgaaaattgaagagttatatttcacagatgaggagatgcaaatgtatgtggatctccattcgatagcgaacacctcaccatatacggtggttgagacaatgtcgctagcaaaagctgctatcctattccgagaactaggattgaggcatctattggttgtgccaaagaccccaaataggcctccaatcgtcggaattctcacaaggcatgattttgtggaggaacatatccacgggttgttccctagtctcaatcctcacaatttccactccgcatcgatgggaggttgactgcgaaaagttttttgttgcttctttaaaaaacaattcatacgagtgctggtggtatgtgatttacacgagtgtgcgtggtatttttgggtgagagctatgtctctgtacatcaattgcatatatatatgctgttttgcaaaacattaatctggctgcatggttagtccagttgcctattgtgagcccgtgaaagggatcgctctgcaaagtgtagagtaaacattcaaaactcttgaatttgaacgataagcatggactgtaaagttgtataaagcatgtctga

SEQ ID NO: 5363 - DNA, 4179 bp, Hordeum vulgare
tggatggacacgagagcaaccggctatgctggccacgacgcaggcgaaggaggcagcgcctcacgacggctacgatgtcgacagaggaggcgactgacactggaaaggagggctcgccggaggccctggcggccgcgcgtgctggcttccgtgggccaagctgccctccgcgggtgcgctggcctgcgaggacgccgcaggtgctgcccttcgccggtgcgctggccgcccagggcgccgcatgtgctggcctcctcatgtacgctggctgcagcgaactggcctccgtagcacacatacatacacgcgcgtcaagtgctagctagctcgctccactgtgaggcccctggtgcgcgtgcgcgcatgtggctgcccgagctcccgcgtgcgcgcgcttcggccgccgcgggcgagtcgggctgctggctgcttgcacgacggctggccgccggcccacctacccgccgcctccacctatgagctatggcgtgcagtcgactcgtcggtgcgcatgacatgtacacgatgtgtttgatgaaatgtcccatacaaagagaaagcgagggaaaccaggggatgtgattgttttagagagagagagagagtaggggtgaaagcgaggcgccgaattagctggacgcggctatagatgcgctcatgcattacataatttacattccaagcctgctttcgactccctccgtatcaaaattactttatgttttggtacagcttgtagtattattattattttgagcaacaaccacttagtttttcagcaaactgctattgtatttatcaaatttttctggcatgccggaatagccgataggaaatatcttgcgcacatggtagtttgggaagccactagttgcgaatattcatttggagctcaagagcatggtagacttgtccacgtgactattaaaatccacgagagcagtctcgggtggtatcctcttgactcctgagcctcatttgtccgttcatttttttcaccggttccggatatttaactttttgttaattgttggtttaaaatacctaactgttcatacccagacattgtttcttctggatatctaataagatttcatctgagcatgttcaacaaaatcatagagttggaaccaaaatattttctttcgcaaaaaagaaccaaattatttttgttaaactatttcgaattttcttttgttggtaaacaccttgaccctgtgaaaatttagttcaaaattctaacgaatgattgttgcaaccattttttttttgggcaaaatgaaaccataatctattaatacttgtatgttgcagttgtcaagaggacggcaggcaaatggatggaggccagtcgccacggcctcagcagcaccaccgcacgccggagcgagaggggaacaacaactacgacatcgagcgcatggacggtgcacgagaaggggagcggtggcagaatggttcttctgacgcgctgcttcggtacgacgaccgccagagcgtacacgagccgctcatgcggaaacgcaccattaacaccgcctcccagatcgctattgttggtgccaacatttgccccatcgagagcctcgattacgaagttgtggagaataaccttttcaagcaagactggcggtcaagaaagaagaagcagatatttcagtacattgttatgaagtggactttggtgcttctgatcggcctgttgaccggacttgttggcttcttcaataaccttgcagtcgaaaatattgctggactaaaattgctaatcacaagtgatcttatgctcaaccaaaggtattttactgcatttttggcgtatggaggttccaatctagtcttggcagcagcagctgcagcaatatgtgcttacattgcacctgcagctgctggatctggtattcccgaagttaaagcatatcttaacggagtcgatgcttattctatactggctcctagtacactttttgtgaagatatttggttcaatacttggagtttcagccggatttgtacttggaaaggaaggtccaatggtacatacgggggcgtgcattgcaaacttacttggtcagggagggtcacgcaagtaccatcttacatgcaattggctaagatatttcaagaacgacagggataggcgggatttgattacatgtgggtgcgcagctggagtggccgctgccttccgcgcacctgttggtggcgtcctgtttgctcttgaggaagcagcatcatggtggcgaagtgctcttttatggagagcattctttacaactgctgttgttgctgtcgtgttgaggactctgattgagttctgtcgcagtggaaagtgtggtctctttgggcaaggtggattgattatgtttgatctcagttcaactgttgcaacttatagtactccggatctacttgcaataattatccttggaataattggtggtatattcggaggcctctttaactttctattggataaaattcttcgtatttacagtattatcaatgagagaggtgccccgtccaagatccttctcactatgatagtatcggttatcacatcaatgtgctcctatggcctcccttggctagcttcgtgcacacaatgccccgtggatgccatggagcaatgtcccaccgttggtcgctctggaaactataagaactttcagtgcccaccggggtattacaatggtatggcatcactgttctttaacacaaacgacgatgccatccgcaatcttttcagcactggaactgcgactgagtaccatatgtctagtctcttcatcttcttcgtcgcaatttattgccttggccttgtaacttatgggattgctgtcccatctggtctctttatcccagttatccttgctggagccacatacggtcgaatagtgggtacgcttttgggatccatatcaaatcttgaccctggactttttgcacttcttggtgcggcctcttttctcggtgggacaatgagaatgacggtgtcagtctgcgtgatccttctagaactcaccaatgatctgcaaatgctccctttggtcatgcttgttcttctaatatcgaagaccatcgcggacagctttaacaagggggtttatgaccagatagtggtaatgaaaggtttgccgtacatggaggctcatgctgaaccgtacatgagacatttggttgctggtgatgttgtgtcgggcccactaatcacattttcaggtatcgagaaggtagcggacattgttactgcgttgaggatcactggccacaatggatttccagtggttgatgagccacctctaacagaagtgcctgagttggttgggcttgtgatcaggtctcatctattggttttgctgaaaggcaagatgtttatgaaggagcgggtaaaaaccagcggtagctttgttatggaaaggttcggtgcctttgactttgctaagccggggtcagggaagggtttgaaaattgaggatctacatttcactgatgaggagatgcaaatgtatattgatctccatacgattgcaaacacgtcaccatatacggtggttgagacaatgtcactagcaaaagctgctctcctatttcgagaactaggattgaggcatctcttggttgttccaaagactccatacaggcctcccattgttggaattctcacaaggcatgattttgtggaggagcatatccacggcctattcccaagtttcaatcctcacaacttccattcaacctcgatgggaggttgactgtgaaaagttttgtgtttcttcccatctacagaaatcatacaagtcttatgtacatcaattagattgctcttgtgtgataataatttggccacatggttggacgcctgcccagtgtcagaaggtcaaagaagttcgtgaactaaagacaaggaagccggtgaccctagttgtctgttgtaatcatatgagaggaattactgtacaactgtagagtaaacattcaaagtctggaactggaaagatgaacatacatgatacatttcctacaaagcatgtttgagtccgaggtttgtgtgtgtgtgtgtgtgtgcgcgcgcgtgtgtgtgtttgcgaagagtctaagggtttagttaagaacttctaaaaatatttaaacaagtctcattctcatttgcaagtatttgcttggcctcttgactgta

SEQ ID NO: 5364 - DNA, 2783 bp, Avena sativa
aagaggcggcgggcggacgggcgcgaaatggacggcggccagcagtcgccgcggcctcagccgccccgccgcgcgccggagcgggaggggagccacaactacgacatcgagcgcatggacaacggcgcaggggaaggggagtggtggcagaacgcctcgtccgacgcgctgctccgctacgacgaccgcgggagcgtgcacgagccgctgatgcggaagcgcaccgtcaacaccacctcccagatcgccatcgtcggggccaacgtctgccccatcgagagcctcgactacgaagttgtagagaataacttcttcaagcaagactggcggtcgagaaagaagaagcagatatttcagtacatcgtcatgaagtggaccttggtgcttcttattggcgtgttgactggacttgtcggcttcttcaataacctcgcggtggagaacattgctggattaaaattgctgcacacgagtgaacttatgctcgagcaaaggtattttactgcatttttggtgtatggaggttccaatctagtcttggcaacggctgcagcagcaatatgtgcttacattgcacctgcagcggctggatctggtattcctgaagttaaagcatatctcaacggtgttgatgcttattctatactggctcctagtacactttttgtaaagatatttggttcaatacttgctgtctcagctggatttgtacttggaaaggaaggtccaatggtacatacaggagcgtgtattgccaacttgcttggtcagggagggtcacgcaagtaccgtctcacatggaattggctaagatatttcaagaacgacagggataggcgtgatttgattacttgtgggtgtgctgctggagtggctgctgccttccgtgcacctgttggtggtgttttgtttgctcttgaggaagcagcatcatggtggcgcagcgctcttttatggagaacattctttacaactgctgttgttgctgtggtgttgaaggctttgattgagttctgtcgcagtggaaaatgtggtctctttgggcaaggtggattgattatgtttgatctcagttcaacagttgcggcctacagtacttcggacctaattgcaataattctccttggaataattggtggcgtcttcggaggcatcttcaactttctcttggataagatcctccgtgtttacagtattgtcaatgagagaggtgctccatccaagatccttctcactgtagccatatcaattatcacatcaacgtgctcctatggcctcccttggcttgctgcgtgcactcaatgccctgaagatgctgtggagcaatgtcccaccgttggtcgctctggaaacttcaagaactttcagtgcccaccagggtattacaacggtcttgcatcactattcttcaacacaaatgatgatgccatccgcaatctcttcagcaatggaaccgagactgagttccacatgtatagtcttttcatcttcttcatcgccatttattgccttggacttttgacttacggaattgccgtcccatctggtctctttatccctgttattcttgctggagccacatacggtcggatagtgggtacacttttgggatccatatcaaatcttgatcctggcctttttgcactgcttggtgcagcttcttttctcggtggaacaatgaggatgactgtgtcagtctgtgtgatcctcctagagctcaccaatgacctgcaaatgcttcctttggtcatgcttgttcttctcatatccaagaccatagcagacacctttaacaagggggtttatgatcagatagtggtaatgaaaggtttgcccttcatggaggctcatgctgaaccatacatgaggcacttggtagctggtgatgttgtgtctggcccactaatcaccttttcaggcgtcgagaaggtaggaaacattgttactgcgttgaggatcacaggtcacaatggatttccagtggttgatgagccacctctaacagaatccgctgagttggtcgggcttgttatcaggtctcacctattggttttgctgcaaggcaaaatgttcatgaaagagcctgtgaaaaccagtggtagctttctgctggacgggtttggtgcctttgattttgccaaggcagggtcagggaagggcttgaaaattgaagagttatatttcacagacgaggagatgcaaatgtatgtggatctccattcgatagcgaacacctcaccgtatacggtggttgagacaatgtcgctagcaaaagctgctatcctattccgagaactaggattgaggcatctattggttgtgccaaagaccccagacaggcctccaattgtcggaattctcacaaggcatgattttgtggaggaacatatccatgggttgttccctagtatcaatcctcacaatttccactccgcatcgatgggaggttgactgtgaaaagtttttgttgcttactttaaaaaaacaattcatacgagtgctggtggtatgtcatttacacgagtgtgcgtggtattttttgggtgagagctatgtctctgtacatcaattgcatatatatatgctgttttgcaaaacattaatctggctgcatggttagtccagttgcctattgtgagcccgtgaaagggatcgctctgcaaagtgtagagtaaacattcaaaactcttgaatttgaacgataagatgcactgtaaagttgtataaagcatgtctgagactgtacagtgaactgctgacactttaaataaggcattctcatt

SEQ ID NO: 5365 - DNA, 2750 bp, Avena sativa
attagaagcgaagaaaagctttgttagacaagaaggaagccggtcaagcgaagcaagaggcggcgggcgggcgcgaaatggacggcggccagcagtcgccgcggcctcagccgccccgccgcgcgccggagcgggaggggagccacaactacgacatcgagcgcatggacaacggcgccggggaagcggagtggtggcagaacgcctcctccgacgcgctgctccgctacgacgaccgcgggagcgtgcacgagccgctgatgcggaagcgcaccgtcaacaccacctcccagatcgccatcgtcggggccaacgtctgccccatcgagagcctcgactacgaagttgtagagaataacttcttcaagcaagactggcggtcgagaaagaagaagcagatatttcagtacatcgtcatgaagtggaccttggtgcttcttattggcgtgttgactggacttgtcggcttcttcaataacctcgcggttgagaacattgctggattaaagttgctgcacacgagtgaacttatgctcgagcaaaggtattttactgcatttttggtgtatggaggttccaatctagtcttggcaacagctgcagcagcaatatgtgcttacattgcacctgcagcggctggatctggtattcctgaagttaaagcatatctcaacggtgttgatgcttattctatattggctcctagtacactctttgtaaagatatttggttcaatacttgccgtctcagctggatttgtacttggaaaggaaggtccaatggtacatacaggagcgtgtattgccaacttgcttggtcagggagggtcacgcaagtaccgtctcacatggaattggctaagatatttcaagaacgacagggataggcgtgatttgattacttgtgggtgtgctgctggagtggctgctgccttccgtgcacctgttggtggtgttctgtttgctcttgaggaagcagcatcatggtggcgcagcgctcttttatggagagcattctttacaactgctgttgttgctgtggtgttgaagactttgattgagttctgtcgcagtggaaaatgtggtctctttgggcaaggtggattgattatgtttgatctcagttcaactgttgcggcctacagtacttcggacctaattgcaataattctccttggaataattggtggcgtcttcggaggcatcttcaactttctcttggataaaatcctccgtgtttacagtattgtcaatgagagaggtgctccatccaagatccttctcactgtagccatatcaattatcacatcaatgtgctcctacggcctcccttggcttgctgcgtgcactcaatgccctgtagatgctgtggagcaatgtcccaccgttggtcgctctggtaacttcaagaactttcagtgcccaccagggtattacaacggtcttgcatcactattcttcaacacaaatgatgatgccatccgcaatctcttcagcaatggaaccgagactgagttccacatgtatagtcttttcatcttcttcatcgccatttattgccttggacttttgacttacggaattgccgtcccatctggtctctttatccctgttattcttgctggagccacatacggtcggatagtgggtacacttttgggatccatatcaaatcttgatcctggcctttttgcactgcttggtgcagcttcttttctcggtggaacaatgaggatgactgtgtcagtctgtgtgatcctcctagagctcaccaatgacctgcaaatgcttcctttggtcatgcttgttcttctcatatccaagaccatagcagatacctttaacgaaggggtttatgatcagatagttgtaatgaaaggtttgcccttcatggaggctcatgctgaaccatacatgaggcacttggtagctggtgatgttgtgtctggcccactaatcaccttttcaggcgtcgagaaggtagggaacattgttactgcgttgaggatcacaggtcacaatggatttccagtggttgatgagccacctctaacagaatccgctgagttggtcgggcttgttatcaggtctcacctattggttttgctgcaaggcaaaatgttcatgaaagagcctgtgaaaaccagtggtagctttctgctggacgggtttggtgcctttgattttgccaaggcagggtcagggaagggcttgaaaattgaagagttatatttcacagatgaggagatgcaaatgtatgtggatctccattcgatagcgaacacctcaccatatacggtggttgagacaatgtcgctagcaaaagctgccatcctattccgagaactaggattgaggcatctattggttgtgccaaagaccccagacaggcctccaattgtcggaattctcacaaggcatgattttgtggaggaacatatccatgggttgttccctagtatcaatcctcacaatttccactccgcatcaatgggaggttgactgcgaaaagttttttgttgcttctttaaaaaacaattcatacgagtgctggtggtatgtcatttacacgaccgtatgtggtattttttgggtgagagctatgtcttctgtacatcaattgcatatatatatgctgttttgcaaaacattaatctggctgcatggttagtccagttgcctattgtgagcctatgaaagggaatcactctgcaaagtgtagagtaaacattcaaaactcttgaatttgca

SEQ ID NO: 5366 - DNA, 2885 bp, Secale cereale
cgatcggcgatgagccgccgtacgtgctctggatgatcaccgcaagtccttggcctcgtcatcagctcaagctccagttttcttcatagataagttgccaggaggacggcaagaggcgggggcaaatggacggaggcgagtcgccgcggcctcagcagcaccaccgcatgccggagcgggaggggaacaacaaccacgacattgagggcatggacggtgcagcagaaggggattggtggcagaacggctcttctaacgcgctgcttcggtacgacgaccgtgggagcgtatgcgagccgctcatgcggaagcgcaccatcaacaccacctcccagatcgccattgttggtgccaacatctgccctatcgagagcctcgactatgaagttgtggagaacaaccttttcaagcaagactggcggtcaagaaagaagaagcagatatttcagtacattgtgatgaagtggactttggtgctcctaatcggcctgttgactggatttgttggcttcttcaataaccttgcagtcgaaaacattgctggattaaaattgctaatcacaagtgatcttatgctcaaccaaaggtatttcactgcatttttggcatatggaggttccaatctagtcttggcaggagctgctgcagcaatatgtgcttacattgcacctgcagctgctggatctggtattcctgaagttaaagcatatcttaatggagttgatgcttattctatactggctcctagcacactctttgtgaagatatttggttcaatacttggagtttcagctggatttgtacttggaaaggaaggcccaatggtacatacgggggcgtgcattgcaaacttacttggtcagggagggtcacgcaagtaccatcttacatgcaattggctgagatatttcaagaacgacagggataggcgggatttgattacgtgtgggtgcgcagctggagtggccgctgccttccgcgcacctgttggtggcgtcctgtttgctcttgaggaagcagcgtcttggtggcgaagtgctcttttatggagagcattctttacaactgctgttgttgctgtcgtgttgaggactctgattgagttctgtcgcagtggaaagtgtggtctctttgggcaaggtggattgattatgtttgatctcagttcaactgttgcaacctatagtagtccggatctgcttgcaataattctccttggaataattggtggtatattcggaggcctcttcaactttctcttggataaaattcttcgtatttacagtattatcaacgagagaggtgctccatccaagatccttctcacaataacaatatcaattatcacatcaatgtgctcctatggcctcccttggcttgcttcgtgcactcaatgccccgaggatgccgtggagcaatgtcctaccgttggtcgctctggcaactataagaactttcagtgcccaccagggtattacaatggtatggcatcacttttcttcaatacaaacgacgatgccatacgcaatcttttcagcactggaacagcgactgagtaccacatgtctagtcttttcatcttcttcgtcgcgatttattgccttggactggtaacttacggaattgccgtcccatctggtctctttatccctgttatccttgccggagccacatatggtcgaatagtgggcacgcttttgggatccatatcaaatctggaccctggactttttgcgcttcttggtgcggcctcttttctcggtggaacaatgagaatgactgtgtcagtctgcgtgatccttctagaactcaccaatgatctccaaatgctccctttggtcatgcttgttcttctaatatcgaagaccatagcggataacttcaacaaaggggtttatgatcagatagtggtaatgaaaggtttgccgtacatggaggctcacgctgaaccgtacatgagacatttggttgctggtgatgttgtgtctggcccactaatcaccttttcaggaatcgagaaggtaggggacattgttactgcattgaggatcacgggccacaatggatttccagtggtcgatgagccacctctaacagaagtgcctgagttggttgggcttgtgatcaggtctcatctattggttttgctgaaaggcaagatgttcatgaaggagccagtgaaagtgagtggtagctttgttatggaaagatttggtgcctttgattttgctaaggcagggtcagggaagggtttgaaaattgaggatctacatttcactgatgaggagatgcaaatgtatgttgatctccatacgattgcaaacacctcaccatatacggtggttgagacaatgtcactagcaaaagctgcactcctattccgagaactaggattgaggcatctcttggttgttccaaagaccccatacaggcctcctattgttggaattctcacaaggcatgattttgtggcggaacatatccacgacctgttcccaagtattgatcctcacaactttcattcagcctcaatgggaggttgattgtgattgttttttggggtttcttcccatttacaaaaatcacacaagtcttatgtacatcaatcagattacgcttttgtaataataatgtggccacatggttggacgtctgcctagtgccagaaggtcaaggaagttggtgaactgatgacagggaaaccagcaaccctagttttctattgtgagcctatgacaggaatcgttgcgccaactgtagataaaacattcaaaaccctggaactcgaaagataaacatacatgctaaagtttctacaaagcatgtttgagtatgagattttagttacattgaacttctggcaatatttaaacaagtatggttct

SEQ ID NO: 5367 - DNA, 2380 bp, Avena sativa
tcggggcaaacgtcttccccatcgagagcctcgactacgaaattgtggagaatgatcttttcaagcaagattggcgatcaagaaagaagaagcagatatttcagtatattgttctgaaatgggcactggttcttcttattggcttgttgactggacttgttggtttcttcaacaaccttgcagtcgaaaatattgctggattcaaattgttgctcacaggtgatcttatgctccagcagaggtacttcacagcatttttggcatatggaggctgcaatcttgtcttgggagctactgctgcagcaatctgcgcttacatagcacctgctgctgctggttctggtatccctgaagttaaggcatatcttaatggagttgatgcttactctattttagctcccagcacactctttgtgaagatatttggttcaatccttggagtttcagctggatttgtacttgggaaagaaggtcccatggtacatacaggggcatgcattgccaacttgcttggtcagggaggatctcgcaagtaccatcttacctgcaattggctgaaatattttaagaatgatagggataggcgagatttgattacatgtggtgcagcagctggagtggcagcagcatttcgtgcacctgttggtggtgtactctttgctctcgaggaagcagcatcatggtggcgaagtgctcttctgtggagaacattctttacaactgctgttgttgctgtcgtgttgagggccctgatcgaggtctgtcgtagtggaaaatgtggtctgtttgggcagggagggttgattatgtttgaccttagctcaaacgtcccgacatacggcacccaagatgtcattgcaatagtagtccttggaataattggcggcgtcttcggaggcctcttcaactttctcttggataggattcttcgtgtctacagtattatcaatgagagaggtgctccactaaagatccttctcaccatcacaatatcaattatcacgtcggcatgctcctatgggctcccttggcttgcttcatgcactccatgccctgttggttccatggaggaatgccccactatcggccgatctggaaattttaaaagcttccagtgtccgcctggtcattataatggcctggcatcacttttcttcaacacaaatgatgatgccatccgcaatctcttcagccgtggcaccgcgaacgagttccacatgtctagccttttcatattcttcatcgctatttactgcctcggtctggtgacatatggtattgctgtcccatctggtctctttatccccgtaatacttgctggggctacctatggacgcatagttgggacacttcttggccccgtctctgatcttgatccgggcctctttgcgctgcttggtgctgcatctttccttggtggaacaatgaggatgaccgtgtcagtctgcgtaatccttctggagctcactaacgaactccatatgctccctctggtcatgctcgtccttctgatatcaaagaccatagccgattgcttcaacaaaggggtttatgaccagattgtggtgatgaaaggtttgccattcatggaggcccatgctgagccatacatgaggcacctggtagctggcgacgtcgtgtctgggccactgatctccttttcaggtgtcgagagggtgggcaacatcgttcaagcgttgaagatcacgggccacaacggatttccggtggtcgatgagccgcctctaacagaatctccagagctggttgggctggtgcttagatcacacctgttggttctactgaaaggcaggaccttcatgaaggataaggcgaaaacaagcggtagctttgtgttgcgaagattcggtgcgtttgactttgccaagcccggttccgggaaaggtctgaagatcgaggacctggatttcactgatgaagaaatggagatgtatgtcgatctccacccgatcacgaatacttcaccctacacggtggttgagacaatgtcacttgcaaaggctgcggtccttttcagggcactggggctaagacacctcctggttgtgccgaagaccccagggagacctcccattgttgggattctcacaaggcacgacctcatgccggagcatatccacgggctgttcccggatctccgcaagtcgcattgaggcgcgaaaccggagcactcatagcagatcatacaatttttcttcgtctctcagtcatttctcatgaagatgcctcattggatcgtggaataatgtgattgtaaagagttggttccccaatcagcagtttcagtggatttcttttttgtagtagtttattatacccttgtgtaacagacaatgctctttgtcagtacatgtgctct

SEQ ID NO: 5368 - DNA, 2222 bp, Avena sativa
cttccccatcgagagcctcgactacgaaattgtggagaatgatcttttcaagcaagattggcgatcaagaaagaagaagcagatatttcagtatattgttctgaaatgggcactggttcttcttattggcttgttgactggacttgttggtttcttcaacaaccttgcagtcgaaaatattgctggattcaaattgttgctcacaggtgatcttatgctccagcagaggtacttcacagcatttttggcatatggaggctgcaatcttgtcttgggagctactgctgcagcaatctgcgcttacatagcacctgctgctgctggttctggtatccctgaagttaaggcatatcttaatggagttgatgcttactctattttagctcccagcacactctttgtgaagatatttggttcaatccttggagtttcagctggatttgtacttgggaaagaaggtcccatggtacatacaggggcatgcattgccaacttgcttggtcagggaggatcacgcaagtaccatcttacctgcaattggctgaaatattttaagaatgatagggataggcgagatttgattacatgtggtgcagcagctggagtggcagcagcatttcgtgcacctgttggtggtgtactctttgctctcgaggaagcagcatcatggtggcgaagtgctcttctgtggagaacattctttacaactgctgttgttgctgttgtgttgagggccctgatcgaggtctgtcgtagtggaaaatgtggtctgtttgggcagggagggttgattatgtttgaccttagctcaaacgtcccgacatacggcacccaagatgtcattgcaatagtagtccttggaataattggcggcgtcttcggaggcctcttcaactttctcttggataggattcttcgtgtctacagtattatcaatgagagaggtgctccactaaagatccttctcaccatcacaatatcaattatcacgtcggcatgctcctatgggctcccttggcttgcttcatgcactccatgccctgttggttccatggaggaatgccccactattggccgttctggaaattttaaaagcttccagtgtccgcctggacattataatggtctggcatcacttttcttcaacacaaatgatgatgccatccgcaatctcttcagccgtggcaccgcgaacgagttccacatgtctagccttttcatattcttcatcgctatttactgcctcggtctggtgacatatggtattgctgtcccatctggtctctttatccctgtaatacttgctggggctacctatggacgcatagttgggacacttcttggccccatctctgatcttgatccgggcctcttcgcgctgcttggtgccgcatctttccttggtggaacaatgaggatgaccgtgtcagtctgcgtaatccttctggagctcactaacgaactccatatgctccctctggtcatgctcgtccttctgatatcgaagaccatagccgactgcttcaacaaaggggtttatgaccagattgtggtgatgaaaggtttgccattcatggaggcccatgctgagccatacatgaggcacctggtagctggcgacgtcgtgtctgggccactgatctccttttcaggtgtcgagagggtgggcaacatcgttcaggcgttgaagatcacgggccacaacggatttccggtggtcgatgagccgcctctaacagaatctccagagctggttgggatggtgcttagatcacatctgttggttctgctgaaaggcaggaccttcatgaaggataaggcgaaaacaagcggtagctttgtgttgcgaagattcggtgcattcgactttgccaagcccggttccgggaaaggtctgaagatcgaggacctggatttcactgatgaagaaatggagatgtatgtcgatctccacccgatcacaaatacttcgccctacacggtggttgagacaatgtcacttgcaaaggctgcggtccttttcagggcactggggctaagacacctcctggttgtgccgaagaccccagggagacctcccattgttgggattctcacaaggcacgacctcatgccggagcatatccacgggctgttcccggatctccgcaagtcgcattgaggcgcgaaaccggagcactcatagcagatcatacaatttttcttcgtctctcagtcatttc

SEQ ID NO: 5369 - DNA, 3947 bp, Cocos nucifera
gccgctgtggcggccccgtttccgttgctctcattctctctcttctttacttccagccgtctctccctctctatgtaagacggccttttgtccctatccattaccagcgggagactcgtgccccaactttctctctctctaactcacggagaagtaggaaaagagaagagaaagcgatctttcaaccgaaaacacaaaaataaatttctctctgctctctccaccattcgatcaatcccatttactatttttcttagccatatttctccttccaatgatccagttctaagtcccggcagatggtatccagctcccaagttttcgattgcaagaagacgcccaaatcgtaaatccaggtggaattggaggggtaagaaggaatagctgtctcctgtctgtgttaagggaacggagggaataaggaggtggaataatggatctcagagaggggactaacgacatagagagcatggagggattggggagggatgtagagaggaacgggtcggggtttgaggacgagaaggaggccgggatgaggcagccgctgctgctgaggaagaggaccatgaatacaacctcacagattgccatagttggtgccaacgtttgccccattgaaagcttggattatgaaattgtggagaatgatctttttaagcaagactggagatcaaggaaaaaggttcagatatttcaatacattgtccttaagtggactcttgcacttcttataggcttggcaactggacttgttggcttcttcaacaaccttgcagttgagaatattgctggattcaaattgttgctaactagtaatcttatgcttgagcatagtgcaggttctttgcagcatttttggcatattctggttgcaatttagtattggcagcagcagcagccgccatctgtgcttacattgcacctgcagctgccgggtctggtatacctgaagtgaaggcatatctcaatggaattgatgctcattctatattagctccaagtacgctctttgtaaagatatttggttcagttcttggagtttctgctggatttgttttgggcaaggaagggcctatggtacatactggagcatgcattgccaacttacttggtcagggtgggtctcgcaagtaccacctgacatggacatggctcaggtattttaagaacgatagggatcgccgagatttgatcacctgcggggctgcagctggagtggcagctgccttccgagcacctgtaggcggtgtcctctttgcccttgaagaagcagcatcttggtggcgaagcgctctcctgtggaggacattcttcacgacagctgttgttgctgtggtattaagagctttcatagaatactgccgtggtggaaaatgtggactattcggggaaggaggactgataatgtttgatcttagttcaaccatcactacatatagtactccagatctagtagcaattttggtccttggagtcattgggggtgtattcggaggtctctacaactatctattggaccggatccttcgcacctacagcatcattaatgagaaaggtgctccattcaagatacttctcacgatcaccatatctctcctcacatcatgctgttcctatggacttccttggctcgctaggtgcactccatgtcctgcagatctccgagagcaatgtcctaccattggccgctcaggcaactttaagaatttccagtgccccccaggtcactacaatgaccttgcctccctatttcttaacaccaatgatgatgccatccgcaacctattcagtggtaacactgacaacgagttccacatgtccacccttttcatctttttcactgccatttatttccttggcctcgtaacatatggagttgctgtcccttctggtctcttcattcctgttatacttgctggtgcttcctatggccgcattgtagggactcttctgggtcccatctctgacctagatactggcctcttcgccctacttggggctgcatcttttcttggtggaaccatgagaatgaccgtctcagtctgtgttattcttctggagctcaccaatgatcttctaatgctccccttggtcatgcttgttcttctgatatccaaaacagtagctgatagcttcaacccaggggtctatgatcagattgttaagatgaagggcttgccatacatggaggctcatgcagagccttacatgaggcacttggtcgctggagatgtggtctcaggcccgcttatcacttttgctggtgtggagaaggtggggaacatagtgcatgcattgaggttgacaggccatagtggttttccagtgattgatgagccacctttctcagatgcacctgagttgtgtgggcttgtcttgagatctcatctgcttgtgttgttaaaagggaagagtttcaccaaagagagggtgagaactggggtgggggagttattacagagatttggtgcttttgattttgccaagcctggatcaggtaaaggaatgaagtttgaagacttggatatccaggaggaggaaatggacatgtatgtggatctgcacccgatcacgaatacatcaccatacacagtggttgagacaatgtcactggcaaaagctgcagtgctttttcggcagcttggactccggcacctttgtgttgtgccaaagacaccaggcaggcctcccattgttggaattcttacgcggcatgactttatgccagagcacattcttggactgttcccacatttcaaccctcacaagtaggctgaggatggatggtgcaagtttctcttgccttggtttgtcgaaattgctgctatcattattataaatacttatttttagtgtgagttttactgtccctttgtttttcccctttttcttttgaggtggatgaaggtccatttgcgacctcaaaatatgcttgaaaggaactgagcttaaacatcaattgttgaatatgttccatgtagcattttgatatgttctatattttttcattagaattatattagtttgattgatgcaagtgctttaataatctgcagtcaattgcttggtggtgcatcgtgtttagttttcctacataacaaaaagagcattatatctttagatggttgaaatacatcactgcaaattctcaacctagtggatggactgaataccaaaacaaattttgttaaatgcaagaacctatatttgacgtttacagggtagacaagaccatccccgcaagaattttcatcatggatggcttcatgcatggtttatagatatagagggcactgaaggaagaattcgttctcaatttaggatgaactactgtttgtttgcatggctttaatttctgtcctgatttgcttttcgatatagacttcgggacctaacagatcattgggttttggaacatggccttgctcattaaccaagaggtgaaagaccgctgattcaaggctggctcatatagcaaccaaaaaatgttggcttttattttcttaccttgccaaattgtttcatctaaattttttgcccagctaccaaatatctcctgcagcttctgtcagggtctcgtacgtattgaacttgtatataaatctggggccctatgtgatggtgcggttaatcttaattatctaaagccagcagtcaagaactcacaggtttcacctttggtatttatacatctttttgtttgtgtggattatcgaacatggcaacgtgcttccactggtttgtatgtttggcgatgaatggtgcattatcatactgtttttgctgtggacttgtttctttggtggcgttggcacaactgtgtggcaacgtcaggaaaccagatgatgcggttcctctgtcttgcccttgcgaccaaccatctgttgtgccgcatctgtagataattccatttgtctattttcatttatgatgttgggagtttt

SEQ ID NO: 5370 - DNA, 3143 bp, Elaeis guineensis
agcccaggtggaaaggtggaataggagggataaggaggaatagaactcctgcctgtgttaagggatcggagggaataaggaggtggaataatggatctcagagaggggactaacgacatagagagcatggagggactgggaatggatgtagagaggaacgggtcggggtttgaggacgagaaggaggccgggatgaggcagccgctgctgctgaggaagaggaccatgaatacaacctcacagattgcgatcgttggtgccaacgtttgccccattgaaagcttggattatgaaattgtggagaatgatctttttaagcaagactggagatcaaggaaaaaggttcagatatttcaatacattgtcctcaagtggactcttgcacttcttataggcttggcaactggactagttggcttcttcaacaaccttgcagttgagaatattgccggattcaaattgttgctaactagtgatcttatgcttaaggataggttctttgcagcatttttggcatattctggttgcaatttagtattggcagcagctgctgcagccatctgtgcttacattgcacctgcagctgccgggtctggcatacctgaagtgaaggcatatctcaatggaattgatgctcattctatattagctccgagtacgctctttgtaaagatatttggttcagttcttggagtttctgctggatttgttttgggcaaggaagggcctatggtacatacaggagcatgcattgccaacttacttggtcagggtgggtcccgcaagtaccacctgacatggacatggctcaggtattttaagaatgacagggatcgccgagatttgatcacctgcggggctgcagctggagtggcagctgccttccgagcacctgtaggtggtgtcctctttgcccttgaagaagcagcatcttggtggcgaagcgctctcctgtggaggacattcttcacaacagctgttgttgctgtggtattaagagctttcatagaatactgccgtagtggaaaatgtggactcttcggggaaggaggactaataatgtttgatcttagttcaaccatcactgcatacagtactccagatctagtagtaattttggtccttggagtcattgggggtgtatttggaggcctctacaactatctattggaccggatccttcgcacctacagcatcattaatgagaaaggtgctccattcaagatacttctcactatcaccatatccctcctcacctcatgctgctcctatggactcccttggctcgccaggtgcactccatgtcctgcggatcttcaagaccaatgtcccaccattggccgctcaggcaactttaagaatttccagtgccccccaggtcactacaatgaccttgcttccctatttcttaacaccaatgatgatgccatccgcaacctattcagtggtaacactgacaacgagttccacatgtccacccttttcatctttttcactgccatttatttcctcggccttgtaacctatggagttgctgtcccttctggtctctttattcctgttatacttgctggtgcctcctatggccgcattatagggactcttctgggtcccatctctgacctagatactggtctcttcgccctgcttggggctgcatcttttcttggtggaactatgagaatgactgtctcagtatgtgttattcttctggagctcaccaatgatcttctaatgctccccttggtcatgcttgttcttctgatatccaaaacggtagctgatagtttcaacctaggtgtctatgatcagattgttaagatgaaaggcttgccatacatggaggctcatgcagagccctacatgaggcacttggtcgctggagatgtggtctcaggcccgctcatcacttttgctggtgtggagaaggtggggaacatagtgcatgcattgaggttgacaggccataatggatttccagtgattgacgagccacctttctcagatgcacctgagttgtgtgggcttgtcttgaggtctcatctgcttgtgttgttaaaagggaagaggttcaccaaagagagggtgagaactggggtgggggagctattacaaagatttggtgcttttgattttgccaagcctggatcaggtaaaggaatgaagtttgaagacttggatatccaggaggaggaaatggacatgtacctggatctgcacccgatcacgaatacatcaccatacacagtggttgagacaatgtcactggcaaaagctgcagtgctttttcggcagcttggactcaggcacctttgtgttgtgccaaagacaccagggaggcctcccattgttggaattctgacgcggcatgacttcgtgccagagcacattcttggattgttcccacatttcaaccctcacaagtagcccaaggatgcatggtgcaagattctcttcccttggtttgtcgaaattgctgttattactatcatacatacatatctttagtgtgaattttactgtctctttatttttcacctttttcttttgaggtggatgaaggtccatttgtgacctcaaaatctgcttggaaggaactgagtttaaacatcaattgtcaaatatgttccatgtaacattttgatatgttctatattttttcaggagaactatattagtttgattgatacaagggctttaataatctgcagtcaattgtttggtagtgcatcgtgtttagttttcctacactcataaacgataagagcattatatctttagatggttgaaatacattactgcaaattttcaatctagtggatggactgaacactgaaataaaattttgttgaatgcaagaacatatatttgacatttacagggtagacaagaccatccctgcaacaatttttgtcaaggatggcttcgtacatggttgacaggtacggagggcactgcaaggaagaatttgttctcaatttaggatgaaccactgtttgtttgcatggcaataatttctgtcctgatttggttttcgatatagacttggggacctaaacagatcattgggttttgcaacaaggccttgctcgccaaccaacaggctatagactgctgattcaaggctggctcatattataacc

SEQ ID NO: 5371 - DNA, 2379 bp, Triticum aestivum
cgtcttcgccatcgagagcctcgactacgaaattgtggagaatgatcttttcaagcaagactggcgatcgagaaagaagaatcagatatttcagtatgttgtcctgaaatgggcattggttcttcttattggcttgttgactgggcttgttggcttcttcaacaaccttgcagtcgagaatattgctggattcaaattggtgctcacaggtgatcttatgctccagaagaggtacttcacagcatttttggcatacggaggctgcaatctagtcctaggagccactgctgcagcactatgcgcttacatagcaccagctgctgctgggtctggcatccctgaagttaaagcatatcttaatggagttgacgcttactctattttagctcccagcacactctttgtcaagatatttggttcaatacttggagtttcaggtggatttgtacttgggaaagaaggtcccatggtgcatactggggcatgcattgccaacttgcttggtcaggggggatcacgcaagtaccatctcacatggaattggctgaaatatttcaaaaatgatagagatagacgagatttgattacatgtggtgcagcagctggagtggcagccgcatttcgcgcacctgttggtggtgtactctttgctctcgaggaagcagcatcatggtggcgaagtgctcttctgtggagaacattcttcacaactgctgttgttgctgtagtgttgagggccctgattgagttctgtcgtaaaggaaaatgtggtctctttgggcaaggagggttgattatgtttgatcttagctcgaacgtcccatcatatggtacccaagatctcatcgcgattataattcttggagtaattggtggcgtcttcggaggccttttcaactttctcttggataggattcttcgtgtctacagtattatcaatgagagaggcgctccatccaagattcttctcaccatcacaatatcgatcatcacttcggcgtgctcctatgggctcccttggcttgctgcgtgctctccgtgccctgttggttcaatggaggaatgccccaccattggccgctctggaaattttaagagcttccagtgcccgcctggtcactacaatggtcttgcatcactcttcttcaacacaaatgacgatgccatccgcaatctcttcagccgtggtaccgaaaatgagttccacatgtctagccttttcgtcttcttcattgctatctactgccttggtctcgtgacgtatggtattgctgtcccatctggtctctttatcccggtaatacttgccggggcaacatatgggcgcatcgttgggacacttctcggtcccatgtctgatatcgatcctggcctctttgcactgctgggtgccgcatctttccttggtggaacaatgagaatgaccgtgtcggtctgcgtgatccttctggagctcacaaatgagctccacatgctccccttggtcatgctcgtcctcctgatatcgaagaccatagccgattgcttcaacaaaggtgtgtatgaccagatcgtggtgatgaaaggcttgccattcatggaggctcatgctgaaccgtacatgaggcacttggtagctagtgatgttgtgtctgggccactcatctccttttcgggtgttgagaaggtgggcaacatcgttcatgcgttaaggatcacgggccacaacgggttcccggtggtcgacgagccgcctgtatcagaagctccggagctggttgggctggtgcttaggtcacatgtgttggttcttctgagtgggaggaacttcatgaaggagaaggtgaaaacaagtggtagctttgtgcttagaagatttggtgcgtttgacttcgccaagcctggttccgggaaaggtatgaaaatcgaggacctagatttcaccgaggaagaaatggagatgtatgtggatctccatccaatcacaaacacttcaccgtacacggtggtcgaaacaatgtcgcttgcaaaggctgcagtcctgttcagggcactagggctaagacacctgctggttgtgccaaagaccccagggagatttcctatagttgggattctcaccaggcacgatctgatgccggagcatatccatgggctgttccccaatctccgcaagtcacattgagaagtaaatcagcaggccatacaacattttcttgctgtattgttatttctcatgaaggtgcttcttcattggatcatggaataatcaatctgatatatttattgtaaaaagggctgattccctgatcagcagtcgagtggatttcattttgtcagcctgtgatctttgtgtaacaaaacaatcctctccttgtcagtacatgttctctctttttg

SEQ ID NO: 5372 - DNA, 3085 bp, Musa acuminata
gcacccaccaaaccatggtgcgacctccaattgtcgtctgccgacgcccgatggaccactagtttgtggtccgtaatatcgacgtgcctgttcataattcgcttcattgctggaatgatgacctgaacgtctactgcatttcaggtgaaccgagatcttcatattgaaggtcttttggcagcgacagacacagggaggagcaatggatcatcaagagggaagcaacgacatagatggcatggagggcgcgtggcgggagatagagaggaatggatcggggttgtacgagaatgaggaggctgggagtatgagggagccactactgaggaagcgcaccatgaatacaacctcgcagatcgctatcgttggcgccaatgtctgcaccatcgagagcttggactacgaaattgtggaaaacgatcttttcgagcaagactggcggtcgaggaagaaagtccagatattccagtacattgtcctcaaatggactcttgctcttctgattggtttggcaacagggctagttggctttttcaataaccttgcagttgagaacattgctggatttaaattgttgctgacgagtaatcttatgcttgagcacaggtactttgcagcatttttagcctactgtagcatcaatgcaattttggcagcatctgcagctgccctctgtgcttatgttgcacctgcggctgctgggtctggcattcctgaagtgaaagcttatctaaacggagtcgatgcttattccatactggctcctagcacgctcttcgtaaaaatatttgggtcaattggtggagtttctgctggatttgtattgggtaaggaggggcctatggtgcacacaggagcatgcattgccaacttacttggtcaaggtggatctcgcaagtatcatctgacttggacatggctcaggtacttcaaaaatgatagggatcgacgagatctgataacctgtggatcagcagcaggagtggcagctgccttccgagcaccagttggtggtgttctctttgctctcgaagaagcggcttcctggtggcgaagtgcgcttctgtggagaacattcttcacaacagctgttgttgctgtatcattgagaagtttaatagagtattgccgcagtggaaaatgcgggttgtttggcaaaggaggactaataatgttcgatgttagctcaagcgttaccacatacagcactcccgatctgatagtcataatagttcttggagtaattgggggagtattcggagccctcttcaattaccttctggaccggattcttcgaacctacagcttcatcaatgagaaaggtgctccgttcaagattctcctcaccgtggccatatctatcctcacatcatgctgctcttatgggctcccttggctcgccagctgcactccctgccccgcacatctccaagagcagtgcccgaccattggccgctccggcaatttcaagaacttccagtgtcccccgggtcactacaatgaccttgcctccctcttcctcaacaccaacgacgatgccatccgcaatctcttcagtgccggcactgacaacgagttccatatgtctacccttttcgtcttcttcgctgcggtttattgccttggactcgtaacatatggcattgctgttccttcgggtctcttcatcccagttatactcgccggttctacatatggccgaatggttgggactctgcttggccctatctcggacctcgacgccggcctctttgccctccttggagcagcatcttttcttggtggaaccatgagaatgactgtttcagtctgtgtcatcctccttgagctcaccaatgacctgctactgctacctctggtgatgctggttcttctgatatccaaaacagtggctgatagcttcaacaagggggtctatgaccagattgttcggatgaagggcttgcctttcatggaggcccatgcagagcctcacatgaggcacttggtcgcaagggatgtggtctcaggaccccccgtcagcttttctggagtggagaaggtgggaaccatagtacatgcactaagattgaccggtcacaatggatttccggtggttgatgagccaccgttctcggatgcccctgagttagtcgggctggtgttgaggtctcacttactgattctgctgaaagggaagagattttccaaggaaagggtgaagactggggtacgagaaatgttacaaaggtttggtgcctttgatttcgctaaagctggatcagggaaaggactcaagttggaagacttgaacatcctcgaagaggaaatggatatgtttgttgatctccatcctgttacgaataaatcaccctacacggtggttgagacgatgtcattggctaaggctgccatcctcttcagggagctcggactccggcacctctgcgttgtgccaaagacaccggggacgcctccaattgttggaatccttactcgacacgacttcatgccggaacacattcttggattgttccctcatcaccactcccacaaataggtcatcgctgtacttatatttctttgcctgtcacactgttactgcaatatctatcaacatattaatatcgctgcagactttatttttttttttgctctttttatgaaagaatacaacttaaaaagtcgattgcattccaccgttgttacacgagttcttacggctcctcgaggaggatagtttttttgccaatctctgctatttggtgcttcgtatccggtcattctcgaattcttatggacagaaaagggccattgcaacccaagatggttgaaacacacagcaaactcgacggattacatagggaataaacccaaaggaccttgctgcacgctttcaattagtggatgagctcatgcaatggagtgcaacacactatgattgatctttgtatattttgtacaagcaacactgcacaaggaaatcttaaagctttttaaaaaacatggtcgtgcttatgcaatggagtgcaatacactgcgattgatctctatatatgttgtacaagcagaacactgcataaggaaatcttgagctttttaaaag

SEQ ID NO: 5373 - DNA, 2346 bp, Musa acuminata
ggaggagcaatggatcatcaagagggaagcaacgacatagatggcatggagggcgcgtggcgggagatagagaggaatggatcggggttgtacgagaatgaggaggctgggagtatgagggagccactgctgaggaagcgcaccatgaatacaacctcgcagatcgctatcgttggcgccaatgtctgcaccatcgagagcttggactacgaaattgtggaaaacgatcttttcgagcaagactggcggtcgaggaagaaagtccagatattccagtacattgtcctcaaatggactcttgctcttctgattggtttggcaacagggctagttggctttttcaataaccttgcagttgagaacattgctggatttaaattgttgctgacgagtaatcttatgcttgagcacaggtactttgcagcatttttagcctactgtagcaccaatgcaattttggcagcatctgcagctgccctctgtgcttatgttgcacctgcggctgctgggtctggcattcctgaagtgaaagcttatctaaacggagtcgatgcttattccatactggctcctagcacgctcttcgtaaaaatatttgggtcaattggtggagtttctgctggatttgtattgggtaaggaggggcctatggtgcacacaggagcatgcattgccaacttacttggtcaaggtggatctcgcaagtatcatctgacttggacatggctcaggtacttcaaaaatgatagggatcgacgagatctgataacctgtggatcagcagcaggagtggcagctgccttccgagcaccagttggtggtgttctctttgctctcgaagaagcggcttcctggtggcgaagtgcgcttctgtggagaacattcttcacaacagctgttgttgctgtatcattgagaagtttaatagagtattgccgcagtggaaaatgcgggttgtttggcaaaggaggactaataatgttcgatgttagctcaagcgttaccacatacagcactcccgatctgatagtcataatagttcttggagtaattgggggagtattcggagccctcttcaattaccttctggaccggattcttcgaacctacagcttcatcaatgagaaaggtgctccgttcaagattctcctcaccgtggccatatctatactcacatcatgctgctcttatgggctcccttggctcgccagctgcactccctgccccgcacatctccaagagcagtgcccgaccattggccgctccggcaatttcaagaacttccagtgccccccgggtcactacaatgaccttgcctccctcttcctcaacaccaacgacgatgccatccgcaatctcttcagtgccggcactgacaacgagttccatatgtctacccttttcgtcttcttcgctgcggtttattgccttggactcgtaacatatggcattgctgttccttcgggtctcttcatcccagttatcctcgccggtgctacatatggtcgaatggttgggactctgcttggccctatctcggacctcgacgcgggcctctttgccctccttggagcagcatcttttcttggtggaaccatgagaatgactgtttcagtctgtgtcatcctccttgagctcaccaatgacctgctactgctacctctggtgatgctggttcttctgatatccaaaacagtggctgatagcttcaacaagggggtctatgaccagattgttcggatgaagggcttgcctttcatggaggcccatgcagagcctcacatgaggcacttggtcgcaagggatgtgctctcaggaccccccgtcagcttttctggagtggagaaggtgggaaccatagtacatgcactaagattgaccggtcacaatggatttccggtggttgatgagccaccgttctcggatgcacctgagttagtcgggctggtgttgaggtctcacttactgattctgctgaaagggaagagattttccaaggaaagggtgaagactggggtacgagaaatgttacaaaggtttggtgcctttgatttcgctaaagctggatcagggaaaggactcaagttggaagacttgaacatcctcgaagaggaaatggatatgtttattgatctccatcctgttacgaataaatcaccctacacggtggttgagacgatgtcattggctaaggctgccatcctcttcagggagctcggactccggcacctctgcgttgtgccaaagacaccggggacgcctccaattgttggaatccttactcgacacgacttcatgccagaacacattcttggattgttccctcatcaccactcccacaaatag

SEQ ID NO: 5374 - DNA, 3171 bp, Pennisetum glaucum
tgtcctggagcatcccattcagagcaaccagcaacagtaaagaaacgttggacacatggccattatactcgcacagacaaggacaagcacaatggccattcctgctccatggctttcctttgccgttgttgtcgccgtgctcctccttccctccacatccctcgccggcgacctggacttgctccaggacatctgcgtcgcggacctcacatctaccgtgaagatgaacggatttccttgcaaggccaccgtgacagaggacgacttctacttcaaaggactcgccaaccccggtagcaccaacaacacctacggctccatcgtcaccggcgccaacgttgagaaggtgccgggcctcaacaccctcggcgtgtcgctttcacgcatcgactatgcccccggcggcctaaacccgccgcacacccaccctcgggccaccgagattgttttcgtcctgcagggcaccctggatgtgggcttcataaccaccgcaaacaagctgattgccaagaacatctctgccggcgacgtcttcgccttcccccgtggcttggtgcacttccagaagaacaacggagaagcacccgccgccgttatatcggccttcaatagccagcttcctggcacgcaggccctcgccatgacgctgttcgcggcgacgccagaggtgccgaacaacgtgctcaccaaggcgttccaggtcggtagcaaggaggtggagaagatcaagtccaggctacctcccagatcgccatcgtcggggccaacgtctgccccatcgagagcctcgactacgaaattgtggaaaatgaccttatcaagcaagattggcgatcaagaaagaagcagcaaatattccagtatattgttctgaaatggtccttagttcttctcattggcttgtgcacgggacttgttggcttcttcaacaaccttgcggttgaaaacattgctgggttcaaactgttgcttacaagtgatctaatgctcaagcagaggtacatcacagcctttctggcatatgcaggctgcaatgtagtcttggcagcaagtgctgcagctatctgcgcttatatagctcctgctgctgctgggtctggtatacctgaagttaaagcataccttaatggaattgatgcttatgctatattggctcctagtacactctttgtgaagatatttggttccatacttggagtttcagctggatttgtacttggaaaggaaggtccaatggtacatacaggagcttgcattgccaacttgcttggtcaaggggggtcacgcaaataccatcttacatgtaactggctcagatattttaagaatgatagagataggcgggatttgattacttgtgggtctgctgctggagttgcagcagcattccgtgcacctgttggtggtgtgctcttcgctctagaggaagcagcatcatggtggcgaagtgctctcctgtggagagcattctttactactgctgttgttgctgttgtattgaggggcctgatccagttctgccgtagtggaaaatgtggcctctttggtcaaggaggattgattatgtttgatcttagttcaacaatacctacttacagtacacaagatatcatcgctataattgtccttggaataattggaggggtctttggaggtctgttcaactttctgttggataggattctccgtgcctacagttttatcaatgagaaaggtgctccttccaagatccttcttactatcacaatatcaattatcacatcagcatgctcctacgggctcccttggctcgctccatgcactccatgcccagctgatgccccggagcaatgtcccaccattggacgctctgggaattttaagaattttcagtgcccagcaggttactacaacggtcttgcatcactcttcttcaacacaaatgacgatgccatccgcaatctgttcagtagtggcacggagaaagaattccacatgtccactctttttgtcttcttcactgccatttactgccttggccttgtgacatatggtattgctgtcccatctggtctcttcatccctgttatacttgctggggctacgtatggacgcatagtagggacgcttcttggtccaatatcagaccttgaccctggacttttcgcccttcttggtgcggcatctttccttggtggaacgatgaggatgactgtctcagtttgtgtgatacttctggagctcacaaatgacctcctcatgctcccactggtcatgctcgttcttctgatatcgaagactatagctgacagcttcaacaaaggggtttatgaccagatcatagtgatgaaaggaatgccgttcctggaggctcatgccgaaccatacatgaggcacttggttgctggcgatgttgtatctgggccattgatctccttttcaggcgttgagagagtagggaacattgttcaggcgttgaggatcacaggccacaatggatttccagtggtggatgaaccacctctatcagaagctccggagctcgttgggctcgtgcttaggtcccatctgctggtcctgctgaatggcaagtgcttcatgaaagagaagttgaaaaccagtggtagcttcgtgctgaaaaagtttggcgcctttgattttgccaaggctggatctggaaaaggtctgaagattgaggaccttgatttcacggatgaggaaatggatatgtatgttgatctccatccaattacaaatacctctccatacaccgtggttgagaccatgtcacttgcaaaggctgcagtccttttccgggcactaggattgaggcacttgttggttgtgccaaagaccccagggagaccaccgattgctggaatcctcacgaggcacgatttcatgccggagcacattcacgggctgttcccgaatctccacaagtcacactgaggaaagcatccagtaaatgttttgtttgctatttgttgcctcgtagcttagctgtacgcagagaaagctgccttgcgcaatatttgctagcattttgtttgcccttattgtatttattgtgaagtgctccaaaatctttaaactgttgaataatatcgtattcattgtaaagagctgattaccccatcagcaaattgagtggatttttgtagctcatcatcctcttgtcgattttcaacg

SEQ ID NO: 5375 - DNA, 2502 bp, Triticum aestivum
aattgtggagaatgatcttttcaagcaagactggcgatcgagaaagaagaaccagatatttcagtatgttgttctcaaatgggcgttagttctgcttattggcttgttgactgggcttgttggcttcttcaacaaccttgcagtcgagaatattgctggattcaaattggtgctcacaggtgatcttatgctccagaagaggtacttcacagcatttttggcatatggaggctgcaatctagtcttgggagccactgctgcagcactatgcgcttacatagcaccagctgctgctgggtctggcatccctgaagttaaagcatatcttaacggagttgatgcttactctattttagctcccagcacactctttgtgaagatatttggttcaatacttggagtttcaggtggatttgtacttggaaaagaaggtcccatggtgcatacaggggcatgcattgccaacttgcttggtcaggggggatcacgcaagtaccatctcacatggaattggctgaaatatttcaagaatgatagggatagacgagatttgattacatgtggtgcagcagctggagtggcagccgcatttcgtgcacctgttggtggtgtactctttgctctcgaggaagcagcatcatggtggcgaagtgctcttctgtggagaacattctttacaactgctgttgttgcagtagtgttgagggccctgattgagttctgtcgtaaaggaaaatgtggtctctttggtcaaggagggttgattatgtttgatcttagctcgaacgtcccatcatatggtactcaagatctcatcgcgattattattcttggagtaattggtggcgtcttcggaggccttttcaactttctcctggataggattcttcgtgtctacagcattatcaatgagagaggtgctccatcaaagatccttctcaccatcacaatatcgatcatcacttcggcgtgctcctatgggctcccttggcttgctgcgtgctccccatgccctgttggttcgatggaggaatgccccaccattggccgctctggaaattttaagagcttccagtgcccgcctggtcattacaatggtcttgcatcactcttcttcaacacaaatgacgacgccatccgcaatctcttcagccgtggtaccgaaaatgagttccacatgtctagccttttcgtcttcttcatcgccatctactgccttggtctcgtgacgtatggtattgctgtcccttctggtctctttatcccggtaatacttgccggggcaacatatgggcgcatcgtggggacacttctcggtcccatgtctgacatcgaccctggcctctttgcactgctgggtgccgcatctttccttggtggaacaatgagaatgaccgtgtcggtctgcgtgatccttctagagctcacgaatgagctccatatgctccccttggtcatgctcgtcctcctgatatcgaagaccatagccgattgcttcaacaaaggtgtgtatgaccagatcgtggtgatgaaaggcttgccattcatggaggctcatgctgaaccgtacatgaggcaccttgtagctagtgatgttgtgtctgggccactcatctccttttcgggtgttgagaaggtgggcaacatcgttcatgcgttaaggatcacgggccacaacgggttcccagtggtcgacgagccgcctgtatcagaagctccggagctggttgggctggtgcttaggtcacatgtgttggttcttctgagtgggaggaacttcatgaaggagaaggtgaaaacaagtggtagctttgtgctcagaagatttggtgcgtttgactttgcaaagcctggttccgggaaaggtatgaaaatcgaggacctagatttcaccgaggaagaaatggagatgtatgtggatctccatccaatcacaaacacttcgccgtacacggtggtcgaaacaatgtcgcttgcaaaggctgcagtcctgttcagggcactagggctaagacacctgctggttgtgccaaagaccccagggagatttcctattgttgggattctcacgaggcacgatctgatgccggagcatatccatgggctgttccccaatctccgcaagtcacactgagaagcaaaatcagcaggccacacaaaattttcttgcagtattgttatttctcatgaaggtgctgcttcattggatcatggaataatcaatctgatatatttattgtaaaaagagctgattccccaatcagcagtcgagtggatttcattttggcagcttgtgtaacaaacaatcctctccttgtcagtacatgttctctcttttgcctcacacatcttctcatatgcacctgctgtaacttggaccgcaacaccttgtcggtagtagcagaatgctatccatagagatttctgaacaaaatgatgccgacaaggctctgaaatctgaatcttagtgttcattcatgaccaaggaaatgcagctgcttc

SEQ ID NO: 5376 - DNA, 2451 bp, Triticum aestivum
aattgtggagaatgatcttttcaagcaagactggcgatcgagaaagaagaaccagatatttcagtatgttgttctcaaatgggcgttagttctgcttattggcttgttgactgggcttgttggcttcttcaacaaccttgcagtcgagaatattgctggattcaaattggtgctcacaggtgatcttatgctccagaagaggtacttcacagcatttttggcatatggaggctgcaatctagtcttaggagccactgctgcagcactatgcgcttacatagcaccagctgctgctgggtctggcatccctgaagttaaagcatatcttaatggagttgatgcttactctattttagctcccagcacactctttgtgaagatatttggttcaatacttggagtttcaggtggatttgtacttgggaaagaaggtcccatggtgcatacaggggcatgcattgccaacttgcttggtcaggggggatcacgcaagtaccatctcacatggaattggctgaaatatttcaagaatgatagggatagacgagatttgattacatgtggtgcagcagctggagtggcagccgcatttcgtgcacctgttggtggtgtactctttgctctcgaggaagcagcatcatggtggcgaagtgctcttctgtggagaacattctttacaactgctgttgttgctgtagtgttgagggccctgattgagttctgtcgtaaaggaaaatgtggtctctttgggcaaggagggttgattatgtttgatcttagctcgaacgtcccatcatatggcacccaagatctcatcgcgattataattcttggagtaattggtggcgtcttcggaggccttttcaactttctcttggataggattcttcgtgtctacagtattatcaatgagagaggcgctccatccaagatccttctcaccatcacaatatcgatcatcacttcggcgtgctcctatgggctcccttggcttgctgcgtgctctccgtgccctgttggttcaatggaggaatgccccaccattggccgctctggaaattttaagagcttccaatgcccgcctggtcattacaatggtcttgcatcactcttcttcaacacaaatgatgatgccatccgcaatctcttcagccgtggtaccgaaaatgagttccacatgtctagccttttcgtcttcttcatcgctatctactgccttggtctcgtgacgtatggtattgctgtcccatccggtctctttatcccggtaatacttgccggggcaacatatgggcgcatcgtggggacacttctcggtcccatgtctgatatcgaccctggcctctttgcactgctcggtgccgcatctttcctcggtgggacaatgagaatgaccgtgtcagtctgcgtgatccttctggagctcacgaatgagctccatatgctccccttggtcatgctcgtcctcctgatatcgaagaccatagccgattgcttcaacaaaggtgtgtatgaccagatcgtggtgatgaaaggcttgccattcatggaggctcatgctgaaccgtacatgaggcacttggtagctagtgatgttgtgtctgggccactcatctccttttcgggtgttgagaaggtgggcaacatcgttcatgcgttaaggatcaccggccacaacgggtttccggtggtcgatgagccgcctgtatcagaagctccggagctggttgggctggtgcttaggtcacatgtgttggttcttctgagtggaaggaacttcatgaaggagaaggtgaaaacaagtggtagctttgtgctcagaaggtttggtgcatttgactttgcaaagcctggttccgggaaaggtatgaaaatcgaggacctagatttcaccgaggaagagatggagatgtatgtggatctccatccaatcacaaacacttcgccgtacacggtggtcgaaacaatgtcgcttgcaaaggctgcagtcctgttcagggcactagggctaagacacctgctggttgtgccaaagaccccagggagatttcctattgttgggattctcaccaggcacgacctgatgccggagcatatccatgggctgttccccaatctccgcaagtcacattgagaagcaaaatcagcaggccatacaaaattttcttgcagtattgttatttctcatgaaggtgcttcttcattggatcatggaataatcaatctgatatatttattgtaaaagagctgattccccaatcagcagtcgagtggatttcattttggcagcttgtgtaacaaacaatcctctccttgtcagtacatgttctctcttttgcctcacacatcttctcatatgcacctgctgtaacttggaccgcaacaccttgtcggtagtagcagaatgctatccatagagatttctgaacaaaatgatgccgacaaggctct

SEQ ID NO: 5377 - DNA, 4672 bp, Sorghum bicolor
caagctgcgggcgccgcccagatgagaatcgggttccgacacgcacgcgcccacgcagcgcaccgctccgagccgcgatggctgcgccctcgccttcgaccgcgcccgctccgtcctcctcagcgtcggcggcggcggtggtcttcgccgtgaacggcgagcgggtggagctccgcgagggggacgtggaccccggcgccaccctcctcgagttcctccgcacccgcacccgcttcaccgggcccaagctcggctgcggcgaaggcggatgcggcgcgtgcgtggtgctgctctcctcgtacgacgcggcgtcgggcgcggtgtcgcacgcggcggcgagctcctgcctcacgctggtgcacgggctccaccaccgcgccgtcaccaccaccgaggggctcgggggcggccggggcagcggacgcctccacgccgtgcacgagcgcctcgcggggttccacgccacgcagtgcggcttctgctcgcccggggtgtgcatgtccctcgccgcggcgctcgcgggcgccgaggccaaggccagggcggggaggaggcccgagcccgacgacgacccgcccgaggggttcgcgaggctcacggcggctgaggcggagcgggcggtggcgggcaacctctgccgctgcacggggtaccgcccgatcgccgatgcctgcaagagcttcgcggccgacgtggatttggaggacctgggcctcaactccttctggaggaaaggggacgcccatgcttccaagctgccgcggtacgacgaggggagcatcggtgtgttcccggagttccttaaggctgagatcagagcttcttctggggttgatgacctgtacacgccgccggcattggtcggaagtgccagcacttggcaccggcctcggagcgtggaggagtactataagctggtaggttctgagttgtttggcgaaagtagaacaaaggtggttgtgggaaacaccgcttcaggcgtttacagagaaacagatgtgtatgataggtacattgacctcagatgcatcccagagctgaattcggttaataaggaagccaatggtgttcacattggagctgcagtaccgatttctcaggcaattgagattttaagagtagaagctggtggctgcaatgatgtgatattctgtaagattgctgatcatatggaaaaagtggcttctccatttgttcggaacaccgcaagtttgggtggaaatttgataatggcacagagggaccagtttgcctctgacattgcaacgatcctccttgctgctggttcatcaatatgcatccaggcatcatcaaaaaggttgactgtcacgttggagaacttccttcagatgccaccttgtgatcacaagacactgctattaaacatttacattcctcggtggactctcattggtggcttatctggtggtaaaaccatggatgggacagtaagtaaaataggaacttctgtgctatttgagacgtaccgagctgctccacgccctcttggcaatgcagtcgcatatcttaattcggctttcttggctcaagtctcttcagatgaaacttcaagcagcttagtattgacagagctatgtctggcttttggtgcgtatgggagccaacacgccatcagggctaggaatattgagaaactgttagtgggtaaacctattactgcatcggtgctacttgaagcatgtagacttctcaaggaaacaattgttcctaaagaaggcacaaggcatgctgcttataggtcaagcttggcagttgcctttctgtttagttttctttacccagtaactgaaggaactttgaagcctgtaaaggcagttcatcttaatggctatgtaacttctggcactaacggaaatccaaattgtggacccgatgcggatgttgatgtttcacttaagaagatcaatgatgtgaactctggttcatgtaccaatgatcgcattcttgaatattcaaaccagattattgaaatcaataaagactatctccctgttggcataccaaccaagaaagttggagcagaactccaaacctctggtgaggccgtatttgtggatgacatccccgctcccaaggactgtgtttatggagcatttatatatagcacaaaacctttagcccatgtgaagagcataaaactcgacctttcactcgagcagcttaaaacgctggaagtagttactgttaaggatattccggaaggtggcagcaatgttggggccaacactatatttggacctgaacctctgtttggtgatccagttactcagtgtgcaggggaacctcttggtgttgtgattgcagaaacacaaagatttgccaatatagctgcaaaaagagctgttattgactacagtactgagaacttagatgctccaattttatccatagaggaggctgttaaaaggtgcagttattttgaaaccccaccgtttcttcttcctcagaaaattggtgatttctcaaaaggaatggcagaagcagatcagaaaatctcctctgaggttaaacttaattctcagtactacttttacatggaaacacaagctgctctggcaatacccgatgaggataactgtttggtagtgtatagctcaagccaatgccccgagacagcacagaatgtcattgcaaagtgccttggtttaccttgtcacaatgttcgtgttattaccagaagagttggtggtggatttggaggaaaagctgttagatcattacctgtggcaactgcgtgtgcgcttgcagcatttaagttgtgtcgtcctgtccgtatgtatcttgaccgcaagactgacatgatagtgactggaggtcggcatcccatgaaaatatgctattcagtgggattcaaatcagatgggaaaatcactgctttgcatatagatttgttcataaatgcaggaatgacaaaagatgttagcctcataatccctcataatttcattgaggcactgaagaaatataattggggtgctttttcttatgaagcaaagatctgtaaaacaaacattgctacaaagtctgcgatgcgggggcctggggaagtacaaggttcttatgttgccgaagctataattgagcatgttgcttccacgctctccgctgatgctaatttggttagacataaaaatcttcacacggttgagagccttgctttgttccatagtgagtgctctgaagatgccatgggctatactcttcgctctatatgcgatcaagtgactgcatcagaaaactatcagcatcggcttgaaacaatccagtctttcaacaaaaacaacaaatggaaaaagagaggcctctcttttgtgccaatagtacacaaagtattatctcgaccgacacctggaaaagtgtctattcttaatgatgggtctattgctgttgaagttggaggcattgagttaggccaggggctttggacaaaagtgaagcagatggcagcgtttggtcttggacaactctgtcctgatcgaagtcaagagctgttggagagaataagagttattcaagcggatacattaagtaatgtacaaggagggtggaccacagggagtaccacatcagaatctagctgtgaagcagttcgtctcgcatgctatgtcttggtcgacaggctgaagccagtcaaggagcaatttcaagaaaagcaaggcaatgtttcatgggacgaacttatttccaaggccataatggttggtgtgaacttatcagcacgagaatactacattcctggtccttctggttcctacctaaactatggggctgctgctagtgaggtagagattgatcttctcactggggcctccacaattgtacgaagtgatcttatatatgactgtggccagagcttaaaccccgctgtggacttgggacaggttgaaggggcatttgttcaaggaatcggctatttcatgactgaggaatatgtcaccaactcagatggattgcttatctctgacgggacttggacatacaagatcccaactgtggacaccatcccaaagcagtttaatgtgaagttacttaacagtggatttcacaagaaacgcgtgctctcttcaaaagcatctggggagccaccattgcttcttgcagcttcagtgcactgcgcaacaagagaagcaatcagagctgcaaggaatgaaccacactgctctgggtttggaccttcaccatcccattttgatttggaagttcctgccatcatgcccgtggtgaaggaactgtgcggcttggacaacgtagagaggtacctgcagagcctgccgagttccgaatgaagagccattctctgttttccctactcagccgtggaataccatacgtagataacatatgttgtgacgcggttgtgccgaagtcatcagagaagagagaatcataggtgtagatagatagtagatgatatcatcaggtctttgccattttgggttccgagcaagacggacttcctctgggtgtaaaaatctttgggaacatatacatatagcagtgaaactgagactattttctacccattccgttctgttctaattataagtcactttgacttttttggtagatcgaatttgctatatgtatgatatacaatagcaagttggatgtataaaaaaagaagttaaaatgacttataatttagaaaagt

SEQ ID NO: 5378 - DNA, 2055 bp, Glycine max
atagcaaccattctttgtttcttggcgcactccaagtcacaatggagcatttcaacaaagccaaagccgtgaagctccgcagccacctcggcaagtacctcatcgccgacgaggacaaactccgtcaaagcaaacgaggctcaacaagaaaggcaatatgggaaattgaactaataaacggaaagaaccaccacgtgcggctgaaaagctccaacggccgttacctaacggcgacggacgcgccgtttctcttaggcatgacggggaacaaggtggtgctagcgaatttcgacaagggcacggattggaagttcgagtgggaacccataacggaggggttccacgtgaagctgagaagctggtgcgggaagtacctcagaggtaacggcggcacggtgccatggagaaactccgttacgcacgatgaccctgctagctccgttactcacacttggatcttgtgggcttcggaacccgtgcaagagtttcctgagaaaatggtttctttcgccgagagcgacttttcgtcgttggattcggaggatgagcttctggcctcggaggaagagtcttcgagaagtcacaagtccatgctcaagacaacaagttccaacacctccggcgccacctcgatccgttccggcatggagctcttccaccgcgcgaaggcggtgcgcctccgcagccaccacgacaagtacctcctggccgacgaggacgaggagtccgtcacgcaagaccgcaacggatcctcccgcaacgccaagtggacggtggagctcatcccggagttcgacaacatcatcagactcaagagctgttacggaaaatacttgacggcgtccaaccagccgttactgctcggcgtgacggggcgcaaggtggtgcagagcttgccgcggcggctcgactcctccgtggagtgggagcccgtgcgcgacggcgcgcaggtcaagctcaagacccgttacgggaactttctgagagcgaacggtggggtcccaccttggaggaactccgtgacgcacgatatcccgcataggaccgccacacaggattggatcctgtgggatgtggatgttctcgagattcatgtggtgtcccctgctccgcctccgattccgcactccgattcgcttgatttcgaatcgaatactccttctgctgtaaacatcaaatctactaccttctccagacaagagtcgacggattcgaatgtgggttcgccgccaaagaagatggaggggaggactatatactaccacgttgcagaagataatggggatgtggatgatgagaatgtgcagggttattctttgaatttcaaagggaatggggttgagcagttagctcgaaagtttgaggaagagactgggcttgagggagttattgtgtgcactcgaagtcctttgaatggaaaactctaccctcttcgcttgcagcttcctccaaacaatgtcaccatgcaggttgttttggttcttccctcatctaaagtggcaagagaatttgaggagcaaggtatactatgacaagctacattattgttggagtcttgaatctactgaaatgcaaggcctatgtacgttgtgatccaagcgtgtttcaaattttatgtgatagcatttaacaatatgttgcaaaactccacctatttcaagtgagtccattgcatttataaggcagagttcaccaaggtccaatggaggtaacttaaagtttccatggcaaggttcatatcagcaatatcctctattaagtggtgtggaagggttgtagatgattctgatggagatgaaagtctttgttaggcttcctatttattagtgctatagctttaatctttagcctattcttgtggattcagatatttgttgtttctttctctgttggtaattttctgtttttcatgtttttttaaggtgtatcatttgtatagacaacttttatcagaaaactagaggtatattttttattcatatataaatttaaggtattagaagcattttttaatcagataattttttgcctcatttgtttgtatctaatcaagtg

SEQ ID NO: 5379 - DNA, 2951 bp, Glycine max
agtcaaacaacagcaaagaacccagtttttttttccatcctgcattaaagaattgggagttaccaagaatcagttattattctttcccttctcattcttctatccaattctcttcctcaacaccccatcttttctctctctcacacaccctttctctccctagactctctctcttgtggtttctgcaatggcaacccttgcagacattggggtctcagctgccatcaacattctctcagcctttgccttcttgctggcttttgctcttctgagaatccaacccatcaatgatagaatctactttccaaagtggtatatcagtggagatagaagcagtccaaggaggtctggtgggaattttgtgggaaaatttgtgaacctcaatttcagaacttacctcactttcctgaactggatgccacaagctctcagaatgagtgagtctgagattattagccatgctggccttgactctgctgctttccttagaatctatactctcggcttaaatatttttgttccaatcacacttgtggcactccttgtacttataccagtcaacgtatcaagtgggacattatttttcctaaaaaaggaattggtagtgagtgatattgataaactgtcaatatcaaatgttccacctaagtctataagattttttgttcacatagcattggaatacctgttcacaatatggatttgttttctgctgtacaaagaatatgatcatatcgcatcaatgagattgcatttcttggcctcacagcggaggcgtgtggaccaattcgcagtagttgtcaggaatatccctcatatgtctggccatacaatatcagataccgtggatagcttctttcaaacaaaccacccagaacattatataggacaccaggctgtctacaatgcaaataaatttgctaaatttgcaaaaagaagagatagactccaaaattggctggactattaccagcttaagtttgagagacatcctgacaagaggccaactgtcaagaatggatttttaggattttggggtgggaaagttgatgctatcgagtactacaaacattcaattaaggaacttgatacgatgatgacaatggaacgtcagaaaattataaaagatcccaaatctattttgccagttgcttttctttcattcaaatcccgatggggagcatcagtttgtgcgcaaacccaacaaagcaagaatcctacactctggctgactgattgggccccagagccacgtgacgtatattggcagaacttggccataccatttgtttctttaaacattcgaaagcttataatatcattgtctgtgtttgccttggtattcttctacatgattcccattgcttttgtgcaatctcttgccaatttggagggtcttgaaagagttgctcctttcctcagaccagttatagaattgaaattcatcaagtcctttctacaaggttttcttcctggtttggcccttaaaatatttttgtacattctacccacagttctaatgatcatgtcaaaaattgagggatatattgcattgtcaacacttgagcggaagacagcagcaaaatattattattttatgctggtgaatgttttcttgggaagcatagtgactgggactgcatttcagcaactgcatgctttccttcaccagtcacctactcagattcctagaacgattggagtttccattccaatgaaggctaccttctttatgacatacataatggttgatggatgggctggaattgctggtgagattctcagattaaagccattggttatataccatctcaaaaacatgttcttagttaaaaccgaaagagatagagggaaggccatggaccctgggagtgtggactttccagagactattccaagtcttcaactatacttccttcttggaattgtgtatgctgtggtgacaccaatccttcttcccttcgtactagtcttctttgcctttgcatatttggtttaccgtcatcagataatcaatgtctacaaccaacagtatgaaagtgctgctgcattttggccacttgttcacagccgcattatcgcaagcttgctaatatcccagcttcttctgttgggtcttcttagcaccaaaaaggcagctaaatccacacctttactcgtcatattaccaatattgacatttgcattccacaagttctgccagagacgttttgagccagcatttaggaagtaccctcttgaggaagcaatgtcaaaggatttattagagaagagcacagaacctgacttgaacatagaggcttatttggctgatgcttacttgcacccaatcttcaggtcatttgaggtagacgacgaattggttgaagtcagagtagataatcaccaaactaatgtagctgattcccaaccaagtgagcctagttcaccatctccaccacatcatgtgcaacaaccatccccaccccatcatatccatgaaccatctccacctcaatatagtgagtatcaaacttcaccaccaagttattactaccaataccatcctccatccccaccccattatgtttatcaatactaagttgagccttcttgaaccagtgcatatcaattaaccatgttgcttgagaccccttaccaaaaatttagtgtttcaatcaacttagatatgttttttttatttttatctatccatcgcaaatgtaaatgtttattttttccttacatgtaaatgctttggattcttctaaatatgcggtggctaaagtaggcaggattttacttgatcaagctgctagagaggtttttatgtttgccaaattgatttgttttgattaatagggtgattgccttgaatattgctattatgaaagtgattcaatttatgcaatcctcggagtggtcttcggtggttttagaaatataatataatgtggagagaaaaagaaatc

SEQ ID NO: 5380 - DNA, 3166 bp, Glycine max
cacaaaaacaagacaacagaatgatagaaaataaacgaaaaccaccagtcctatgtatgtgaggtaacaacacccaaaccaaacataaaaacagaacatgtcacactgttaaatgttaatcctttcctattaacacatgagatgaaaccccccggcccccactacttgcaaagtgctctcttactcatcacaatcaaacaaaacccacctctaatatttttaatcttttgagtaaagtttattaattgctgctgaataaagtcaaacaacagcaaataacccagctttttctttgcactctgccttaaagaattgggagttaccaagaatcagttattattctttctcccttcttattcttctattcaattctcttcttcctcttccttcacaccccatcttttctctctctctctctcttgtattgtggtttctgcaatggcaacccttgtagacattggggtctcagctgccatcaacattctctcagcctttgccttcttgctggcttttgctcttctgagaatccaacccatcaatgatagaatctactttccaaagtggtatctcagtggagggagaagcagtccaaagaggtctggtgagaattttgtgggaaaatttgtgaacctcaatttcaggacttacctcacttttctgaactggatgccacaggctctcagaatgagtgagtctgagattattagccatgctggccttgactctgctgttttccttagaatctatattcttggcttcaaggtttttgctccaatcacacttgtggcactcttcattcttataccagtcaacgtatcaagtgggacattatctttccttaaaaaggaattggtagtgagtgatattgataaactctcaatatcaaatgttccacctaagtctataagattttttgttcacatagcattggaatacctgttcacaatatggatttgtattctgctgtacaaagaatatgataaaatagcaacgatgagattgcatttcttggcctcacagtggaggcgtgtggaccaattcacagtagttgtcaggaatatccctcatatgtctggtcatacagtatcagatactgtggatagcttctttcaaacaaaccacccagaacattatattggacaccaggctgtctacaatgcaaacaaatttgctaaatttgcaaaaagaagagagagactccaaaattggctggactattaccagcttaagtttgagagacatcctgaccggaggccaactgtcaagactggaattttagggctttggggtgggaaagttgatgctatcgagcactacaaacattcaattaaggaacttgataagatgatgacattggaacgccagaaaattataaaagatcccaaatctattttgccagttgcttttctttcattcaaatcccgatggggagcatcagtttgtgcgcaaacccaacaaagcaagaatcctacactctggctgactgattgggccccagagccacgtgatgtatattggcggaacttggccataccatttgtttctttaaacattcgaaagcttataatatcattgtctgtgtttgccttggtatttttctacatgattcccattgctattgtgcaatcccttgccaatttggagggtcttgaaagagttgctcctttcctcagaccagttatagaattgaaattcatcaagtcctttctacaaggttttcttcctggtttggcccttaaaatatttttgtacattctacctacagttctgatgatcatgtcaaaaattgagggatatattgcattgtcaacacttgagcggaagacagcaggaaaatattattattttatgctggtgaatgttttcttgggaagcatagtgactgggactgcatttcagcaactgcatgctttccttcaccagtcacctactcagattcctagaacgattggagtttccattccaatgaaagctaccttctttatgacatacataatggttgatggatgggctggaattgctagtgagattctcagattaaagccattggttatataccatctcaagaacatgttcttagttaaaaccgaaagagatagaggaaaggccatggaccctgggagtgtggactttccagagactattccaagtcttcaactatacttccttcttggaattgtgtatgctgtggtgacaccaatccttcttcccttcatagtagtcttctttgcctttgcatatttggtttaccgtcatcagataatcaatgtctacaaccaacagtatgaaagtgctgctgcattttggccacttgttcactgccgcatcatcgcaagcttgctaatatcccagcttcttctgttgggtcttcttagcaccaaaaaggcagctaaatctacacctttgcttgtcatattaccaatattgacgtttgcattccacaagttctgccagagacgttttgagccagcatttaggaagtaccctcttgaggaagcaatgtcaaaggatttattggagaaaagcacagaacctgacttgaacatagaggcttatttggctgatgcttacttgcatccaatcttcaggtcatttgaggtagaagaagaggaattggttgaagtcagagtagataaacaccaaactaatgtagctagctccccaccaactgagcctagttcaccctctccaccccatcacgtgcaacaacaaccatccccacctcatcatatacatgaaccctctctacctcaatatagtgagtatcaaacttcaccaccaggttattactaccaataccatcctccatctcctccccattatgtttatcagtactaagttgagccttcttgaactagtgcataccaattaaccatattgcttgagaccccttaccaaaaatttagtgttcctataaacttggatgttttagcttttttatctatccattgcaaacgtaaatgttttttttttcccttacatgtaaatgctttggattcttctaaatatgcgatggctaaagtaggcaggattttacttgatcaagctgctagagaggtttttatgtttgccaaattggctttgttctgattaatagggtgattgccttgaatattgctattagaaagtgtttcaatttatgcaaccctcggagtggtcttcggtc

SEQ ID NO: 5381 - DNA, 2939 bp, Cajanus cajan
ttattctttgccttctcattcttctcttcctcttccaaaccccatcatcatctctctctctctctctgaactcttgcaatggcaactcttgaagacattggggtctcagcagccatcaacattctctcagcctttgctttcttgctggcttttgctctgctgagaatccaacccatcaatgacagggtctactttcccaagtggtatatcaatggagggagaagtagtccaaggaggtctggaaattttgtggccaagtttgtcaacctcaatttcaggacttacctcacttttctcaactggatgcctcaggctctcagaatgtctgagtctgagattatcagccatgctggccttgactctgctgctttccttagaatctatactcttggcttaaagatttttgctccaatagcagttgttgcactcctagttcttataccagtcaacgtatcaagtgggacattatttttcctaaaaaaagaattggtagtaagtgatattgataaactctcaatatcaaatgttccacctaaatctataagattttttgttcacatagcattggaatacatgttcacaatatggatttgttttctgctttacaaagagtatgataatatagcatcaatgagattgcatttcttggccacacaacgcaggcgtgtggagcaattcactgtagttgtcaggaatatccctcatatttctggtcacacagtatcagatagtgtggatagcttctttcaaacaaaccacccagaacattatattggacaccaggccatctacaatgctaacagatttgctaaatttgcaaaaaggagagacagactccaaaattggctggactattaccagctcaagtttgagagacatcctgaaaagaggccaaccatcaagactggatttttagggctttggggtgggaaagttgatgcaattgagtactacaagcattcaattaaggaacttgataagatgatgacattggaacgccagaagattataaaggatcccaaagctattttgccagttgcttttctttcattcaattcccgttggggagcatcagtttgtgcacaaacccaacaaagcaagaatccaaccctctggttgactgattgggctccggagccacgcgatgtatattggcggaacttggccataccatttgtttctttaagcatccgaaagcttataatttcgttgtctgtgtttgccttggtattcttctacatgattcccattgcttttgtgcaatcccttgcaaatttggagggtcttgaaagagtagctcctttcctcagaccagtaatagaattgaaattcatcaaatcctttctacaaggttttcttcctggtttggctcttaaaatatttttgtacattctacccgcagttctgatgatcatgtcaaaaattgaggggtatattgcattgtcaacacttgagcgtaagacagctgcaaaatattattacttcatgttggtgaatgttttcttgggaagcattgtgactgggactgcatttgagcaattgcattctttccttcatcagtcacctacacagattcctagaacaattggagtttccattccaatgaaggctactttctttatgacatatataatggttgatggatgggctggaattgctggtgagattctcagattaaagccattggttatataccatctcaagaacatgttcttagttaaaacagaaagagatagaggaaaggcaatggaccctgggagtgtggactttccagagactattccaagtcttcagctatacttccttcttggaattgtgtatgctgtggtgactccaatccttcttccgttcatactaatcttctttgccttcgcatatttggtttaccgtcatcagataatcaacgtctacaaccaacaatatgaaagtgctgctgcattttggccacaagttcacagccgcattatagcaagcttgttaatatcacagcttcttctgttgggtctgcttagcaccaaaaaggcagctaaatcaacacctttgcttgtcatgttaccaatattaacatttgcatttcacaagtactgccagagacgttttgagccagcatttaggaagtaccctcttgaggaagcaatgtcaaaggatttattggagaaaagcacagaacctgacctgaacataaaggcttatttggctgatgcttacttgcatccaatcttcaggtcatttgaggtagaagaagaggaattggttgaagtcagagtagataaacaccaaactaatgtagctagtgcaccaccaagtgagcctagttcaccctctccaccccatcatctcgatcaaccatccccaccccatcatgatcatcaaccctcccaacctcaatatggtgactatccaattccaaatccaactttaccaccaggttattactaccaataccatcctccctccccttcatatgtttatcacaattatcagtaccaaggttagccttgaactagtgcatacccattaacaaggttgcttgagaccccttactgaaaatttagtctttctatcaacttagatatgtgttctggttttttagttttgatcaatccatcgcaaacgtaaatgatcatttttctttccttaaaatgtaaatgctttggtttcttctaaatttgcggtggctaaaataggcaggatttacttgatcaagcagctagagatttcttttcctggtttattaaatgtttgccaaattaatttgttctgagtaattgggtatttttttgaatattgctataatacagattcaatttatgcaatcctcagagtggtattcggacgttttagaaattagacgtgccagtaaagaaatgtatataatgtaatttagaatgattataattatcttaaaaataaatattatgttgtattattacatttaa

SEQ ID NO: 5382 - DNA, 2780 bp, Lotus japonicus
ggttttggtttttggcaataatggctaccttggccgacattggggtctctgctgcaatcaacattctctctgcctttgctttcttgctagcctttgctcttctcagaatccaacccatcaatgacagggtctactttcccaaatggtacatcaatggagaaagaaccagcccaaggagcactgggaattttgtagggaaatttgtcaacctcaatttcaagacttaccttactttcctcaactggatgccacaggctctgagaatgagtgagaatgagattatcaatcatgctggtcttgactctgctgttttcctcagaatctacactcttgggttaaagatttttgttccggtgacagttgtggcactcctcattcttattccagtcaatgtatcaagtggggcattattcttcctaaaaagagatttggtcgtgagtgatattgataaactctcaatatcaaatgttccgtccaaatcttcaagattttttgttcacataggattggaatacatgttcacactatggatttgttttctactttacaaggagtatgacaatatagcaatgatgagattgcatttcttggcttcacagcgcaggcgtgtggagcaattcacagtagtcgtcaggagtgtccctcatatttctggtcactcagtatcagattccgtcgagagcttctttcaaacaaaccacccaaatcattatattggacaccaggctgtctacaatgcaaacaaatttgcgaagttggtaagaagacgagatagacttcaaaattggttggactattaccagcttaagtttcagaggcatcctgacaagaggccaactatcaacgtatgtgttttagggctttggggtaggaaagttgatgctattgagtactacagccatacaattaaggagcttgataaagtcatgacattggagcgccagagaattataaaagatcccaaatgcattttgccagttgcttttctttcattcagttctcgttggggagcatcagtttgtgcacaaacccaacaaagcaaaaatcctacactctggctcactgattgggctccagagccccgtgatatatactggaggaacctggccataccatttgtttctttaagcatccgaaaacttgttatatcactatcagtgtttgccttggtattcttctacatgattcccattgcttttgtgcaatcccttgcaaatttggagggtcttgaaagagttgctcctttcctcagaccagtaatagaattgaaattcatcaagtcctttctacaaggttttcttcctggtttggcccttaaaatattcttatatattctaccggcagttctgatgatcatgtcgaaaattgagggacatattgctaagtcaacacttgagcggaagacagcagcaaaatattattactttatgctggtgaatgttttcttgggaagtatagtgaccgggactgcatttgagcaactgcattctttcctccaccagtcacctacacagattcctagaacaattggggtttccattccaatgaaggctactttctttatgacatacataatggttgatggctgggctggaattgctggtgagattctcagattaaagccattggttatatatcatctcaagaacatgttcatagttaaaactgagagagatagaggaaaggccatggaccctgggagtgtggacttccctgagactattccaagtcttcaactatatttccttcttggaattgtgtatgctgtggtgactccgatccttctgcctttcatactggtcttctttgccctagcatatttggtttaccgccatcagataatcaatgtctacaatcaacagtatgaaagtgctgctgcattttggccacatgttcacagccgcattatcgcaagcttactaatatcccagcttctaatgttgggtctgcttagcaccaaaaaggcagctaaatctacacctttgcttgccattctaccaatattgacgttcgcatttcacaagtactgccaacaccgttttgaaccagcatttaggaagtacccccttgaggaagcaatggcaaaggacttattggagaaaaccacagaacctgacctgaacataaaggcatatctggccgatgcttacttgcatccaatcttcagatcatttgaagttgaagaggagttggttgaagtcagggtagacaaacaacccgaaactcaagttgctagtcccacattgagtgagcccagttccccctccccactccatgatcatgtgcatcaaccttccccacctcaacatgtgaatcagtacagtcactacccaacatcaccaccagggtattactatcatcctcctccccctcctcattatgcttatcagtatcaagatgaaccttgaactagtgcatagcagttaccaacttgcttgagagttgagacccacttggtgtttttatcaacttagatttgtgttttagccttctatatatctattacaattgtaaattattatttttcttaggtgtaaatgttatggtttcttttaaatatgaggttgctaaagtaggtgatatttcacttcatcaagcagtttgaaagaactctctttttatgggtttgtcgtatgctttccaaattagttttttgtagttaattgggtgattatgcaagtgattcaatttgtactcagccctcaaagtgttattcagacattttaggtataaaataatgtaatgcgaagaagaaaaacttaattgcacttttggttcat

SEQ ID NO: 5383 - DNA, 3071 bp, Cicer arietinum
cacatattctcaatgatcacacaacctccaatgccaccttgttccacctttcattcccaaaagaataattttttcttacttgcacatgcaaatctcaactatatactaattagtgccttcttactcatcacaatcatacaaaaccaatcttcaatattttaatcaaagtctattaatttattaccaaaaaaactctaaacaaacatcaaagaatagaagtaaatgattatcatcagttattctttgccttctccattctccactcttcatcacaacaccacctctttctctctctaaaaactatctctttctctctctaaaatggctactctagaagacattggtgtctcagctgccatcaacatactctctgccattgctttcttggtagcatttgctttactgagaattcaacccatcaatgacagagtttactttccaaaatggtacatcagtggtggaagaagcacaccaagaagttctggaaattttgttgggaaatttgtcaaccttaatttcaagacttatttgacttttctcaactggatgcctcaagctttgagaatgactgaaactgagattattaatcatgctggtcttgattctgctgtttttcttagaatttatactcttggcttaaagatgtttgttccagtgacaattgtggcactcctcattcttattccagtcaatgtatcaagtgggacattatttttcctaagaagagaattggtagttagtaacattgataaactctcaatatcaaatgttccacctaaatctttaagatttttcgttcacatagcattggaatacctgttcacaatatggatttgctttctgctctacaaggagtatgatactatagcaataatgagattgcatttcttggcctctcaacgcaggcgcgtggagcaatttacggtagttgtcaggagtatccctcatatgtctggtcactcggtatcagatactgtggacagcttctttcaaacaaaccacccagatcattatattggacaccaggctgtctacaatgcaaacagatttgctaaatttgtgacaaaaagagatagacttcaaaactggctggattattaccgtctaaagtttcagaggcgtcctgatcggaggccaactattacgactggatgtttagggctttggggtaggaaagttgatgctattgagtactatgaacaacatattaaggaacttgataaattgatgagctcagagcgtcagaaaattataaaagatcctaaatctattctgcctgtggcttttctttcgttcaactcgcgttggggagcatcagtttgtgcacaaacccaacaaagcaaaaatcctacactctggctaactgattgggctccagagccacgtgacatatattggcggaacctcgcgataccatttgtttctttaaccatccggaaacttattataacattgtcggtatttgccttggtattcttctacatgattcccattgcttttgtgcaatcccttgcaaatttggatggtcttgaaaaagttgctcctttcctcagaccagtaatagaattgaaattcatcaagtcctttctacaaggttttcttcctggtttggcccttaaagtatttttatatattttaccaacagttctaatgattatgtcgaaaatcgagggatatattgcattatcaacgcttgagcggaagacagcagcaaaatattattactttatgctggtgaatgttttcttaggaagcatagtgaccggaactgcatttcagcaactgcatgcttttcttcaccagtcacctacacagattcccagaacaattggagtttctattccaatgaaggctaccttctttatgacatacataatggttgatggctgggctggaattgctggtgagattctaagattaaagccattggttatatatcatctcaagaacatgttcttagttaaaactgagagagatagagaaaaggccatggaccctggtagtgtggactttcccgagactcttccgagtcttcaactatatttccttctcggcattgtatatgctgtcgtgactccaatccttcttcctttcatacttgtcttcttcgccctcgcgtatttggtttatcgtcatcagataatcaatgtctacaatcaacggtatgaaagtgctgccgcgttttggccgcatgttcacagccacattatagcaagcttactaatatcacagcttcttctattgggcttgcttagcaccaaaaaggcggctaagtctacacctttgcttgtgatgttaccaatactgacatttgcatttcacaagtactgcaagagtcgattcgagccggcatttcggaagtacccccttgaggaagcaatggcaaaggatttattggaaaaaagctcagaacccgacctaaacataaaagcatatttggcagattcttacttacatccaatcttaagatcatttgaggttgaagaggaattggttgaacttgaaagggttgaagttagagtagataaacaccaaactcatcatgtttctagtcctacattgagtggtgaacctagttcaccttcaccaccacaccatgttcatcaacatcaaccttcaccacctcattacaatgattacccaacttcaccacaagattattattaccaacctcccttacctcctcattatgtttatcaatatcacaatcaaccttaaattcgtctcgaacgaattcaacgacgtattcaaagaaattctgaccggacgcgggaatagttcgcgggttaattacaaattacaaagctattacttgagactccttagtgttttttctttagtatattttgactttagatatgtgtttttggccattttgttacctattgcaaatgtaaattattactattatttttcctaatgtaaatgatgaattgaaattagttttgactccaaattgatccacaaaccttccctttgtctcttcatacattcaccattttagtaagggagcaatttccaattgcaaattagagatgcaacattgtcagctttaagaatgcatatttccc

SEQ ID NO: 5384 - DNA, 2627 bp, Trifolium pratense
ctctacaatggctactcttcaagaccttggtgtatcagctgccatcaacatactatcagcttttgctttcttgttagcatttgctttactaagaattcaaccaatcaatgacagagtttatttcccaaaatggtatatcagtggtggaagaagcaatccaagaagttctggaaattttgttggaaaatttgtcaaccttaatgtcaaaacttatttgacttttcttaattggatgcctcaagctttgagaatgagtgaaactgagattattaatcatgctggtcttgattctgctgtttttctcagaatttatactcttggcttaaagatgtttcttccggtgacaattgtggcactcctcattcttattccagtcaatgtatcaagtggaacattgtttttcctaagaaaagaattggtagtgagtgatattgataaactctcaatctcaaatgttccacctaaatctctaagattttttgttcacataggattggaatacatgttcacaatctggatttgttttctgctctacaaggagtatgataatatcgcgttaatgaggctgcatttcttggcctcacaacgcaggcgtgcggagcaatttacggtagtagtaaggaatgtccctcatatttctggtcactcggtatcagattctgtggacggcttctttcaaacaaaccacccagatcattatattggacaccaggctgtctacaatgcaaacaggtttgctaaatttgtgagaaaaagagatagattccaaaattggttggactattaccgcctaaagtttcagaggaatccagataagagaccaacgatgaagaccggatgtttagggctttggggtaggaaagttgatgctattgagtactatgatcagcatatcaaagaacttgataaactgatgacattggagcgccaaaagattataaaagatcccaaatctattttgccagtggcttttctttcattcaattcgcgttggggagcatcagtatgtgcacaaacccaacaaagcaaaaaccctacactctggttgactgattgggctccagagccacgtgatatatattggcgaaacttggccataccatttgtttctttaaccgtccgaaaacttataataacattatcagtgtttgccttggtattcttctacatgattcccattgcttttgtgcaatcccttgcaaatttggatggtcttgaacgagttgcgcctttcctcagaccagtaatagaattgaaattcatcaagtcctttctacaaggttttcttcctggtttggccctcaaaatatttttatatattctgcctacagttctcatgattatgtcaaagattgaaggatatattgcattatcgacacttgaacggaagacagcggcaaaatattattactttatgcttgtgaatgttttcttgggaagcataataactggaactgcatttgagcaactgcatgcttttcttcaccagtcacctacacaaatacctagaacaattggagtttccattccaatgaaggctaccttctttatgacgtacataatggttgatggctgggctggaattgccggtgaaattctcagattaaagccattggttatatatcatctcaagaatgtgttcatagttaaaactgagagagatcgaggaaaggccatggatcctgggagtgtggactatcccgaaactctgccaagccttcaattatatttccttcttggcattgtgtatgccgtggtgactccaatccttcttcctttcatactagtcttcttcgccttcgcatatttggtttatcgccatcagataatcaatgtctacaatcaacagtatgaaagtgctgctgcattttggccacaagttcacagccgcattatcgcaagcttaataatatcacagctgcttctgttaggcttgcttagcaccaaaaaggcagctaggtctacacctttgcttgtgttattaccaatattgacatttgcatttcacaagtattgcaagaatcgtttcgagccagcatttaggaagtacccggtcgaggaagcaatggccaaggatgtattggagaaaacaacagaacctgacctaaacataaaagcatatttagcagattcttacttgcatccaatcttaagatcatttgaagttgaagaagaggaattagttgaactcgaaacggttcaagtgagagtagataaactcgaaactcatcatgttgctagtcaaacaaggagtgaatcaagttcaccttcaccaccacatgacgttcatcatcaacattcaccaccacatcatgtccatcaacatcaaccttcaccacctcattacaatgactaccctttaccacctgagtattattaccatcatacatcccctccacattacaactatcaatatcaagatcaaccttgaattgatctaggttaccaattataaagttgctctagaaccttggtgtttttctttttaatatatattttgacttagatatatgatttggccatttacctattgcaattgtaaattatcaaatttagtttctctttcatgtaaatgttatgacttatgacttcttttaaattaggtgggataaaaagtaggaagattt

SEQ ID NO: 5385 - DNA, 2603 bp, Trigonella foenum-graecum
ctctaaacttactactctctctctctctctagaatggcaactcttcaagacattggtgtctcagcagctatcaacatactatcagcctttgcattcttgttagcttttgctttgctcagaattcaaccaatcaatgacagagtttatttcccaaaatggtatatcagtggtggcagaagcaatccaagaagctctgcaaattttgttggcaaatttgtcaatcttaatttcaagacttatttgacttttcttaattggatgcctcaagctttgagaatgtctcaaactgagattattaatcatgccggtcttgattctgctgttttctcagaatttatactcttggcttaaagatgtttgttccaatgacaattgcggcactcctcattcttattccagtcaatgtatcaagtgggacattatttttcctaagaagagaattggtagtgagtgatattgataaactctcaatatcaaatgttccacctaaatctttaagattttttgctcacataggattggaatacatattcacaatatggatttgttttctgctctacaaggagtatgataatgtagcattaatgagattgcatttcttggcctcacagcgcaggcgtgcagaacaatttacggtagttgtcaggaatgtccctcatatttctggtcactcggtatccgatagtgtggacagcttctttcaaacaaaccacccagatcattatattggacaccaggctgtctacaatgcaaatagatttgctaaatttgtgagaaaaagagacagacttcaaaattggctggactattaccggattaagttgcagaagcatcctgatacaaggccaactatcaagactggatgtttagggctttggggtcggaaagttgacgccattgagtactatgaccaacatattaaggaacttgataaactgatgacatcagagcgccagaaaattataaaagatcctaaatctattttgccagtggcttttctttcatttaattcgcgttggggagcatcagtatgtgcacaaacccaacaaagcaaaaatcctacactctggttgactgattgggctccagagccacgtgacatatattggcgaaacttggccataccatttgtttctctaaccatccggaaacttataataacgttgtcggtatttgccttggtattttctacatgattcccattgcctttgtgcaatcccttgcgaatttggatggtcttgaaaaagttgctcctttcctcagaccagtaatagaattgaaattcatcaagtcgtttctacaaggttttcttcctggtttggccctcaaaatatttttatatattctaccgacagttctaatgattatgtcaaaaattgagggatatattgcattatcgacacttgaacggaagacagcagcaaaatattattactttatgcttgtgaatgttttcttgggaagcataataactggaactgcatttgagcaactgcatgcttttcttcaccagtcacctacacagattcctagaacaattggagtttccattccaatgaaggctaccttctttatgacttacataatggttgatggctgggctggaattgctggtgagattctcagattaaagccattggttatatatcatcttaagaacatgttcatagttaaaaccgagagagatcgaggaaaggccatggatccagggagtgtggattttcccgaaactcttccaagccttcaactatatttccttcttggtattgtgtatgctgtgatgactccaatccttcttcctttcgtacttgtcttcttcgcctttgcatatttggtttatcgtcatcagataatcaatgtctacaatcaacaatatgaaagtgctgctgcattttggccacaagttcacagccgcatcatcgcaagcttaataatatcccagcttcttctgtttggcttgcttagcacaaaaaaggcagctaagtctacacctttgctgataatgttaccaatattgacatttgcatttcacaaatactgcaagcatcggtttgagccagcatttaggaagtaccccgttgaggaagcaatggctaaggatatattggagaaaaccacagaacctgatctaaacataaaggcatatttagcagattcttacttgcatccaatcttaagatcatttgaagttgaagaagaggaacttgttgaacttgaaagggttgaaattagagtagataaacaccaaactcatcatgttgctagtccaatattgagtgagtctggttcaccttcaccaccacatcatgtccatcaacatcaaccttctccacctcattacaatgactaccctttaccacctgaatattattaccatcctccctctcctccacattatgcctaccaatatcaaaatcaaccttgaattgatctaatgcttaccagttacagagttgcttgagattcttattagtgttttactttttaatataaattgacttagaatatgttttttggccatttacctattgaaattgtaaattaattttttattgatgtaaatgctatgacttcttttaaatatgaggtggataagtaggaag

SEQ ID NO: 5386 - DNA, 2585 bp, Trifolium pratense
ctctacaatggctactcttcaagaccttggtgtatcagctgccatcaacatactatcagcttttgctttcttgttagcatttgctttactaagaattcaaccaatcaatgacagagtttatttcccaaaatggtatattagtggtggaagaagcaatccaagaagttctggaaattttgttgggaaatttgtcaaccttaatttcaagacttatttgacttttcttaattggatgcctcaagctttgagaatgagtgaaactgagattattaatcatgctggtcttgattctgctgtttttctcagaatttatactcttggcttaaagatgtttattccagtgacaattgtggcactcctcattcttattccagtcaatgtatcaagtggaacattgtttttcctaagaaaagaattggtagtgagtgatattgataaactctcaatctcaaatgttccacctaaatctctaagattttttgttcacataggattggaatacatgttcacaatatggatttgttttctgctctacaaagagtatgacaatatagcgttaatgaggctgcatttcttggcctcacaacgtaggcgtgtggagcaatttacggtagtagtaaggaatgtccctcatatttctggtcactcggtatcggattctgtggacagcttctttcaaacaaaccatccagatcattatattggacaccaggctgtctacaatgcaaacagatttgctaaatttgtgagaaaaagagatagataccaaaattggttggactattaccgcctaaagtttcagaggaatccagatacgaggccagcgatcacgactggatgtttagggcttttcggtaggaaagttgatgctattgagtactatgaccaacatattaaagaacttgataaactgatgttctcggagcgccaaaagattataaaagatcccaaatctattttgccagtggcttttctttcattcaattcgcgttggggagcatcagtatgtgcacaaacccaacaaagcaaaaatcctacactctggttgaccgattgggcaccagagccacgtgacatatattggcgaaacttggccataccttttgtttctttaaccatccgaaaacttataataacattatcggtgtttgccttggtattcttctacatgattcccattgcttttgtgcaatcccttgcgaatttggatggtcttgaaagagttgctcctttcctcagaccagtaatagaattgaaattcatcaagtcctttctacaaggttttcttcctggtttggccctcaaaatatttttatatattctaccaacagttctcatgattatgtcaaagattgaaggatatattgcattatcgactcttgaacggaagacagcagcaaaatattattactttatgcttgtaaatgttttcttgggaagcataataaccggaactgcatttgagcaactgcatgcttttcttcaccagtcacctacacagattcctagaacaattggagtttccattccaatgaaggctaccttctttatgacgtacataatggttgatggctgggctggaattgccggtgaaattctcagattaaagccattggttatatatcatctcaagaatgtattcatagttaaaaccgagagagatcgtggaaaggccatggatcctgggagtgtggactatcccgaaactttgccaagccttcaattatatttccttcttggcattgtgtatgctgtggtgactccaatccttcttcctttcatactagtcttcttcgcctttgcatatttggtttatcgtcatcagataatcaatgtctacaatcaacaatatgaaagtgctgctgcattttggccgcaagttcacagccgcattatcgcaagcttaataatatcacagctgcttctgttaggcttgcttagcaccaaaaaggcagctaggtctacacctttgcttgtgttgttaccaatattgacatttgcatttcacaagtattgcaagcatcgtttcgagccagcatttaggaagtaccccgtcgaggaagcaatggccaaggatatattggagaaaacaacagaacctgacctaaacataaaagcatatttagcagattcttacttgcatccaatcttaagatcatttgaagttgaagaagaggagttagttgaactcgaaacggttgaagtgagagtcgataaactccaaactcatcatgtcgctagtcgaacaatgagtgaatcaagttcaccttcgccaccacatcatgtccatcaacatcaaccttcttcaccacctcattacaatgactaccctttaccacctgagtattattatcatcatacatcccctccacattataactatgaatatcatgatcaaccttgaattgatatagtggttactaattataaagttgcttgagaaccttagtgtttttctttttaatatatattttgacttagatatgtgttttggccatttacctattgcaattgtaaattatcattttttgtttctcttgatgtaaatgttatgacttcttttaaatgaggtgggataaagtagg

SEQ ID NO: 5387 - DNA, 2836 bp, Medicago truncatula
acacaaactagaacatgccaccttgttctatcttccattcctagcacatgcaaatcccaaaaatttcttaactatagtgctctctactcatcacaaactccattaatatattctcaaaaaaagtccaaacactctttcctataataaacaacacagattaatgtaaaatcagttacacttctttgctttgtttttctctctctaaaaactctctctctctctctagaatggcaactcttcaagacattggtgtctcagcagctatcaacatactctcagcctttgcattcttgttagcatttgctttgctaagaattcaaccaatcaatgacagagtttatttccctaaatggtatattagtggtggcagaagcaatccaagaagctctgcaaattttgttggaaaatttgttaatcttaatttcaagacttatttgacttttcttaattggatgcctcaagctttgagaatgagtgagactgaaattattaatcatgctggtcttgattctgctgtttttctcagaatttacactcttggcttaaagatgtttattccggtgacaattgtggcactcctcattcttattccagtcaatgtatcaagtgggacattatttttcctaagaagagaattggtcgtgagtgatatcgataaactctcgatatcaaatgttccgcctaaatctttaagattttttgttcacataggattggaatacatgttaacaatatggatttgttttctgctctacaaggagtatgataatgtagctttaatgagattgcatttcttggcctcacaacgcaggcgtgtagagcaatttacggtagttgtcaggaatgtccctcatatttctggtcactcggtatcagatagtgtggacagcttctttaaaacaaaccacccagatcattatattggacaccaggctgtctacaatgcaaatagattcgctaaatttgtgagaaaaagagatagacttcaaaattggctggactattaccggatcaagtttcagaaacatcctgatacaaggccaactgtcaagactggatgtttagggctttggggtaggaaagttgatgctatcgagtactatgaccaacatgttaaggaacttgataaactgatgacattggagcgccagaaaattataaaagatcctaaatctattttgccagtggcttttctttcattcaattcacgttgggcagcatcagtatgtgcacaaacccaacaaagcaaaaatcctacactttggttgaccgattgggctccagagccacgtgacatatattggcaaaacttgtccataccatttgtttctttaactgtccgtaaacttgtaataacgttgtcggtgtttgccttggtattcttctacatgattcccattgcttttgttcaatcccttgcaaatttggatggtcttgaaaaagttgctcctttcctcagaccagtgatagagttgaaattcatcaagtcctttctacaaggttttcttcctggtttggcccttaaaatatttttatatattctaccaacagttctgatgattatgtcaaaaattgagggatatattgcattatcaactctcgagcggaaaacagcagcaaaatattattactttatgctggtgaatgttttcttgggaagcataataactggaactgcatttgaacaactgcatgcttttcttcatcagtcacctacacaaattcctagaacaattggagtttccattccaatgaaggctaccttctttataacttacataatggttgatggctgggctggaattgctggtgagattctcagattaaagccattggttatatatcatcttaagaacatgttcatagttaaaaccgagagagatcgaggaaaggccatggatccagggagtgtggagtttcccgaaactcttccgagccttcaactatatttccttcttggtattgtgtatgctgtgatgactccaatccttcttcctttcatacttgtcttcttcgcctttgcatatttggtttaccgtcatcagataatcaatgtctaccatcaacaatatgaaagcgctgctgcattttggccacaagttcacagccgcatcatcgcaagcttaatactatcccagattcttctgtttggcttgcttagcacaaaaaaggcagtgaagtctacacctttgcttataatgttaccaatattgacatttgcatttcacaagtactgcaagagacgttttgagccagcatttaggaagtaccctgttgaggaagcaatggctaaggatatactagagaaaaccacagaacctgacctaaacataaaggcatatttagcagattcttacttgcatccaatcttaagatcgttcgaagttgaagaagaggaactggttgaactagaaacggttgaagtaagagtagataaacaccaaactcatcatgttgctagtccaatattgagtgagcctggttcaccttcaccaccacatcatgtccatcaacaccaacatcaaccttcaccacctcattacaatgactaccctttacctcctgagtattattaccatcctacctcccctactcattatgcctatcaatatcaaaatcaaccttgaattgagctaattcttatcagttacaaagttgcataagacccttattagtgtttttctttttaatttttattgacttagatgtgttttgtccatttacctattgcaattgtaaattatcattatttttttcttgatgtaaatgttatggcttctttttaacaatgaggtggttaaagtaggaagatttcacttgatcaagttggtggaaa

SEQ ID NO: 5388 - DNA, 2781 bp, Lupinus angustifolius
tttgacatgaatggtgtagttcctaaataagcatactcacacttattaaaaatccattaaaactaatctcactaaattctgaagtctaaacaacagtagaaaaaacccactttccctgcaataaacaattaatttggagttcctcaaaagttcttatattctttgacttcactcaccatcttctattctatccattcttcattttcttctctctcttgcaatggcaaccttagctgatattggtgtctcagctaccatcaacatactcacagcttttgcttttttgcttgcttttgctattcttagaatccaaccaatcaatgacaggatttactttccaaagtggtatattagtggaggaagaactagttcaaggaccactactggcaattttgtgggaaaatttgtgaaccttaatttcaggacttacctcacattcctgaattggatgcctcaagctctcagaatgagtgagactgagattattaaccatgctggtcttgattctgctgctttccttagaatctatactcttggcttaaagatttttgttccagtgacagtcgtggcactccttgttcttattccagtcaatgtatcaagtgggacactatttaacctaaaaaaagaattggtggtgagtgatattgataaactatcaatatcaaatgttccacctaaatctataaggtttttttttcatatagcactggaatacctggtcaccttatgggtttgtttcctgctctacaaagaatacaataatgtatcaactatgagattgcaattctttgtctcacaacgcaggcgtgtggagcaattcacggttgttgtcaggaatgtccatcatattcatgggcactcagtttccgattctgtggataacttctttcaaaaaaaccatcccaatcactatattggacaccaggctgtctacaatgcaaacaaatttgctagattagtgagaaaaagaaatggacttcaaaattggctggactattaccagcttaagtctgaaaggaatcccgacaagaagccaactgtcaagttaggattttggggtctttggggccagaaagttaatgctgttgagtattatagacgcattattacggaacttgataagatgatgatatcggaaaggcagaacgtcataaaagaccccaaatgtattttgcccgtcgcttttctttcattcaattcacgttggggagcatcagtttgtgctcaaacccaacaaagcaaaaatccaacactgtggttgactgattgggctccagagccgcgtgatatttattggcagaacctggccataccttttgtttctttgagcattcggaaactgataatatcatcattagtatttgctttagtattcttctacatgattcccattgctttggtgcaatcccttgcaaatttggagggtcttgaaaaagttgttcctttccttagaccagtaatagaattgaaattcatcaagtcctttcttcaaggttttcttcctggtttggctctcaaattatttttgtatgttcttccttcaattttgatgatcatgtcaaaaatcgagggatatattgcattgtcaacgctggaccggaagacatcatcaaaatattattattttatgctggtgaatgttttcttgggaagcatagtgactgggactgcatttgagcaactgcatgctttccttcaccaatcacctacagagattcctagaacaattggagtttccattccgatgaaggctaccttttttatgacatacataatggttgatggatgggctggaattgctagtgagatcctgagattaaaggaaatgattatatatcatctcaagaacatgttcatagttaaaactgagagagatagagaaaaggccatggacccggggagtgtagactataaggaaactattccaagtcttcaactatacttccttcttgggattgtgtatgctgtggtgtctcctgttttgcttcctttcatactgatcttctttgccttcgcatatttggtttaccgtcatcagataatcaatgtctacaatcaacagtatgaaagtgctgctgcattctggccacatgttcacagccgcattgtagcgagcttgataatatcccagcttcttttgttgggcctacttagcactaaagaggcggctaaatctacacctttgcttgtcatcttaccaatactgacatacgcatttcacaaatactgtcagagtcgtttcgagccagcatttaggcagtacccgcttgaggaagcaatggcaaaggatttgttggagaaaaccacagaacctgagttgaacataaaggcatatctagcagatgcttacttgcatccaatctttcagtcatttgagatagaggagcatgagttaattgaagtgagagtagataaacaacaaactcaagtaactagtccttcatcaaatgacactacttctccatcctcatcccattatcatcatcatctaccttctccaccaccctctccaccccatgatgactacccaggttttttccaccatgttcctcattatggctatcagtatcaacttgaaccttagaactagtgcataacaattacctagttgctttaacaccctttacataaaatttaagtgaaatataaacttagatgtgctttgacattttaaccattgcaaaatgtaaattattattctcttaaatgtaagtgtgatggtttcctttaaatatcaggtggcaaaagtaggcagaatttaattatagctgctagaaa

SEQ ID NO: 5389 - DNA, 3519 bp, Volvox carteri
cacgtctcgtcttgacttttgtttactcaatcatatataaaaagttaggacgtgggactgaacaattaccagcgacccgcttatacagaagccctcaacgccccgccgctgccccgttgtatgtgtatatgaggtcattaaagaacggccgtggacctgcctagggaaattgcagtcaggttatctgcttctagccacgcttcctgcaaacttgcaaacccacggcagagtacacagctgcaagcgatcgcggctctaccgcggacctcacgtcggccgacaactcacgccgaatcctggccctggccgcatggaggaccatcagtccgcgccataaagcgctgcgcgttagtgggggggaagtgctgaagtggccgcctctgactttgtggcctttcggcagatttgcggcctgtccggcgcctaccgtgttccagcaccgcttttcccacccacctaaattaggagggtgggagttaatgcgtgtctgaagcaccgaccgcctcttcagcagcgaggcccggctaagcgttgttttctggtgcccgacagctggacggctgtggaagtgcgcaagccggcatggctgtgaagacccgctgccgccagcagggtctcctcttgcgactagataagcgatacgattcctactttgcgcgctgtgctttacgtgaattgcaatgggctcaatactcaaccaacgattttgactcgtcgggaggatctggactcttaggcaagatttggagggccgggctgggcggcaagcaaaaggagggagcggaatctgggagcagcggcagtagcggcagcagtggcagcagcaacaaggggggctcaggcggcgcgaaggggtcctccgaagatgcgctggtgccctccggccccgagcgcaagcaccacaaggtgttcgtggtggagctgtcccgcaagcccctgttccctggcatctacaccccggtgatgatcagtaagaatgaggcgctcgtgagggaggtcatggaggtcaagaaacagggggcacacgcctacgtgggagctttcctccggaagcccccctcagacagcaacccccaaccccaaccccacccggaggaggggggaaatgcagcatcccatctgtacgacatcgggaccttcgcgcaggttcacacggtattggcgggtgacggggcggactccgcccagctgctgctgctgggacaccgccgaatacggaagaccgcggtgatatcccctgagcccctcagagttcacattgaccacttgagggacgagagctatacaagcgatgatatactcaaggccacaagtatggagatcgtcaacacgatgcgggacctgctgcagctcaaccccctgtacggcgaacagttccgtacattgctgtctctaactggcagtatcgacctgcaggatatgtcccgactggtggacgccgccgcctccctcactagtgcggatgacgtcaccctgcagggggtgctggaacagctgaatgtgccggagagggcccgtatggtcctcaacctgctgaagaaggaggtggagctgtgcaagctgcaagcggatatccgggagcaggttgagggcaagatcgccaaggagcagcggcgcatgttgctgatggagcagctcaagtccataaagaaggaactgggcctggagcgggacgacaagagcgcactgctgcaaaggttccaggcccgctgggatgaaaagaaggcggccgcaccccccgatgtggccaagacggtgaaggaggagctcgacaagctgggtgggctggagcccgtgtctccggagttcaacatcacccggacctacctggactggctcacctccctgccctggggtacgacaacccaggaggtgtttgacctgacgcgtgcgaagcaggtgctggatgacgagcacttcggtctggacgacgtcaaggaccgcatcctggagttcatcgcggtgtcgcacctgaggggcagcgcgcaggggaagatcctgtgcttggtggggccccccggtgtgggtaagaccagcatcggtcgctccatcgccaccgccctcaaccgggagtactaccgcttctctgtgggggggttgcatgacgtggcagagataaagggccacagcagcttcactcgttcgtggcgcacgtatgtgggcgcgatgcccggcaagctggtccaatgtctcaagtccacgggcagctccaacccgctggtgttgatcgacgaggtggacaagctgggtcgcgggcacgcgggggaccccgccagcgccctactggagctgctggacccggagcagaacgcggcgttcctggaccactacctggacctgcccctggacctgtccaaggttctgttcgtgtgtacggcgaacacacttgacaccatccccggtcccctcctggaccgaatggaagtcattaggttgtcgggatatgcgcaagatgagaagcgctccatcgcccggcggtacttagaaccggcagcggcggccgacgcgggagtgcctcgcgggtccgtgtcgctgtcggatgaggcgctggagggccttatctccgagtactgcagggaggcgggtgtacggaacctgaaaaaacacatcgacaaggtgtaccgcaaggtggcgctgcagctgctcaaggagtatgtgggtcaggcccccttcgcgaaagacaagttctatgaaaccaccccgccgggtgtggttatgggcctcgcctggacgcccctcggcggcgccaccctgtacgtggaggcggcccgggtggcggggagcgaggccaagggcgccctcaccaccaccgggcagctgggggacgtctttcgggagtccgccaccatcgcccacaccttcgcgcgcaacttcctatccgcgcgagaccccgccaccgcccactccttcttcggcggctcggccctgcacgtgcacgtgcccgccggcgccacccccaaggacggcccctcggcgggctgcacgctggtgacggcgctgctgtccctggccctcaaccggaccgtgcggcccgacctggcgatgacgggggaggtgaccctgacgggctgtgtgctgcccatcggcggggtgaaggagaaggtgctcgccgcccgccgtagcggtgtccgggtggtggtgttcccggagggcaacagaccggagtacgaggacctgccgcaggagcttagacagggcttggagccgcacttcgtgagctcgtacgggcaggtgtacgaactggccctgggcggccaggaccccaccagcccgccagcgaaacagggcgagcaggactccctccgtcgggacgcagcacagctactgccgccactgccctcaccttcaccccgaccagctgcatggacagccagctactctcgatgtaagtatgttccccgccaggccctgaccgacctagcggacggcggtctgaccactttcgaggtgagcggcgccggctggccgtactgctctcttaggtcgctgttcggcgagctgccctcggctgcgccataa

SEQ ID NO: 5390 - DNA, 1307 bp, Saccharum officinarum
cgacgagtccgacctcagggcgctagcggcgccggggtgcttccgggccccgcggacgtcgtgtctcgaggtcgcggtgtattacctggcccgcttcggcgcttcttctcgctgcggcgtcgtcgccgcctgcaggaggaagcggctggtcggcgtgttcagggtggagctcccgtcgtcggagtggcgggacggcaagcccgtgctgctgcaccatgggtgggcgggcatcggcaagggggaggccaggccggagctccacctcagggtgaagctggaggccgacccccgctacatcttccagtttgacgacgacatcgcgctgaacccgcaggtggtccagctccatggcagcatccggcagcccgtgttcagctgcaagttcatccgcgacaggcggccgtctcagagtgacccgttgggcggcgggcagtactggtcgagctccagcagcgaggagaaggacatggagatggtgaggcgggagaggaagggctggaaggtggtgatccacgacctgtccggctcggccgtcgccgcggcgttcatggccaccccgttcgtggcggcgccgggcggggacacggtggcgcggtccaacccgggcgcctggctcatcgtgcgcgccgacaccacggggtcctcggacagctggcagccgtggggacggctggaggcttggcgcgacgcggcggcgtcgggggcgagcagcggcaaggacacggtgcgcctgcggctgcacctgctgccggaccgccacgacgactgcgtgctcgtgtcggagacgcccctgagcagcgacaagggcggggagttcttcatcgacatggacaggcaggcgccctccgccacggccgcggagcactgcgcggcgagcctgggcgccgcgtgcgccggcggagggttcgtcatgagctgcagggtggaaggggaggcgaggagcagcaggccgttcgtgcagctcgccatgcgccacgtcacgtgcatggaggacgccgccatgttcgtcgcgctcgccgcggccgtcgacctcagcgtcaaggcgtgccgcccgttccggaggaagccgaacaagaagtctggctcgccgtcgcccgaccttctcgagctcgacacgtaggaacacagcacagaagacgcccgccgactagcatccatggccggccatggatccatctaactcgatctgtaaattcacttaatttcaagagctggaccagaccttttgcactttgcagcaatccaaaactctgttgtttgatttattcttgcacaacggttagtggtttgtgcgttctatcgccgat

SEQ ID NO: 5391 - DNA, 1698 bp, Setaria italica
catcaaacacacacagagctcagagaacagcctctcgtttcttgcacgaatccagcttcgatccatcgatcggaacatcgcttacggccagacgcagctgatcaaggcattatctgcaatgggtgagctgatccccgggttgccggaggaggtggcgagggagtgcctcgtccgggtgggcttcgaccagctgccggtggtccgccgcatctcgcgccagtggaagtcggaggtggagtcgccggactaccaccgcctgcgccgggcggaggggctggcgcggccggtgctcgcgcttgcccaggcgcagccagcggcgccggccgacgacgcggctccggcggcgcacaagcactcgtcgaccgcggcctcgggggggcccgcgaactcgtaccggatggtgctgctggacccggtggaggggcggtgggcgccgctgccggcgctgcccgggccgacggagagcctgcccctgttctgccaggtggccgccttggacggcgggcaggggaggaagcggctggtggtcgtcggcggctgggatccggagacgtgggcgccgatggacgcggtgttcgtgtacgacttcctcaccggtgcgtggcggcgcggcgcgcccatgcccgggccgcggcggtccttcttcgcctgcgcggccgtcggcggcgccgtgtacgtggccggcggccacgacgaggagaagaacgcgctgcggtccgcgctggcgtacgacccggacgccgacgcgtgggcgtggctcccggacatggcggcggagcgcgacgagccgcgcggcctctgcgtcgccggcaggttcctcgtcgtcggcgggtacccgacgcaggcgcagggccgcttcgttggctccgcggaggccttcgacccggcgacgtcggcctgggtgcccgtccaggacggcctgatcgaggacggcgcgtgcccgaggacctgctgcgcggcgccgggggcgtcggagcggatgtacatgcttcgcgacggccacctcgtggcgcgcgacggccctgccgcgtcgtggcgcccggtggcgcaggtgccggaggacgcgctcaccgcggcgaccgtctccgccatccccgacgggcgcgtcgtggtgatcggcgccggatgccacggcggggaccagaccgtgtacgtgctccgcgaggaggccgggaagggcgcgtcctgggcgcgcgcgccggcgccgcccgaattctccggccacgtgcaggccgcctgctcccttcaaatctgatcaagtgtacgtagaagaatgcagaacagatctgcctgtacgcatatacatagctagctacgcgcctctgcaactatacgtctcacggttgtatatagcattagaccacgtggatgtttgaatactaattagatagactaaatatgaatgaattataaaactaattgcagaattcctaggctaattcgcgagacaaatctattaagtctaattaatccatcattagcaaatggttacggtagcaccacattatcaaatcatggactaattaggcttaatagattcgtctcgcgatttagcctccatcatacaattagtttatatttaatattcttaattagcatcaaatatcctgatacaacagggctatccaaacaggtctaagaatgcactgcacatgtttgaaaaagagtgaaggattggcaggttcggaatattttgtt

SEQ ID NO: 5392 - DNA, 1594 bp, Setaria italica
catcaaacacacacagagctcagagaacagcctctcgtttcttgcacgaatccagcttcgatccatcgatcggaacatcgcttacggccagacgcagctgatcaaggcattatctgcaatgggtgagctgatccccgggttgccggaggaggtggcgagggagtgcctcgtccgggtgggcttcgaccagctgccggtggtccgccgcatctcgcgccagtggaagtcggaggtggagtcgccggactaccaccgcctgcgccgggcggaggggctggcgcggccggtgctcgcgcttgcccaggcgcagccagcggcgccggccgacgacgcggctccggcggcgcacaagcactcgtcgaccgcggcctcgggggggcccgcgaactcgtaccggatggtgctgctggacccggtggaggggcggtgggcgccgctgccggcgctgcccgggccgacggagagcctgcccctgttctgccaggtggccgccttggacggcgggcaggggaggaagcggctggtggtcgtcggcggctgggatccggagacgtgggcgccgatggacgcggtgttcgtgtacgacttcctcaccggtgcgtggcggcgcggcgcgcccatgcccgggccgcggcggtccttcttcgcctgcgcggccgtcggcggcgccgtgtacgtggccggcggccacgacgaggagaagaacgcgctgcggtccgcgctggcgtacgacccggacgccgacgcgtgggcgtggctcccggacatggcggcggagcgcgacgagccgcgcggcctctgcgtcgccggcaggttcctcgtcgtcggcgggtacccgacgcaggcgcagggccgcttcgttggctccgcggaggccttcgacccggcgacgtcggcctgggtgcccgtccaggacggcctgatcgaggacggcgcgtgcccgaggacctgctgcgcggcgccgggggcgtcggagcggatgtacatgcttcgcgacggccacctcgtggcgcgcgacggccctgccgcgtcgtggcgcccggtggcgcaggtgccggaggacgcgctcaccgcggcgaccgtctccgccatccccgacgggcgcgtcgtggtgatcggcgccggatgccacggcggggaccagaccgtgtacgtgctccgcgaggaggccgggaagggcgcgtcctgggcgcgcgcgccggcgccgcccgaattctccggccacgtgcaggccgcctgctcccttcaaatctgatcaagtgtacgtagaagaatgcagaacagatctgcctgtacgcatatacatagctagctacgcgcctctgcaactatacgtctcacggttgtatatagcattagaccacgtggatgtttgaatactaattagatagactaaatatgaatgaattataaaactaattgcagaattcctaggctaattcgcgagacaaatctattaagtctaattaatccatcattagcaaatggttacggtagcaccacattatcaaatcatggactaattaggcttaatagattcgtctcgcgatttagcctccatcatacaattagtttatatttaatattcttaatt

SEQ ID NO: 5393 - DNA, 1931 bp, Zea mays
gccgaaccataaaaaataaaaaagctctggaagcgactggatccacacaatgacacacaaccatatagaaatatcacagccttcccccgctatcacactcacaccctgctctgtttccatataagtagcccactctgctcccgcctcacacaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcctgcctctgttctgccaggtggccgccgccgtggacggcggcgggcaggggaggaagaggctgctggtggtggtcggcggctgggacccggagacgtgggcgccgacggacgcggtgctcgtctacgacttcctgtcgggcgcgtggcggcgcggcgcgcccatgcccggcccgcgcaggtccttcttcgcctgcgcggccgtgggcggcgccgtgtacgtggccggcggccacgacgccgagaagaacgcgctgcgctcggcgctggcctacgacccgggcgccgacgcgtgggcggggctcccggacatggcggaggagcgcgacgagccgcgcgggctctgcgtcgccggacgcttcgtcgtcgtcggcgggtacccgacgcgggcgcagggccgcttcgtcgcctccgcggagtccttcgacccggcggcggcggcgtcgcccgcctggggctgggcgcccgtccacgaccgcctgctgcccgaggacggcgcgtgcccgaggacctgctgcgccgcgccgcggtccgtcggccgcatgtacatgctccgcgacgggcacctcgtggcgcgcgacggcgccgcggcgtggcgccccgtggcgcgggtgccagacgacgcgctcaccgcgccggccgtctccgccttccctgacggccgcgtcgtggtcgttgggtccgggtgccacggcggggaccagaccgtgtacgtgctccgcgaggagggcgggagacctgcgtcctggtcgcgcgcgccgccgccgccgccggagttcgccgggcacgtgcaggcctcctgcttccttgaactctgaactctgaagtggagggtgtgtacctacacgtacgtggtggctgtgcatacatgacggaactacgctaccgtacttgttgtgccactgctgcagtgctgctagtctgctactcatcacggttgtatatacttagcaaataaatcatcacggttgtatgtacttagcaaataaagcagcggaacgggaatgatgtttattaaagaacatttccaggctagtgtaattaattagcgatgtcttcgttggattggatcacaatttgtttgatccgatctgcatgtaggggactagggacaggaaactgctgctaccggcgcgcttgcaaatggctgctgaaaatgctgtgcactaacagcggaccccggccccagtttagctcagtggtttcagtttctagaaccttttgatggaactgttttggcgggacatgaaaggagagtttctgtttttgggacctcatcttttgtcccaatccttatctagttatcttcccaggccctgtcgttttcgagctgaatttacatt

SEQ ID NO: 5394 - DNA, 1400 bp, Triticum aestivum
tcagcacgcagctctcgcacggagcagatcaagcaagctctcactcaatcgtttcttgttgaaatcattccgagttcattaatgagcagttgctttgaggcgtcagcaatgagcgacctgattccagggttgccggaggaggtggcgagggagtgcctcatccgggtgggcttcgaccagctgccggcggtgcgccgcatctcgcggcagtggaaggaggaggtcgagtcgccggactacggccgcctgcgccgcgcggaggggctggcgcgcccggtggtcgccatggtccaggcgcagcctgagcacgtcgagccgggcccggcgcagaagcacgcgtcggcgtcggcggccaacggcggatccgcgaacaactacaggatggttctgctggaccccgtggaggggcggtgggctccgctcccggtgctgcccggcccgaccgggagcctgcccctgttctgccaggtggctgcggtggacggcgcgcaggggaggaagcggctggtggtcgtcggcgggtgggacccggagtcgtgggcgccgaccgactcggtgtacgtgtacgacttcttgacaggcgcgtggcggcgcggggcgcccatgccgggcccgcgccggtccttcttcgccaccgcggccgtcggcggggccgtgtacgtcgccggcgggcacgacgaggagaagaacgcgctccggtcggcgctggcatacgacccggacgccgacgcgtgggccgcgctcccggacatggcagaggagcgcgacgagccgcgcgggctctgcgtcggcggcaggttcctggtcgtcggcgggtacccgacgcaggcgcaggggcggttcgctggctccgccgaggccttcgacccggcgacggcggcctgggccaccgtccaggagagcctgctagaggacggaacgtgcccgagaacctgctgcgtggcgccgggagcggagcgcatgtacatgcttcgcgacgggaacctcgtggctcgcgacgccggtgcctcggcgggctggcgcacggtggcgtccgtgccggaggacgcccgtaccgcctcgacagtctccgccatccccggcggacgcgtcgtggtgatcggctcaggctgccacggaggcgaccagaccgtgtacatgctgcgcgacgaggccggcaaggccgcgtcctgggcacgcgcccccgcaccgccggagttctctgggcacgtgcaggctgcatgcctcctagagatctgatcacctgagcgtatgtacagaaccatgaatagtgtatataaaggtatgtgtgcgtctgcgagggctgcgcctttttgcgccatgactcgagcttgcatagcacccatgtaagaaaatgatggttaaacgagtccagaaagatcgttgcaatgaacaaagct

SEQ ID NO: 5395 - DNA, 2127 bp, Hordeum vulgare
gagaaaatccaccttatcccttcccttgcaccgccgccataccacatacagatcgcttgctgcaccacgacactgtcgtccctttcaacagaccgcgacgccgctaaaagatctggaagaatccgcctcccgcaagtacgcgacgataagctccaaaccgtcccggccccacaccacaccccagtcccatacgattcctctgtttctgtataaatatggcgcgccactcccgccactcgccgcacacaagaacatcagcacacagctctcgcacacagcagatcaagcacgctctcactcttttcttgctcacttcacttcaagttcattgatgagcagctgctttgaggcgtcagcaatggccgacctgattccggggttgccggaggaggtggcgagggagtgcctcatacgggtggggttcgaccagctgccggcggtgcgccgcatctcgcggcagtggaaggaggaggtcgagtcgccgggctacggccgcctgcgccgcgccgaggggctggcgcgcccggtgctcgccatggtccaggcgcagcccgagcgcgtcgagcctggcccggcgcacaagcactcgtcggcgtcggctgccaacggcggccccgcgaacaactacaggacggtgctgctggacccggtggaggggcggtgggccccgctgcctctgctgcccggcccgaccgggagcctgcccctgttctgccaggtggccgcggtggacggcgcgcaggggaggaagcggctcgtggtcgtcggcgggtgggacccggagtcgtgggcgccgacggactcggtgtacgtgtacgacttcttgacaggcgcgtggcggagcggggcgcccatgccgggcccgcgccggtcgttcttcgccaccgcggccgttgccggggcagtatacgtcgccggcgggcacgacgaggagaagaacgcgctccggtcggcgctcgcgtacgacccggactccgacgcgtgggccgcgctcccggacatggcggaggagcgcgacgagccgcgcgggctctgcgtcggcggcaggttcctggtcgtcggcgggtacccgacgcaggcgcaggggcggttcgctggctctgccgaggccttcgacccggtgacggcggcctggggcactgtccaggagggcctgctcgaggacggcgcgtgcccgagaacctgctgtgtagcgccgggagcggagcgcatgtacatgctccgcgacgggaacctcgtggcgcgcgacggcggcccctcggcgggttggcgcacggtggcgtccgtgccggaggacgcccgcactgcgtcgaccgtctcggccatccccggcggacgcgtcgtggtgatcggctcaggctgccacggaggcgaccagaccgtgtacatgctgcgcgacgaggccggcaagaccgcgtcctggacgcgcgcctcggcaccgccagagttctcggggcacgttcaggccgcatgcttcctagagatctgatccactccacatatgatgtgatcactgaagcctgtgtacagaactatggatagtgtatatagaggtatatttatgcgtatatgacgcatcaacgcgcgccgacgagggcctcgtttttccgcgccatgtctcgagctttcatagcaaccaacaaccatgtacgaaaatgatgacggttaaacgagtgcagaaagattgttgcaatgaacaaagctcagtgataggatggcggttctgttttcgattttggatgccacgagacgagatgtcgatcgccggtgagaagacgctggagctgctttacgccgaccaaattggtgctgttttctgtttgttctgttccgccggagcattgatgggccttctagaacatgtcgttgcaaaaggcggcctgcttcgctctgtgtccttcataagaccagattccttttggagagtgaagcgttgggaagcttctgcagcggattatcctaattttggaaggacgccggtgcccgttttcatcgaatctcgaagactcgaaccaccttttgtcgccttctcactccagatgtggcttttgggttcatgctcgcgctgaaccatgacttttggctccctgtatgttcagaaaccatgtacagtactccctcggtttt

SEQ ID NO: 5396 - DNA, 1929 bp, Brachypodium distachyon
ccactcgccgcacacaagaacatcaacacgcagctctcagaacaaatcaagaaaagaaagctctctcactcatcccctcactcgttccttgctcagctcatttccagcacgctgcgttagttgatcagaagcgcgttggccattaactggcagccgcaatgagcgagctgatccctgggttaccggaggaggtggcaagggagtgcctcatccgtgtggggttcgaccagctgccggcggtgcggcgcatctcgcggcagtggaaggaggaggtcgagtcgccggactacggccgccttcgccgcgcggaggggctggcccggccggtgctcgctctggtccaggcccagccggagcccgtcgagccaggcccggcccacaaacactcgtcggccaacggtgggccggcgaatgactaccgaatggtgctgctggacccggcggagggccgatgggccccgatcccggtgctgcccggcccaaccgggagcctgcctctgttctgccaggtggccgcggtcgacggcgagcatgggaggagcaggaagcggctggtggtcgtcggcgggtgggaccccgacacgtgggcgcccacggacgcggtccacgtgtacgacttcctgaccggcgcgtggcgccgcggggcgcccatgccgggcccgcgccggtccttcttcgcctgcgccgccgtcggtaaggccgtgtacgtggccggcgggcacgacgaggagaagaacgcgctccggtcggcgctggcgtacgacccggacgccgacacgtgggccacgctccctgacatggcggaggagcgagacgagccgcgcgggctctgcttcggcggcaggttcctcgtcgtcggcgggtacccgacgcaggcccagggccggttcgcgggctcggcggaggccttcgacccggcgacatgggcctgggcccaagtccaggagggcctgctcgaggacggcgcgtgcccgaggacgtgctgcgcggcgccgggagggcagcgcatgtacatgctcagagacgggcagctagtggcgcgcgatggcggcggcggcgcgtggcgcacggtggcgcccgtgccggaggacgcccgcaccgcgtcgaccgtctgcgctatccccgggggacacgtcgtggtcatcggctccgggtgccacggaggcgagcagaccgtgtacatgctgcgcgacgtggccgggaagcccgcttcctgggcgcgcgcgccggcgccgccggagttctccgggcacgtgcaggctgcctgcttcctagagatctgaacgctcaggcgcatgtacagaatcatgcatagatgtaactaaacaggggcgttttcgtgcgccatgtctcgagttttgcgtagcaaccatgtaaataaggaaaggatggttaaacgagtaaagaaagataatgtaagtgccatggaagaaaaggacggtaaacgagtccagaaagataatgttcgtcaaagtagtttgtggtcccgcttatgttttttattttgctacaacgagaggtgtagaagatggagttgctctactccaattggggtgcccatttttgtctgttcttgttctgctggaacattttcggagcttctggacggcagagcagagctcttctgttctactccaaaggaaaaaagattctatttcgagagtgaaaagttcagaagcttctgcaacggcttatccaaacttttttattaaaaaaacggtaggatccagatttttattcattagcagtgaacttagcacaaaatacaaacattaaagactccgaattacaaacaagtccctggactttgcagaaaggaccctgcaaggggatgaagaaacgcaattgggtcctcagctcccaatcggagatctcctcgccgtcaccggggactacgccacttgggacgacgaggccgtcgcagcaggc

SEQ ID NO: 5397 - DNA, 2361 bp, Brachypodium distachyon
cgccactcgccgcacacaagaacatcaacacgcagctctcagaacaaatcaagaaaagaaagctctctcactcatcccctcactcgttccttgctcagctcatttccagcacgctgcgttagttgatcagaagcgcgttggccattaactggcagccgcaatgagcgagctgatccctgggttaccggaggaggtggcaagggagtgcctcatccgtgtggggttcgaccagctgccggcggtgcggcgcatctcgcggcagtggaaggaggaggtcgagtcgccggactacggccgccttcgccgcgcggaggggctggcccggccggtgctcgctctggtccaggcccagccggagcccgtcgagccaggcccggcccacaaacactcgtcggccaacggtgggccggcgaatgactaccgaatggtgctgctggacccggcggagggccgatgggccccgatcccggtgctgcccggcccaaccgggagcctgcctctgttctgccaggtggccgcggtcgacggcgagcatgggaggagcaggaagcggctggtggtcgtcggcgggtgggaccccgacacgtgggcgcccacggacgcggtccacgtgtacgacttcctgaccggcgcgtggcgccgcggggcgcccatgccgggcccgcgccggtccttcttcgcctgcgccgccgtcggtaaggccgtgtacgtggccggcgggcacgacgaggagaagaacgcgctccggtcggcgctggcgtacgacccggacgccgacacgtgggccacgctccctgacatggcggaggagcgagacgagccgcgcgggctctgcttcggcggcaggttcctcgtcgtcggcgggtacccgacgcaggcccagggccggttcgcgggctcggcggaggccttcgacccggcgacatgggcctgggcccaagtccaggagggcctgctcgaggacggcgcgtgcccgaggacgtgctgcgcggcgccgggagggcagcgcatgtacatgctcagagacgggcagctagtggcgcgcgatggcggcggcggcgcgtggcgcacggtggcgcccgtgccggaggacgcccgcaccgcgtcgaccgtctgcgctatccccgggggacacgtcgtggtcatcggctccgggtgccacggaggcgagcagaccgtgtacatgctgcgcgacgtggccgggaagcccgcttcctgggcgcgcgcgccggcgccgccggagttctccgggcacgtgcaggctgcctgcttcctagagatctgaacgctcaggcgcatgtacagaatcatgcatagatgtaactaaacaggggcgttttcgtgcgccatgtctcgagttttgcgtagcaaccatgtaaataaggaaaggatggttaaacgagtaaagaaagataatgtaagtgccatggaagaaaaggacggtaaacgagtccagaaagataatgttcgtcaaagtagtttgtggtcccgcttatgttttttattttgctacaacgagaggtgtagaagatggagttgctctactccaattggggtgcccatttttgtctgttcttgttctgctggaacattttcggagcttctggacggcagagcagagctcttctgttctactccaaaggaaaaaagattctatttcgagagtgaaaagttcagaagcttctgcaacggcttatccaaacttttttattaaaaaaacggtaggatccagatttttattcattagcagtgaacttagcacaaaatacaaacattaaagactccgaattacaaacaagtccctggactttgcagaaaggaccctgcaaggggatgaagaaacgcaattgggtcctcagctcccaatcggagatctcctcgccgtcaccggggactacgccacttgggacgacgaggccgtcgcagcaggcttgtgcaacccaccagtcgggagatgaaaggatggccgcctttcgactagcagatgcagtggcacggcgagagccggcaccgaatctcctccacggtagccaccgctgatgagatcgaccacaagaggaaagtttcaacctgcctcctacaactcgctgaagaaccacctccatggtgactgcaacagcaagaggaggagccgagtactacctggaaagaaaggacttcgagattattctggaggttgtcaacgaccctctcagcagcgaccttccatcggccaccaccgggatctccgtcgccaagcgccgccgactgctactcgcccacggccacggacctcctcctaacagcatatcgccacacctcggcatcaagccaacgacccctaaggggaacctagcaactatggagcaccgagcacctccc

SEQ ID NO: 5398 - DNA, 1835 bp, Triticum aestivum
tcagcacgcagaacaaatcaagcaagctctcctctcactcgtttcttgctcggttcatttgcggcgtcagcgatgagcgacctgattccagggttgccggaggaggtggcgagggagtgcctcatcagggtgggcttcgaccagctgccggccgtgcgccgcatctcgcggcagtggaaggaggaggtcgagtcgccggactacggccgcctgcgccgcgccgaggggctggcgcgcccggtgctcgccatggtccaggcgcagcccgagcgcgtcgagcctggcccggcgcagaagcacgcgtcggcgtcggcggccaacggcggacccgcgaacaactacaggatggtgctgctggacccggtggcggggcggtgggctccgctcccggtgctgcccggcccgaccgggagcctgcccctgttctgccaggtcgccgcggtggacggcccgcaggggaggaagcggctggtggtcgtcggcgggtgggacccggagtcgtgggcgccgaccgactcggtgtacgtgtacgacttcctgaccggcgcgtggcgccgcggggcgcccatgccgggcccgcgccggtccttcttcgccaccgcggccgtcggcggggccgtgtacgtcgccggcgggcacgacgaggagaagaacgcgctccggtcggcgctcgcgtacgacccggacgccgacgcgtgggccgcgctcccggacatggcggaggagcgcgacgagccgcgcgggctctgcgtcggcggcaggttcctggtcgtcggcgggtacccgacgcaggcgcagggccgcttcgccggctccgccgaggccttcgacccggcgacggcggcctgggacaccgtccaggagggcctgctcgaggacggcgcgtgcccgagaacctgctgcgtggcgcccggagccgagtgcatgtacatgctccgcgaagggaacctcgtggcgcgcgacggcggcgcctcggcggggtggcgcaccgtggcgtccgtgccggaggacgcgcgcaccgcgtcgaccgtctccgccatccccagcggccgcgtcgtggtgatcggctcaggctgccacggaggcgaccagaccgtgtacatgctgcgcgacgaggccggcaacggcaaggccgcgtcctgggcgcgcgccccggcgccgccggagttctccgggcacgtgcaggctgcatgcttcctagagatctgatctgatcacctaagcgtgtgtacagaaccatgaatagtgtacatagaggtagtatatgtgtgcatataacgcatcaatgcgcgtctgcgagggctgcgccttttcgcgccatgactcgagcttgcattgcacccgtgtaagaaaatgatggttaaacgagcccagaaagatcgttgcaatgaacaatgttttcgattttgtctgccgcgagacgagatgtcgatcgccggtgagaggattccggagctgttttgcaccgaccaatgggtgccgtttttctgtttgttctgttcagccgggacgttgagataggccttctagaacacgtcgttgcaaaagacgggtctgctttgctttgctctgtgctggacaagacaagaattcttttggagagtgaagtgttgggaagcttctgcaacggcttatcctaaatttggaaggacgacgatgcccgttttcatcatatctcgaaccatcttttgtcgtcttctcactccagatgtggcttttgggttcgtgctcgcgcttaaccgtgacttttgttccgtctatgctgggtactctttatggcttctttggatcacatcattagaaaataaaggaattcaaaaacacatgaatttgac

SEQ ID NO: 5399 - DNA, 2523 bp, Arnica chamissonis
gtgctagggaagagggtgtggcacagcaagtatacgagacagaattgcttctgtatgtcagtagattgtacgcactgcaactactacggtggatttggtgagcttgctaatcccttacaatggcctcaacttcgcaaaaggcgtcgcattcttctgatgattcccttccaatccgccgtcaaattgttcctgcctccgccgctcccgacgtcgttgtcatcgaggattggaataacgacgatcggccactgccgataaaaattccgtgatcaattcttctgatccttcggctaatgcttccacgaaaggaatccaagtcctcacaagggctcaaaccagtcatcctttggacccattatcggcagctgaaatcaaggtagccattgcaactgttagggctgctggagcaacccctgaggttagagatggcatgcgatttgtggaggtggttctatcagagccggaaaaaatattgtggcacttgcagatgcatacttctttccaccattccaaccatcattgttacccagaagcaaaggaggggctttgatacctattaaacttcctccaaggagagctcggcttgttgtttataataaaaaatcaaatgagacgagtgtatggactgttgaattatctgaggtacatgcagcaactcgaggtgggcatcatagaggaaaagtcatttcatcacgagttgtcctagatgttcagcctcccatggatgctgtggaatatgctgagtgtgaagctgtggtgaaagattatcctccctttcgggaggctatgaagaagaggggtatagatgatatggagctagtgatggttgatgcctggtgtgttggataccacagtaaggctgactcacctagccgtagactagcaaaaccacttatattttgtaggacagaaagtgacagtccaatggaaaatggatatgcacgtccagttgaaggcataaatgttcttgtcgatatgcaaaatatggtagtgcttgagtttctagaccataagcttgttcccttaccaccagctgatccgttgcgaaattacacccctggtcatacacgaggcggtgttgaccgcagtgatgtaaaaccgctacagattctccagcccagtggaccaagcttccgtgttaatgggcactatgttgagtggcaaaagtggaactttcgtatcggtttcactccgagggagggtctggtattacattcggttgcatatgttgatggtagtagaggtcgaagatcaatagcccatagattgagctttgtggagatggttgtgccttatggcgatccaaatgatccacattacagaaagaatgcatttgatgctggtgaagatggccttggaaaaaatgctcattccctaaagaagggatgtgattgcttaggatatatcaagtactttgatgcacattttacaaacttcattggaggtgttgaaacaattgaaaattgtgtatgtatgcacgaggaggaccatggcatcctatggaagcaccaagactggagaactggcttagcagaagtccgaagatctcgacggctcacagtttcttttatatgtactgttgcaaactatgaatatggtttctattggcacttttaccaggatggaaagattgaagctgaagttaaactcactggaattctaagcttaggagcattgcagccaggtgaagttagaaaatatggcactaccattgcaccaggactgtatgcaccggttcatcaacatttttttgttgctcgaatggacatggcggttgattgtaagcctggagaaacatacaatcaggttgtcgaagttgatgttaaagttgaagaaccaggaaaaaataatgttcacagtaatgcattttacacacaggtgacattgctgaagtctgaatctcaagcaatgcgggattgtaatccgttatctgctcgccattggattgttagaaacacaagaaccgtgaacaggacagggcaactgacaggctacaagctggtacctggttcaaactgcttgcctttagcaggttcagaagccaagtttttgagaagggccgcgtttctgaagcataatctgtgggttacaccttatgcacctggagaagattttcctgggggagagttccctaaccaaaaccctcgggttggcgaaggtctggcctcatgggttcagaaagatcgatctcttgaagaaaccgatatcgtcctctggtatgtattcgggatcactcatgttcctaggttggaagactggcctgtgatgccagtggagcggatcgggtttatgcttcagccacatgggttctttaactgctctccggctgtagacgttcctcctggagcttgtgagtcagatgtgaaagacggtcatgttaaagacataattgctcccaagccggtttcaaatggtttgatagccaagctttgagttgatcttaaacagtgtaatttagaatgttgatgttgtaaaacattgggctagctagctttgaaccctggtgtttttggtgtatgaatc

SEQ ID NO: 5400 - DNA, 2378 bp, Flaveria ramosissima
ccgcttccgacgtcgtcgtcgtcgacgattggagtaacgacgatcggccgattccgatcaacaagcccgtgatcggaccttctgatccttccgctaatgcttccgccaaaggaatccaagtccttacaagggctcaaagcagtcatcctttggatccattatctgctgctgaaatcaaagtagccgtggcaactgtcagggcagctggagcaacccctgaggtcagagatggcatgagatttgtggaggttgttctattagaaccagataaaaatgttgtggcgcttgcagatgcgtacttctttccaccattccaaccatcattgttacccagaagcaaaggaggagctgtaatacctactaaacttcctccaaggagagctcggcttgttgtttataataaaaaatcaaatgagacaagtgtatggatcgttgaattatctgaggtacatgcagcaactcgaggtggccatcatagaggaaaagtcatttcatcacaagttgtcgtagatgttcagcctcccatggatgctgtggaatatgctgaatgtgaagctgtagtgaaagattatcctccttttcgggaggctatgaagaagaggggtattgatgatatggatctagtaatggttgatgcttggtgtgttggatatcacagtaaggctgatgctcctagccgcaggttagcaaaaccacttatattctgtaggacagaaagtgatagtccaatggaaaatggatatgcacgtccagttgaaggcatatatgttcttgttgatatgcaaaatatggtagtgcttgaattcgaagaccgtaagcttgttcccttgccgccagctgatccattaagaaactacactcctggtcatacacgaggcggtgttgatcgcagtgatgtaaagcccctacatattcttcagcctgatggaccaagcttccgtgttaatggccactatgtagagtggcaaaagtggaacttccgtatcggattcactccaagggagggtttggtaatacattctgttgcatacgttgatggtagtagaggtagaagaccaatagctcacagattgagctttgtggagatggttgtgccttatggtgatccaaatgatccgcattaccgaaagaatgcatttgatgctggtgaagatggccttggaaagaatgctcattctcttaaaaagggatgtgattgcttaggatacatcaagtactttgatgcacattttacaaacttcatcggaggtgttgaaaccattgaaaattgtgtatgtatgcatgaagaggaccatggaatcttatggaagcaccaagactggagaactggcttagctgaagtccgaagatcccgacggctaacagtttcttttatatgcactgttgcaaattacgaatatggtttctattggcacttttaccaggatggaaagattgaagctgaagttaaactcactggaattctaagtttaggagcattgcagccaggagaagttagaaaatatggcactacaattgcaccaggactttatgcaccggttcatcaacatttttttgtttctcgaatggacatggcagttgattgtaagcctggagaagcatacaatcaggttgttgaagttgatgttaaagttgaagaaccaggagaaaataatgttcacaataatgcattctacacacaggaaacattgcttaaatctgaatctcaagcaatgcgggattgtaatccgttatctgctcgccattggatcgttagaaacactagaactgtgaatcggaccggacttttgactggctacaagctggtacctggttcaaactgcttgcctttagcaggttcagaagccaagtttttgagaagggctgcctttctgaaacataatctgtgggttacaccttacgcacctggtgaggattttcctggaggagagttccctaaccaaaacccacgtgttggtgaaggtctggcctcatgggtccagaaaaaccgatctcttgaagaaaccgatattgttctctggtatgtatttgggatcactcatgttcctaggttagaagactggcctgtgatgccagttgagaggattgggtttatgcttcagccacatgggttctttaactgctctccggcggtagatgttcctcctggagcttgcgagtcagatgtgaaagacaaccatgtgaaagacacaattactcccaagtcggattcaaatgggttgttagccaagctctgatttatgttaatataatcttttggttgtgtgaatgtgaaccagtacaatgcttagttggtttctatactttttgtcaagtcagtagaatggccaaaatgtttcgtgtcggtacctttgtgtgcctgatgaataaggatatgc

SEQ ID NO: 5401 - DNA, 2272 bp, Cichorium intybus
agtcatcctttggatccattatctgctgctgaaatcaaagtagctgtggcaactgttagggcagctggagcaacccctgaggtgagagatggcatgcgattcgtggaggtggttctatcagaaccggataaaaacgttgtggcacttgcagatgcttacttctttccacctttccaaccatcattgttacctagaaccaaaggaggggctgtaatacctactaaacttcctccaagaagagctcgacttgttgtttataatcaaaaatcaaacgagacgagtatatggattgttgaactatctgaggtacacgcaacaacacgaggcggacatcatagaggaaaagtcatttcatcacgagttgtccttgatgttcaacctcccatggatgctgtggaatatgctgaatgtgaagctgttgtgaaagactaccctccctttcgggaggctatgaagaagaggggtatagaggatatggatcttgtaatggttgatgcttggtgtgtggggtatcatagtgaggctgatgctccaagccgtagattagcaaaaccgcttatattttgcaggacagaaagtgacagtccaatggagaacgggtacgcgcgtccagttgaaggcatatatgttcttgttgatatgcaaaatatggtagtgcttgaatttgaagaccgtaagcttgttcccttaccaccagctgatccattaagaaactacactcctggccatacacgtggcggtgttgaccgcagtgatgtaaagcctctacaaattcttcagcctgatggcccaagcttccgtgttaatggacactatgttgagtggcagaagtggaattttcgtattggtttcaccccacgcgagggtttggtaatacattctgttgcatatgttgatggaagtcgaggtcgaagaccaatagctcatagattaagctttgtggaaatggttgttccctatggtgacccaaacgaaccgcattacagaaaaaacgcatttgatgctggtgaagatggtcttggaaagaacgctcattctctaaaaaaaggatgcgattgcttaggatacatcaaatactttgatgcacattttacaaacttcattggaggcgttgaaaccatcgaaaactgtgtatgcatgcatgaagaagaccatggaatcctctggaagcatcaagattggcgaactggcttagcggaagtcagaagatccaggcggttaacagtttcttttatttgtactgttgcaaattatgaatatggtttctactggcatttttaccaagatggaaagattgaagctgaagttaaacttactggaattttgagcttgggagcattacaaccaggagaagttagaaaatatggtactacaattgcaccaggactatatgcacctgttcaccaacattttttgttgcaagaatggacatggcggttgattgtaagcctggagaagcatacaatcaggttgttgaagttgatgttaaagtggaagagccaggaaaagataacgttcacaataacgcgttctacacacaggaaacattgcttaaatctgaatcacaagcaatgcgcgattgtaatcagttatctgctcgtcattggattgttaggaacacgagaaccgtgaacaggactggacagttaaccgggtacaaactggtacccggttcaaactgtttacctttagccggctcagaagctaagttcttaagaagggctgcttttctaaagcataatctgtgggtcacaccgtatgcttgcggtgaggatttccccggaggagaattccccaaccaaaatccgcgtgtgggtgaaggtctggcttcatgggtccaacaaaaccgatctcttgaagaaaccgacattgtactttggtatgtatttgggataactcatgttcctaggttggaagactggcctgtgatgcctgtggagcggattgggtttatgcttcagccacatgggttttttaactgctctcctgcggtggatgttcctcctggagcttgtgagccggatgtgaaagagagccatgtgaaagagacgatttctcctaagtcggtttcaaatgggttgatagccaagctttgattgttcacatgtttgatttattaaagcgtgtaagatgatggtgtgtgaatttgaaccgagtatatatagagtttgaataacagttggtttgaactaggtttttatggagttaggttgtatatgatgataataaaatttcagtgtcaaaaatcataaaagttagccgtttttaggcc

SEQ ID NO: 5402 - DNA, 2229 bp, Ambrosia trifida
ccgtctgatccttcatcgaaaggaatccaagttctcacacgggctcaaactagccatcctttggacccattatctgcagctgaaatcaaagtagccgttgcagctgtcagggctgctggagcaacccctgaggtcagagatggcatgcgatttgtggaggtggttctagcagaaccggataaaaatgttgtggcgcttgctgatgcatacttctttccaccattccagccatcattgctacccagaagtaaaggaggggctgtgatacctactaagcttcctccaaggagagctcggcttgttgtttataataagaaatcaaatgagacgagcgtatggattgttgaattatctcaggtacatgcagcagctagaggtgggcatcatagaggaaaagtcatctcctcacgagttgtccaagatgtgcagcctcccatggatgctgtggaatatgctgaatgtgaagctgtggtgaaagattatcctccttttcgggaggctatgaagaagaggggcatagatgatatggatctagtgatggttgatgcttggtgtgttggataccatagcaaggctgatgcacctagccgtagattagcaaaaccacttatattttgtaggacagaaagtgatagtccaatggaaaatggatatgcacgtccagttgaaggcatacgtgttcttgttgatatgcaaaatatggtagttcttgaatttgaagaccttaagcttgttcccctaccaccagcagatccattgcgaaactacactcctggtcatacacgaggcggtgttgaccgcagtgatgtaaagccgctacagattattcagcctgaaggaccaagctttcgtgttaatggatactatgttgagtggcaaaagtggaactttcgtatcggtttcactccgagggagggtttagtattacattcagtggcatatgttgatggtagtagaggtcgaagatcaatagctcatagattgagctttgtggagatggttgtgccttatggcgatccaaatgatccacattatagaaagaatgcatttgatgctggtgaagatggccttggaaaaatgctcattccctaaagaagggatgtgattgtttaggatatatcaagtactttgatgcacattttacaaacttcataggaggggttgaaacgattgaaaattgtgtatgtatgcacgaagaggaccacggaatcctctggaagcatcaagactggagaaccggcttagctgaagtccgaagatctcgacgactcacagtgtcttttatatgtactgttgcaaactatgaatatggtttctattggcacttttaccaggatggaaagattgaagctgaagttaaactcactggaattttgagcttaggggcattgcagccaggagaagttagaaaatatggcaccaccattgcaccaggactgtatgcgccggttcatcaacatttttttgttgctcgtatggacatggcagttgattgtaagcctggagaaacatacaatcaggttgttgaagttgatgttaaagttgaagaaccaggaaaagataatgttcacaataatgcattctacacacaggaaacattgcttaaatctgaatctcatgcaatgcgggattgtaatccgttatctgctcgtcattggattgttagacacacaaggaccgtgaataggacaggccaactgacaggctacaaactcgtacctggttcaaactgcttgcctttagcaggttcagaagccaagtttttgagaagggccgcctttctaaagcataacttatgggtgacgccttacgcacctggtgaggattttcctggaggcgagttccctaaccaaaacccacgtgttggcgaaggtctggcctcatgggtccagaaaaatcgatctcttgaagaaaccgatatcgttctctggtacgtgttcgggatcactcatgttcctaggttggaagactggcctgtgatgccagtggagcggattgggtttatgcttcagccacatggattctttaactgctctccggcggtagatgttcctcctggagcttgcgagtcagatgttaaagacagtcctaaagacgcaattggtcccaagccggtttccaatgggctgatagccaagctttaatttgatcataaataatgtaagatatgaaacattggttagtttgtaacctgtctttggtgtatgcatccgaacacgtacaatactt

SEQ ID NO: 5403 - DNA, 3150 bp, Petroselinum crispum
tatacatacatatatttgctgtatgtcagtgagttgtttcacgcattactacggtggatttggtgagcttgcaaacccattacaatggccacaattaagaaaacgccgtcgtttttaccttccgatgacactccgctcgtttctcgccgtgccgacgttgttcaggactggagtgttgcgtcgtctgtttcctccgatgatcggccgatcaaaacgtccgccattgctcccttgaattcttccgctagtgctactgcttctactaaaggaatccagattatgctaagggcacaaagtagtcatcctttagaccctttatcttcagctgagatctcagtggccgtagcaactgtcagggcagctggagctacccctgaggtcagagatggaatgcggtttgttgaggttgttctgtcagaaccaagtaaaaatattgttgcattggcagatgcttacttcttccctccattccaaccctcattactgccacgaactaagggtggagctgtaattcctagtaagctacctccaaggcgagctagacttgtggtttacaacaaaaagtcaaatgaaacaagcatatggatcgtagaactatcagaagtacatgcagcaactagaggtggacatcacaggggaaaagtgatttcctcacaggttgttcctgatgtacagccaccaatggacgccatggaatatgctgagtgtgaagcagttgtaaaagagtatcctcctttccgtgaagctatgaagaagcggggtattgaggatatggatcttgtcatggtcgatgcttggtgtgttggttactatagtgatgctgatgctcctaatcgtagactcgctaagccacttattttctgtagaacggaaagcgattgtcctatggaaaatggttatgcacgcccagtggaaggcatatatgtgctagttgatatgcaaaacatggttgtcattgagtttgaagatcgtaaacttgtcccattacctccagctgatccactaagaaactatactcctggtgaaacaaggggaggggttgatcgtagtgatgtaaagcctttacagattgtacagcctgagggtccaagctttcgagttagtgggcactatgtagaatggcagaagtggaatttccgaattggtttcaccccgagggaaggcctggttatacattctgttgcatacgttgatggtagtagaggccgaagacccatagctcatagactgagttttgttgagatggttgtcccctatggcgatccaaatgacccccattacaggaaaaatgcatttgatgcaggggaagatggccttgggaagaatgctcactcacttaagaagggatgtgattgtttgggctatattaagtacttcgatgcacattttacaaattttaccggtggcattgaaactatagaaaattgtgtatgccttcatgaggaggatcatggaatcctttggaagcaccaggactggagaacaggcctagcagaagtccgaagatccaggcgactaacggtttcttttatatgtactgtggctaattacgaatatggtttttactggcacttctatcaggatggaaaaattgaagctgaagtgaaacttactggcatcctcagcttaggagcattgcagcctggggagtcccgaaaatatggtacaacaattgcaccaggactgtatgcaccagttcatcaacattttttatttctcgaatggatatggctgttgattgcaagcctggggaagcatacaatcaggttgttgaggttgatgtcaaagtcgaagaacccgggaatgacaatgtacataacaatgcgttctacactgaagaaacgttgctgaaatctgaattgcaggcaatgcgtgattgcaatttttcatctgctcgccattggattgttaggaacacaagaacagtaaataggactggacaactgacaggctacaagctggtacctggttccaactgtctgcctttggctggtccggaggccaagtttttgagaagagctagttttctaaagcacaatctctgggttacaccgtatgcgcaggacgagaactttccaggaggagagtttcctaatcaaaatccacgagttggtgatgggttagcttcctgggttaagcaaaacaggtcactagaggaaacaaatatagttctttggtatgtttttggtatcacacatgttcctcggttggaagattggcctgtcatgcctgtagaacgcatcggttttatgcttcagccacatggattcttcaactgctcgcctgctgtagatgtcccgcccaatgcatgcgagttggatgtgaaagacggtgattccaaagatagtgcagataccaaatctatttcaaacgagctgatggccaagctctgatatcttctatgactacgtctgtattttctttctctcgtattctttttgacaatgagttgtatgaaacaagggtaatttcgttgtctgtttcactgtcaattttccttaaacggtgtttgaacaataactttgatgttgcatcattggtatttttcttaaataatttgcgtgttttttggtttgatttaataccggagttagtatactggttgtgtcgcagtcctaaatactagtagtagtaaaagtctagcctttcagcaaataccagttcaaaggtcaagggtctttttatactacgtttatcgtactccctctctcttattctggtccacaaaagtgatatccaccattaccttcccttttcccaaaatcatttctttacattatttagtatctgtgtatagtattatactaatgtcactagtgttctacttttctatagtagtagaataatatcaagaacatttgtctgtgggaagtgggaactccacttttcaatactcgtgattcttttcaaggtattctattactctctctttctatctctatctcatggctgctactgaacaagaagagaagagcatccaagttgagctcacagaccaaatcttactcgctgaacgagttatcaaatcagcccaagaagccgagtcttccaaactcgaatgctctgaactcgctaaacagtccacccaactcgctcacctcctccgatccatagtccgactcaccccctctactcagtccttatatgaac

SEQ ID NO: 5404 - DNA, 2299 bp, Cichorium intybus
agcagctggagcgacccctgaggtcagagatggtatgcggtttgtggaggtggttctatcagaaccagataaaagtgttgttgcacttgcagatgcatatttcttcccacctttccaaccttctttgttacctagaagcaaaggtggtgctgtaattcctagtaagcttcctccaaggcgagccaggcttgttgtctacaataaaaaatcaaatgaaacaagcatatggattgttgaactatctgaagtacacgcaacaactcgaggtggacatcatagaggcaaagtcgtttcatcaaaaacaatccaagatgttcaaccccccatggatgctgttgaatatgctgaatgtgaagctgttgtgaaagagtactttccctttcaagaagctatgaagaagagaggtattgaagatatggatcttgtgatggttgatgcttggtgtgttggttaccatagtgaagcagatgctcctagtagaagattagcaaaaccactgatattttgtaggactgaaagtgacagccctatggaaaacggatacgcaaggccagttgaaggaatttatatcctggttgacatgcaaaacatggtagtcattgactttgaagaccgaaaactcgtcccactaccacctgctgaccctttaagaaattacactcctgcccatacgcgaggtggtgttgaccgaagcgatgtgaagcccctacaaatccttcagccagatggaccaagcttccgtgttaacgggcactttgtggaatggcagaagtggaatttccgaatcgggttcactccaagggagggtttagtgatacattcggttgcgtatgttgatggcagccgaggtcgtagaccaatagctcacagactaagttttgtggagatggtggtcccgtatggtgatccaaacgacccgcattacaggaagaacgcgtttgatgcaggcgaagatggtctcgggaaaaatgcccattctcttaaaaaggggtgtgattgtctaggttatatcaagtactttgatgcacattttacaaacttcacgggaggtgttgaaacaattgaaaattgtgtatgtatgcatgaagaggaccatggaatcctctggaagcatcaggattggagaactgggttagcggaagtacgaagatctcggcgactcacggtgtcgtttatatgcactgttgctaattatgaatatggtttctattggcacttttatcaggatggaaagattgaagctgaagttaaacttacgggaattctgagcttaggagcattgcagccaggggaagttagaaaatatgggacaacaattgcaccagggctgtatgcgccagttcatcaacatttttttgtagcgcgtatggatatggctgttgattgcaagcctggggaagcatacaaccaggttgttgaagttaacgtgaaagttgaagaatctgggaaagataatgtccataataatgcattctacaccgaagaaacattgcttaaaactgaaaatcaagctgcgcgtgattgcaatcagttatctgcccgtcattggattatcagaaatacgaggactgtgaataggaccgggcagctgaccgggtataaactcgtacctggttcaaattgcttgcctttagcaggctccgaggcaaagtttctaagaagggctgaatttctgaagcataatctttgggttacaccgtacgcacttgatgagaattttcccggaggagagtttcctaatcagaatccacgtgttggtgaagggttagcctcctgggtcaagcaaaaccgttccctcgaggaaaccgacatcgtactatggtatgtattcggaatcactcatgtcccccggctagaagattggcctgttatgccagtggagcacattggctttatgcttcagccacatggattctttaattgctcgcctgctgttgacgtcccgcctggagcgtgtgagtcggatgtgaaagacaatgaagctaaagaagttgttgctaccaagtctgtttcaaacgctttaattgccaagctttgatttttttttcttcatcttttacagttattattatgtctagttgattgaaatttgtacgactttaaaaacaatatactttggtgtgtgaatttgactcggtctcaagttcagttcatatgtcacagactcactgtggactcttttcgtcatatcccagacccctcactatttaggtacatgactctttcctttactcctttttccttggaattattaaaataattatatggcccatctataagccactataggaaaaagcat

SEQ ID NO: 5405 - DNA, 2321 bp, Cichorium intybus
agcagctggagcgacccctgaggtcagagatggtatgcggtttgtggaggtggttctatcagaaccagataaaagtgttgttgcacttgcagatgcatatttcttcccacctttccaaccttctttgttacctcgaagcaaaggtggtgctgtaattcctagtaagcttcctccaaggcgagccaggcttgttgtctacaataaaaaatcaaatgaaacaagcatatggattgttgaactatctgaagtacacgcaacaactcgaggtggacatcatagaggcaaagtcgtttcatcaaaaacaatccaagatgttcaacctcccatggatgctgttgaatatgctgaatgtgaagctgttgtgaaagagtactttccctttcaagaagctatgaagaagagaggtattgaagatatggatcttgtgatggttgatgcttggtgtgttggttaccatagtgaagcagatgctcctagtagaagattagcaaaaccactgatattttgtaggactgaaagtgacagccctatggaaaacggatacgcaaggccagttgaaggaatttatatcctggttgacatgcaaaacatggtagtcattgactttgaagaccgaaaactcgtcccactaccacctgctgaccctttaagaaattacactcctgcccatacgcgaggtggtgttgaccgaagcgatgtgaagcccctacaaatccttcagccagatggaccaagcttccgtgttaacgggcactttgtggaatggcagaagtggaatttccgaatcgggttcactccaagggagggtttagtgatacattcggttgcgtatgttgatggcagccgaggtcgtagaccaatagctcacagacttagttttgtggagatggtggtcccgtatggtgatccaaacgacccgcattacaggaagaacgcgtttgatgcaggcgaagatggtctcgggaaaaatgctcattctcttaaaaaggggtgtgattgtctaggttatatcaagtactttgatgcacattttacaaacttcacgggaggtgttgaaacaattgaaaattgtgtatgtatgcatgaagaggaccatggaatcctctggaagcatcaggattggagaactgggttagcggaagtacgaagatctcggcgactcacggtgtcatttatatgcactgttgctaattatgaatacggtttctattggcacttttatcaggatggaaagattgaagcggaagttaaacttacgggaattctgagcttaggagcattgcagccaggggaagttagaaaatatgggacaacaattgcaccagggctgtatgcgccagttcatcaacatttttttgtagcgcgtatggatatggctgttgattgcaagcctggggaagcatacaaccaggttgttgaagttaatgtgaaagttgaagaatctgggaaagataatgtccataataatgcattctacaccgaagaaacattgcttaaaactgaaaatcaagctgcgcgtgattgcaatcagttatctgcccgtcattggattatcagaaatacaagaaccgtgaacaggaccgggcagctgaccgggtataaactcgtacccggttcaaactgcttgcctttagcaggctccgaggctaagtttctaagaagggctgaattcctgaagcataatctctgggttacaccgtacgcacttgatgagaattttcccggaggagagtttcctaatcagaatccacgtgttggtgaagggttagcctcctgggtcaagcaaaaccgttcccttgaggaaaccgacatcgtactatggtatgtattcggaatcactcatgttccccggctagaagactggcctgttatgccagtggagcacattggctttatgcttcagccacatggattctttaactgctcgccagctgtcgacgtccctcccggagcatgtgagtcggatgtgaaagacaatgaagctaaagaagttgttgctaccaagtctgtttcaaacgctttaattgccaagctttgattttttttttttttcatcttttacagttattattatgtctagttgattgaaatttgtacgactttaaaaacaatatactttggttgtgtgaatttgactcggtctcaagttcagttcatatgtcacagactcactgtggactcttttcgtcatatcccagacccctcactatttaggtacattactctttcctttactcctttttccttggaattattaaaataattatatggcccatctataagccactataggaaaaagcatatgcttttactttttatat

SEQ ID NO: 5406 - DNA, 2390 bp, Prunus persica
ctcgcgaaccccttgcaatggcctcagcttcgaaaaaaacgtcgtcttcttgttgcttccgctccgattcggctcccattccacgcgaggctgcgccggctccgaacgccgtcgtttcggcctccgtggttcaagattggaccgccatcgcgggttccgaggatcggcgcgatgatcagcgacccaaaaagatagcgatggcgtccttgattaccgaaccgtccgccaatgcatccaccactggcatcccgatcatgcttaggcctcaaacaaggcatccactggaccctttatctgctgccgaaatctctgtggcagtggcaaccgtcagggctgctggagccacacctgaggttagagatagtatgcgttttgttgaagttgttctactggaaccagataaacacgttgtaggtttagcggatgcgtacttcttcccccctttccaaccatcattgcttcccagaaccaaaggtggacctataatcccgactaagcttcccccaaggcgagctaggcttgttgtgtacaacaaaaagtctaatgagacaagcacatgggttgttgagctgtcagaagtgcatgcagccactcgaggtggacatcacagaggaaaagtaatatcctcacaagttgttccagatgttcagcctcccatggatgctgtggagtatgctgaatgtgaagctgttgtgaaagactttcctccatttagagaggctatgaagaagaggggtattgaagatatggaccttgtgatggttgatgcctggtgcgttggttaccatagtgatgctgatgctcccagtcaaaggcttgctaaaccacttatattctgtagaactgagagtgactgcccaatggaaaatggttatgcacgcccagttgagggcatctatgtacttgttgatatgcaaaacatggtggtggtagagtttgaagaccgtaagcttgttcctctacctccagctgatccattgaggaactatactcctggtgaaacaagaggtggtgttgatagaagtgatgtgaaacctttacaaattcttcagcctgaaggtccaagctttcgtgttaatgggtactttgtggagtggcagaagtggaattttcgtatcggattcactcctagggagggactggttatatattcagtggcatatgttgatggcagtagaggacgaaggcctgtagcccataggttgagttttgtggaaatggtggtgccatatggcgatccaaatgacccgcattacagaaaaaatgcttttgatgctggggaagatggcctgggtaaaaacgcacattctctcaagaaggggtgcgattgtttggggtatatcaaatactttgatgcacattttacaaatttcaccggaggtattgaaactattgaaaattgtgtatgcttgcacgaagaagatcatggaattctgtggaagcatcaggactggagaacaggcttagcagaagtgcgcaggtcaaggcgactaacagtgtcatttatatgtactgtggctaattatgagtatggattcttctggcacttttatcaggcaagatgggaagattgaagctgaagttaaacttacaggaatactcagtttaggagcactgcaacctggagaagttcgaaaatatggtactgttattgcaccagggttatatgcaccagttcatcaacatttttttgttgctcgtatggatatggctgttgattgcaaacctggggaaacttacaatcaggttgtggagctggacgtaaaggttgagaaacctggggataataatgtccacagcaatgcattttatgctgaagagacacttctcaggactgaattgcaagcaatgcgtgactgtaatcctttgactgctcgccattggattgtaaggaacacgcgaactgttaacaggactggacagttaacaggctacaagctcgtacctggttcaaactgtttgccattagccggttctgaggccaagtttttgcgaagagcagcattcttgaaacataacctttgggttacaccatatgcccaagatgagatgtttcctggaggagagtttccaaaccaaaatccacgtgtcggtgaaggattggccacatgggttaagaagaaccgatctctggaagaaactgatattgttctttggtatgtttttggaataacacacgtgccacgattggaagactggcctgtcatgccggtggagcgaattgggtttatgctcatgcctcatggattcttcaactgctctccagcggtggatgttccacctagtgcatgtgaattggaggccaaagacaatgatgtaaaagacaatggggtagccaagccaattccgaatggcttgctagcagcaaagctttgaagccaaaaaagaaa

SEQ ID NO: 5407 - DNA, 3218 bp, Fragaria vesca
gcgctcgcgaaccccttgcaatggcctcagcttcgcaaaaagcgacgccttcttcttcatgttgcggcggcggcgacgcttcttccgttgctcctcgcgaggccgcggcgcctccatcgaacgccgtcgtttcggccgccgtggcgaaggattggaccggctcggtgaccgaggatcgccgcgacgatcagcgcgtgcctcccaagaagatcgccatggcgtccttggtttccgaaccttccgccaagaatgcctccgccgcaggcatcccgatcatggttaggcctcagtcaaggcaccccttggaacctttatctcctgccgaaatatctgtggcagtggcgactgtcagggcagctggagcaacacctgaggttagagatagtatgcgttttgttgaagtggttctactagaaccagataagcatgttgttgcattagcagatgcttacttcttccctcctttccaacccacattacttccaagaaccaaaggtggacctataatacccagtaagcttcctccgaggcgagctagacttattgtttacaacaagacgtcaaatgagataagcacatggattgttgagctgtcagaagtgcatgcagctactcgtggtggacatcacagaggaaaagtaatatcatctcaagttatccctgatgttcagcctccaatggatgcagtggaatatgctgaatgtgaagctgttgtgaaagactttcctccatttggagaggctatgaagaagaggggcattgaagatatggacctagtgatggttgatgcctggtgtgttggttatcatagtgaggctgatgctcctagcaaaaggcttgctaaaccattgatattctgtagaactgagagtgactgcccaatggaaaatggttacgcgcgccctgttgagggaatccatatacttgttgatatgcagagcatggtggtgttagagtttgaagaccgtaagcttgtacccttacctccagccgatccattgaggaactatacttctggtgaaacaagaggtggtgttgatcgaagtgatgtgaagccattgaaaattgttcaggctgaaggtccaagctttcgtgtggatggatactttgtggagtggcagaagtggaatttccgtgttggattcactcccagggaggggctagtaatatattcaattgcatatgatgatggtagtagggggcgaaggcctgtagcccataggttgagttttgtggaaatggtggtgccatatggagatcccaatgatccacattacagaaaaaatgcttttgacgctggggaagatggccttggtaaaaacgcgcattctctaaagaaggggtgtgactgtttgggctatatcaaatactttgatgcccattttacaaactttactggaggtgttgaaacaattgagaattgtgtatgtttgcacgaagaggaccatggaatgttgtggaagcaccaggactggagaacaggcttagcagaagtgcgcaggtcgagaaggctgacagtgtcttttatatgtactgttgctaattatgaatacggattcttctggcacttttatcaggcaagatggaaagattgaagctgaagttaaactcactggaatactcagcttaggagcactacagcctggagaagttcgaaaatatggtactgttattgcaccagggttatatgcaccagttcatcagcacttttttgttgctcgtatggatatggctgttgattgcaaacctggggaagcatacaatcaggtagtggagctagatgttaaagttgaaaaacctggagagaataatgtccacagcaatgcattttatgctgaagagagacttcttagaactgaattggaggcaatgcgagactgtaatcccttatctgcccggcattggattgtaagaaatacacgaactgttaacaggaccggacagttaacaggctacaagcttgtacctggttcaaattgcctgccattagctggtcctgaggccaagtttttgagaagagctgccttcttgaaacataatctttgggttacaccatattcacgtgatgagatgtatcctggaggagaatttcccaaccaaaacccacgggtgggtgaaggattggctacatgggttaagaagaatcgatctcttgaagaaactgatattgtcctttggtatgtatttgggataactcacattcctcggttagaagactggcctgtcatgccagtggagcaccttggctttgttctcatgcctcatggattcttcaactgctgtcctgcagtggatgttcctcctagtgcctgtgaatcggaagtcaaagaagatgatgtcaaagacaatggggtagccaaaccaattcagaatgggttgatggcaaagctttgaagagatgctctgttggtcttttaaatttcaatcaaagaaggagaagttcttgggacgaatccgctacttgtcttttcaacatcaagcttctaagaacgcagattcttgttgatgatgctcaagcttataaaaatggaactgttgtcctttttgttccaaaaaccaagagtgtacttttcttgtattagaagagaatatattgaaggaaatgtttaaagaacaatgctgctatgttcttgcacggtttgctctcttttttaagctactatcttcctcccacttgggatttaggaagatcatgtacaaggatgagaaagcaaaagtttttcctgtgtttaattaccttctagatgcgcgcttaaacaagaagtcagtgatgctggaagtgttatgaagatactcggatgcatttgagaagttcttgcctttgcttccacactttcgatccagctcatgtacaagtcgttgaagttgatttgggaactagagaatatgttgatgatatctctcttgcgagaagtagaaggtttttggcgagttgctttgctcatgtgttgtttagatcctttcactctagaatatcgaagagcgttgtttagatcctttccgatacttgatgatctaggccggtcttgacagattctgggatgtcaagccattacttgattgaaaggatgataaacttttgcagcttaaatcttgtcagtaaatggcaaaggaatgttcttgcatggcagctagctcatcttttggggactgcagaagaatgcatagtggaaactccttcaacttacagttagaaattttagtattgagtattgaga

SEQ ID NO: 5408 - DNA, 3435 bp, Ricinus communis
atcaaattcctgccttcgcctcgacaaagaaagcaaactacagacagaacagaaacaaaatccaccaccaacccaaacccactttctttatttctttctcccattattactgccaagttgcaagcaaaacccacttctcctctgcgtataaaatcccagcaaaacagcagtgttttctttatcaccagagagaaacttcaacattgtcccagtatagtgaaaggaagagaggaagtgcaagaaaggttaaggtgaagagatcaaaagttttaaaagattttagaatagagttaatttgctgtatgtcagtgaaatactacagtgataattactgcggtggacacggtgaagttgctaaccctttacaatggccacagctcaggaaaaggcgacgctttcttcttcttcttcttcttcttcttcctgttgcactgacaacaactcttccaacaaggccacttcttctgctgctgctgctgcaactcaagttttgcaagattggagtgttgctccagtttctaacctggctcaggatccgatccgagacagatcatcaactactaccatgtcttcattgattcaacctgttgattcacttactgatcctactcctccaccgaatcctgtttctgctaaagggatcccgacgatgacaagggcacaaaccagccaccctttggaccctttaactgccgctgaaatctcagttgcagtggcgactgttagagcagctggagcaactcctgaggtgagagatagcatgcgctttgttgaagtagttctgctggagccagaaaagaatgttgttgcattagcagatgcttatttcttccctcccttccagccttcattaattcccagaactaaaggtggacctctaattcccactaaacttccacccagaaaagcaagacttattgtttacaacaaaaagtccaatgagacaagcatatggattgtcgaactatcagaagtacatgccgcaactcgaggtggccaccacaggggcaaagtcatttcatccaaagttgttccagatgttcagcctccaatggatgctgtggaatatgctgaatgtgaagctgtggtgaaagacttccctccatttctagaggcaatgaaaaagaggggtattgaggatatggatcttgtgatggtagacccctggtgttctgggtaccacagtgatgctgatgctcctagccgcaggcttgcaaagccacttatcttctgcaggactgaaagtgactgtcccatggaaaatggttatgctcgtcctgttgaagggatccatgtccttgttgatatgcaaaatatggtggtaatcgagtttgaagaccgtaaacttgtcccccttccgccagcggatcctttaagaaattatactgctggtgaatcacgaggaggtgttgatagaagtgatgtgaaaccgctacagatcattcagcctgaaggtccaagctttcgtgttaatggacattttgttcagtggcagaagtggaactttcgtattgggtttacacccagggagggtttagttatatattctgttgcatatgttgatggcagtcgaggtcggagacctgttgcccacaggttaagttttgttgagatggtggttccctatggagatcccaatgacccacattataggaaaaatgcatttgatgcaggggaagatggattgggcaaaaatgcacattctcttaagaagggttgcgattgtctgggcttcatcaagtactttgatgcacatttcacaaatttctctggaggtgttgaaacaatcgaaaattgtgtttgtttgcacgaagaggaccatgggatcctatggaagcatcaggactggagaactggattagcagaagtccgacgctctagaaggttatcagtgtcgtttgtgtgcactgtagctaattatgaatatggatttttctggcatttttatcaggatggaaaaattgaagctgaggttaaactcactggaattcttagcttaggagctttgcaacctggggaagtacgaaaatacggtacgacaatcgctcctggattatatgcacctgtccatcaacacttttttgtggcacggatggatatggcggttgactgtaaacctggtgaaacattcaatcaggtcgttgaggtgaatgttaaagttgaagaaccaggaaaggataatgttcacaataatgcattctatgctgaagataagctgctccgatctgagttgcaagcaatgcgcgactgtaatccattaactgctcgtcattggattatcagaaacacaagaaccgtcaaccggacagggcagcttacaggttacaagttagtacctggttcaaattgtttacctttagctggttcagaggcaaaattcttgagaagagctgctttcttgaaacataatctttgggtaacaccttatgcgcctgatgagatgtatcctggaggagaatttcccaatcaaaacccacgtgttggagagggtttggctacttgggtgaagcaaaatcgatcgcttgaggaaacaaacatagttctatggtatgtctttggggtgacacatattcctcgactggaagactggcctgtcatgccagtggaacgcatcggttttatactaatgccccatggattctttaactgctcaccagctgtggatgttcctccaagtgcatgtgacatggatatcaaggacaacgggataacagcaaagcctcctatccagaatggattacttgctaagctctgaacggatggggccggcatcgcagcaggcacttgataatctcttccttgaataattaaggctattggcattagcctaatcaagctgctgcaacttttttttttatcttcaaactatatatgatgatgatgaatgaaaggtgttgtgtgttataacatcagctgtcaatgtacttgtgttgtttactggaaatatgtcctggagcagtgccataccagggacagggattttgcattctgctgctgcaggccgaaccaatgatgatcaagttctgttgtagaactagaagatcctgaatgattcggatccagcttgatcatgattttaataatcaggatgtaatcacacatatatattggaggatttcttattccataagcatctacatactatgcacccacttatctttttttctttttaaaaatccaactgctttatttaaaaactgtgaggatctggatttttttcacttgaaatgaagccagttgatatttctacatacccggatatacattgttgttggatctcggatgaataaatctgcttggaaaatgagggatttagattatagaagggaagagagtggattatttgtgggcaacttttgtatatgtgtgatcaggatccaatattggcgtgtgtccgcacattgtttataaaataaaataattatttttataaga

SEQ ID NO: 5409 - DNA, 1989 bp, Cichorium intybus
aaccagataaagtgttgttgcacttgcagatgcatatttcttcccacctttccaaccttctttgttacctagaagcaaaggtggtgctgtaattcctagtaagcttcctccaaggcgagccaggcttgttgtctacaataaaaaatcaaatgaaacaagcatatggattgttgaactatctgaagtacacgcaacaactcgaggtggacatcatagaggcaaagtcgtttcatcaaaaacaatccaagatgttcaacctcccatggatgctgttgaatatgctgaatgcgaagctgttgtgaaagagtactttccctttcaagaagctatgaagaagagaggtattgaagatatggatcttgtgatggttgatgcttggtgtgttggttaccatagtgaagcagatgctcctagtagaagattagcaaaaccactgatattttgcaggactgaaagtgacagccctatggaaaacggatacgcaaggccagttgaaggaatttatatcctggttgacatgcaaaacatggtagtcattgactttgaagaccgaaaactcgtcccactaccacctgctgaccctttaagaaattacactcctgcccatacgcgaggtggtgttgaccgaagcgatgtaaagcccctacaaatccttcagccagatggaccaagcttccgtgttaacgggcactttgtggaatggcagaagtggaatttccgaatcgggttcactccaagggagggtttagtgatacattcgattgcgtatgttgatggcagccgaggtcgtagaccaatagctcacagacttagttttgtggagatggtggtcccgtatggtgatccaaacgacccgcattacaggaagaacgcatttgatgcaggtgaagatggtctcgggaaaaatgcccattctcttaaaaaggggtgtgattgtctaggttatatcaagtactttgatgcacattttacaaacttcacgggaggtgttgaaacaattgaaaattgtgtatgtatgcatgaagaggaccatggaatcctctggaagcatcaggattggagaactgggttagcggaagtacgaagatctcggcgactcacggtgtcatttatatgcactgttgctaattatgaatatggtttctattggcacttttatcaggatggaaagattgaagcggaagttaaacttacgggaattctgagcttaggagcattgcagccaggggaagttagaaaatatgggacaacaattgcaccagggctgtatgcgccagttcatcaacatttttttgtagcgcgtatggatatggctgttgattgcaagcctggggaagcatacaaccaggttgttgaagttaatgtgaaagttgaagaatctgggaaagataatgtccataataatgcattctacaccgaagaaacattgcttaaaactgaaaatcaagctgcgcgtgattgcaatcagttatctgcccgtcattggattatcagaaatacaagaaccgtgaacaggaccgggcagctgaccgggtataaactcgtacccggttcaaactgcttgcctttagcaggctccgaggctaagtttctaagaagggctgaattcctgaagcataatctctgggttacaccgtacgcacttgatgagaattttcccggaggagagtttcctaatcagaatccacgtgttggtgaagggttagcctcctgggtcaagcaaaaccgttcccttgaggaaaccgacatcgtactatggtatgtattcggaatcactcatgtcccccggctagaagactggcctgttatgccagtggagcacattggctttatgcttcagccacatggattctttaactgctcgccagctgtcgacgtccctcccggagcatgtgagtcggatgtgaaagacaatgaagctaaagaagttgttgctaccaagtctgtttcaaacgctttaattgccaagctttgatttttttttttttt

SEQ ID NO: 5410 - DNA, 3154 bp, Cannabis sativa
aataggaatttgagtagaattagaattgagtaatgcacgtgtaggctcccctataaaacccgtctcttcgttgttcatctccccctgtcttcaaccagtgaatcaaatctctcttttctcctttttcgtctttcactcacgtttttctctctcttttctcttctttctctctctcagagtttcagaacagaaaaaagaaaatcattcacatttcaatcgaaatctagccctagctcggtgatcgtccaacatagtaacaaacttttcatcttgattttactgcagagagttttttttttttttttttttgagattttctctctggttttcgcttcttctcgaagttttttttttcctttcgcttgcggaaccacgcagcgttagaaggtgagagagatttgtgctgtatgtcagtggattgtattgagacttatttcggtggaattggtgagctagcgaacccattacaatggccccagcttcgaaaaagacgacgggtggttcctcttcctgttgcttcacatcctccgattctgcttccattcaccgtgactccaccgcctcctccgttgtcgctgtctccgctgctccagccagtgacggcgccgttgtttccgccaatgccgtccaggattggactatctcctccactgacttgcgcgatgatcagcgcgccaagaagatggccatgtcatcgttgatatcggaatcatccactactctttcaacaaaagggatcccaattatgctaagagctcagtcgagccatcctctggatcctctttccgcagctgagatctcagtggcagttgccacagtcagggcagcaggagctacccctgagctcagagacagtatgcgctttgttgaggttgttctgcttgagccagataaacatgtcgttgctttagcagatgcatatttcttcccacctttccagccgtcattgcttccaagaacaaaaggtggacctgtgatccccagtaagctccctgcaaggcgagctagacttgttgtttacaacaagaagtcgaatgagacaagcacatggattgtcgagctctcagaagtacacgcagcgactcgtggtgggcaccataggggaaaagtgatttcctcacaagtagttcccgatgtgcagcctcccatggatgctgtggaatatgctgaatgtgaagctgttgtgaaagactttcctccttttagagaggctatgaagaagagaggtattgaagacatggatatcgtgatggttgatgcatggtgtgtgggctatcatagcgatgccgacgctcctagtcgtaggcttgctaagccactgatattctgtagaactgaaagcgactgcccaatggaaaatggttatgcaagacccgtagagggaatccatgtagttgttgacatgcaaaacatggtggtgattgagtttgaagaccgcaaactagttcccttacctcctgctgatcctctgaggaactatactcccggtgaatcaagaggtggtgttgatcgaagtgatgtgaagcctttacaaattattcagcctgaaggtccaagctttcgcgtcaatgggtactttgttgaatggcagaagtggaacttcaggattggatttacacccagggagggtttaatcatatattctgtggcctatgtcgatggtagtcgagggagaaggcctgtagctcatagattgagttttgtggaaatggttgtgccttatggagatccaaatgacccacattacagaaaaaatgcttttgatgcaggagaggatggccttggtaaaaatgcacattctcttaagaagggatgtgattgtttgggctatatcaagtactttgatgctcacttcacaaatttcactggaggtgttgaaactttagagaactgtgtatgtttgcatgaggaagatcatggaattttgtggaaacatcaagattggagaactggtttagctgaagttcgaaggtctaggcgtttgacagtgtctttcgtatgtactgtggctaattatgagtatggattcttctggcatttctatcaggatgggaaaattgaagcagaagttaaacttactggcatacttagtttaggagcattgcaacctggagaatttcgaaagtatggtacaatgattgcaccgggattgtatgcgccagttcatcaacacttttttgttgctcggatggatatggctgttgactgcaaacctggtgaaactaacaatcaggttgttgaggtggatgttaaagttgaagaacctggagagaacaatgttcacaacaatgcattctatgctgaggaaagacttcttaaatctgaatcagaggcaatgcgtgactgtaaccctttggcagctcgtcattggattgtaaggaacacaagaactgttaataggactggacatttcacaggctataagctagtgcctggttcgaactgcttgccattggctggtcctgaggccaagtttttgagaagagctgcttttttgaagcataatctttgggttacttcatatgcacgtgatgagatgtatcctgggggagagtttcctaatcaaaatccccgtgctggagaaggactggccacttgggttaagaaaaatcgatcgctggaggaaacaaatattgttctttggtatgtgtttggaatcacacatgttcctcggcttgaagactggcctgtcatgccggtggagcatattggctttatgcttatgcctcacggtttcttcaactgctctccggctgttgatgtcccacccaatgcgtccgatatggataccaaagaaccagacgtcaaagatgccggagttgtgaagccactattagcaaaactctgaagaaatgtctatcactttagtctccattactagcaataacatagctagtattccccttgtttgcttagtttagtagtgttttttttttcagttgtgtttgactatggaacttaaggggcacaccagatgtggtggtctcttttagactttgtttttatgtttcatttgctattttatttttatccagtctttgacgaataaatcgaaatggattttgctttgaactttaaatcattatatctatctttttctgtttcatttacctttcctttattttggaacttattggaaaaattataaggcgta

SEQ ID NO: 5411 - DNA, 3656 bp, Ricinus communis
cagaggcaatggtttcagatttccagtcgctgtcaagagcaaggagaaaagaaaaagataggtcatgtattattgttattattaaatcatccattaatctcttacaactttacaagtggctgctcttatcactttgtaactccatttctcttttgtcttcttcttcgctcttcccaatcccaatcaaattcctgccttcgcctcgacaaagaaagcaaactacagacagaacagaaacaaaatccaccaccaacccaaacccactttctttatttctttctcccattattactgccaagttgcaagcaaaacccacttctcctctgcgtataaaatcccagcaaaacagcagtgttttctttatcaccagagagaaacttcaacattgtcccagtatagtgaaaggaagagaggaagtgcaagaaaggttaagctcaggaaaaggcgacgctttcttcttcttcttcttcttcttcctgttgcactgacaacaactcttccaacaaggccacttcttctgctgctgctgctgcaactcaagttttgcaagattggagtgttgctccagtttctaacctggctcaggatccgatccgagacagatcatcaactactaccatgtcttcattgattcaacctgttgattcacttactgatcctactcctccaccgaatcctgtttctgctaaagggatcccgacgatgacaagggcacaaaccagccaccctttggaccctttaactgctgctgaaatctcagttgcagtggcgactgttagagcagctggagcaactcctgaggtgagagatagcatgcgctttgttgaagtagttctgctggagccagaaaagaatgttgttgcattagcagatgcttatttcttccctcccttccagccttcattaattcccagaactaaaggtggacctctaattcccactaaacttccacccagaaaagcaagacttattgtttacaacaaaaagtccaatgagacaagcatatggattgtcgaactatcagaagtacatgccgcaactcgaggtggccaccacaggggcaaagtcatttcatccaaagttgttccagatgttcagcctccaatggatgctgtggaatatgctgaatgtgaagctgtggtgaaagacttccctccatttctagaggcaatgaaaaagaggggtattgaggatatggatcttgtgatggtagacccctggtgttctgggtaccacagtgatgctgatgctcctagccgcaggcttgcaaagccacttatcttctgcaggactgaaagtgactgtcccatggaaaatggttatgctcgtcctgttgaagggatccatgtccttgttgatatgcaaaatatggtggtaatcgagtttgaagaccgtaaacttgtcccccttccgccagcggatcctttaagaaattatactgctggtgaatcacgaggaggtgttgatagaagtgatgtgaaaccgctacagatcattcagcctgaaggtccaagctttcgtgttaatggacattttgttcagtggcagaagtggaactttcgtattgggtttacacccagggagggtttagttatatattctgttgcatatgttgatggcagtcgaggtcggagacctgttgcccacaggttaagttttgttgagatggtggttccctatggagatcccaatgacccacattataggaaaaatgcatttgatgcaggggaagatggattgggcaaaaatgcacattctcttaagaagggttgcgattgtctgggcttcatcaagtactttgatgcacatttcacaaatttctctggaggtgttgaaacaatcgaaaattgtgtttgtttgcatgaagaggaccatgggatcctatggaagcatcaggactggagaactggattagcagaagtccgacgctctagaaggttatcagtgtcgtttgtgtgcactgtagctaattatgaatatggatttttctggcatttttatcaggatggaaaaattgaagctgaggttaaactcactggaattcttagcttaggagctttgcaacctggggaagtacgaaaatacggtacgacaatcgctcctggattatatgcacctgtccatcaacacttttttgtggcacggatggatatggcggttgactgtaaacctggtgaaacattcaatcaggtcgttgaggtgaatgttaaagttgaagaaccaggaaaggataatgttcacaataatgcattctatgctgaagataagctgctccgatctgagttgcaagcaatgcgcgactgtaatccattaactgctcgtcattggattatcagaaacacaagaaccgtcaaccggacagggcagcttacaggttacaagttagtacctggttcaaattgtttacctttagctggttcagaggcaaaattcttgagaagagctgctttcttgaaacataatctttgggtaacaccttatgcgcctgatgagatgtatcctggaggagaatttcccaatcaaaacccacgtgttggagagggtttggctacttgggtgaagcaaaatcgatcgcttgaggaaacaaacatagttctatggtatgtctttggggtgacacatattcctcgactggaagactggcctgtcatgccagtggaacgcatcggttttatactaatgccccatggattctttaactgctcaccagctgtggatgttcctccaagtgcatgtgacatggatatcaaggacaacgggataacagcaaagcctcctatccagaatggattacttgctaagctctgaacggatggggccggcatcgcagcaggcacttgataatctcttccttgaataattaaggctattggcattagcctaatcaagctgctgcaacttttttttttatcttcaaactatatatgatgatgatgaatgaaaggtgttgtgtgttataacatcagctgtcaatgtacttgtgttgtttactggaaatatgtcctggagcagtgccataccagggacagggattttgcattctgctgctgcaggccgaaccaatgatgatcaagttctgttgtagaactagaagatcctgaatgattcggatccagcttgatcatgattttaataatcaggatgtaatcacacatatatattggaggatttcttattccataagcatctacatactatgcacccacttatctttttttctttttaaaaatccaactgctttatttaaaaactgtgaggatctggatttttttcacttgaaatgaagccagttgatatttctacatatacccggatatacattgttgttggatctcggatgaataaatctgcttggaaaatgagggatttagattatagaagggaagagagtggattatttgtgggcaacttttgtatatgtgtgatcaggatccaatattggcgtgtgtccgcacattgtttataaaataaaataattatttttataagaaatccaaaaaataatttaattactttggactgtcatagaatgttgtaataattattcccctgtgtgaaactatataaaaaaaaagaagagaaaaatgtaatgtttttttagtttagcaggggattaagtggagcagagcaggatgtccatttgtcggatactcgag

SEQ ID NO: 5412 - DNA, 2622 bp, Chelidonium majus
agtggattgcagtgagagttattacggtggaatcggtgaaattgcaaatcctttacaatggcctcaattacgcaaaaagcgacgtcatcatcatcatcatcttgctgctccaccacaactggaactaataaatctactactacttccctgcgacgccaggcaacatcatctgctccaccaccggaggttgaacaggagtggtccgtctccaccaccaccaccactgatcaacaacagccgaagaagatagctgctgtttctactactatggagaccttaattcgtcctgttgaatcacttcctgaaacttctaccaaagggatccagattatgatgagggctcaaagtagccatccgttggaccctttatcaggtgctgaaatttcagtggcagtggcgactgtcagggcagctggagcgactcctgaggtgagagatagcatgcggtttgttgaagtagttttgctggagccagataaacaagttattgctttggcagatgcatatttctttcctccattccagccatctttacttcccaaactaaaggtggagcatttattcctagtaagcttcccccaaggagggctagacttgttgtgtacaacaaaagatccaatgagacaagcctatggattgttgagctaactgaagttcatgcggcaactcgaggtggccatcataggggaagagtcatctcatcagaagttgttccagatgttcaaccccccatggatgcagaggaatatgctgaatgtgaggctgttgttaaggactatccaccattccgagaggcaatgaaaaagaggggtattgaggatatggatcttgtgatggtagatgcatggtgcgttggttaccatagtgatgttgatgcacctagccgcagacttgctaagccacttattttctgtagaactgagagcgattgcccaatggagaatggctatgcacgcccagttgaaggcatttatctagttgttgatatgcagaacatggtgatacttgagttcgaagaccgtaaacttgttcctctgcctcctgctgatcccttaagaaactatactcctggtgaaactcgaggaggcgttgaccgaagtgatgtgaaaccgctgcagattattcagcctgaaggtccaagtttttcgcgttaacgggcaatttgtagaatggcaaaagtggaatttccggattggtttcacaccgagggagggtctggttatctattctgttgcatacattgatggaagccgtggtcggagatctgtagcccacaggttgagtttcgttgagatggtggtgccgtatggagatcctaatgagccacattaccggaagaatgcatttgatgccggggaagatggccttggtaaaaatgcgcattctcttaaaaagggatgtgattgtctaggatatatcaaatacttcgatgcccattttacaaattttactggaggtgttgagacaattgaaaattgtgtatgtttgcacgaagaggatcatggtatcttatggaagcatcaagattggagaacaggcttagcagaggttcggcggtctagacgcctaacagtgtcctttatatgtactgtggctaattatgagtatggattcttctggcacttctatcaggatggaaaaattgaagctgaggttaaacttactggaattctcagcttaggagcactgcagcctggggaatctagaaaatatggtacgactattgcaccgggattatatgctccagtgcatcaacacttctttgtcgctcgaatggacatggctgtcgactgtagacctggtgaaaagtttaaccaggtcgttgaagtgaatgtcaaagttgaagaaccggggccgaataatattcacaacaatgcattctatgcagaagaggaacttctcagaacagagatgcaagcaatgcgtgattgtagtcccctatctgcccgtcattggattgtgcagaacacaagatctgtcaatcggactggacagctgacaggctacaagcttgtacctggttcgaattgtttgccattagctggtgcagacgcaaaatttttgagaagagctacttttttaaagcacaatctttgggttacaccatatgcacgtggcgagatgtatccaggaggagagttccctaatcagaacccacgtgttggtgagggactggggacatgggttaagcagaatcggccgcttgaagaaagtgatatagttctatggtatgtatttggaattacgcacattccccggctggaagactggcctgtcatgccggtggagcacattggctttatgcttatgccgcatggattcttcaatcgctccccggcagtggatgtcccaccaagtacttgtgagctggatctcaaagaaaatggattgccaaagcctattcagaatgctgtgcttgcaaagctgtaagtgggctatgaaaggcgatctggtctaaacacaaactcatctctctgataagcaattcatcatctcggctaaaaaaaaagaagcaattcatcttctcgtcttcaataaaacaattcacaattcatcatgttcagttttcgttaatttgctggtaggcaatggattgaatgcatgaacttaataattgcagaa

SEQ ID NO: 5413 - DNA, 2853 bp, Citrus clementina
ccacttctcttttttataaaaggccacccctcggatctcgattcttcttcagtttctttcactctcttttcttttagaaagaaagtgattttgagtttgctgttccgtggcctgtggctgtggctgtggctgtggctgtgtgtgagtgaaaggggatagtgttaagaggaggacgcagcgataatttgctctgtatgtcagtggaatactactgtgataaattctgcggtggatacggtgcgcttgctaagcctttacaatggccacaactcaggaaaagacgacgcctacttgttgcattaacaactcctccaagccttccgccactgaacccgtcaaagattggaaggtttccgggtcggatccttccttggatcctgtccgtaagcgtgactccgttaccactctcatccgtcccgttgaatccctccctgatcctcctcctcctcctaacaccatttcctcaaccaaaggaattccaatgatggtcagggcccaaacaagccatcctttagaccctttatctgctgctgagatctccgtggcagtagccactgttcgggctgccggagcaacccctgaggtgagagacagcatgcggtttgtggaagtggttcgagtggagccagataaacaagtggttgcattagcggatgcttatttcttccctccttttcagccgtcattaattcccaggacaaaaggtgggccaataatccctactaaacttcctcctagacgagcaagacttgttgtttacaacaaaaggtcgaatgagacaagcatatgggttgttgaactgtcggaggttcatgctgcaactcgaggtggtcaccatagaggaaaagttatttcatcgaaagttgttccagatgtccagcctcccatggatgctgtggaatatgctgaatgtgaagctgttgtcaaagactttcctccatttcgggaggcaatgaaaaagaggggtattgaggacatggaccttgttatggtggatccatggtgtgtagggtatcacagtgatgcagatgctccaagtcgcagacttgctaaaccgctcatcttctgcagaactgagagtgactgcccaatagaaaacggttatgctcgtccggtggaaggaatccatgtgcttgttgatatgcagaatatggtggtgatcgagtttgaagaccgaaagcttgttcacctaccaccagctgatccgttaagaaactacacagctggtgaaacaagaggaggtgttgaccgaagcgatataaaaccgcttcagattgttcagcctgagggtccaagcttccgtgttaatggacattttgttgaatggcagaagtggaatttccgtattggttttactcctagggaaggtttgatcatctattctgttgcgtatgttgatggtagtcgaggtcggaggcctgtagcccacaggttaagctttgttgagatggtggtcccttatggggatccaaatgatccccattacaggaaaaatgcatttgatgcaggggaagatgggctgggtaaaaatgcacattctcttaagaagggttgcgattgtctcgggctacatcaagtattctgatgcacatttcaccaattttgctggagggtgttgatacaattgagaattgtgtttgtttgcatgaagaggaccacggtatcttatggaagcatcaggattggagaacaggattggcagaagttcgaaggtctagaaggctatcagtgtcatttatatgtactgtggccaactatgaatatgcatttttctggcacttttaccaggatgggaagattgaagctgaggttaagctcacaggaattctcagcttaggtgcactgcaacctggagaagtgagaaaatatgggactattattgcacctgggttatacgcacctgttcatcaacacttttttgttgctcgtatggacatggcggttgattgcaagcctggtgaagcacataatcaggtagttgagatgaatgttaaagtggaagaaccagggaagaataatgttcacaataatgcattctatgctgaagaggaactgctcaaatcagaattgcaagcaatgcgtggttgtaatcctttaaccgctcgtcattggattatcagaaacaccagaaccgttaaccgtactggacagctaactggttataagttagtacctggttcaaactgtttgccattagccggttctgaggcaaaatttttaagacgagctgctttcttgaagcataatctttgggtcactccttatgcacatgatgaaatgtatcctggaggagagtttcctaatcaaaatcctcgagttggcgaaggattggctacttgggttaagcaaaatcgctctctggaagaaactgacatagttctgtggtatgtatttggagtgactcacattcctagactggaagactggcctgtgatgcctgtggatcgcattggctttatgctcatgccacatgggttcttcaattgctcaccagcagtggatgtccctccaaatgaaagcgatttggatctcaaggacactgtgatcgccgaaaagcccgtccagaatgggctgcttgccaagctctgaatgtatatccgtggttggttgagttcgtggctgcttgctttcttcttttagtgggttgtttgtttaaaaatttaggtctttggacaacttcaggcaaataataatttttaatccagtaactaaagtactatttgaatggacgtcgtgtggtggtgttagttgtttgttaacaagtatttatttcctttagaaaaaaaaaaattattattattattatgaattggtaaaatttgtttttaagaactcattattattattattatt

SEQ ID NO: 5414 - DNA, 3271 bp, Manihot esculenta
gaagggagaaaaagggcggtttggcatctctgacacggggatactaatttccatttctcgcttgtatcttctttccttcgcctaaaaaaaagcaagaaaatttcatcccaccaaatccactttctctcctacatttttccacttgagaaacccacttccggcactcttcagctataaaatcccaatcaaacccatcattatttcactgcatacacttgagaaagcttctttcctgggaaagttagtgggagagaaagtgctggaaaggttagatcaagagaaaacaaaaaaacgaaattctgtatactagagttaagaaaatagaatagaaattagaattttgctgtatgtcagtgaaatactacagtgacaattactacggtggatacggtgaacttgctaaccctttacaatggccacagctcaggaaaaggcgacgacttcttgttgcacttccaccaaatcttcctctgctgccgccgctgcagcaactgaggttttgcatgattggagcgttgccactgtatctaatccgccacaggatccgattaacaagagagccaccatgtcgtccctgatccgccctgttgagtccctaaatgatccttctccacctaacaccaactctgctaagggaataacaatgatggcaagggcacaaaccagccaccctttggaccctttaacagctgctgaaatttctgttgcagtagctactgtcagggcagctggagcaactcctgaggtgagagatagcatgcgctttgttgaagtcgttttactggagccagacaagcaggttgttgcattggcagatgcgtatttcttccctcctttccagccttcattacttcctagaactaaaggtggacctgtaattccaaccaaacttcctcccagaaaagcaagacttattgtttacaataaaaagtcaaatgaaacaagcatatgggttgttgagctatcagaagtacatgctgcaactcgaggtggccatcacagaggcaaagtcatttcatccaaagttgttccaaatgttcagcctcctatggatgccgtggaatatgctgaatgtgaagctttggtgaaagccttccctccatttcaggaggcaatgaaaaagaggggtattgaggatatggatcttgtgatggtggacccctggtgtgctggatatcacagtgaagctgatgctcctagccgcaggctcgctaaacctctcatcttctgcagaaccgagagtgactgtcctattgaaaatggttatgctcgtccagttgaaggaatccacgttcttgttgatatgcaaaacatggtggtgattgaatttgatgatcggaaacttgttcccctaccaccagctgatcccttaagaaattacactgccggtgaatctcgaggaggcgttgatagaagtgatgtgaaacctctacagatcattcagcctgaaggtccaagcttccgtgttaacggacactttgttcagtggcagaagtggaatttccgtattggtttcacgcccagggagggtttagttatctattctgttgcatatgttgatggcagtcgaggtcggaggcctgtagcccacaggttaagttttgttgagatggtggttccctatggagatccaaatgacccgcattataggaaaaatgcatttgatgcaggggaagatggattaggtaaaaatgcacattctcttaagaagaattgtgattgcttgggcttcatcaagtactttgatgcacactttacaaatttcactggaggtgttgaaacaattgagaattgtgtttgtttacatgaagaggatcatggaatcttatggaagcatcaggattggagaacaggattagcagaagtccggcgttctagaaggctgtcagtttcttttatatgcactgtggctaattacgagtatggatttttctggcatttttatcaggcaagatgggaaaattgaagctgaggttaaactcactggaattcttagcttaggagcactgcaacctggggaagttcgaaaatatggtactacaattgctcctgggttatatgcacctgtccatcaacacttctttgtggcacgtatggatatggcagttgattgtaagcctggtgaaacattcaatcaggttgtcgaggtgaatgttaaagttgaagaaccaggaaaggataatgtgcataataatgcattctatgctgaagaggaattgcttagatctgaattgcaagcaatgcgtgactgcaatccattaactgctcgccattggattatcagaaatacacgaactgtcaaccggactgggcaacttacaggttataagttagtacctggttcaaattgtttaccattagctggttcagaggcaaaattcttaagaagagctgctttcttgaaacataatctttgggtaacaccttatgcacgtgatgagatgtatcctggaggagagtttcccaatcaaaatcctcgtgttggagagggattggctacttgggtgaagcaaaatcgatcacttgaagaaactaacatagttctatggtatgtatttggagtgacacacattcctcgactggaagactggcctgtcatgccagtggaccgcattggttttatgctgatgccacatggattttttaactgctcaccggctgtggacgttcctccaagttcaagcgatttggatctcaaggataatggaataacagcaaagcctattcagaatggactattggctaagctctaatgtcctcgtccttgaataatggaagcgacattgttcccaacttccagcaaaggctatttgattattctaagtactatattatttggaatatctcctttgttgtggtcacacgtccaaactctgttgtcttggttttgtaactctcctaataatgtacatttgtgctgttatggccaaatgtctttctattgatgtacctgtatgagttatgtcatgtccccagatagatgcttcgcatgaggggaatgcattctgctgctgccggcggagtttgtttaagattctaaatgactggaatccagcttggttgtggatgtgacatcataacagaacaagatacttgaaattttacatgtaacaatgatccagtttagctggcggatttgttcgtgtgtgtatttgctttctttctttcttttttttaaagagaaaaaaaaagttgggtttgaagaacttttgtcgggttgtagtcatcttatttgattccattcataaattagtttagtttgatgtctgag

SEQ ID NO: 5415 - DNA, 2738 bp, Tripterygium wilfordii
tggagggaaggggaaaggttagcttgataagaaaaatcacaatttgcttgcttgctgcatgtcagtggtgatataccgcagtgacaattactacggtggatacggtcagcttgctaatcctttgcaatggcctcaactcaggaaaaagcgacgccttctttcattgacagtaccgacaagaagagcagccacacttctgccacttctcctgccagtttggttcgaaaggcagcaacagaagttttgcagaattggaactttgaggagtcggaagcctctggggattcgatccggaagagagctgcagtggcggccctgatccgtcctgtcgatccgctctccgatactactaaaactgcttccaataaaggaatcccaatcatgacgagggctcaaacttgccatcctttggaccctttatctgccgctgaaattgctgtggcagtgtctactgttagagctgctggagcaacccctgaggttagagatagcatgcgttttgttgagatagttttggtggaaccggataagcaggttgttgcattggcagatgcatacttctttcccccctttccagccatcattaccttcccagaactaaaggtggacctgttattcctactaaactgcctccgaggaaagcaagacttgttgtttacagcaaaaggtcaaacgagacgagcatatggattgttgaactatctgaagttcatgctgcaactcgaggtggccaccacaggggtaaagtcgtttcatccaaagtggttccagatgttcagcctcccatggatgctaccgaatatgctgaatgtgaagctgtagtgaaggactttcctccatttcgggaggcgatgaaaaagagaggcattgaagatatggatctcgtgatggttgacacgtggtgtgttggatatcacagcaatgcggatgctcccagtcacaggcttgctaaaccgcttatcttctgcaggactgagagtgactgccccatggaaaatggttatgctcgtcccgtagaagggattcatgtgcttgttgatatgcaaaatatggaggtgattgagtttgaagaccgtaaacttgttccccttccaccagctgatcctttgagaaattacactgccggtgaaactcgaggaggtgtggatcgtagtgatgtgaagccattacaaattattcagccagagggtccaagttttcgtgttaatgggcactttgttgagtggcagaagtggaatttccgaatcggtttcactccccgggagggtttagttatatattctgtcgcatatgttgacggcaatcgaggtcgtagacctgtggctcacagattgagttttgttgagatggtggtcccttatggagatccaaatgacccacattataggaagaatgcatttgatgcaggggaagatggcttgggtaaaaatgcacattcacttaagaagggttgtgattgtttgggctatatcaagtactttgatgctcacttcataaatttcactggaggtgttgaaactattgagaactgtgtctgtctgcatgaagaggaccatgggattttatggaagcatcaagattggaggacgggcttagcagaagttagacggtctagaaggctctcagtttccttcatctgcactgtggctaactatgaatatggatttttctggcacttttatcaggatggcaagatggaagctgaggtcaaactcactggaatacttagtctaggagctctgcaacctggagaagtgcggaaatatggtacgacaattgctcctggattatatgctcctgtccatcaacacttctttgttgcacgaatggacatggcagttgattgtaagcctggtgaagcatacaatcaggttgtggaggtgaatgttaaacttgaagaaccagggaaagataatgttcataacaatgcattctatgctgaagaggaacttctcagatctgaattgcaagccatgcgtgactgtaatccttttagtgcccggcattggattgtgagaaacacaagaactgtcaaccgtactgggcagctaacaggttacaagctggtacctggcactaattgcttaccactagctggttcagaggcgaaattcttgagaagagctgcttttctgaagcataacttttgggttacaccttattcatctgatgaaatgtaccctggaggagaatttccgaatcaaaatccacgtgtaggagagggattggccacttgggtgaaacaagatcgatcactagaagaaactgacatagttctttggtatgtttttggagtcacacacattccccgactggaagactggcctgtcatgccggtggaacgaattggttttatgcttatgccgcatgggttctttaaccgctccccagcagtggatgtcccaccgtgtgcaagcgatatggatctcaaagatgccggaattgtgtcaaagccaatccagaatggactacttgctaagatttgaatgtcatttgcaacggttacaaacttttgatttcaagtttgtcaaataatcaagaagccattatcccagttcgtggcttttaatttatctaatatgaataaagtatcatttgtgagagcaaagattgtattgtgtgatgtaatttatttgtaatcccatgaaaatggtatgcgtgcaacggaacttttgcttcaataggattatttgatgctgttattgggttttaagttcctcttgaaattgatttggttt

SEQ ID NO: 5416 - DNA, 2639 bp, Castanea mollissima
ctctgcttcctgctgtatcaacgacgatctttcttcctcctcttcttcttcaatttctagagagcctacggcggcttctgctgctccgatcttggccaatgcaccggcggctgctccggtatcggcttctgcctccgccaatgccgcccaagattggaccgtcgcctcctccgccgatcgccgagacgataagcccgcgcctgcctcctccaaagcgatcccactaatgctgagggctcaaacaagtcaccctttggatcctctatctgccactgagatctctgtgacaattgcaaccgtcagggcagctggtgccacacctgaggtcagagatagcatgcgcttcatagaagtagttctggatgaaccaaacaaacatgttgttgctttggcagatgcttatttctttcccccttttcaaccatctttagttccgaaaaccagaggtggacccagaatccctaccaagctccctcctaggcgagccagacttattgtctacaacaaaaagtcaaatgagacgagtgtgtggattgttgagttatcagaagtgcatgctgtaacccgtggtggacaccataggggaaaagttatttcatcacatgttattccagatgttcagcctccaatggatgctgtggaatatgctgaatgtgaagctgttgtgaaagacttccctccatttagggaggcaatgaagaggaggggtattgaagacatggatcttgtgatggtcgatccatggtgtgttggttatcacagtgaagctgatgctcctaaacgaagacttgctaaaccacttatattctgtagaactgagagtgactgcccaatggaaaatggatatgcacgcccagttgagggcatccatgtacttgttgatatgcaaaatatgatagtaattgagtttgaagaccgtaaacttgtgcccttacccccagctgatccgttgagaaattacactgctggtgaaaccagaggtggtgttgatcgaagtgatgtaaaacctttacaaattgtccagcatgaaggtccaagcttccgtgttaatggctactttgtagaatggcagaagtggaatttccgcattggattcactcctagagagggtttggttatatattctattgcatacgttgatggtagtcgaggtcgaagacctgtggcccacaggttgagtttcgtggagatggttgtgccttatggagatccaaatgatccccattacagaaaaaacgcctttgatgcaggggaagatggccttggaaaaaatgcacattcacttaagaaggggtgtgattgtttgggatatatcaaatactttgatgcccactttacaaattttactggcggtgttgaaacaattgaaaattgtgtctgtttgcacgaagaggatcatggaatattatggaagcatcaagactggagaacaggcttagcggaagttcgaaggtctagacgactatcagtgtcctttatatgtactgtggctaattatgagtatggattttactggcacttttatcaggatggaaaaattgaagctgaagttaaactcacaggaattctcagcttaggagcattgctgcctggagaatttcgaaagtatggtacaatgattgccccaggtttatatgcacctgttcatcaacactttttcgttgctcgtatggacatggctgttgattgcaaacctggtgaagctttcaatcaggttgtagaggtggatgtcaaagttgaggagcctggagagaacaatgtccacaataatgcattctatgctgaagagagactgctcaaatctgagttggaagcaatgcgtgattgtagtcctttgagtgctcgccattggattgtaaggaacacaagaactgttaatcgcactggacagttgacgggttataagcttgtgcctggttcgaactgcttgccgttagctggtgcggaagctaagtttctcagaagagcttctttcttgaagcataatctttgggttacaccatatgctcatgatgaaatgtttcctggaggagagttccctaatcaaaatccacgtgttgatgaaggattggctacgtgggttaagcagaatcgatctctggaagaaacagatgtagttctatggtatgtatttggaatcacacatgtccctcggttggaagactggcctgtaatgccagcagagcgcattggttttatgcttatgcctcatgggttcttcaattgctcacctgcggtagatgttcctcccaatgcctgtgaattggaagccaaagacaatgatgtcaaggacaatggggtagtcaagccaattcagcctgcgctgctggcaaagttgtgacatcttttcttcctagtcaaatttgtcttccaatttaattgagaggacaataaggtagccaaagccaattcaacctgtgttggtggcaaagatgtcaagtctttacttccaagtcaatttgtctttcaatttcgtagagagatgtcataatggttcttcccgcttcctctgtctaatcttaaattccaagttaagctgatgagtttatccccaccaccctcaatgtagaatttcaaataatttacagactacttcaatcttttataaatcagaaagccatttgtgcaatgtgatttcg

SEQ ID NO: 5417 - DNA, 2568 bp, Olea europaea
cgacgccttctccttctactgagagttgggtcctgggggagacgccagcaaagccatcatccgccgtgaggcagcttctgccaccgcccctgattggagcggtgaagatcagcagagaaagaaagattcttccgtagttcccttgattcgacccgagccttcatccaatgctgctgctaaagggatcccgatcatgacaagggctcaaactagccatcctttggatcctttatctgctgctgaaatatctgtagctgtggcaactgtcagagcagctggtgccacccctgaggttagagatagcatgcgatttgttgaagtggttctattggaaccagagaaacatgtagtcgcacttgcagatgcctatttcttcccccctttccaaccatcattattgcctagaaccaaaggaggaccaacaattcctagtaagctaccaccaaggcgagcaagactagttgtgtataataagaagtcaaacgagacaagtatctggattgtcgagctgactcaagtacacgcaacaactcgaggtggacatcataggggaaaagtcatttcatccacagtggtcccagatgtacagccacctatggatgctgcggaatatgctgaatgtgaagctgttgttaaagattaccctccatttagagatgcaatgaagaagaggggtattgaagatatggatttagtcatggttgacccttggtgtgtcggttatcacagtgaagctgatgctcctagtcgcagacttgcaaaaccacttatattttgcagaacagagagtgactgtcctctagaaaatggttatgcaagaccagttgaaggaattcatgtacttgttgatatgcaaaatatggttgtgattgagtttgaagatcgtaaacttgtccccttacctccagctgatccattgaggaactatacctctggtgaaacaagaggaggggttgatagaagtgatgtgaaactcctgcaaattgttcagcctgagggtccaagctttcgagttagaggacattatgtagagtggcaaaagtggaatttccgggttggtttcactccaagagagggtttggttattcactctgttgcctatatagatggtaatcggggtcgaagacctatagcccataggttgagttttgtagagatggttgtgccctatggagatcccaatgatccgcattacaggaagaatgcatttgatgctggggaagatggacttgggaagaatgctcattctcttaaaaagggatgtgattgtttgggatatataaagtacttcgatgctcattttacaaattttactggaggagttgaaacaattgaaaactgtgtatgtttgcaagaagaagatcatggagtcctatggaagcatcaagattggagaactggccttgcagaagtgcgaaggtcgaggcggctcactgtttcttttatctgcacagttgctaattatgaatatggattctactggcacttttaccaggatgggaaaattgaagctgaagttaaacttactggaattcttagtttaggagctctccaacctggagaatctcgaaaatatggcacaacaattgctccaggcttgtatgcgccagttcatcagcacttttttgttgctcgcatggacatgacagttgactctaagcctggagaagcaaacaatcaggttgttgaagtgaatgtgagagttgaagaacctggacaggataatgttcacagtaacgctttctatgcagaggaaactttacttagatctgaactagaagccatgcgtgattgtgatccttcatcagctcgccattggattgtccggaacacaagaactgtcaataggagtggccaactgacaggctacaaattggtacctggttcaaactgtttgccattggctggtccagaagctaagtttatgagaagagctgcatttttgaagcataacctatgggttacaccctatgcacggggggaggattttcctggaggagagtttcctaaccagaatccacgtgttggagaggggttggcttcttgggtgaagaagaatcgttctctggaagaaaatgatattgttctttggtatgtttttggaattactcatgttcctcggttggaagactggcctgttatgccagtggaacacattggttttatgcttcagccacatggattcttcaactgctcgcctgcagtggatgtcccgcctaatacctgcgagatagataccaaagagaacgatgtaaaggacaatggcgtaccaaagccaacttctgttggtttaatggcgaagatctgaagatatagccacaaaacaccattcatattagtattctgctgcagaacttttacgttgagcttgttgaacccaggtgcccgcgtttgcactttatttgatcttgcttatttgactctctttggtcattatttgttttgtcaattaaatttctttgatatttatgttgtgtatgatctttgtgtcaaatagttgctccattggtaattgtatgaggtcgaactaacgtttgtttcattttataaattgtttataaacattga

SEQ ID NO: 5418 - DNA, 2884 bp, Papaver somniferum
caatatctccgatattctctcaaagtttatcccattttccctctgttttcgatttttgttgcttactggttctactcttgttagggtttttgattttcgaaaaacaatataaaacagaaattacagaaacagagtgaaccactgatttaatcgtgcgaaaggattaggggtgctgtatgtcagcagtaagaggagaagaagactgtactagtattcagagttacaatcacggagggagatttctttcaaatccattacaatggcctcagcttcgaaaaaaacgacgtctaacaacaactgtttctccatcattaatggtgttggtgcttcttcagctttggaattacgtcgtgaagctgtttctgctgagatcctacaggattggactattaatgataacaagaagaacaacaacgatgattatgaaaaacaacagaacaagaagatagttgcatcaactactaatttgactgatccttcaactaccaatccttcttccaaaggtatccagattatgttaagggctcaaagcagccaccctttggaccctttatcagctgccgaaatctcagttgctgtggggacagtcagagctgctggagccactccagaggtgagggatagtatgcggtttatcgaagtggttttgttggagccggataaaaatattgttgcattggcagatgcatatttttttccacctttccagccatcactacttcctaaatcaaaaggtggcgcgttcattcctagcaaacttcctgcaagacgagctagacttgtggtgtataacaaacgatcaaatgagaccagtgtttggattgttgaattgactgaagtacacgccgcgactcgtggtggtccaaatagaggaaaggttgtttcatcgcaagttatacccgacgttcagcctcccatggatgccatggaatatgctgagtgtgaagctgtggtgaaagacttcgcaccatttcaggatgcaatgaagaagaggggaattgaggatatggatcttgtcatggttgatccctggtgtgtaggctactacagcgatggagatgctcctagccgcaggcttgctaaaccactcatattctgtagaacggagagtgactgccctatggagaatggttatgcgcgaccagtcgaaggcatttatgttctggttgatatgcaaaatatggtggtaattgaatttgaggaccgtaaacttgttcctcttcctccagctgatccgttaagaaactacactgccggtgaaacacgaggaggtgttgaccgtagcgatgtgaagcccctacagattattcagccagaaggaccaagctttcgtgttaatgggcagtttgtggaatggcaaaaatggaactttcgggttggtttcactcccagagagggtttggttatatattccgttgcatatactgatggtagtgggggtcggagacctgtagctcacaggctgagttttgttgagatggtggtcccatatggtgatccaaatgagccacattacaggaaaaatgcatttgatgcaggagaagatggcctgggtaaaaatgcacattctctgaaaaaggggtgtgattgtttgggttacatcaagtatttcgatgcccattttacaaatttcaccgggggagtagaaacgattgaaaattgtgtgtgcttacatgaggaggaccatggtatactgtggaaacatcaagattggaggtctggcttagcagaagttagaaggtctagaaggctcacagtatcctttttttgcactgtggctaattatgagtatggattcttctggcacttctatcaggatggaaaaatagaagctgaggttaagctaactggaattctcagcttaggagcaatacaaccaggtgaatccaggaaatacggtacaactatagctccaggattgtatgcaccagtacatcaacacttctttgtttctcgtatggatatggctgtggactgtaagcctggtgaagcattcaatcaggtagttgaggtggatgtgaaagtcgaagaacctgggaagaacaatattcataacaatgctttctacgctgaagaaacactgctcaagtctgagatgcaagccatgcgtgactgcaatcctttatcagctcgtcattggattatcaagaacacaagaaatgtcaatcgcacagggcaattaacaggctataagctaatgcctggttcaaactgttcgcctttcgcaggccctgaggcaaaatttctgagaagagctgcttttcttaaacacaatctttgggttacacaatatgcccatgatgagatgtatccaggaggcgagtttccaaatcaaaatccacgcgacagtgagggtttgactacatgggtcaagcagaatcgctctcttgaagaaacaaatatagttctctggtatgtatttggaatcactcatgttcctcgattggaagactggcctgtgatgccggtggagcatattggttttacacttgtgccacatgggttctttaattgctctcctgctgtggatgtcccaccaagtattggtgctagcgaattagacctgaaggaaatcggagtctccaaacctattcagaacggactgctatcgaagctttagaagaagaatctgcatctatgaaaacaaccttgtgtttcaattttttttttcttcacctagtttttaggaaatgtttatgcaataattatggtctcataaactggtactcattagctccatcgtcgaccctgtttagttgctggtttgtgcacatatgataattttgcttttccattggttgcttgctgaaattgaaaggacatgactttgcagcttaataacagattacagattatgtactctcttctaatccaattatatgga

SEQ ID NO: 5419 - DNA, 2719 bp, Aquilegia formosa
atggccacaacttcggaaaaagcgacgctttgttgcattaatgacactaagaaatcaaacctatccaatctttccatgcgtagtagtcgacaacctgtttctgtctctggtcccaccaccaccaccactactacttctacttctgatcttgttgctcaagattggatcgtcacaacaaattccaatactgatcatcaacagcaagaacaacaacagcaacagaagaagagagcttcggctatggcgaccttgattactcctgttgaatctattccagaaccttcaactaatccaccaactaaaggtctccagatcatgatgagggctcaaagcagccatcctttggatcctttatccgcagcggaaatatcagtggcagttgggaccgtcagggctgctggagctacacctgaggtgagagacagtatgcggtttattgaagtggttcttttggaaccagataaacatgttgttgcattggcagatgcatattttttccccccttttcaaccttcattacttcccaaaacaaaaggtggacctgtcattcccagtaagctccccccaaggcgggccagacttgttgtttacaataaaaagtcaaatgagacaagcatctggattgttgagctgacagaagtacatgctgcgactcgaggtggccatcataggggaaaggttattacctcacaaatagttccagatgtacaacctcccatggatgctgtggaatatgctgaatgtgaagctgttgtaaaagacttccctccatttcgggaggcaatgaagaagaggggtatcgaggatatggatctcgtgatggttgatccatggtgtgttggttaccatagtgattctgatgctccaagtaggaggcttgctaaaccactaatcttctgtagaaccgagagtgactgcccaatggaaaatggttatgcacgcccggtcgaaggcatctatgtagttgttgatatgcaaaatatggttgtagttgaatttgaagatcgtaaactagttcctcttcctcccgctgacccattaagaaactatacttcgggtgaaacgcggggaggtgttgaccggagcgatgtgaaacctctgcaaatcattcaacctgaaggtccaagtttccgtgttcatggtcactttgtcgaatggcaaaagtggaattttcgaattggctttacaccgagggagggcctggtaatatattcggtagcatatactgatggtagtaggggaaggagacctgtagctcacaggctgagttttgttgagatggtggtaccctatggggacccaaatgagccacattacaggaaaaatgcctttgatgctggagaagatggccttggtaaaaatgcccattcccttaagaaggggtgtgactgcttgggatacatcaaatacttcgatgcacattttacaaatttcactggaggagtcgagacaactgaaaactgtgtttgcttacatgaagaggatcatggcatgctatggaagcatcaagattggaggacaggattggcagaagttaggcgttctagacgccttacagtatcttttgtatgtacagtagctaattatgagtacggattcttctggcacttctatcaggatgggaaaatcgaagctgaggtaaaactcacaggaattctcagtttaggagcagtgcaaccaggggaatctaggaaatatggtacaacgattgctccaggattatatgcacctgttcatcaacatttctttgttgctcgcatggacatggctgttgactgtaagcctggtgaaacgtttaatcaggttgttgaagtgaatgtcaaagttgaagaacctggaaagaacaatgtccacagcaatgcattctacgctgaagaggaactgcttacatctgagctggatgctatgcgtgactgcagtcctttgactgctcgtcattggattgttaggaatacgagaacggtcaaccgaactggccaattaacgggctataagctagtgcctggatcaaattgtttgccattagctggctctgaggcaaaatttttgagaagagctacattcttaaagcataatctttgggttactccatatgcccgtggtgagatgtatcctggcggggagtttcctaatcaaaatccacgtgttggtgagggtttggctacatgggttaagcaaaaccggtctcttgaagaaactaatatagttctctggtatgtatttggtgtgacgcacattccaagattagaagactggcctgtcatgccagtggagcacatcggttttatgcttatgccacatgggttcttcaactgttcccctgctatagatgtgccacccagttcaaatgatctggagctaaaggaaaatggagtgtcaaagcctattcagaatgggttgctagcaaagctttaagaaacttctgttagggatttcctacaatcatgcggctatatatgaatttgatgaaacatcattacttttaagttttgttagcagagttttttttttccccaactgtgaatgactatcttaaacaagtgctaatgtagactgtttatctttgtggtctaaattggtatagtgcgttggtatgttattcccttttttacagtgatgtcaagtgtacattctttcctaggctagttcatttaatgtggaaaaaacaggcagttgatttgtctgtcgatgcttaaacaagaatcaacattgatgtgcc

SEQ ID NO: 5420 - DNA, 2689 bp, Amborella trichopoda
atggccacaactcaggaaaaagcgacgctctgttgcacctctaatggagccattggtggtaataatgcgcagtcgagagaaggagctcgttcctcctctgtcgtggtggagaaggccgcctctgctcctctcacaagagaggcggtttctgcagaggtgcctgaatggacagatgagaagcaaaatctcgccctaactggtttgattcaccctgttgatgcgctccacgaaccgcctgctaaaggtgctgggatacatgtgatgatgagggctcaaaccaggcatccattggatccactttccgcggcggagattgcagtggcggtggctactgtcagggctgctgggaaaacgccagaggtgagggatggcatgaggtttattgaagtggtattgtgggagccagataagagtgtggttgcattggcagatgcgtacttcttcccccctttccaaccctctctactccccaaaaccaaaggtggccctgtgattcccagtaagcttcctccaaggcgagctaggcttgttgtctacaacaagaagtcaaatgagacaagtatctggatcgtggaacttactgaggttcatgcagcgacacgaggtggccatcacagaggaaaggcggtatcctctgaagtggttccagatgttcagcctcctatggatgctgtggaatatgccgagtgtgaagctgttgtcaaggattatcctcctttcagggaggcaatgaaaaagaggggtatagaggacatggatcttgtaatggtcgatgcatggtgtgttggttatcatagtgatgcagatgccccaagtcgcagacttgcaaaaccacttatcttctgtagaactgaaagtgactgtccaatggagaatggatatgcacgccccgttgaaggaattcatatacttgttgatatgcaaaacatggttgttattgagtttgaggaccgaaagttagttcccttgcccccagctgaccctttgaggaattatacccctggagagacacgagggggcattgatcgaagtgatattaaaccccttcacatccttcagccagagggtccaagttttcgggttaatggatattttgtggaatggcagaagtggaacttccgaattggtttcactcctagagagggcctagtgatatactctgtggcatatattgatggaagcaggggtcggagacctgtagcccacaggttaagttttgttgagatggttgttccctatggggatcccaatgaaccacattacagaaagaatgcatttgatgcaggagaagatggccttggaaaaaatgcacattcactaaaaaggggttgtgattgtttaggctacatcaaatattttgatgctcattttacaaatttcactgggggagtggaaacaattgaaaactgtgtctgcttgcatgaggaagatcatggaatattatggaaacatcaagattggagaactgggttggcagaagtccggaggtcaagacggttaactgtatcttttatatgcactgtggctaattacgaatatggatttttttggcacttttatcaggatgggaaaattgaggctgaagtgaagttaactggaattctcagcttaggagctctgcaacctggtgaatctaggaagtatggaacaacaatagctcctggcttgtatgctccagttcatcagcacttctttgttgctcgcttggatatggctgtagattgcaagcctggggaagcacttaatcaggtagttgaggtgaatgtcaaagttgaggagccaggaaagaataatattcacaacaatgcattttatgcagaggaggaactgctcagatcagaattgcaagcaatgcgtgattgtaatccgttgactgctcggcattggatcgttcggaacaccaggtctgtcaaccgaactgggcaattaactggctataagttgctgcctggctcaaattgcttacccttagctggttcagaggctaagtttctacggagagctgccttcttgaagcacaatctttgggttactgcatataaacgtgatgaaaagtatcctggaggagagtttcctaatcaaaatccacgtattgatgagggcttggccacatgggtgaagcagaatagacctctggaagaaaatgatattgttctttggtatgtatttggagttacacacatacctcgtcttgaagattggcctgtcatgcctgttgatcggatagggtttatgcttatgcctcatggtttcttcaactgctctccggctgtggatgttccccccagttcaactgagacggatctcaaggaaattggggtgccaaagccgcttcagaatgggcttgtttcaaagctttaaacttgggtgattttcctcttgctattgtgtcttatttagttgctgcaaaggcctacagagctaaaatctgtgttgcgaatgctgttcttggtgtgagactgttttctccccccaaaagaaaaaaaaatcccttgtattagttttcttgttgtttgttgactctgttgttgatggactaccagttttatgcgactttgtagtgatggatttcagaatctcgtgtattcatagcatttgtaattttgtgcgttttattatgggtgggatttgtataagctgtagaagtatcttgcacaatttacttgggagatatagtttggtgttggac

SEQ ID NO: 5421 - DNA, 2766 bp, Prunus persica
agagcgagaaagttcgagagcgttttcatttcctcaatctgttgctgagagaggcattgctgtatgtcagtggaaaactactccagtgacagttactacggtggatacggtgagctcgataacccttcgcaatggccgcaactcaggaaaaagcgacgccttgttgcctggacgctgtacccgccaaatcctcggctctgcttcgcaaggcctccgacccgatgcgcgattggaccgtttcgggctccgatccgtcccaggatccgatccgcaacagagctgctgtgccgaccttgatccgacccatcgagacccttcctgctacttctacaaacaccactgccgccaaaggcatcccagtcatgttgagggctcaaaccagccatcctttggagcctttatctgctgctgaaatctctgtggcagtggccactgtcagggcagctggagcaacccctgaggtgagggatagcatgcgctttgttgaagtggctttggtagaaccagataaacacgttgttgcattggcagatgcatatttcttccctcctttccagccatcattgcttcccagaactaaaggtggacctatgattcctagtaaacttcctcccaggcaagcaagacttgtggtttataacaaaaagtcaaatgagacgagcatctgtattgttgaactatcagaagttcatgctgcaactcgaggtggtcaccataggggtaaagtcatttcgtccaaagttgttccagatgttcagcctcccatggatgctatggagtatgctgaatgtgaagctgttgtaaaggactttcctccatttcgggaagcaatgaagaagaggggtattgaggatatggaccttgtgatggtggatccttggtgtgctggataccacagtgaagctgatgctcctagccgcaggcttgcgaaaccgcttatcttctgtagaactgagagtgattgccctatggaaaatggttatgctcgtccagttgaaggaatccatgtgcttgttgatatgcaaaatatggtggttcttgaatttgaagaccgcaaacttgttcccctgcctcctgctgatccattgagaaattatactccaggtgaaacacgaggaggtgttgatcgaagtgatgtgaaacctctacagataattcagcctgaaggaccaagttttcgtgttaatgggcactttgttgaatggcagaagtggaatttccgtattggttttacttccaaggaaggtttggttatctattctgtcgcgtatattgacggtagcagaggccggaggcctgtagcccataggttaagttttgttgagatggtggtcccttatggtgatccaaatgctccgcattacaggaagaacgcatttgatgcgggagaagatgggctgggtaaaaatgcgcattctcttaaaaagggttgtgattgtttaggctatattaagtacttcgatgcacactttacaaatttcactgggggtgttgaaacaattgagaattgtgtttgtttgcatgaggaggatcatggaattttatggaaacatcaggattggagaacaggtttagcagaagttcgacggtctagaaggctgacagtatcttttatttgcactgtcgctaactatgatcatgcttatcaattttcttttgtaggatgggcatattgaagctgaggtgaaacttacaggaattctaagcttaggtgcactgcaaccaggagaaacccgaaagtatggtacaactattgcacctggactatatgcaccggtgcatcaacacttttttgtagctcgtatggacatggcagttgatagtaagcctggtgaaactttcaatcaggtggttgaagtaaatgttaaagttgaagaaccaggaaagaataatgttcacaacaatgcattctatgctgaggaaaaattgctgaaatcagaattgcaagcaatgcgtgattgtaatcctttatctgctcgccattggattgtcagaaacaccagaaacgtcaaccgcaccgggcagctaacaggttacaagctagtacctggttcaaattgtttaccactagctggttctgaggcaaaatttctgagaagagctgcttttttgaagcataatctttgggtcacatcttatgcacgtgacgaagtgtatcctggaggagaatttcctaatcaaaatccacgcattggggagggattggccacttgggttaagaaaaatcggtcactggaagaagctgacattgttctttggtatgtatttggagtgacacacattcctcgactggaagactggccggtgatgcctgtagaacgtattggttttacactcatgccacatgggttctttaattgctcaacggcagtggacgtccccccgaatacatgcgatttggacctcaaggacaatgggatgactgcaaaacctattcagaatggactactggctaagctctaaaaatgaagaggacgaggatgcatgctacagagagattctaccaaaacctatttagatagtcaagtggcatgcttatggtcagattagttatattttaagatagataaacgaacttgttctcttattataaaacaatgtatggtgctgacatatcctttgtccaacttttttctttggtgctcaaactgaggctgatcatagcatgacatgagtcatggtcgctctgtgtgtggcttccattccatatacaacaagcttctcacatttggtttgattataatatccctgaaatgattgtcattt

SEQ ID NO: 5422 - DNA, 2922 bp, Nicotiana benthamiana
tcacgttttttcgttttcttcattgctccgttcctacttctccattaaaactctagagctttccacagagagagaaaaagcagaagcagagggaaaagtcagttgattttgggaatcggaggaggtggagttgtggattccgagcggcagaattgtaagtgctgtatgtcagaggactactactactattacagtgacaagtattacggcggttacagtgaactcgcgaatccattgcaatggcctcaactcaggaaaaggcgacgctttcttccccttcacgaaatgcttccgccgctcagttttcgccggaatggactgccgccggaaccgtagctgaaatttccgatcgttcctctaccaccagatcggcggccaacgccaaaagcactgccactgctgctgttggtgtgatcgactccattgatcgtccttctctgtcaaatgctcctgccgttaaagggctgcctaccttgttgagggctcaaagtcaccatcccttggaccccttaactgctgctgaaattgctgtggctgttgcaactgtcagggccgctggcagtactcctgaggtgagagatagcatgcgctttgtcgaggctgttttggtggaaccagacaagagcgtgattgctttagctgatgcatactttttccctcctttccaaccatctttgttgccgagaacgaaaggtgggcctgtaattcctagtaaacttcctccaaggaaggctagactaattgtttataataagaaatcaaatgagaccagcatatggattgttgagctctcggaggttcatgctgtgactcgaggaggccaccaccgcggcaaagtcatttcatctcaggttgtgcctgatatacagcctccaatggacgctgctgaatatgctgaatgtgaagctgttgtgaaggatttccctccttttcgtgatgcaatgaagaagagaggaatcgatgatatggaacttgtgatggtcgatgcctggtgtgcaggttacttcagtgaggctgatgcacctaaccgccgtctaggaaaacctctaatattttgcagaactgaaagcgactgtccaatggaaaatggctatgctcgaccagttgaaggaattcatatactggttgatatgcagaatatggttgtgatagagtttgaagatcgtaaagtggttccgttaccaccagctgatccattgagaaattacactcctggtgaaacgagaggaggggttgacagaagtgatgttaaacctcttcttataagtcagcctgaaggtcctagcttccgtgtcagtgggcactttgttgaatggcagaagtggaactttcgtattggttttacccccagggagggtctggttatctattctgttgcatatgttgatggtagcagaggtcgtagacctgttgcgcataggctgagcttcattgaaatggtagtcccctatggggatccaaatgagccacattacaggaaaaatgcttttgatgcgggggaagacgggcttggtaaaaatgcacattccttaaagaagggttgtgattgcttaggctatattaagtatttcgatgcacattttacaaacttcacgggcggtgttgagacaatcgaaaattgtgtctgcctacatgaggaggatcatggaatgttatggaagcatcaagattggagaacaggtttagctgaagtacgacgttcgcgacggttaacagtgtctttcatctgtactgttgcaaactatgaatatggattttactggcacttttatcaggatgggaaaatcgaggctgaagttaagctgactggaattctcagcttaggtgctcttctacctggggaagttcgaaaatatgggacaactattgcacctggcttgtatgcacctgtacatcagcacttctttgtggctcgcatggatatggctgttgactgcaaaccaggggaagcacataaccaggtggttgaagtaaatgcaagagttgagccaccaggagaaaataatgttcacaataatgcgttttatgctgaagagagattgcttagaactgaattggaagcaatgcgtgattgtaatcctctaactgctcgccattggattatccggaatacaagaacagtcaatcgcacggggcagttaactggttacaagctagtaccaggtacaaactgtctgccactagctggatcagaggcaaaattcttgagaagagctgctttcttaaagcataatctttgggtcaccccttactctggtgatgagatgtttcctggaggagaatttcctaatcaaaatcctcgtgttggtgagggattggctacttgggttaagcagaatcgatccctggaagaaacacagatagttctttggtatgtttttggacttatacatgttcctcgcctagaagactggcctgttatgcctgtggagcacattggttttatgctgcagcctcatgggttcttcaattgctccccagctgttgatgttcctcccagcacagctgactcggatattaaggaaaacggggtagtgacaaagtcttgccacgacggtggtataatggctaagctttgatagattcaagctagctttgccttctaggattggttcatgtaacttcgcataaattgggttttctttctgtttggagcctttatgtaagcgtttcttaagaacatagactgcaagttggcactattgttctgtggaccaagttccccttccccaaaaaaaacctacatctctgttggacacaatgatattgataatgtcggccttgtttcatttgcttggtaaagcatatatcatggttttctgggtatattattctgatatgcacacccatctgaactaatattgaaagggtactggttcctttcaaaagtggctttatttggaatatctatgctatggaagc

SEQ ID NO: 5423 - DNA, 3430 bp, Medicago truncatula
gtttttggaatattcaccaaacaccacttattttttaagcactaataacacatggacacacttatcctatactagtgtgacatctgattgatcacttaagtaaatgattaattcaatttacgatcaaaattattgttaattcaactatataattaacattttttttttcatgtgattaaccagatgtcgcatgtgtaaaaaatggattagtgggaaacatttttattttattaagttacattgtacattagcgtgacacctgattaatcacttgagtaaatgattgattcaattacgatcaaaactatggttaattcaactacataagtaacattttttgcatatgattaaccagatgtcgtatgcgtagctaaatggattactaggaaacattattgttttttaagttacattggtggtctagctggaaagcatcagaagaaatctagttattatatagtaactaagtatctttcatttcatccaatcaaaactcctcattctctctagctacttcaaaaaagagtgtgtttttgtgtttgtgttgatcttggcattgagggtgagagtggtggaaggaaggaagttgaggaaaaaacgacgcctatttgttgttccctccaaaacaagaacaaaactgctgcaagtgcaacctctcctaatgttcctcagcaaaaacaacagctacctttcatttctgccgttgattcgcgccttgatcctcctccaaaatccgcttcttccaaaggtattacagtaatggcgaaagcacaaacttgccatcctttggatccactttctgctgctgaaatatccgtagctgttgcaactgttcgagcagctggagcaacacctgaggtaagggacggtatacggttcattgaagtaggcttggtagaaccagaaaagcaagtagttgcgttagcagatgcgtacttcttccctcctttccagccctcgttgctcccgagaataaaaggtggacctgtgattccatctaaattgccaccaaggaaagcgagattggttgtctataataagaagtcaaatgagacaagcatatggattgttgaacttacagaagttcatgcaacaactcgtggcggacatcataggggcaaagtgattacttctacagttgttccagatgttcagcctcccatggatgctgtggagtatgctgaatgcgaagctgttgtaaaggactttcctccatttcgagaggcaatgaagaaaagaggaattgaagatatggatcttgtgatggtggatccatggtgtgccggatatcatagtgaaggtgatgctccaagccgcagacttgctaaaccactgttcttttgtaggactgagagtgactgtcctatggaaaacggctatgctcgtccggtggaaggaatacatgtacttgtcgatatgcaaaatatggttgtccttgagtttgaagatcgtaagcttgttccccttccacaggctgatccattgagaaattatacttctggtgaaacacggggaggagttgatcgaagtgatgtgaaacccttacagattattcagccagatggtccaagctttcgtgtcaatggaaacttcattcaatggcagaagtggaactttcgtattggattcactcctagggagggtttggttatttattcagtagcttatattgatggaagtcgtggccgaaggcctgtggcccacagattgagttttgttgagatggttgtcccttatggagatccaaatgatcctcattataggaaaaatgcttttgatgccggggaagatggcctcggtaaaaatgctcattcactcaagaagggctgtgattgtttaggctatatcaagtacttcgatgcacactttacaaacttttatggaggcgttgaaacaattgagaattgtgtttgcatgcatgaagaagatcatggtatgttatggaaacatcaagattggagaacaggtttggctgaagttcgacggtctagaaggttgacagtgtcttttatatgcactgttgctaactatgagtatggattttactggcacttttatcaggatggaaaaatagaagctgaggtcaagctcacaggaattctcagtttaggtgcattgcaacaaggtgaaactcgaaaatatggcacaactattgcacctggcttatatgcgcctgtccaccaacactttttcgttgctcgtatggacatggccgttgattgcaagcccggtgaagcatttaatcaggttgttgaggtgaatgtcaaagttgaagagccgggaaagaataatgttcacaacaatgcattttatgccgaggaaaaactgcttaaatcagaattagaagcaatgcgtgattgtgaccctttatctgctcgtcattggattgttaggaacacgaggagtgtgaaccggactgggcatctaacgggttacaaactagttcctggttcgaattgtttacctttagctggatcagaggctaagtttttaagaagagcagctttcttgaagcacaatctatgggttactccttacgcacgcgacgaattgcatcctggtggagagttccctaatcaaaatccccgcgttggagagggtttggctacttgggttaagcaaaatcgaccattggaagaagctgacatagttctctggtacgtatttggggtgacacacattcctcgattggaagactggcctgttatgcccgtggaacacattggttttatgcttatgccacatggatttttcaattgctcaccagcagtagatgttccaccaagcccaggtgatttggatgataaagagaatggaatgcctgctaagcatagtcagaatggtttaattgccaagctttgaaagctccaaaagcagagatattcaggctcattaagcttctttatgtggaataagtggttcttcaaaattaaaattgaataagtggttctattctacctaattgaacatttaatattgctgctcgtcttaattaatccatggtggtgtgtaacactggttatttaaaaacagtttaatgtgtaatttgtttgtatatagatgtaattctctctcttaatccagtggtatatatcctactacaccataatgttggataatgtgatcaactttgtctcttcttctctctctgtccaaatctcgaaccgagtactttaaggtggaacgctaatcttgcaaccaagtgacctctcgggagacggacaacatgattcaaaacataacaaaaggaccaatatatcaaatgagaatgtatcattacgagtatataatgttgttagaaggatataatctttcctttcattctcatgtaaaaaatagtattaaaaaaatgaaagaaccaatatatcaagcaagaattttctcactagtacataacaaaaggaccttgcatgagtatacaaggtttttg

SEQ ID NO: 5424 - DNA, 2644 bp, Lupinus angustifolius
cttgaaagcgtaaggttgttgcttagtgaccacgaggtcacaagttcaaatcgtaaggctgtgtacattttactccccagaccccactaagtgagagtctcatgcactgggccaccttttgtttttccatgcattttttgtatttagtcctttctcattaatgaaattacttcttccattatatatataacttgtttgctttcttgctggcataggtattccagtcatgatgagagctcaaacctgccaccctttggatccattaaccgctgctgaaatatcagtagccgtggcaactgttcgggcagctggagccacccctgaggtgagggatagcatgcgctttgttgaagtagtcttggtagaaccagataagcaagttgttgcattagcagatgcatatttctttcctccgtttcagccatcattgctccccaggactaaaggcggaccagtgattccaactaaacttcccacgaggaaagcaagactagttgtttacaacaaaaggtcaaatgagacaagcatatggattgttgaacttagagaagttcatgcagcaactcgaggtggccaccacaggggcaaagtaatatcttctgaagttgttccagatgttcagccaccaatggatgctgtggagtatgctgaatgtgaagctgttgtgaaggagtttcctcaatttcgagaagcaatgaagagaagagggatcgaggacatggaccttgtgatggtggatgcctggtgtactggatatcacagtgaagctgatgctcctagccgcagacttgctaaaccactaatcttttgtagaactgagagtgactgccctatggaaaatggctatgctcgcccagttgaaggaatccatgtacttgttgatatgcaaaatatggttgttcttgagtttgaagaccgtaaactagtcccccttccacctactgatccactaagaaattatacttctggtgaaacccggggaggagttgatagaagtgatgtgaaacccttacagattattcagcctgaaggtccgagttttcgtgtcaatgggcacttcattcaatggcagaagtggaactttcgtattggtttcactcctagggaaggtttggttatttattcagtggcttatattgatggaagtcatgggcgtaggcagctggcacacaggttgagttttgttgagatggtggttccttacggagatccaaatgaacctcactataggaagaatgcttttgatgctggagaagatggcctgggtaaaaatgcccattctctcaagaagggctgtgattgcttaggctatatcaagtattttgatgcacatttcacaaacttcactggaggtgttgaaacaatagagaactgtgtctgcttgcatgaagaggatcatggtattttgtggaaacatcaagattggagaaccggtttggctgaagttcgacggtctagaagactgacagtatcttttatatgcactgtggctaactatgagtatggatttttctggcacttttatcaggatgggaaaatagaagctgaggtcaagctcacaggaattctcagcttaggagcattgcaacccggtgaaactcggaagtatggcacaactattgcacctggattatatgcgcccgtccaccaacactttttcattgctcgtatggatatggcagttgattgcaagcctggtgaagcatttaatcaggttgttgaggtggatgtcaaagttgaagagccaggaaagaataatgttcataacaatgcattttatgctgaggaaaaactgcttaaatcagaattggaagcaatgcgtgattgtaatccttcatctgctcggcattggattgttaggaacacaaggacggtaaaccgcactgggcagctaacaggttacaagctagtacctggttcaaattgtttaccgttagctggttcagaggccaaattcctgagaagggcagcttttttgaagcacaacctttgggtcactccttacaatcgcaatgaaatgcatcctggaggagagttccctaatcaaaatcctcgtgttggagaaggtttggctacatgggttaagcaaaatagatcattggaggaagctgatatagttctttggtacgtatttggtatgacgcacattcctcgattggaagattggcctgttatgccagtggaacaccttggttttatgctcatgccacatggatttttcaattgctcccctgctgtagatgttcccccaagtgcaagtgatttggatgataaggagaatggaactcccacaaagcctgttcagaatgggctcattgctaagctctgaaagtaccaaaaacagagacatttggctatgtttatcaaatcatttagtgagtgcatcagtttaattaaatattactgcttgttaaataaatcaatccaaactcaagttttttgtggtccacatggatatttttaagaatgctattcaggtgatgcatctgatgtaattggatagtgatagcaatgctttgtgggtttctctaaatgtgggatttgatgttactatcgtttgaaagtgggaaatcatattttgaggcttggattattataaatttgcattttatagaattcaaattcttacagtttcttataccca

SEQ ID NO: 5425 - DNA, 2665 bp, Quercus alba
gcaccggcggcggctcccgtctcggcttctgcctccgccaatgccgcccaagattggaccgtcgcctcctccgccgatcgccgagacgataaacccgcgcctgcctcctccaaagcgatcccactaatgctgagggctcaaacaagtcaccctttggatcctctatctgccactgagatctctgtgacaattgcaaccgtcagggcagctggtgccacacctgaggtcagagatagcatgcgcttcatagaagtagttctggttgaaccgaataaacatgttgttgctttggcagatgcatatttctttcccccttttcaaccatctttagttccgaaaaccaaaggcgggcccataatccctaccaagctccctccaaggcgagcaagacttattgtctacaacaaaaagtcaaatgagacaagtgtatggattgtcgagttatcagaagtacatgctgtaacccgtggtggacaccataggggaaaagtaatttcatcacatgttattccggatgttcagcctccaatggatgctgtggaatatgctgaatgtgaagctgttgtgaaagacttccctccatttagggaggcaatgaagaggaggggtattgaagacatggatcttgtgatggttgatccatggtgtgttggttatcacagtgaagctgatgctcctaaacgaagacttgctaaaccacttatattctgtagaactgagagtgactgcccaatggaaaatggatatgcacgcccagttgagggcatccatgtacttgttgatatgcaaaatatgatagtaattgagtttgaagaccgtaaacttgttcccttacccccagctgatccattgagaaattacactgctggtgaaaccagaggtggtgttgatcgaagtgatgtaaaacctttacaaattgtccagcatgaaggtccaagcttccgtgttaatggctactttgtagaatggcagaagtggaatttccgcattggtttcactcctagagagggtttggttatatattctattgcatatgttgatggtagtcgaggtcgaagacctgtggcccacaggttgagtttcgtggagatggttgtgccttatggagatccaaatgatccccattacagaaaaaatgcctttgatgcaggggaagacggccttggaaaaaatgcacactcacttaagaaggggtgtgattgtttgggatatatcaaatactttgatgcccactttacaaattttactggcggtgttgaaacaattgaaaattgcgtttgtttgcacgaagaggatcatggaatattatggaagcatcaagactggagaacaggcttagcggaagttcgaaggtctagacgattatcagtgtcttttatatgtactgtggctaattatgagtatggattttactggcacttttatcaggatggaaaaattgaagctgaagttaaactcacaggaattctcagcttaggagcattgctgcctggagaatttcgaaagtatggtacaatgattgccccaggtttatatgcacctgttcatcaacactttttcgttgctcgtatggacatggctgttgattgcaaacctggtgaagctttcaatcaggttgtagaggtggatgtcaaagttgaggaacctggagagaacaatgtccacaataatgcattctatgctgaagagagactgctcaaatctgagttggaagcaatgcgtgattgtagtcctttgagtgctcgccattggattgtaaggaacacaagaactgttaatcgcactggacagttaacgggttataagcttgtgcctggttcgaactgcttgccgttagctggtgcggaagctaagtttctcagaagagcttctttcttgaagcataatctttgggttacaccatatgctcatgatgaaatgtttcctggaggagagttccctaatcaaaatccacgtgttgatgaaggattggctacatgggttaagcagaatcgatctctggaagaaacagatgtagttctatggtatgtatttggaatcacacatgtccctcggttggaagactggcctgtaatgccggcggagcgcattggttttatgcttatgcctcatgggttcttcaattgctcgcctgcggtagatgttcctcccaatgcctgtgaattggaagccaaagacaatgatgtcaaggacaacggggtagtcaagccaattcagcctgcgctgctggcaaagttgtaacatcttttcttcctagtcaaatttgtcttccaatttaatagagaggacaataaggtagccaaagccaattcaacctgtgttgctggcaaagatgtcaaagtctttacttccaagtcaatttgtctttcaatttcatagagagatgtcataatggttcttcccgcttcctctgtctagtcttaccttccaagttaagctgatgagtttatccccaccaccctcaatgtagaatttcaaataatttacagactacttcaatcttttataaatcagaaagccattcgtgctatgtgacttcgatttgcctttttacttaatgactatggtcttaaatgtagactagcatgtaacctgtgcaatgcacaggatttattaaacgttattaatattttttaaatctagattgtcacttgtcagtccattg

SEQ ID NO: 5426 - DNA, 3078 bp, Citrullus lanatus
tttttcccctctcggattcaggtgctctaaattgggattttctccctcttttgagagatcgtctcgtttcgatttttccgatctgtttcgaggtgaaaccctagattgaaggggaaaggatcaactccttttcgtttgatttttctgtcattcattttgggcttttgttgattgtggagaggcgaagagaagaagagaagagtagctgtgttgtgtttgtggtggcggaggagaaacagagaaggcaagcgccagtgatctttgctgtatgtcagtggattgtgttgaaacttattgttgtggaattggcaagctcaagaatcctttacaatggccccaacttcgaaaaaagcgacgttgttttcaagtgatgcttgttgtcatgccactgctgccggttccactaccgttcctcgagaggctgctcctgttgcttccgccaatgtcgtccaagattggaatctcaccacgaatgatcgagccgacgatcgccgtacatccaagaatgttgccatcccctcgttagttcgttctgttgaaccgattcctgaaccttcaactaatgcttcttccaaaggcacttttcttcttccctcgtctctcttttctttttttcctctttcgcttatctctctaatcgatgacctggaatctcgacataaagctgtgcttgatattgacagaaaatatggcacaagcgtttcttctagatggtttctcatgcattgctgtatgattggttgtacaggtgttgttcccccaatgttgagggcacaatcaagacatcctctggatcccctatcagctgctgaaatctctgttgcagtggcgaccgtcagggcagctggagccacgccagaggtcagagatagcatgcgttttattgaagtggtgctactggaaccagaaaaacatgttgttgcattggcagatgcatattttttccctccattccaaccatctttgcttcccaaaactaagggagggccggttattcctacaaagcttcctccaagaagggcaaggattgttgtttacaataagaaatcgaacgagacaagcctatggatcgtcgagctgtcagaggttcatgcagtaactcgaggtggacatcacaggggaaaagttatatcttctacagttgttcctgaggttcagcctcctatggatgctgctgagtatgcagaatgtgaggctgttgtcaaagaatatcctccattcatagaggctatgaagaagaggggtattgaagatatggatttggttatggttgatccttggtgtgttggttatcatagtgaagtagatgctcctggtcgaagacttgctaaacctcttatattttgtagaactgaaagtgactgcccaatggaaaatggatatgctcgcccagttgagggcatacatgtccttgttgatatgcaaaacatggtggttatagaatttgaagacagaaaacttgttccgctacctcctgctgatccattgaggaactacacttcaggtgaaacaagaggtggtgttgatcgtagtgatgtgaagcccttacagatagttcagcctgaaggtccaagctttcgcgtcaatggctactatgtggaatggcaaaagtggaattttcgaattggtttcactccccgagagggtttggttatatactctgtagcttatgttgatggaagcagagggcgaaggcctgtagcacatcgactaagttttgtggaaatggttgtcccttatggagatccaaatgatccacattacaggaagaatgcttttgatgcaggagaggatggactgggcaaaaatgcgcattctctgaagaagggatgtgattgtctgggttacatcaaatattttgatgctcatttcacaaatttcactggtggtgttgaaacaattgaaaactgtgtgtgcatgcatgaagaggaccatggaattctgtggaagcatcaagactggaggacaggattggcagaagttagaagatcgaggcggctgacagtgtcctttatttgtactgtggctaattatgagtatggtttcttttggcacttctttcaggatggaaaaatcgaagctgaagtcaaattaactggaattctcagcctaggagctttgcaacctggtgaatatcgaaaatatggcacgatgattgcaccaggtttatatgcaccagtgcatcaacatttctttgttgctcggatggacatggccgttgattgcaagccgggtgaagctttcaatcaggtagttgaagtggatttgaaagttgaaggacctggggagaacaatgtccacaacaatgctttttacgctgaagagacattgctcaagtcggaaatgcaagctatgcgtgattgtagtcctttatctgctcgccattggatagtgcgaaatactagaactgtaaatcgaactggacaattaacaggctacaagctattgcctggttcaaattgtttgccattagctggttcagaggccaagtttcttcgaagagcttctttcttgaagcataatctttgggtgactcaatattcacgcgatgagatgtttcctggaggggagtttcccaatcagaatccacgcgtcggtgaaggattatctacatgggttaaacaggatcgacccttagaagaaactgacatagtcctttggtatgttttcgggatcacgcatgttcctcggttggaagattggcccgttatgcctgtggatcgcatcggctttacactcttgcctcacgggttcttcaactgttctcctgctgttgatgttccacccagtgcttgtgaattagattcaaaagataccgacgctaaagaaaatggggtgacaaaaccaattcaaactcccattatctcaaagctttgaaaaactctcctcactgctcccttcattgctttacagacttaaaatttctcttctactttggtttctctcttagtcaactgggttgctatcccttgttaatataaaaaacacaaactttttcctttttggtctctttagttgaacacttaaaccgttatgaatgtgaatattatgaatcttcacaataatcgtatccacaca

SEQ ID NO: 5427 - DNA, 3326 bp, Medicago truncatula
gttaaatatcaattttaatatcttaatttttttttccttttttagtaaagttaagttaaactttacatacactaaattaatttattaaaagtacttgaagccgagtcacatggcattattacacaatattccacttcttacgggttatgtctgtctacttaggtgttggttgctgattagcaaaaacaaacaatgtccgaaacagtacaatttcacaaaatgcagtagaaaaataaaaaactttgaaaacaaaaagaaaaggaaaaaacaaactataactccactttctatcttcacggaaaagcgaccccaatcttgagttgcaacttctcttcattcaatgcgatgaaaataaacacaatctatgaatcacggacatagagacatcgacaacactgataatttaaaaaaaaatatataactcaatataatactaatatgttttgcatcttattagacattggacatgcatttgattagaagcgttggtgttataaaagatacaatgatagtatgattaaatatataaatatctacctgtaaagacgatcaatcatttttcacaacacaaacacttgttgagttcttctttgttcttcttctgggaaagagaagagaaggatttgctgtatgtcagtggaatactacagtacagttttgtacggtgagcttgctaacccttcacaatggccacagctcaggaaaaaacgacgcctgacccatctcaggatccaacccgaaacactgattctttccctccaaaaactactcctactaccaaaggtatcccggtcatgatgagagctcaaacctgccatcctttagatccactatctgctgctgaaatatcggtagctgtagcaactgttcgggcagccggggcgacccctgaggtgagggatagcatgcgctttgtcgaagtagtcttggtggaaccagttaagcaagttgttgctttagcagatgcatatttcttccctcctttccagccatcgttgctcccgaggaccaaaggaggaggacctttgattcctactaaacttcccactaggaaagcacgactagttgtttacaataaaaagtcaaatgagacaagcgtatggattgtcgaacttcgagaagttcatgcagcaactcgaggtggcccccacaggggcaaagtcatttcttctcaagttgtgccaaatgttcagccaccgatggatgccatggagtatgccgaatgtgaagctgttgtgaaggacttccctccatttcgagaagctatgaagaggagagggattgaggatatggatcttgtaatggtagatgcctggtgtgttggatatcacagtgaagctgatgctccaaaccgcaggcttgctaaaccactaatattttgtagaagtgaaagcgactgccctatggaaaatggctatgctcgtcctgttgaaggaatctatgtacttgttgacatgcaaaatatggttgttctcgagtttgaagaccgtaaactaatccctcttccacctactgatccacttagaaattatacttccggtgaaacacggggaggagttgatagaagtgatgtgaaacccttacagattattcagcctgaaggtccaagttttcgtgtcaatggtcacttcattcaatggcagaagtggaactttcgtatcggtttcactcctagagaaggtttagttatttattcagtagcatatattgatggaagtcgaggccgaaggccagtggcacacagattgagtttcgttgagatggtggtcccgtacggagatccaaatgatcctcactataggaagaatgcatttgatgcaggagaagatggccttggtaaaaatgctcattctctcaaaaagggttgtgattgtttaggctatatcaagtactttgatgctcacttcacaaactttactggaggtgttgaaacaatagagaattgtgtttgcttgcatgaagaggatcatggtattttgtggaagcatcaagattggagaactggtttggctgaagttcgaaggtctagaaggttgacagtgtcttttatatgcaccgtagctaactacgaatatggatttttctggcacttttatcaggatgggaaaatagaagccgaggtcaagcttacaggaattctcagcttaggagcattgcagccaggtgaaactcgaaaatatggcacgactattgcacctggattatacgcgccagtccaccaacacttttttgttgctcgtatggacatggctgttgattgcaagcccggtgaagcatttaatcaggttgttgaggtggatgtcaaagttgaagatccgggaaaaaacaatgttcacaacaatgcattctatgccgaggaaagactgcttaaatcagaattggaggcaatgcgcgattgcaaccctttatctgctcgacattggattgttagaaacacacggacagtaaaccgaactgggcagctaacaggttacaggctagtacctggttcaaattgtttacctttagctggttcagaagccaagtttctgcgaagagcagctttcttgaagcacaatctttgggtcactccttatgttcacaatgaaatgcatcctggaggagagtttcctaatcaaaatccgcgagttggagatgggttggctacttgggttaagcaaaatagatcactggaagaagctgatatagttctttggtatgtatttggagtgacacacattccacgattggaagactggcctgttatgccggtggaacgcataggtttcatgctaatgccacatgggtttttcaattgctcaccagctgtagatgttcccccaagtgctggtgatttggatgataaggagaatggaatgcctgctaagcccattcagaatgagttgattgcaaagctgtgaatgagccaaaagtagagacatttggtgttatgtttatctaattactatattaaaatttggttttggcctaactcaaccctacaaaattgacttgtaaggcaagggatgcctcccatttatataaatagattttctggtcatatcacatttttaatgcaatgtgagactctgaacacattgagtgcagcaatttgatttaattttactgcttgctagttaaactgattcaaagttaagcttcatgggggatatttaagagtgtttagcttatgcatccgatgtcattgcaaaatgataatacttggtgcatgtttgaaattgcggcaaatttgaaaaaatcatattgatattgtgatttgttgaaattttaaagtgtattttttgtcaaaattatgatggcacactgtaattatgccaaactcgccg

SEQ ID NO: 5428 - DNA, 2414 bp, Cajanus cajan
cacttcctgccataggtatcccactcatgaccaggcctcaaacctcccaccctttggatccactattagccgctgaaatatccgtggccgtagctacagttcgagctgctggcccaacccctgaggtgagggatagcatgcgctttgttgaagtggtcttggttgaaccagataagcaagttgttgcattagcagatgcatatttcttccctcctttccagccatcattgctccctaggactaaaggaggacccgtgattcctactaaacttcccccaagaaaagcacgattggttgtttacaacaaaaggtcaaatgagacaagcatatggattgttgaacttagacaagtgcatgcagcaactcgaggtggtcatcatagaggcaaagtaatttcttctaaagtcgttccaaatgttcagccaccgatggatgctgtggagtatgctgaatgtgaagctgtcgtgaaggacttccctccttttcgagaagcaatgaagagaagagggattgaggacatggatcttgtgatggtggatgcctggtgtgttggatatcatagtgaagcagatgctcctagccgcagacttgctaaaccactaattttttgtagaactgagagtgactgtcccatggaaaatggctatgctcgtccagttgaaggaatccatatacttgttgacatgcaaaatatggaaattcttgagtttgaagatcgtaaattgatcccccttccacctgctgatccgttgagaaattatacttctggtgaaacccggggaggagttgatagaagtgatgtgaaaccattacagattattcagcctgaaggtccaagttttcgtgtcaatgggcacttcattcaatggcagaagtggaactttcgtattggttttactcctagggaaggtttggtaatttattctgtagcctatattgatggaagtcgaggtcgaaggccagtggcccacagattgagttttgttgagatggtggtcccttatggagatcctaatgatcctcactataggaagaatgcttttgatgctggagaagatggtctgggtaaaaatgctcattctctcaagaagggatgtgattgtttaggctatgtcaagtactttgatgctcacttcacaaactttaatggaggtgttgaaacaatagagaattgtgtttgcttgcaagaagaggatcatggaattttatggaaacatcaagattggagaacaggtttggctgaagttcggcggtctagaaggctgacagtgtcttttatatgcactgtggctaactatgagtatggatttttctggcacttctatcaggatggaaaaatagaagctgaggtcaagcttacgggaattctcagcttaggagcattgcaaccaggtgaaactcgaaaatatggcacgactattgcacctggattatatgctcctgtccaccaacacttttttgttgcgcgtatggatatggctgttgattgcaagcccggtgaagcattcaatcaggttgttgaggtggatgtcaaagttgaagaatcaggaaagaataatgttcacaacaatgcattttatgcagaagaaaagctgcttaaatcagaattggaagcaatacgtgattgtaaccctttatctgctcgacattggattgttaggaacacaaggacggtgaaccgaaccgggcagctaacaggatacaagctagtacccggttcaaattgtttacccatggctggttcagaggccaagtttctgaggagagcagctttcttgaagcataatctttgggtcactccttatgctcccgatgaaatgcatcctggaggagagttccctaatcaaaatctgcgtgttggagaaggtttggctacttgggttcagcaaaatagatcactggaagaagctgatatagttctttggtacgtatttggtgtgacacaaattccgcgattggaagactggccagttatgccagtggaacgcattggttttatgcttatgccacatgggtttttcaattgctccccagctgtagatgttcccccaagtgcaagtgatttggatgataaggacaatggcatgtctgcaaagcctattcagaatggggtaattgccaagctctaaaaggaccataagtagagtcatttggtgatgtttaccatcatttaattaaaaatcgtcattcgtaaataacgaagtttcttgtggtccacatgtgatgtaattgtaaaatgatactatattggttgctgaaatcttaattgatgcgaagttcctttcatcagaaagtggaaagagagagagggttggatttaaatactgtatataatgtttgcacttggtaaaattctgtttcatgcatttaccacaaggataataatacttactagtatgaaaaatccatctctt

SEQ ID NO: 5429 - DNA, 2582 bp, Fragaria vesca
acccgagtctccgccccggcgaccctgatccgacccctcgactcctcctcttcagccaacacaacctctgccgccaaaggcctcccagtcatgttgagggctcaatccagccatcccttggagcctttatctgcggctgaaatctcggtggccgtggcaactgtcagggcagctggagcaacccctgaggtgagggatagcatgcgctttgttgaagtagctttggtagaaccagataagcgcgttgtggcattggccgatgcgtatttcttcccgcctttccagccatcattgcttcccagaacaaaaggaggacctatgattcctagtaaacttcctccgaggcaagcgaggcttgtagtttataacaaaaagtcaaatgagactagtgtttgggttgttgagctatcagaagttcatgctgcgactcgaggtggtcatcataggggtaaagtcatctcctccaacgttgttccagatgttcagcctcccatggatgctatggaatatgctgaatgcgaagctgttgtaaaggactatcctccgtttcgggatgccatgaagaagaggggtattgaagatttggacctcgtcatggtggatccatggtgtacaggatatcacagtgaggctgatgctcctagccgcaggctagctaagcctcttatcttctgtcgaactgagagtgattgccctatggaaaatggttatgctcgtccagtggaaggaattcatgtacttgttgatatgcaaaacatggtggttcttgagtttgaagaccgtaaacttgttcccttgcctcctgctgatcctttgagaaattatactcctggtgaaacacgaggaggtgttgatcgaagtgatgtgaaacccctaaagatcgttcagcctgaagggccaagttttcgtgttaatgggcactttgttgaatggcagaagtggaatttccgcattgggtttacttcgaaggaaggtttggttatctattctgttgcttatactgatggcagtcgaggccggaggcctgtggcccacaggttaagttttgttgagatggtggttccttatggagatccaaatgatccccactacaggaagaatgcatttgatgccggggaagatgggctaggtaaaaatgcacattctcttaaaaagggttgtgattgtttaggttatatcaagtactttgatgcacactttacaaatttcactgggggtgttgaaacaattgagaattgtgtttgcttgcatgaggaggatcatggaattttatggaagcatcaggattggagaacaggtttagcagaagttcgacgatctagaaggctgacagtgtcttttatttgtactgtagctaactacgagtatggattttactggcatttttatcaggatgggaaaattgaagctgaagtgagacttacaggaattctaagcttaggtgcgcttcaaccaggagaaacccgaaagtatggtacaactattgcacctggactatatgctcctgtacatcaacacttttttgttgctcgtatggacatggcagttgatagtaagcctggtgaaacttataatcaggtggttgaagtaaatgttaaagttgaagaaccaggaaagaacaatgtccataacaatgcattctatgctgaggaaaaacttctgaaatcagaactgcaagcgatgcgtgattgtaatcctttatctgctcgccattggattgtcaggcacacaagaaatgtcaaccggacaggacagctaacaggttacaagctagtacctggttcaaattgtttaccattagctggttctgaggcaaagtttctgagaagagctgcctttttgaagcataatctttgggtcacctcatatgcacgtgatgaaatgtaccctggtggagaatttcctaatcaaaatccacgtgtaggggagggattagccacttgggttcagcaagatcgatctctggaagaagctgacattgttctttggtatgtatttggagtgacccatattcctcgactggaagactggccggtcatgcctgtggaacatatcggttttacactcatgccacatggtttcttcaactgctcgacggcagtggacgtccctccaaacacatgtgagaacgacctgaaggaaaatgagatgtctacaaaacctattcagactgctcttgtcgctaagctctgagacgcaggaagcacaatggaaaattcagatgagatcccttattccatgtccgtttctgtagtcaatcagtcaatgttttacaatttgaatatttatgaggctggtcaggggatgaactactctttgttattaaagttgtatctgctgaaacttctctgtcaaactccttgactacgctaagtggtgctcaatccaagtctgttcatagtcatatcttcgacttgcaggtcgggctgacttgaacaagacgcaacaaattcccagcatttggtttgactatagtatctaaattctgatgcttttcataatgaataaagaattatgaatgttgttatgttattcctgttttacaactaatctgattctccatgtgaattgaataatatttc

SEQ ID NO: 5430 - DNA, 3074 bp, Theobroma cacao
cccacttctgctttgttttcgtctttcacttgaaaactaatgctcctctttttgtcttaaaccgatctgcaactgcaagcaaaaccatttttcattatcgtttcccatttgggttgatccgggcagcgagagaataatacaaagcttttcgagtggaaggttagaagctcagaataaaaaaagaaaacacgaaaacagacgcatagtatttgctgtatgtcagtagaatactattgtgacaaatactacggtggatacggtgaggttgctaaccctttgcaatggcctcaactcaggaaaaggcgacgccttgttgcattcccaaaaccaacgacgacgtcagcaagaagacctcttcatcttcttcttcctcctctaccgaggttttgcagaattggagtcttgcagtcggctctgggccagtcccgtctgaggatcccatcccaaagacagcctccatggcaaccttgatccgccctgttgagcccatctcggatccttccgctgctaagatcgctactaccaaaggaatttcaatcatgccaagggctcaaaccagccatcctttggatccattgtctgctgctgaaatctcagtggcagtggcaactgtgagggcagctggcgcaacccctgaggtgagagatagcatgcgctttattgaagtggttttggtagaaccagataaacatgttgttgcattggcagatgcatatttcttccctcctttccagccttcattacttcccaggacaaagggtggacctctcattcctagtaaacttcctccccgacaagcaagacttgttgtgtacaacaaaaggtccaatgagacaagtatatggactgttgagttgtcagaagttcatgctgcaactcgaggaggccaccacaggggcaaagtcatttcatctaaagttgttccaaatgtccaacctcccatggatgctatggaatatgctgaatgtgaagctgttgttaaggacttccctccatttcgagaggcaatgaagaagaggggcattgaggatatggatcttgtgatggttgatccctggtgtgtgggttatcatagcaatgctgatgctcctagccgaagacttgctaaaccacttatcttctgcagaactgagagtgactgccccatggaaaatggttatgctcgtccagttgagggaatccatgttcttgttgacatgcaaaatatggtggtaattgaatttgaagaccgtaaacttgttccccttccaccagctgatcctttaagaaattatacggctggtgaaacacggggaggtgttgatcggagtgatgtgaaaccactacaaatcattcagcctgaaggtcccagctttcgtgttaatgggaaatttattgaatggcagaagtggaatttccggattggtttcactcctagggagggtctggtaatctattctgttgcttatgttgatggtaatcgtggtcggaggcctgtagcccatagattaagttttgttgaaatggtggttccttatggagatccaaatgatccgcattataggaagaatgcatttgatgcaggagaagatgggctgggtaaaaatgcacattctcttaaaaagggttgtgattgtttgggatatatcaagtactttgatgctcattttacaaatttcactggaggtgttgaaacaattgagaattgtgtttgtttgcatgaagaggatcatgggatcttatggaagcatcaagattggagaacaggtttagcagaagttcgacggtcaagaaggctaacagtgtcttttgatggtaaaattgaagctgaggttaaactcactgggattctcagcttaggagcattgcagcctggtgaaacacgaaaatatggcaccactattgctcctggactatatgcccctgttcatcaacacttttttgtggctcgcatggacatggcagttgattgtaaacctggtgaagcatttaatcaagttgttgaggtgaatcttaaagttgaagaaccagggaaggataatgttcataataatgcattttatgctgaagaggaacttctcagatctgaactgcaagcaatgcgtgattgtaatccattgagtgcacgtcactggattgttagaaacacaagaaatgtcaacaggactgggcaactaacaggtttcaaactagtacctggttcaaattgtctgccactggctggctctgaggcaaaatttctaagacgtgctgctttcttgaaacataacctttgggtcacaccctatgcacgtgaagaaatgtatcctggaggagagtttcccaatcaaaatccacgtgttggggagggattagctacatgggttaagaagaatcggtcattggaagaagctgatatagttttgtggtatgtctttggagtgacacatgttcctcggttggaagactggcctgtcatgccagtggaacgcattggttttatgctcatgccacacggtttctttaactgctcaccagcggttgatgttcctccaagcgcaactgatctggagctcaaggacaatgacattgcaacaaagcctatccaaaacgggataatagctaagctctgaattgatcttttgtatgattatcctcagcaatatgtcggtaagggtcatataattgagccattgacccccacattattaggtactaaaaaagcatctgagtacgtacagactgcttcagcattcgtatttgtatgtgcttaaggttcactaaatatttgaactgccctcgtatcctagtaaactattggaggcctggcaactgtcagcagcaaattcagcgagtccacctccagtccgtcattgcaaaaatagattcataaataatgtactattttatactgttacagaatcataatgtccgactctgtacctctgaataatagaattcttgcctgattatgttgttgtcttcatgaagatcctttttttaacgctgattgcagcgttttgcggtgatcaaattggatcgtgctgggctgcttgacaaagggtgagttatgaaaagatgacttgatttataattgctaaatgaaaacgacacga

SEQ ID NO: 5431 - DNA, 2897 bp, Nicotiana benthamiana
cgctaattcgaacaatatactgtgtcaggcttccatataacaccatctttatcagtgcaataggaagaaaaaaaaatctgtctctggtctctagatccatcatctctataaattataaaaccgagaggagttccaagagtcacaaacgtacaaacagtacagtcaagaaactatatacagagagacataatttgaagaaacgctgaatctgatttaagttataatcacagtatatgtcagtagcctctaataatcactgttggggttctcatcacagctaaacagtagtctcaatggccactactaaacagaaagtgacggcaccttctccttctccttctccttcttcttcgactgcttcttgctgtccttccacttccatcctccgtcgtgaggcgacagcggccatttcagtcgtgggtgacggactgcagaattggacgtccaacatcccctccgtcgatgataaacagaaaaagacggcctcatcagctcttacgtcattgccaaccaacgaacctctttcctccaatacctctaccaaaggtatacaaatcatgacaagggctcacacctgccatcctttggaccctttatctgctgctgagatctcagtggctgtggcaactgttagagctgccggtgaaacacctgaggtcagagatgggatgcgatttattgaggtggttctggtagaaccagataaaagtgtagttgcactggcagatgcatatttcttcccaccttttcagtcatcattgatgccgagaaccaaaggaggatctcatattcctactaagcttccaccaaggagagctaggcttattgtttacaataagaaaacaaatgagacaagcatttggattgtcgagctaaacgaagtacatgctgctgctcgaggtggacatcacaggggaaaagtcatctcatccaatgttgtccctgatgttcagccacccatagatgctcaagagtatgctgaatgtgaagctgtggtgaaaagttatcctccctttcgagatgcaatgagaagaaggggtattgatgacttggatcttgtgatggttgacccttggtgtgttggttatcatagtgaggctgatgctcctagccgcaggctcgcgaaaccacttgtattctgcaggacagagagtgactgcccaatggaaaatggatatgcaagaccagttgaaggaatatatgttcttgttgatgtacaaaacatgaagattatagaatttgaagaccgaaaacttgtacctttacctccagttgatccactgaggaactatactgctggtgagacaagaggaggggttgatcgaagtgatgtgaaacctctacatgttattcagcccgagggtccaagctttcgtatcagtggaaactacgtagagtggcagaagtggaactttcggattggtttcacccctagagagggtttagttatacactctgtggcgtatcttgatggtagcagaggtcgtagacaaatagcacataggttgagttttgtagagatggttgtcccctatggagatccaaatgatccacattataggaagaatgcatttgatgcaggagaagatggccttggaaagaatgctcattcactgaagagggggtgtgattgtttggggtacattaagtactttgatgcccatttcacaaactttacgggaggagttgaaacgactgaaaattgtgtatgcttgcatgaagaagatcacggaatgctttggaagcatcaagattggagaactggccttgctgaagttagacggtctaggcgactaacagtgtcttttgtttgtacagtggccaattatgaatatgcattctactggcacttctaccaggatggaaaaattgaagcagaagtaaaactcactggaattcttagtttgggagcattgcaacctggagaatatcgcaaatatggtaccacaattttaccaggtttgtatgcaccagttcatcaacacttctttgttgcacgaatgaatatggcagttgattgtaagccaggagaagcacacaatcaggttgttgaagtaaatgtcaaagttgaagaacctggcaaggaaaatgttcataataatgcattctatgctgaagaaacattgcttaggtctgaattgcaagcaatgcgtgactgtgatccgttctctgctcgtcattggattgttaggaacacaagaacagtaaatagaacaggacagctaacagggtacaagctggtacctggtccaaactgtttgccattggctggtcctgaggcgaaatttttgagaagagctgcatttctgaagcacaatctatgggttacacaatatgcacctggagaagattttccaggaggagagttcccaaatcaaaatccccgtgttggcgagggattagcttcttgggtcaagcaagaccggcctctggaagaaagtgatattgttctctggtatatttttggaatcacacatgttcctcggttggaagactggcctgttatgccagtcgaacacattggttttgtgctacagccacatggattctttaactgctccccggctgttgatgtccctccgccctttgcttgcgactcagagagcacagacagtgatgttactgaaactagtgtagcaaagtccactgccactagcttgctggccaagctttgaatgattatgttatcctaacatgagtcctcctcgatcgcctatttacctacggataccaaacttccattttcttttgatagagtattgaattagttggtgcaggaacattgttttgattggtctcatatatggcacgtttaagcaaagcaagtccctttgtgtattgatcttgaattaagcatgttatagggaatggtaactctcggttttagcattttattt

SEQ ID NO: 5432 - DNA, 2942 bp, Nicotiana tabacum
ccctcatgcggccgctaaagacgaacaatactgtgtcaggcttccatataacaccaccatctttatcagtgcaataggaagaaaaaaaatctctctctggtcactagatccatccttcatctctataaatcttaaaaccgagaggagttccaagagtcacaaacgtacaaacagtacagtcaagaaactatatacagagagacataatttgaagaaacgctgaaagtgattatgttataatcacagtatatgtcagtagcctctaatagtcactgttggggttctcatcgcagctttcttcctagctaagcagtactcacaatataatggccactactaaacagaaagtgacggcaccttctccttctccttcttcttcgactgcttcttgctgtccttccacttctatcctccgtcgtgaggcaacagcggccattgcagtcgtgggtgacggcctgcagaattggaccaacatcccctccgtcgacgagaagcagaaaaagacggcctcatcagctctagcgtcattgccaaccactgaacctctttccaccaatacctctaccaaaggtatccaaatcatgacaagggctcaaacctgccatcctttggaccctttatctgctgctgagatctcagtggctgtggcaactgttagagctgccggtgaaacacctgaggtcagagatgggatgcgatttattgaggtggttctggtagaaccagataaaagtgtagttgcattggcagatgcatatttcttcccaccttttcagtcatcattgatgccgagaaccaaaggaggatctcagattcctactaagcttcctccaaggagagctaggcttattgtttacaataagaaaacaaatgagacaagcatttggattgttgagctaaacgaagtacatgctgctgctcgaggtggacatcacaggggaaaagtcatcgcatccaatgttgtccctgatgttcagccacccatagatgctcaagagtatgctgaatgtgaagctgtggtgaaaagttatcctccctttcgagacgcaatgaggagaaggggtattgatgacttggatcttgtgatggttgacccttggtgtgttggttatcatagtgaggctgatgctcctagccgcaggctcgcgaaaccacttgtattctgcaggacagagagtgactgcccaatggaaaatggatatgcaagaccagttgaaggaatatatgtgcttgttgatgtacaaaacatgaagattatagaatttgaagaccgaaaacttgtaccattacctccagttgacccactgaggaactacactgctggtgagacaagaggaggggttgatcgaagtgatgtgaaacccctacatattattcagcctgagggtccaagctttcgtatcagtggaaactacgtagagtggcagaagtggaactttcggattggtttcacccctagagagggtttagttatacactctgtggcgtatcttgatggtagcagaggtcgtagaccaatagcacataggttgagttttgtagagatggttgtcccctatggagatccaaatgatccacattataggaagaatgcatttgatgcaggagaagatggccttggaaagaatgctcattcactgaagaggggatgtgattgtttagggtacataaagtactttgatgcccatttcacaaactttaccggaggagttgaaacgactgaaaattgtgtatgcttgcatgaagaagatcacggaatgctttggaagcatcaagattggagaactggccttgctgaagttagacggtctaggcgactaacagtgtcttttgtttgtacagtggccaattatgaatatgcattctactggcatttctaccaggatggaaaaattgaagcggaagtcaaactcactggaattcttagtttgggagcattgcaacctggagaatatcgcaaatatggtaccacaattttaccaggtttgtatgcaccagttcatcaacacttctttgttgcacgaatgaatatggcagttgattgtaagccaggagaagcacacaatcaggttgttgaagtaaatgtcaaagttgaagaacctggcaaggaaaatgttcataataatgcattctatgctgaagaaacattgcttaggtctgaattgcaagcaatgcgtgattgtgatccattctctgctcgtcattggattgttaggaacacaagaacagtaaatagaacaggacagctaacagggtacaagctggtacctggtccaaactgtttgccactggctggtcctgaggcgaaatttttgagaagagctgcatttctgaagcacaatctatgggttacacaatatgcacctggagaagattttccaggaggagagttccctaatcaaaatccccgtgttggcgagggattagcttcttgggtcaagcaagaccggcctctggaagaaagtgatattgttctctggtatatttttggaatcacacatgttcctcggttggaagactggcctgttatgccagtagaacacattggttttgtgctacagccacatggatactttaactgctctccggctgttgatgtccctccgccctttgcatgcgactcagaaagcagagacagtgatgttactgaaactagtgtagcaaagtccactgccactagcttgctggccaagctttgaatgtttcgtttatcctaacatgagtcctcctcgatcgcctatttacctacggataccaaacttcatttttcttttgatagagtattgaattagttggttcaggaacatggttttgactagtcgcatatatggcacgtttaagcaaagcaagtccctttgtgtattgatcttgaataaagcatgttatagggaaaaactcataaatgtcgatctttggtaactctcggtctttgcatttcattt

SEQ ID NO: 5433 - DNA, 2751 bp, Trifolium pratense
cttcctctttatcgttacactgtgtgttacagatttcatcacgttgcgcggtgaaagagggtgatttgccctaacctgcatgtcagtgtactgtcttggtacctattgtggtgctggaatcggcgaaatagcgaatcctttacaatggcctcagcttcgaaaaagacgacgccaccatcgtcttctccttgttgtccctctgtcgactctccccgcttagccgtcgctgctacctccgccgtcgtccaatccgatcgcgttcctaacaactccgttgccttgattcgtcctctcgattcgcttccagaaccttccaccaccaatgctccttctgctaagggaatcatttcaatgacaaggcctcagtcaagccatcctttggacccgttaactgcggcggaaatttctgtggcagtggcaactgtgagggctgctggagccactccagagcttagagatagtatgcgcttcattgaagtagttttgctggaaccagataaacatgttgttgcactggcagatgcttattttttccacctttccaaccatcattacttcctagaagtaaaggagggcctgtaattcccacaaaactccctccaagatgtgctagacttgttgtttacaataagaaatcaaatgtgactgctctgtggattgtcgaattatcacaagtgcatgctgtaactcgaggtggccatcatcgaggaaaagtaatttcatcacgtgttgttcccgatgttcagcctccaatggatgctgaggaatatgcagaatgcgaggctgttgttaaaagtttccccccttttatagaggctatgaagaaaaggggtattgaagacatggaccttgtaatggttgacccctggtgtgttggttatcatagtgaagccgatgctcctggtcgaagacttgctaaacctctcctattttgtcgatctgagagtgactgccctatggaaaatggttatgcccgcccagttgagggcatctatgttcttgttgatatgcaaaacatgaaggtgatagagttcgaagaccgtaaacttgttcctctgcctccagttgatcccttaaggaactatactcctggtgaatccagaggtggctccgatagaagtgatgtcaaacccttacaaattattcaacctgaaggtccaagctttcgtgtcaatgggtattatgttgaatggcagaagtggaattttcgtattggattcacacccaaagaagggttggttatatattctgttgcgtatgttgatggtagtcgagggagaaggcctgttgctcataggctgagttttgtggagatggttgtaccctatggagatccaaatgaacctcattataggaaaaatgcttttgatgctggggaagatggcttgggaaaaaatgcacattccctcaagaagggatgtgattgtttgggctacatcaaatattttgatgctcactttacaaatttcactggtggagtggaaaccattgaaaattgtgtatgtatgcatgaagaggatcatgggattctctggaagcatcaagactggagaactggcttggcagaagtccggaggtctagaagactttcagtttcttttgtatgcacggtggccaactatgagtatgcattttttggcacttttatcaggatggaaagattgaagctgaagtcaagctgactggaattctcagcttaggtgccttgatgccaggagaatatcgaaaatatggaaccatgattgcaccaggtctatatgctccagttcatcaacactttttcgttgctcgcatggacatgtctgttgattctagacccggtgaagctttgaatcaggttgtggaggtcaatatgaaagttgaagaacctggtgagaataatattcatcacaatgcattctatgccgaagagactttgctcagatctgaatcagaagcagtgcgtgattgcaatcctttaactgctcgacattggattgtaaggaacacaagaactggcaacagaaccggacaattgacaggctacaagctggtaccaggctcaaactgcttgccattggcaggttctgaggccaagtttttaagaagagctgctttcttgaagcataatgtttgggtaacagcatattcacgtgatgaaatgtttcctggaggagaatttcctaatcaaaatccacgtgctggtgaaggactagctacatggattaagcaaaaccggtctttggaagaaactaatatagttctttggtatgtatttggaatcacgcatgttcctcgtctagaagactggcctgttatgccagtagaacacattggttttatgctcatgcctcatggattcttcaattgttctcctgcagtagatgtcccacctaattcatgtgaagtggaatctaaagacaccgacatcaaggataatggtgcttcgaagccaattcagagcggtttagcgtcaaagctttaggcacttgtctcattctgaagttatggcttctcgctgctgaaacaggagaaacaccaagttgagcagattacattttaatctacaataataatcataatcaagctataaacttaaatcctgatatagtttatgctgggaagttgactggtaatatccattagatttttctttctacttgatacaattatgttttcaaattcgacgtgaaagtactgcttagcttaaaataagtggtttgttactatggcgtgttatctagattcataaatcactatgtcttgtggtct

SEQ ID NO: 5434 - DNA, 2706 bp, Solanum phureja
ttctccattgaaaaactcgaacaagttttcgctgagagaagaatcagtagggcttttcggaaggtggtgaatttctgaaatcggagaaggagaatagtgaagctctgtatgtcagaggattactactactactattacagtaacaagtactacggcggttacggtgaacttaccaatccattacaatggcctcagctcaggaaaagacgacggtttctgccccttcacgaaatgcttccgccgcttctgaaaccgaatggactgccggtggaaccgtagctgaagtttccgatctttcatccactagatcggctagttcagctgctccgtctacttgacggctgtgattgactctattgatcttcctgctgcgccaaatcagcagcctgttgtgaaaggcctgcctatcttattgagggctcaaactcaccatcccttggaccctttaactgctgctgaaatttctgtggccgtggcaactgtcagggcagctggaagcactcctgaggtgagagatagcatgcgctttgtcgaggttgttttggtggaaccagataagagtgtggttgctttagctgatgcatacttctttcctccttttcaaccatctttattgccgagaacaaaaggtgggcctgtaattcccagtaagcttcctccaaggaaagctaaactgattgtttataacaagaaatcaaatgagaccagcatatggattgttgagctctcacaggttcatgctgtcactcgaggaggacaccaccgtggcaaagtcatttcatctaaagtagtgcctgatattcagccaccaatggacgcagttgaatatgctgaatgtgaagccgtggtgaaggatttccctccttttcgtgacgcaatgaagaagagaggaatcgatgatatggatcttgtgatggtcgatgcctggtgtgcaggttatttcagtgaggctgatgcacctaaccgccgtctaggaaaacctcttatcttttgtagaactgagagcgactgtccgatggaaaatggctatgctcgcccagttgaaggaattcatatagttgttgatatgcagaatatggttgtgatagagtttgaagaccgtaaagtggttccattaccaccggctgatccattgagaaattacactgccggtgaaacgagaggaggggttgaccgaagtgatgttaaacctcttcttattgttcaacctgaaggtcctagcttccgtgtcaatggacactttgttgaatggcagaagtggaactttcgtattggttttacccccagggagggcctggttatctattctgttgcatatattgatggtagcagaggccgtagacctgttgctcatagactgagcttcattgaaatggttgtgccctatggggatccaaatgagccacattacaggaaaaatgcttttgatgcaggggaagatggacttggtaaaaatgcacattccttaaagaagggttgtgattgcttaggctacattaaatatttcgatgcgcattttacaaatttcactggcggtgttgagacaattgaaaattgtgtctgcttacacgaggaggatcacggaatcttatggaagcatcaagattggagaacaggtttagctgaagtacgacgttcccgacgactaaccgtgtctttcatctgtaccgtggcaaactatgaatatggattttactggcatttttatcaggatgggaagatcgaggctgaggtcaagctgactggaattctcagcttaggtgctcttctaccaggggaagttcgaaaatatggaacaactattgcacctggcttgtatgcacctgtacatcagcacttctttgtggctcgcatggatatggctgttgattgcaaatcaggggaatcacataatcaggtggttgaagtaaacgctagagttgaaccaccaggagaaaataatgttcataataatgcattttatgctgaagagagattgcttagaactgaactggaggcaatgcgtgattgtaatcctctaactgcacggcattggattatccggaacacaagaacagtcaatcgcactgggcagttaactggttacaagctagtaccaggttcaaactgtctgccactagctggttcggaggcaaaattcttgaggagagctgccttcttaaagcataatctttgggtcaccccttactctcgtgaagagatttttcctggaggagagtttccaaatcaaaatcctcgtgttggtgaaggtttggctacttgggttcagcagaatcgatccctagaagaaacgcaaatagttctttggtatatttttggacttatacatgttccacggctagaagactggcctgtcatgccagtggaacacattggttttatgctccagcctcatgggttcttcaattgctccccagctgttgatgttcctcccagcatgtctgactcggatattaaggaaaacgggacagtggcaaagtcttgccacaatgatgctgtaatgtctaagctttgagagattcaatctagttttgtcttctcgtttcatgctgtgatgcacaaattgctttgttatctttgtatttggattgaataaacgatttcttgagaacataaacattcgactgcaagttggcatattattgtcctatggtgtctgaatttgtattgttttgtgctaagtaaattaaatactcccaactgcaa

SEQ ID NO: 5435 - DNA, 2229 bp, Amorphophallus konjac
gggatccagatgctgacaagagctcaaactagccacccattggatccattatctgctgctgaaattgcagttgcagtggcgactgtcagggctgctggtgcaacccctgaggtcagggatagcatgcggtttgttgaagtcgttttgttggagccagagaaacaagtagttgcattggctgatgcatacttttttcctcctttccaaccatccctcttgcccaaaactaaaggtgggcctgtgatcccaagcaagcttccaccaaggagggctaggcttgttgtgtataacaagcggtcaaatgagacgagtgtatggatcgttgaactttcagaggtgcatgcaacgactagaggtggccatcacaggggcaaagtcatttcgtcagaagttgttcctgatgtccaacctccaatggatgctatggaatatgctgagtgtgaagctgttgtgaaggatttccctccgtttatggaggcaatgagaaaaagaggcattgaggatatggatcttgtaatggttgatacttggtgtgttggttatcacagtgaagctgatgctcctagtcgcagactggctaagccacttattttttgtaggacagagagtgactgtcccatggaaaatggttatgcacgccctgttgagggtattcatgtacttgtggatatgcagaatatggttgtaattgagtttgaagacagaaaatttgtccctttaccaccagctgatccattgaggaattacacatctggagaaacacgaggtggtgttgaccggagtgatgtcaagcccctgcatattattcagcctgaaggaccaagttttcgtgtaaatggccactttatagaatggcaaaagtggaatttccggatcggttttactcctagggagggcctggtaatttattctgttgcatatattgatgggagtcgggggcgaaggcctgttgcccatcggctgagtgttgtagagatggtggtgccctatggtgatcctaatgaaccccattaccgaaagaatgcatttgatgctggagaagatggactgggtaaaaatgcacattcacttaagaagggatgtgactgcctggggtacatcaaatactttgatgctcattttcctaatttcactggaggtgttgagacaattgagaattgtgtttgtcttcatgaagaggaccatggaattttatggaagcatcaggattggagaacagggttagctgaagtacgtcggtctagacggctaactgtgtcgtttatatgtactgtggctaactatgagtatggattcttttggcacttttatcaggatggcaaaattgaagcagaagttaaacttactggaattctcagcttaggagccttgcaacagggggagtcaagaaagtatggtacaactattgctcctgggttgtatgcaccagttcaccagcacttttttgttgctcgcatggacatgtctgttgattgtaaacctgctgagccttttaaccaggtggttgaggtgaatgtcaaagttgaagacccaggaaaaaataacattcacaataatgcattctacgctgaagaacaggttctgagatctgagttgcaagcaatgcgtgattgtaatccctccactgctcgccactggattataaggaacacgagagctgtcaatcgaactggccaactcactggatacaaactagtccctggttcaaattgcttaccattagccggtccagatgcaaagtttttgagaagagctgcctttttgaagcataatctttgggttacaccatataaacgtaatgagatgtaccctggaggggagtttcctaatcaaaatccacgtgttaacgagggtttggctacatgggtaaagcagaacaggcctcttgaagaaactgatactgttctctggtatgtctttggaataacacatatacctcgtctagaagattggcctgtcatgcctgtggatcgcattggttttatgctaatgcctcacggcttcttcaacagctcaccagcggtggacgtccctcccaattcttcagaagtggatctcaaggaaaatgggtctccgaaacctgtacagacaggcttgcttgctaagctatagatatgcgtatacttctaggattatcgagctattatgttgaagttgtgggcattttaagaaagactgttgattttctggtttggttatctgtttgcttgtttttggtttgaacaattt

SEQ ID NO: 5436 - DNA, 2435 bp, Plantago ovata
actagtaacttcaagtatgggaaagtgttctgtaatttatatcagcttgttggagctcttttgatgtttcaaagctctgtagttttatcatgttccctctctttcaaactaagggatatttttgggcttcctttgtggggatttcttgatgcctcgttatgattaaatctgggattcaggtcatgacaagagctcaaaccagacatcctttggatcctttatctgctattgaaatctctatggcagtggcaactgtcagagcagctggagctacccctgaggttagagatagcatgcgatttgttgaagccgtcctagaggaaccagaaaaacatatagtagcactggctgatgcgtatttctttcctccatttcaaccatcattgttgcctagaaccaaagcagggccagcaatacccagtaagcttcctccaaggcgggctagacttattgtctacaataaaaggtcaaatgagactagtctatggattgtggagctcacagaagtacatgcaacaactcgaggtggacatcacaggggaaaagtcgtttcttcttcagtcatccctgatgttcagccacctatggatgctgtagaatatgcagaatgtgaagctgtggtcaaagattaccttccatttgtagaagcaatgaagaagaggggtattgatgatatggatctagtcatggttgatccctggtgtgtgggttatcacagtgaagctgatgctcctagtcgtagactcgcaaagccacttatattctgtagaacagagagtgattgcccacttgaaaatggttatgcacgacctgttgaaggaattcacgtccttgttgatatgcaaaatatggttgtaattgagtttgaagatcgtaagcttgttccattgcctccagctgatccactcagaaactatacccctgctgaatcaagaggaggagttgatagaagtgatgtgaaacctcttcaaattgttcagcctgaaggtccaagtttccgaatcaggggaaattatgttgagtggcagaagtggaacttccgtattggtttcactccgagggaaggtttggtcattcattctgttgcctatgttgacggtagtcggggtcggagacctatagcccacagattaagttttgtagagatggtcgtgccgtatggggatcccaatgagccgcattacagaaagaacgcatttgatgctggggaagatggattagggaagaatgctcattctctgaagaagggatgtgattgtctgggatacataaaatacttcgacgcccactttgtgaactttactggaggagttgagaccattgaaaactctgtgtgcttgcatgaagaagaccatgggatcctgtggaagcatcaagactggagaactggccttgcggaagttcgaaggtcacggcggctcactgtttcgttcatttgcactgtagctaattatgagtatggattctactggcacttctatcaggatgggaagattgaagcagaagttaaactcactggaattcttagtttaggagcactccagtctggagaagttagaaaatatggcacaacaattgcaccaggattatatgcgccagttcatcaacacttttttgttgctcgtatggatatgtcggttgactgtaaacctggtgaagcacacaatcaagttgttgaagtaaatgtcagagttgaagaacctggcaacgataacatccacaataacgcattttatgctgaggataccttacttagatctgaattagaagccatgcgtgactgtgatccattttctgctcgccattggattataaggaatacacgagttgtcaatcggaatggacaactcacaggctataaattggttcctggttctaattgcctgccattggctggtcctgaggctaagtttatgagaagagctgcatttctgaagcataatctttgggttacggcatatgcacgtggagaggattttcctgggggagagtttcccaaccaaaatccacgtgctggggagggcttggcttcttgggtgaagcaaaatcgatctctggaggaaactgatgttgttctctggtatgtttttggaattacacatgttcctcggctggaagactggcctgttatgcctgttgaacacattggttttgttcttcagccttttggattcttcaactgctctcctgcggtggatgtaccacccaatgcttgcgagatggaagctaaggagagcgatgtaaaagacggtgttgtagttaagccaatctcatctaccctaatagcaaagctctgaaggtgagagagtagagagattgtttgttgtttgtgactgttggtgtaaaattatgataataagtggctttggaaccgtttgattgtgaacccaagtactactacatgtgttgctttatatatttataaataaattata

SEQ ID NO: 5437 - DNA, 2610 bp, Trigonella foenum-graecum
tccggtcatgatgcgagctcaaacctgccatcctttagatccactatcggccgctgaaatatcggtagctgttgcaactgttcgggcagccggggcgacccctgaggtgagggatagcatgcgctttgttgaagtagtcttggtagaaccagttaagcaagttgttgcattggcagatgcatatttcttccctcctttccaaccgtcattgctcccgaggaccaaaggaggaggacctttgattcctacgaaacttcccacaaggaaagcacggctagttgtttacaataaaaagtccaatgagacaagcgtgtggattgttgaacttagagaagttcatgcagcaactcgaggtggccaccacaggggcaaagtcatttcttctcacgttgtgccaaatgttcagccaccaatggatgctgtagaatatgccgaatgtgaagctgttgtgaaggactttcctccatttcgagaagcaatgaagagaagagggattgaggatatggatcttgtaatggttgatgcctggtgtgttggatatcacagtgaaactgatgctccgaaccgcagacttgctaaaccgctattcttttgtaggactgagagtgactgtcctatggaaaacggctatgctcgtccggttgaaggaatacatgtacttgtcgatatgcaaaatatggttgtcctcgagtttgaagatcgtaagcttgttccccttccacaggctgatccacttagaaattatacttctggtgaaacacggggaggagttgatagaagtgatgtgaaacccttacagattattcagcctgaaggtccaagctttcgtgtcaacggtcacttcattcaatggcagaagtggaactttcgtattggtttcactcctagggaaggtttggttatttattcagtagcgtatattgatggaagtcgaggccgaaggccagtggcacacagattgagtttcgttgagatggtggtcccgtatggagatccaaacgatcctcactataggaagaatgcatttgatgctggagaagatggcctcggtaaaaatgctcattctctcaagaagggttgtgattgtttaggctatatcaagtactttgatgctcacttcacaaactttactggaggtgttgaaacaatagagaattgtgtttgcttgcatgaagaggatcatggtattttgtggaagcatcaagattggagaactggtttggctgaagttcgaaggtctcgaaggttgacagtgtcttttatatgcaccgtagctaactacgaatatggatttttctggcacttttatcaggatggaaaaatagaagctgaggtcaagcttacaggaattctcagcttaggggcactgcaaccaggtgaaattcgaaaatatggcacgactattgcacctggattatacgctcctgtccaccaacacttttttgttgctcgtatggacatggctgttgattgcaagcccggtgaagcatttaatcaggttgttgaggtggatgtcaaagttgaagatccgggaaagaacaatgttcacaacaatgcattctatgccgaggaaaaactgcttaaatcagaattggaggcaatgcgtgattgcaaccctttatctgctcgacattggattgttagaaacacgcggactgtaaaccgaaccgggcagctaacaggttacaggctagtacctggttcaaattgcttacctttagctggttcagaagccaagtttatgcggagagcagctttcttgaagcacaatctttgggtcactccttatgttcacaatgaaatgcatcctggaggagagttccctaatcaaaatccacgtgttggagagggtttggctacttgggttaagcaaaatagatcactggaagaagctgatatagttctttggtatgtatttggagtgacacacattccacgattggaagactggcctgttatgccggtggaacgcatcggttttatgcttatgccacatggatttttcaattgctccccagctgtagatgttcccccaagtgctggtgatttggatgataaggataatggactgcctgctaaacctattcagaatgagttgattgcaaagttgtgaatgagccaaaagtagagacatttggtgttatgtttatctaattattttattaaaatttggtttcggcctaactcaatcctacaaaattgacttgtaaggcaagggatgcctcccatttatataaatagattttcaggtcatatcttatttgtaaggcaatgtaagacttagaacacagtgagtgcaacagtttgatttaattatactgcttgctagttgaactgattcaaaattaagcttaatgatggatatttaagagtatctatttagctgatgatgcatctgctgtcattgcaaaatgataatacttcgtgcatgtttggaatcacggcgagtttgacaaaattacgttgacatatactaaagtgcatgtttggaactctaaagtgtagttttttttttgttgttgtcaaaatgacggtgtcacgctgtaattctgcacaactcaccgcctattttaacatatacttcgagtgtgtttggttttgcgtcgcgaa

SEQ ID NO: 5438 - DNA, 4704 bp, Vitis vinifera
atgccttttaggttctataaatactagtggattgaaggggggaggattctcaattctgtgttggatgaagcaaccctagggagggtggatttgtggagaggaaaggtgtgagtgagactcgtggtggaggtggtggtgcgtgtgtgtgtgaagagagatttgctgtatgtcagtgggttgtagtgagagctattggtactacggtggatttggagtgtttgcgaacccattgcaatggccacagcttcgaaaaaagcgacgtcttgctgcattggagatgattcccgttccattcgacgggaggccgtggcggctgccgctgcggcgccatcagtcgctgctgccgccgccgccgctgttgccgatgtggagcaggattggagcggcgttggtgtggtcggggacgggaagaaggctgcccttgcgtcgttgattcggccggttgaaccgattgctggagcttctgcaaatgcctccgtcaaagggatccagatcatgacaagggctcaaacctgccatccgttggacccattatctgcaactgaaatctcagtggctgtggcaactgtcagagctgctggagccactcctgaggtcagagatggcatgcgatttgttgaagtggttctgtatgaacctgataaacatgttgttgcattagcagatgcatatttcttcccccctttccaaccatcattgcttcccaggaccaaaggtggacctgtaattcctagcaagctccctcctaggaaggctagacttattgtctacaataaaaaatcaaatgagacgagcatttggattgtggagctctcagaagtacatgcagcaactcgaggtggtcatcataggggaaaagccattacaacacaagttgtccctgatattcagcctccaatggatgctgtggaatatgctgaatgtgaagctgttgtcaaagactgtcctctgtttcgagaggcaatgaagaagaggggtgtggaggatatggaccttgtgatggttgatgcctggtgtgttggttaccatggtgaagctgatgctcctagccgtagacttgccaaaccactcatattctgtagaacagagagtgattgccctatggaaaatggttacgcacgcccagttgaaggcatctatgtagttgttgatatgcaaaatatggttgtaattgagtttgaagaccgtaaacttgttccattgcctccagctgatccgttgaggaactatactcctggtgagacaagaggaggtgttgatcgaagtgatgtgaagccgctacagattgttcagccagaaggtccaagctttcgtgtacatgggcactatgtagaatggcagaagtggaatttccgtattggtttcactcccagagagggtttggttatccattctgttgcatatgttgatggtagtcggggtcgaagacctgtagctcataggttgagttttgtggagatggttgtaccttatggagacccgaacgaaccccattacaggaagaatgcatttgatgctggtgaagatggcctgggaaaaaatgcaaactctcttaaaaagggatgtgattgtctagggtttatcaaatactttgatgcccactttacaaacttcactggaggtgttgaaacgattgaaaattgtgtttgtttgcatgaagaggatcatggtatcctttggaagcatcaagactggaggacaggcttagcagaagttcgtaggtctaggaggctaacagcttctttcatatgtactgtggctaattatgagtatggattcttctggcacttttatcaggcaatacgtaattccttcttgttacaggatgggagaattgaggcggaagttaaacttacaggtattctcagcttaggagcgctgcaaccaggagaatctcgaaaatatggcacaaccattgctccagggctatatgcaccagttcatcaacacttctttattgctcgtatggacatggctgttgattgtaaacctggagaagcatttaaccaggttgttgaagtgaacatgaaagttgaaaaccctgggaaggataatgtgcacaataatgcattttatgctgaagaaaaactgctcagatctgaaatgcaagctatgcgtgattgtgatccattgtctgcccgccattggattgttaggaacacaagaactgtcaacaggactggacagctaacaggctacaagttagtacctggttcaaactgcttgccattagctggttctgaggccaagtttttgagaagagctgctttcttgaagcataatctttgggttaccccatatgcgcgagatgagatgtttcctggtggggagtttcctaatcagaatccacgtgttggtgagggattggctacatgggttaagcagaatcgtcctctggaggaaactgatatagttctctggtatgtttttggacttgtacatgtgcctcgcttggaagactggcctgttatgccagtggaacgcatcggttttatgcttcagccacatgggttcttcaactgctcacctgcggtggacgtccccccgaacgcttttgcagcaattatgggtgaagtcgaagagaagacgattcaagatgaactgactgttacgattcaactcgccgaccgagtcatcaaatcggcggaggaggcggagtcgtccaaagcggagtgctccgagattgcgcgtcaagtggagaggctgtccaagatgctgcggtctgcggcgcgcctcgccacctccacgcagtggctgtacgagcggccagtgcgccgtatcgccgccgacgtgacgaagaacctggacagagcgctgacgctggtgcggaagtgcaagcacagcggcgttctccgccaggtgttctcgataaccaccgctgctgatttccggaaggtattggcgcttctggagtcttcgatcggcgacttgaagtggcttgtgaccatcgtcgacccggatgacatcaacctcactctccctcccatagccaacaacgaccccactctcgcctgggtctggtcctatatagctaccattcaaatgggtcaacttcgggaccgcgttgaagccgcaaacgccctagttcttttggctcacaagaacgaccgcaccaagaagattgtggtggacgaaggtgggatcatgccgttgctcaagctcctgaaagaaggcgcttccgccgacgcccaaattgccgcagctaatgctcttttccacatcggcaacgaggaagaaagagtacgatcgatagcggacgcggccggagttccaattattgttcaggttcttggggaatcggtgatgagggttcaggttagtgtggctaatttggtggcgagaatggcggaaatggactctgctgtgcgtgaggccttcgcgagagagaacgtgacaaggccattggtgtcgctgctgtctgtggatacggttttggttctggatgatcctaagctcaaaccgagtaagcctagtatttcatctcttgttcaatttaataaggagttagcgggaaagtctgcgggccataacagttacaaccctagcttgaattctgtatcttcattcacttcttctggtgggcattcgtctttgtctgttcattcctcttcagaaggtagtagtaggggtgggcataatagaaaggacagggaggttgagacgcctgagttgaaattgaagctcaaggttagttgtgcagaggctctgtggaaactgtccaaagatagtgtgttaaatagtaggaagatcactgagactaaggggttgatttgtttggcaaagatcattgagaaggagaaaggggagttgcagtataattgcttgatggctgtaatggagatagctatggtggcagagcaagatgctgaccttcgacgggcggctttcaagactagttctcctgctgccaaagcagtcctggatcaacttttaagagtgattcaagaagagagcagctcaacaatgaaaattcctgctataaaatcaattgggtccttggcacgaacttttcctgcaagggaaacccgaataattggccccttggtggcacagcttagcaatagtgataatgaggtagctatagaagctactatcgccctgggcaaatttgttcatccagaaaatttcaatcgtgttgagcatgcaaaggcaattatcgagtttgatggggttcccccccttttgagattgttgaggaccagtgaacgggctaacatttatggacttatattactatcttatcttgcattgcatgttggcaacagcaaagcgcttgaacaagctcaggccttgagtgttcttgacttggcaattcgttctggagtgcctcaagattataaagagttgtttgccagagctatacataaccttaatctttatcaagctggagttcatacccacagaccatatcctccatagaactgaagaagaggttgcaaataaccaaggttgtgttgtagctggaaacttattgagaacaaggcagtaagtacttctcaaccagcttgaccaaattatatgaagtcctattatctcatctttaagttatgtaaatggtttgaatctaatatttttgttatactggagttatataaaaaatagctgatggatttgttatcagtttttgctttatatgaggatggcactaggagaaatactgcccacttgattagataaattatatcagttttggtctataacttt

SEQ ID NO: 5439 - DNA, 2454 bp, Solanum phureja
ctttttttaaagttacaaaattatctcttcataatatatgccattttcttcctttctaataatcactactcacaatatggccactacttcaaaaaaagtggcaaaatcttttactgattcctgtccttctacctccctcctccgtcgcgaggcgacagcagcgactgctgttgtggtggatgacggtccgcagaagtggaccgtcatcccgtccacagacgataataagcagaaacaaactccatcagctatagcttcattggcaagcaatactgaacctcttccctccaatacctcaaccaaaggtatccaaatcatgctaaaggctcaaacttgccatcctttggatcctttatctgctgctgagatctctgtagctgttgcaaccgttagagctgctggtgaaacgcctgaggtcagagatggaatgcgatttattgaggtggttttattggaaccagataaaagtgttgttgctttagcagatgcatatttctttccacctttccaatcatcgttgatgccccgaaacaaaggaggatctctaattccaactaaacttcctccaagaagagctagacttattgtttacaataagaaaacaaatgagacaagcatatggattgttgagctaactgaagtacacgctgctgctcgtggcggacatcataggggaaaagttatctcatctaattctgtaccagatgttcaaccacctatagatgctcaagaatatgctgaatgtgaagctgtggtgaagaattatccgcccttcagagaagcaatgaagagaaggggtatcgatgacatggatctcgtgatggttgatccttggtgtgttggttatcatagtgaggcggatgctcctagccggaggcttgcaaaaccactagtattctgcagatcggagagcgattgcccaatggaaaatggatatgcaagaccagttgaaggaatacatgtgcttgttgacgtgcaaaatatggagatcatagaatttgaagatcgaaaacttgtcccgttacctccagttgatccattgaggaattatacagctggtgagacaagaggaggggttgatcgaagtgatgtgaaacccctgcatattattcagcccgagggtccaagctttcgcattagtgggaactatgtagaatggcaaaagtggaactttcggataggtttcactccgagagagggtttagttatacactctgttgcatatcttgatgggagcagaggccgtagacccatagcacatcgattgagttttgtggagatggttgtcccctatggagatccaaatgatccacattatagaaagaatgcatttgatgcaggagaagatggcctcggaaagaatgctcattcactaaagagaggatgtgattgtttaggatacataaagtacttcgattcccattttacaaatttcacaggaggagttgaaacaacagagaattgtgtatgcttgcatgaagaagatcatggaatgctttggaagcatcaagattggagaactggcctttctgaagttagacgttctagacgattgacagtgtcttttgtttgtacagttgccaattatgaatatgcattctactggcacttttaccaggatgggaaaattgaagcagaagttaaactcacgggaattcttagtttaggagcattgcaacctggagaatctcgcaaatatggcaccacaattgcaccagggttgtatgcaccagttcatcaacatttcttcgtagcacgaatgaatatggcagttgattgtaagccaggagaagcacacaatcaggttgttgaagtaaatgttaaagttgaagaacctgggaaggaaaatgttcataataatgcattctatgctgaagagacattgcttaggtctgaattgcaagcaatgcgcgattgtgatccattctctgctcgtcattggattgttcggaataccagaacagttaatagaactggacaactaacagggtacaagcttgtacccggtccaaactgtttgccattggctggtcccgaggcaaaatttttgcgaagggctgcatttctgaagcacaatttatgggttacacagtatgcacctggagaagattttccaggtggagagtttcctaatcaaaatccccgtgctggcgaaggattagcttcttgggtcaagcaagaccgacctctggaagaaagtgatactgttctctggtacatttttggaatcacacacgttcctcggttggaagattggcctgttatgccagtagaacacattggttttatgcttcagccccatggattctttaactgctctccggctgttgatgtccctccgccttctggatgtgactcagaaagcagagacagcgaagtcacggataatagtagtgtagcaaaacacactaccactggtttgatggccaagctttgaaggacatgagccttcaa

SEQ ID NO: 5440 - DNA, 2704 bp, Solanum lycopersicum
ggtctttaaaagtcttcttttaaaaattacaaaattatctcttcataatataagccacttttctcctttctctaataatcactaatcacaattatggccactaattcaaaaaaagtgacaaaatcttttactaattcctgtccttcgacttcccttctcctccgtcgcgagacgacagcagcgactgctgtcgttgtggatgacggtccgcagaagtggaccgtcatcccatctgtggatgataataagcagaagaaaacgtcatcatcagctatagcttcattggcaagtaatactgaacctcttccctccaatacttcaaccaaaggtatccaaatcatgctaagggctcaaacttgccatcctttggatcctttatctgctgctgagatctctgtagctgttgcaaccgttagagctgccggtgaaacgcctgaggtcagagatggaatgcgatttattgaggtggttctattggaaccagataaaagtgttgttgctttagctgatgcatatttcttcccacctttccaatcatcgttgatgccccgaaccaaaggaggatctctaattccgactaaacttcctccgaggagagctagactcatcgtttacaataagaaaacaaatgagacaagcatatggattgttgagctaactgaagtacatgctgctgctcgtggcggacatcataggggaaaagttatctcatctaatgttgtaccagatgttcaaccacctatagatgctcaagaatatgctgaatgtgaagccgtggtgaagaattatccgcccttcagagaagcaatgaagagaagggatatcgatgacatggatctcgtgatggttgatccttggtgtgttggttatcatagtgaggcggatgctcctaaccgtaggcttgcaaaaccactagtattctgcagatcggagagcgattgcccgatggaaaatggatatgcaagaccagttgaaggaatacatgtgcttgttgatgtgcaaaacatgcagatcatagaatttgaagatcgaaaacttgtcccgttacctccagttgatccattgaggaattatacagctggtgagacaagaggaggggttgatcgaagtgatgtaaaacccctgcatattattcagcccgagggtccaagctttcgtattagtgggaactatgtagaatggcaaaagtggaactttcggataggtttcaccccgagagaggggttagttatacactctgttgcatatcttgatggtagcagaggtcgtagacccatagcacatcgattgagtttcgtggagatggttgttccctatggagatccaaatgatccgcattatagaaagaatgcatttgatgcaggagaagatggtctcggaaagaatgctcattcactcaagagaggatgcgattgtttaggatacataaagtacttcgatgcccattttacaaacttcacaggcggagttgaaacaacagagaattgtgtatgcttgcatgaagaagatcatggaatgctttggaagcatcaagattggagaagtggccttgctgaagttagacgttcaagacgattgacagtgtcttttgtttgtacagttgccaactacgaatatgcattctactggcacttttatcaggatgggaaaattgaagcagaagttaaactcacgggaattcttagtttaggagcattgcaacctggagaatatcgcaaatatggtacaacaattgcaccaggattgtatgcaccagttcatcaacatttcttcgtagcacgaatgaatatggcagttgattgtaagcctggagaagcacacaatcaggttgttgaagtaaatgttaaagttgaagaacctgggaaggaaaatgttcataataatgcattctatgctgaagaaacattgcttaggtctgaattgcaagcaatgcgcgattgtgatccattctctgctcgtcattggattgttcggaataccagaacagttaatagaacaggacaactaacaggatacaagcttgtacctggtccaaactgtttgccattggctggtccagaggcaaaatttatgcgaagggctgcatttctgaagcacaatctatgggtaacacagtatgcacctggagaagattttccaggaggagagtttcctaatcaaaatccccgtgctggcgaaggattagcttcttgggttaagcaagaccgtcctctggaagaaagtgatactgtcctctggtacatttttggaatcacacacgttcctcggttggaagattggcctgttatgccagtggaacacattggttttatgcttcagccccatggattctttaactgctctccggctgttgatgttcctccgccttctggatgtgactcagaaaccagagacagcgatgtcacggaaagtactagtgtagcaaaacacactaccactggtttgatggccaagctttgaagtacatgagacttcaaagcttcatttttcatttgataagacttaaaagagtaatgaattaggaggtgcaggagcatggacatgtttaagcaaagaaagtcttgtttgttgtgtatttatcttaaacaatgtcacaagaaatactaataaaatcggatcgttgagtagctataaatgtcgcggttcttgcattttatcttgtactagtagttgttaaccatattgctcagagttttacaacaaa

SEQ ID NO: 5441 - DNA, 2542 bp, Nicotiana tabacum
gattacacttggcattttcattccattcgcaatggccgcaactttgcacaaggtgactccgactactgcttcggcctccgcttctatcgcccgtcgtgagtccgccgcagcctccgtcctggtggacgatcagcagaaacaaacgccggctctgacgtcattgcttaactctcaacctccttcctccaatccctctagcaaagggaaacaaatcatgccaagagctcatacatgccatcctttggaccctttatctgctgctgaaatctctgtggctgtggcgaccgtcagagctgccggtgaaacacccgaggtcagagatggcatgcgctttattgaggtggttcttctggaacctgataaaagtgtcgttgcactggctgatgcctatttcttcccacctttccaatcttcattgatgtccagaaggaaaggagggcttcccattcctactaagcttcctccaaggcgagctagacttattgcatataataagaaaacaaatgagacaagcatatggattgttgagctagctgaagtacatgctgctgctcgaggtggacatcacaagggaaaagtgatttcatccaatgttgttccagatgttcagccacctatagatgcacaagagtatgctgactgtgaagctgtagttaaaaattatcctccttttagggaagcaatgaagagaaggggtattgatgacatggatgttgtgatggtggacccctggtgcgttggttatcacagtgaggctgatgctcctagccgcaggcttgccaaaccgctagtattctgcagaacagagagtgactgcccaatggaaaatggatatgcaagaccggttgaaggaatatatgcccttgttgatgtgcaaaacatgcaggtgatagagtttgaagaccgcaaacttgtacctttacctccagctgatccactgaggaattacactgctggtgagacaagaggaggggtcgatcgaagtgatgtaaaacccctccagattattcagccagagggtccaagctttcgagtcaatgggaactatgtggaatggcaaaagtggaacttccgagtaggtttcacccctagggagggtttggttatacactctgtggcatatcttgacggtagcaggggtcggagacccatagcccataggttgagttttgtggagatggttgtcccctatggggatccaaatgacccacattacagaaagaacgcttttgatgcaggagaagatgggctcggaaagaatgctcattcacttaagaggggatgcgattgtttaggatacataaagtactttgatgccaattttgcaaattttactggaggagtagaaaccactgaaaattgtgtatgtttgcatgaagaagatcacgggatgctctggaagcatcaagattggagaactggccttgcagaagttagacggtctagacgacttacagtttcttttatttgcactgtggccaattatgaatatggattctactggcacttataccaggatgggaaaattgaagcagaagtcaaactcacaggaattctcagtttgggagcattgccccccggagagtctcgtaaatatggcaccacaatagcaccaggattgtatgcacctgttcatcaacacttctttgttgctcgtatgaatatggcagttgattgtaaaccaggagaagcacacaatcaggttgttgaagttaatgtaagagttgaagaacctgggaaagaaaatgttcacaacaatgcgttctatgctaaggaaacagtgcttacgtctgaattgcaagcaatgcgggactgtgatactttatctgctcgtcattggattgttaggaacacaagaacatccaatagaacaggacagctaacagggtacaagctggtacctggccctagctgtttgccattagctggtcctgaggctaagtttttgagaagagctgcatttttgaagcacaatctatgggttacacaatatgcacccggagaagattttccagggggagagttccctaatcaaaatccacgtgttggtgagggattagcttcttgggttaagcaagatcgttctctggaagaaagtgatgttgttctctggtatgtttttggaatcacacatgttcctcggttggaggactggcctgttatgccagttgaacatatcggttttatgcttcagccgcatggattctttaactgctctcctgctgtagatgtacctcctcctcggggatgtgacttggaaatcaaagacagtgatggttcagaaaatggtgtagcaaagcccactcccagtagtttgatggccaagctttgaaaggtttgtgattcagaaaatagtcctctcgtattatctgcacagacacacaacaggcaaacttccatcttctgtttctttcggtactgtcctgaattagttggtgctaccacatggatgttgttatactttagataacgtgtttatgcaaagcatgtcctgttttctattgaccttgaacatcgttatatagaaaaactaataacattc

SEQ ID NO: 5442 - DNA, 2730 bp, Solanum lycopersicum
atttactccactcacgctttttcgtcttcactattctccattgaaaaactcaaaaacaagttttcgcagagagaagaatcagtcggaagaaggtggtgaatttgtcaaatcggagaaggagaatagtgaatctctgtatgtcagaggattactactactactattacagtaacaagtactacggcggttacggtgaacttaccaatccattacaatggcctcagctcaggaaaagacgacggtttctgccccttcacgaaatgcttccgccgcttctgaaactgaatggaatgctggtggaaccgtaactgatgtttctgatctttcatccaccagatcggctagttctgctgctccctctactttgacggctgtgattgattctattgatcgtccttctgcgcaaaatcagcagcctgctgtgaaaggactgcctaccttattgagggctcaaactcaccatcccttggaccccttaactgctgctgaaatttctgtggccgtggcaactgtcagggcagctggaagcactcccgaggtgagagatagcatgcgctttgttgaggttgttttggtggaaccagataagagtgtggttgctttagctgatgcatacttctttcctccttttcaaccatctttattgccgagaacaaaaggtgggcctgtaattcccagtaaacttcctccaaggaaagctaaactgattgtttataacaagaaatcaaatgagaccagcatatggattgttgagctctcacaggttcatgctgtcactcgaggaggccaccaccgtggcaaagtcatttcatctaaagtcgtgcccgatatacagccaccaatggacgccgttgaatatgctgaatgcgaagccgtggtgaaggatttccctccttttcgtgatgcaatgaagaagagaggaatagatgatatggatcttgtgatggtcgatgcctggtgtgcaggttacttcagtgatgctgatgcacctaaccgccgtctaggaaaacctcttatcttttgtagaactgagagtgactgtcctatggaaaatggctatgctcgcccagttgaaggaattcatatagttgttgatatgcagaatatggttgtgatagagtttgaagatcgtaaagtggttccattaccaccggctgatccattgagaaattacactgccggtgaaacaagaggaggggttgaccgaagtgatgttaaacctcttcttattgttcaacctgaaggtcccagcttccgtgtcaatggacactttgttgaatggcagaagtggaactttcgtattggttttacccccagggagggcctggttatctattctgttgcgtatattgatggtagcagaggccgtagacctgttgctcatagactgagcttcattgaaatggttgtgccctatggggatccaaatgagccacattacagaaaaaatgcttttgatgcaggggaagatgggcttggtaaaaatgcacattccttaaagaagggttgtgattgcttaggttacattaaatatttcgatgcgcattttacaaatttcactggcggtgttgagacaattgaaaattgtgtctgcttacacgaggaggatcatggaatcttatggaagcatcaagattggagaactggtttagctgaagtacgacgctcccgacggttaactgtgtctttcatctgtaccgtggcaaactatgaatatggattttactggcatttttatcaggatgggaagatcgaggctgaggtcaagctgactggaattctcagcttaggtgctcttctaccaggggaagttcgaaaatatggaacaactattgcacctggcttgtatgcacctgtacatcagcacttctttgtagctcgcatggatatggctgttgattgcaaatcaggggaatcacataatcaggtggttgaagtaaacgctagagttgaaccaccaggagaaaataatgttcataataatgcattttatgctgaagaaagattgcttagaactgaactggaagcaatgcgtgattgtaatcctttaactgcacgccattggattatccggaacacaagaacagtcaatcgcactgggcagttaactggttataagctagtaccaggttcaaattgtctgccactagctggttcagaggcaaaattcttgaggagagctgccttcttaaagcataatctttgggtcaccccttactctcgtgaagagatgtttcctggaggagagtttccaaatcaaaatccccgtgttggtgaaggtttggctacttgggttcagcagaatcgatccctagaagaaacgcaaatagttctttggtatatttttggacttatacatgttccacggctagaagactggcctgtcatgccagtggaacacattggttttatgctccagcctcatgggttcttcaattgctccccagctgttgatgttcctcccagcatgtctgactcagatattaaggaaaacgggacagtggcaaagtcttgccacaacgatggtgtaatgtctaagctttgatagattcaatctagttttgtcttcagggatcgtgttgcacaaatgctttcttatctttgtatttggattgaataagcgatttcttgtgaacataaacattcgactgcaagttggcatattattgttctatggtgtctgaatttgtcttgttttgtgctaagtaaaataaatactcccaactgcaa

SEQ ID NO: 5443 - DNA, 2459 bp, Trifolium pratense
tccaatccgatcgcgttcctaacaactccgttgccttgattcgtcctctcgattcgcttccagaaccttccaccaccaatgctccttctgctaagggaatcatttcaatgacaaggcctcagtcaagccatcctttggacccgttaactgcggcggaaatttctgtggcagtggcaactgtgagggctgctggagccactccagagcttagagatagtatgcgcttcattgaagtagttttgctggaaccagataaacatgttgttgcactggcagatgcttattttttccacctttccaaccatcattacttcctagaagtaaaggagggcctgtaattcccactaaactccctccaagatgcgctagacttgttgtttacaataagaaatcaaatgcgactgctctgtggattgtcgaattatcacaagtgcatgctgtaactcgaggtggccatcatcgaggaaaagtaatttcttcacgtgttgttcccgatgttcagcctccaatggatgctgaggaatatgcagaatgcgaggctgttgttaaaagtttccctccttttatagatgctatgaagaaaaggggtattgaagacatggaccttgtaatggttgatccctggtgtgttggttatcacagtgaagctgatgctcctggtcaaagacttgctaaacctctcctattttgtcgatctgagagtgactgccctatggaaaatggttatgcccgcccagttgagggtatctatgttctcgttgatatgcaaaacatgaaggtgatagagtttgaagaccgtaaacttgttcctctgcctccagttgatcccttgaggaactatactcctggtgaatccagaggtggctccgatagaagtgatgtcaaacccttacaaattattcaacctgaaggtccaagctttcgtgtcaatgggtattatgttgaatggcagaagtggaattttcgtattgggttcacacccaaagaagggttgattatatattctgttgcatatgttgatggtagtcgagggagaaggcctgttgctcataggctgagttttgtggaaatggttgtaccctatggagatccaaatgaacctcattataggaaaaatgcttttgatgccggggaagatggcttggggaaaaatgcacattccctcaagaagggatgtgattgtttgggctacatcaaatattttgatgctcactttacaaatttcactggtggggtggaaaccattgaaaattgtgtatgtatgcatgaagaggatcacgggattctctggaagcatcaagactggagaactggcttagcagaagtccggaggtctagaagactttcagtttcttttgtatgcacggtggccaactatgagtacgcattttttggcatttttatcaggatggaaagattgaagccgaagtcaagctgactggaattctcagcttaggcgccttgatgccaggagaatatcgaaaatatggaaccatgattgcaccagggctatatgctccagttcatcaacactttttcgttgctcgcatggacatgtctgttgattctagacctggtgaagctttgaatcaggttgtggaggtcaatatgaaagttgaagaacccggtgagaataatattcaccacaatgcattctatgccgaagagactttgctcagatctgaatcggaagcaatgcgtgattgcaatcctttaactgctcgacattggattgtaaggaacacaagaactggcaacagaaccggacaattgacaggctacaagctggtaccaggctcaaactgcttgccattggcaggttctgaggccaagtttttaagaagagctgctttcttgaagcataatgtttgggtaacagcatattcacgtgatgaaatgtttcctggaggagaatttcctaatcaaaatccacgtgctggggaaggactagctacatggattaagcaaaaccggtctttggaagaaactaatatagttctttggtatgtatttggaatcacgcatgttcctcgtctagaagactggcctgttatgccagtggaacacattggttttatgctcatgcctcatggattcttcaattgttcccctgcagtagatgtcccgcctaattcatgtgaagtggaatctaaagacactgacatcaaggataatggtgcttcgaagccaattcagagcggtttagtgtcaaagctttaggcgcttgtctcattctgaagttatggcttcccgctgctgaaacaggagaaacaccaagttgagcagattacatgttaatctacaataataatcataatcaagctataaacttaaatcctgattttatagtttatgctgggtagttggctggtaatatccattaggtttttctttgtacttgatacggttatgttttcaaattcgatgtgaaactactggttagatttttctggtggtct

SEQ ID NO: 5444 - DNA, 2831 bp, Trigonella foenum-graecum
aactggagtgaagagaagagtctctatctatcgtctttcaactttgcttcttttctttctagaattttcctttgttactgtgtgttgcagatttcacgacggttgcgcggtggaagatcggaagaagaagagggtgagtcgccgtacctgcatgtcagtgtactgtcttgatacctattgtggtgctggaatcggcgagatagagaatcctttgcaatggcctcagcttcgcaaaagacgacgtcaccaccgtcttcttcttgttgtccccctggcgactcttcccgcttagccgccgtctccgccgcccctgccgttgttcaatccgatcgcgttcctaacaccgttgccttgattcgcccgcttgattcgcttccagaaccttccactaccaatgccccttccgctaagggaatcacttcaatgacaaggcctcagtcaagccatcctttggatcctttatctgccgctgaaatttctgtggcagtggcaactgtgagggctgctggagccactccagagcttagagatagtatgcgcttcattgaagtagttttgctggaaccagataaacatgttgtagcactggcagatgcttattttttccacctttccaaccatcattacttcctagaagtaaaggagggcctgtaattcccactaaactccctccaagatgcgctagacttgttgtttacaataagaaatcaaatgagactgctctgtggattgtcgaattatcacaagtgcatgcagtaactcgaggaggccatcatcgaggaaaagtaatttcatcaaatgttgttcctgatgttcagcctccaatggatgctgaggaatatgcagaatgcgaggctgttgttaaaagttttcccccttttatagaggctatgaagaaaaggggtattgaagacatggatcttgtaatggttgatccctggtgtgttggttatcatagtgaatctgatgctcctggtaaaagacttgctaaaccactcttattttgtcgatctgagagcgactgccctatggaaaatggttatgcccgcccagttgagggcatctatgttcttgttgatatgcaaaacatggtggtgatagagtttgaagaccgtaaacttgttcctcttcctccggttgatcccttgaggaactatactcctggtgaaaccagaggtggttctgatagaagtgatgtaaaacccttacaaattattcaacctgaaggtccaagctttcgtgtcaatgggtattatgttgaatggcagaagtggaattttcgcattggattcacacccaaagaaggtttgattatatattctgttgcatatgtcgatggtagtagagggagaaggcctgttgctcataggctgagttttgtggaaatggttgtaccctatggagatccaaatgaaccacattataggaaaaatgcttttgatgccggggaagatggcttgggaaaaaatgcacattccctcaagaagggatgtgattgtttgggctacatcaaatattttgatgctcacttcacaaatttcactggtggagtggaaactatcgaaaattgtgtatgtttgcatgaagaggatcatgggattctctggaagcatcaggactggagaactggcttagcagaagtccgaaggtctagaagactttcagtttcttttgtatgcacagtggccaattatgagtatgcatttttttggcacttttatcaggatggaaagattgaagctgaagtcaagctgactggaattctcagcttaggagccttgatgcctggagaatttcgaaaatatggaaccatgattgcacctggtttatatgctccagttcatcaacactttttcgttgctcgcatggacatgtctgttgattctagacccggtgaagctttgaatcaggttgtggaggtcaatatgaaagttgaagaacctggtgcgaataatattcacaataatgcattctatgcccaagagactttgctgagatctgaaatggaagcaatgcgtgattgcaatcctttgactgctcgacattggattgtaaggaacacaagaaccggcaatagaactggacaattgacaggctacaagctggtaccaggttcaaactgcttgccgttggcaggttctgaggccaagtttttaagaagagctgctttcttgaagcataatgtttgggtaacagcatattcacgtgatgaaatgtttcctggaggagaatttcctaatcaaaatccacgagttggcgaaggactagctacatggatcaagcaaaaccggtctttggaagaaactaatatagttctttggtatgtatttggaatcacgcatgttcctcgtctagaagactggcctgttatgccagtagaacacattggttttatgctcatgcctcatggattcttcaattgttcccctgcagtagatgtcccacctaactcatgtgaagtagaatctaaagacagcgaaatcaaggataatggttcttcgaagccaattcagagcgggttagcgtcgaagctttaggcaatacaggggaaacgcacaggggaaacgcaaagttctattttggcgtccactgaaacaccaagttgagcagattgtatttttaatctacaataataataaagctatggacttaaatcttgattttctagtttatgatgggaagcttgctggtaatattcattagatttgtcttggtacctgtgaggattatggtttcaatttcgacgttaaaattccgcttagcttaaaataagtggtttgttactatggtgtgttatcaagattcagaaatcactaaatctggtggtgttt

SEQ ID NO: 5445 - DNA, 2386 bp, Quercus alba
aggtatcctaagcatggtgagagctcaaactagtcaccctttggaccctttatctgctgctgaaatctctgtggcagtggcaactgtccgggcagctggagcaacccccgaggttagggatagcatgcgctttgttgaagttgctttggtggaaccagcaaagagtgttgttgcgttggcagatgcatattttttccctcctttccagccatcattacttcccaaagcaaaaggcggacctgtaattcctagtaagcttcctccaaggcaagcaagactagttgtgtataacaaaaagtcgaatgagacaagtgtgtggatcgttgaactatcggaagttcatgcagcaactcgaggtggtcaccataggggcaaagttatttcatccaaagttgttccagatgttcagcctcccatggatgctgttgaatatgctgaatgtgaagctgttgtaaaagactttcctccatttagggaggcaatgaaaagaaggggcattgaggatatggatcttgtgatggtcgatgcatggtgtgctggatatcacagtgatgctgatgctcctagccgcagacttgctaaaccgctaatcttttgtagaactgagagcgactgccctatggaaaatggttatgctcgcccagttgaaggaatccatgtactagttgatatgcaaaatatggtgcttattgagtttgaagatcgtaaacttgttcccttaccacctgctgacccattaagaaattacactcctggagaaacacgagggggtgttgatcgaagtgatgtgaaacccttacaaattattcagcccgagggtccaagttttcgtgttaatgggaactttgttcaatggcaaaagtggaattttcgtgtcggtttcactcccagggaaggtttgataatttattctgttgcatatattgatggtagtagaggtcggagacctgtggcccacaggttaagctttgttgagatggtggtcccttatggagatccaaatgaaccacattacaggaagaatgcatttgatgcaggggaagatgggcttgggaaaaatgcacattcacttaagaagggttgtgactgtttagggtatgtcaagtacttcgatgcacacttcacaaattttaatgggggtgttgatacaattgagaattgtgtatgcttgcatgaagaggatcatgggcttctgtggaaacatcatgattggagaactggtttagcagaagttcgacgatcgagaaggctgacggtgtcttttatatgcactgtggctaactatgagtatggattcttctggcatttttatcaggatggaaagatcgaagcagaggttaaactcacaggaattcttagcttaggagcattacaacaaggggaagcccgaaaatatggtacgaccattgctcctggcttatatgcacctgtccatcaacatttttttgtagcacgtatggacatggcagttgattgcaagcctggtgaagcatttaatcaggttgttgaggtgaatcttaaagttgaagagccagggaaagataatgttcataataatgctttctatgctgaagaggaactactgagatctgaaatgcaagcaatgcgcgattgtaatcctttatctgctcgccattggattatcagaaacacaagaaatgtcaaccggactggacagctaacaggttacaaacttgtacctggttcaaattgtttaccattagctggttctgaggcaaaatttctaaggagagccactttcttgaagcataatctttgggtcacaccttatgcacgtgatgaaaagtatccgggaggagagtttcctaatcaaaatccacgtgttggggaaggattggctacttgggttaatcaaaatagatcattggaagaagctgacatagttctttggtatgtatttggaatgacacacattcctcggctggaagactggccagtgatgcctgtagaacgccttggttttatgctcatgccacatggattctttaattgctcaccagcagtggatgtccctccgaatacaagcgatgtggaaattaaggacaatgggatggctgtaaagcctatccagaatgagctactagctaagctttgaaagcaatatttaacaggatttcagtgctgttgtttattaagagtgggagaacaggattacattgctgtttaatttgtcggatttaggtatgtttgtcaaataattgagccataggtcttactcgatactctgagtattttatgtaccatttgattataaggattaaggtggcgtgccctcagtgtcattgcatggctcttcaaaatactaatataaatcaatgtatactgaaccaccagtattatatgatattttatggtgctgaagacc

SEQ ID NO: 5446 - DNA, 2379 bp, Quercus alba
aggtatcctaagcatggtgagagctcaaactagtcaccctttggaccctttatctgctgctgaaatctctgtggcagtggcaactgtccgggcagctggagcaacccccgaggttagggatagcatgcgctttgttgaagttgctttggtggaaccagcaaagagtgttgttgcgttggcagatgcatattttttccctcctttccagccatcattacttcccaaagcaaaaggcggacctgtaattcctagtaagcttcctccaaggcaagcaagactagttgtgtataacaaaaagtcgaatgagacaagtgtgtggatcgttgaactatcggaagttcatgcagcaactcgaggtggtcaccataggggcaaagttattttgtccaatgttgttccagatgttcagcctcccatggatgctgttgaatatgctgaatgtgaagctgttgtaaaagactttcctccatttagggaggcaatgaaaagaaggggcattgaggatatggatcttgtgatggtcgatgcctggtgtgttggatatcacagtgatgctgatgctcctagccgcagacttgctaaaccgctaatcttctgtagaactgagagcgactgccctatggaaaatggttatgctcgcccagttgaaggaatccatgtactagttgatatgcaaaatatggtgcttattgagtttgaagatcgtaaacttgttcccttaccacctgctgacccattaagaaattacactcctggagaaacacgagggggtgttgatcgaagtgatgtgaaacccttacaaattattcagcctgagggtccaagttttcgtgttaatgggaactttgttcaatggcaaaagtggaattttcgtgtcggtttcactcccagggagggtttgataatttattctgttgcatatattgatggtagtagaggtcggagacctgtggcccacaggttaagctttgttgagatggtggtcccttatggagatccaaatgaaccacattacaggaagaatgcatttgatgcaggggaagatgggcttgggaaaaatgcacattcacttaagaagggttgtgactgtttagggtatgtcaagtacttcgatgcacacttcacaaattttaatgggggtgttgatacaattgagaattgtgtatgcttgcatgaagaggatcatgggcttctgtggaaacatcatgattggagaactggtttagcagaagttcgacgatcgagaaggctgacggtgtcttttatatgcactgtggctaactatgagtatggattcttctggcatttttatcaggatggaaagatcgaagcagaggttaaactcacaggaattcttagcttaggagcattacaacaaggggaagcccgaaaatatggtacgaccattgctcctggcttatatgcacctgtccatcaacatttttttgtagcacgtatggacatggcagttgattgcaagcctggtgaagcatttaatcaggttgttgaggtgaatcttaaagttgaagagccagggaaagataatgttcataataatgctttctatgctgaagaggaactactgagatctgaaatgcaagcaatgcgcgattgtaatcctttatctgctcgccattggattatcagaaacacaagaaatgtcaaccggactggacagctaacaggttacaaacttgtacctggttcaaattgtttaccattagctggttctgaggcaaaatttctaaggagagccactttcttgaagcataatctttgggtcacaccttatgcacgtgatgaaaagtatccgggaggagagtttcctaatcaaaatccacgtgttggggaaggattggctacttgggttaatcaaaatagatcattggaagaagctgacatagttctttggtatgtatttggaatgacacacattcctcggctggaagactggccagtgatgcctgtagaacgccttggttttatgctcatgccacatggattctttaattgctcaccagcagtggatgtccctccgaatacaagcgatgtggaaattaaggacaatgggatggctgtaaagcctatccagaatgagctactagctaagctttgaaagcaatatttaacaggatttcagtgctgttgtttattaagagtgggagaacaggattacattgctgtttaatttgtcggatttaggtatgtttgtcaaataattgagccataggtcttactcgatactctgagtattttatgtaccatttgattataaggattaaggtggcgtgccctcagtgtcattgcatggctcttcaaaatactaatataaatcaatgtatactgaaccaccagtattatatgatattttatggtgct

SEQ ID NO: 5447 - DNA, 2481 bp, Capsicum annuum
ggttacggtgaacttacaaatccattacaatggcctcaattacggaaaagacgacggttcgaaatgcttcttccgccgcttctgaaacaacggaatggactggcggaaccgtagctgatgtttccgatatttctgctaccagatcggccaaagtcaaagccaccgctgcttctactgctgctccgtctactaatttgaccgctgtgatcgactctattgatcgtccttctacgcaaaagccacctgccgtcaaaggactgcctatcttgttgagggctcaaactcaccatcccttggatcccttaactgctgcggaaatttccgtggccgtggcaactgtcagggcagctggaagcactcctgaggtgagagatagcatgcgctttgtcgaggctgttttggtggaaccagaaaggagtgtggttgctttagctgatgcatacttcttccctcctttccaaccatcattattgccgagaacaaaaggtgggcctgtaattcctagtaaacttcctccaaggcaggctaaattgattgtttataacaagaaatcaaatgagaccagcatatggattgttgagctctctgaggttcatgctgtcactcgaggaggccaccaccgtggcaaagtcatttcatctaaggttgtgcctgatatacagcctccaatggatgctgttgaatatgctgaatgtgaagctgttgtgaaggatttccctccttttcgtgatgcaatgaagaagagagggattgatgatatggatcttgtgatggtcgatgcctggtgtgcaggttattttagtgaggctgatgcccctaaccgccgtctaggaaaacctcttatcttttgcagaactgagagcgactgtccaatggaaaatggctatgctcggccagttgaaggaattcatatactggttgatatgcagaatatggttgtgatagaatttgaagatcgtaaactggttccattaccaccagctgatccattgagaaattacactcctggtgaaacaagaggaggggttgatcgaagtgatgttaaacctcttcgaattagtcagcctgaaggtcctagcttccgtgtcaatgggcattttgttgaatggcagaagtggaactttcgtattggttttacccccagggagggtctagttatccattctgtcgcatatattgatggtagcagaggccgtagacctgttgctcatagactgagcttcattgaaatggtagttccctatggggatccaaatgagccacattacaggaaaaatgcctttgatgcaggggaagatgggcttggtaaaaatgcacattccttgaagaagggttgtgattgcttaggctatattaaatatttcgatgcgcattttacaaacttcacaggcgttgttgagacaattgaaaattgtgtctgcttacatgaggaggatcacggaatcttatggaagcatcaagattggagaacaggtttagctgaagtacgccgttctcgacggctaactgtgtctttcatctgtactgtggcaaactatgaatatggattttactggcatttttatcaggatgggaaaatcgaggctgaggttaagctgactggagttcttagcttaggtgctcttctaccaggggaagttcgaaaatatgggacaactattgcacctggcttgtatgcacctgtacatcagcacttctttgtggctcgcatggatatggctgttgattgcaaagcaggggaatcacataatcaggtggttgaagtaaacgctagagttgaaccaccaggagaaaataatgttcataataatgcattttatgctgaagagagattgcttagaactgaactggaagcaatgcgtgattgtaatcctctaactgcacgtcattggattatccggaacacaagaacagtcaatcgcactgggcagctaaccggttacaagctagtaccaggttcaaactgtctgccactagctggctcagaggcaaaattcttgaggagagctgctttcttgaaacataatctttgggtcaccccgtactctcgtgatgagatgtttcctggaggagaatttccaaatcaaaatcctcgggttggtgaaggattggctacttgggtccagcagaatcgatccctggaagaaacacaaatagttctttggtataattttggacttatacatgttccgcggctagaggactggcctgtcatgccagtagagcacattggttttatgctccagcctcatgggttcttcaattgctccccagctgttgatgttcctcccagcatagcttacttggataaggaaaatgggaagtcttgccacagtgatggtataatggctaagctttgaaggagattcaatctacttttgtcttctgggatcgcttcgctccatgctgctctgcaaaaattgctttgttatcctcgtatttggattgataaacattcgacagctagttggcatattattc

SEQ ID NO: 5448 - DNA, 2781 bp, Capsicum annuum
cgtagtgttggaatcgaagtggtgaatagtgaaatcggagaagggagaatagtaaagtgctgtatgtcagaggattactactactattatagtaacaagtactacggcggttacggtgaacttacaaatccattacaatggcctcaattacggaaaagacgacggttcgaaatgcttcttccgccgcttctgaaacaacggaatggactggcggaaccgtagctgatgtttccgatatttctgctaccagatcggccaaagtcaaagccaccgctgcttctactgctgctccgtctactaatttgaccgctgtgatcgactctattgatcgtccttctacgcaaaagccacctgccgtcaaaggactgcctatcttgttgagggctcaaactcaccatcccttggatcccttaactgctgcggaaatttccgtggccgtggcaactgtcagggcagctggaagcactcctgaggtgagagatagcatgcgctttgtcgaggctgttttggtggaaccagaaaggagtgtggttgctttagctgatgcatacttcttccctcctttccaaccatcattattgccgagaacaaaaggtgggcctgtaattcctagtaaacttcctccaaggcaggctaaattgattgtttataacaagaaatcaaatgagaccagcatatggattgttgagctctctgaggttcatgctgtcactcgaggaggccaccaccgtggcaaagtcatttcatctaaggttgtgcctgatatacagcctccaatggatgctgttgaatatgctgaatgtgaagctgttgtgaaggatttccctccttttcgtgatgcaatgaagaagagagggattgatgatatggatcttgtgatggtcgatgcctggtgtgcaggttattttagtgaggctgatgcccctaaccgccgtctaggaaaacctcttatcttttgcagaactgagagcgactgtccaatggaaaatggctatgctcggccagttgaaggaattcatatactggttgatatgcagaatatggttgtgatagaatttgaagatcgtaaactggttccattaccaccagctgatccattgagaaattacactcctggttgaaacaagaggaggggttgatcgaagtgatgtttaaacctcttcgaattagtcagcctgaaggtcctagcttccgtgtcaatgggcattttgttgaatggcagaagtggaactttcgtattggttttacccccagggagggtctagttatccattctgtcgcatatattgatggtagcagaggccgtagacctgttgctcatagactgagcttcattgaaatggtagttccctatggggatccaaatgagccacattacaggaaaaatgcctttgatgcaggggaagatgggcttggtaaaaatgcacattccttgaagaagggttgtgattgcttaggctatattaaatatttcgatgcgcattttacaaacttcacaggcgttgttgagacaattgaaaattgtgtctgcttacatgaggaggatcacggaatcttatggaagcatcaagattggagaacaggtttagctgaagtacgccgttctcgacggctaactgtgtctttcatctgtactgtggcaaactatgaatatggattttactggcatttttatcaggatgggaaaatcgaggctgaggttaagctgactggagttcttagcttaggtgctcttctaccaggggaagttcgaaaatatgggacaactattgcacctggcttgtatgcacctgtacatcagcacttctttgtggctcgcatggatatggctgttgattgcaaagcaggggaatcacataatcaggtggttgaagtaaacgctagagttgaaccaccaggagaaaataatgttcataataatgcattttatgctgaagagagattgcttagaactgaactggaagcaatgcgtgattgtaatcctctaactgcacgtcattggattatccggaacacaagaacagtcaatcgcactgggcagctaaccggttacaagctagtaccaggttcaaactgtctgccactagctggctcagaggcaaaattcttgaggagagctgctttcttgaaacataatctttgggtcaccccgtactctcgtgatgagatgtttcctggaggagaatttccaaatcaaaatcctcgggttggtgaaggattggctacttgggtccagcagaatcgatccctggaagaaacacaaatagttctttggtataattttggacttatacatgttccgcggctagaggactggcctgtcatgccagtagagcacattggttttatgctccagcctcatgggttcttcaattgctccccagctgttgatgttcctcccagcatagcttacttggataaggaaaatgggaagtcttgccacagtgatggtataatggctaagctttgaaggagattcaatctacttttgtcttctgggatcgcttcgctccatgctgctctgcaaaaattgctttgttatcctcgtatttggattgataaacattcgacagctagttggcatattattcttctatggaccaagttctatgtctgaagttgtcttgttttctactagtattgtttctttacataatggcggttccatttggaacacagcccctgctgataatgtggatctggtcttgtttcatttgttccgtaaagacttggcttgctggttatgtatatttaatatactcggtgctccaatctattatt

SEQ ID NO: 5449 - DNA, 3716 bp, Cicer arietinum
ccaggttgtttgggtgcatatctcatgtgactggtgctgatttggcaaccttgtctttttgcgaactattattgttttctttcctcaatcaatctactcacatatccactttgactatttatatcatcatttcttcattcatccaatccaatcaatactttttaaagcaataatagcaatgggtttttctttttccattcaccaaaccccacttagtaaccagccattttatttttagttgctttggtgttgctggaaagcattaaaaactcacttatatataaataagtaaaatatatttaaagttgtttataacagttttgtctttcgtgttttttttttaatatttagattgtttaagtttatttcttatttcctttagttttctaaatttgtattttattctttaattatatgacgtttgcgccattattttttaaattatatccgtcattctttaaaattgactattttctcaaactactgtctcaaaatgataaagatttaattcaattaacgtgttaagttgattattcaaattactttataaataaaaaaaattaataaaattgattacgtaagtaaatatcgatagagatataaagttgatttagtgactagagtgagatatataattaaagagtagagtaccaaaaaaagatgcaacttctatcctcatccacacaaaaaaaattaataatattaacattactaaaatattgataattataagatttaattgatgtttcttgaagaattaatactaaggacgacaagcatattattttcgtgaaaaataacaaagaaatgaatttctctataaataattatgtttgattatttcatctaatcacaagctctgattctttgtgttattgtataagtgtgtgtatgtgttgttgtaagttgttagtgataagttggttgcagtttgtagagaggagaaagacttgaagtgggaaatataattactgtatgtcagtggaatattacagtggaatattttatcacgttgagcttgataatcctttgcaatggccacagttgaggaaaaaacgacgccaccttgttgttcccttcaaaataacaacaaatctgctgcagctgcatcttctaccgttgattcccgctctgatcctcctcctaaatcaccttctgccaaaggtattactgtaatggcgaaagctcaaacttgccatcctttggatccactttctgctgctgaaatatcggtagctgtagcaactgttcgagcagccggagcaacacctgaggtgagggatagcatgcggttcattgaagtagacatggtagaacctgaaaagcatgttgttgcattagcagatgcatacttcttccctcctttccaaccctcacttctcccgaggacgaaaggcgggcctgtgattccatcaaaactgcctccaaggaaagcaagattggttgtctataataagaagtcgaacgagacaagcatatggatcgttgagcttacagaagttcatgcaacaactcgcggaggacatcatagaggcaaagtgatttcttctacaattgttccagatgttcagcctccaatggatgcggtggagtatgctgaatgtgaagctgttgtaaagaactatcctccatttcaagaagcaatgaagaagagaggaattgaagatatggatcttgtgatggtggatccatggtgtgctggatatgacagtgaagccgatgctccgagccgcagacttgctaaaccattattcttttgtaggactgagagtgactgtcctatggaaaatggttatgctcgtccggtcgaaggaatacatgtactcgttgacatgcaaaatatggttgtccttgagttcgaggatcgtaagcttgtccctcttccacctgctgatccactaagaaattatacttccggtgaaactcggggaggagttgaccgaagtgatgtgaaacctttacagattattcagccagacggtcccagttttcgtgtcaatggacacttcattcaatggcagaagtggaattttcgtattggattcactcctagggagggtttgattatttactcagtagcgtatattgatggaagtcgcggccgaaggcctgtggctcatagattgagttttgttgagatggttgtcccttatggagatccaaatgatcctcactataggaaaaatgcttttgatgctggagaagatggccttggtaaaaatgctcattcactcaagaagggttgtgattgtttaggctatatcaagtactttgatgcacactttacaaatttttacggaagtgttgaaacaattgagaattgtgtttgcttgcatgaagaagatcatggtatgttatggaagcatcaagattggagaacaggtttggctgaagttcgacgatctcgaaggctgacagtgtcttttatatgcactgtggctaactatgagtatggtttttactggcacttttatcaggatggaaaaatagaagctgaggtcaagctcacaggaattctcagcttaggtgcattgcagcaaggcgaaactcgaaaatatggcacaactattgcacctggattatacgcgcctgtccaccaacacttttttgttgctcgtatggacatggcggttgattgcaagcccggcgaagcatttaatcaggttgttgaggtgaatgtcaaaattgaagagccaggaaagaataatgttcacaacaatgcattttatgccgaggaaaaaccgcttaaatcagaattagaagcaatgcgtgattgcgaccctttatctgctcgtcattggattgttaggaacacgaggagtgtgaaccgtaccgggtatctaaccggttacaaactagttcctggtgcaaattgtttacctttagctggatcagaggctaagtttttacgaagagcagctttcttgaagcacaatctttgggttactccttatgcacgcggcgaaatgtatcctggaggagagttccctaatcaaaatcctcgcgatggagagggtttggctacttgggttaagcaaaatcgaccgttggaagaagctgatgtagtcctctggtacgtatttggagtgacacacattcctcgattggaagactggcctgttatgcctgtggagcacattggctttatgcttatgccacatgggtttttcaattgctcaccagcagtagatgttccaccaagcccaagtgatttggatgataaggagaatggcatgcctgcaaagcctagtcagaatgggctaattgccaagctttaaaaggcccaaaagcagatatactccggcccattcagcctcttcagtggttgagttcatcacatgaataagttgttcaaattaaaaaaataacattcaaaaaactacatgttaattaatcaatggtggtgtgtaaccttgttattcaaaaataggctattgtgtaatttgtgtgtcatgtgttaataaaatttatgtatatattcgaagctaaatatttcttcaaaaaacccatttttttgcatgatatgatctaaataatttcaatcctctgaataccttatagtctacagaagcaaggataagctcgtcatattttctaaaattactattgttacttttttaaagatataagtcagtttctcttgtttttaacgttaaaagtatagattgttgatgttagagagtgctttttctaatatttataatactttagaagtt

SEQ ID NO: 5450 - DNA, 2970 bp, Sorghum bicolor
tctccaaatcacccgacgcggcacataacccaacaccactctccctctcccagttctcaccgccaacgccaccacccccaccattgcaaaccaccgtctcccaccggttgccgtttctctccccccacccctccctcggcggctcctcgcggacggagagaacccccgctcccttgtctagggttccaggaaccctagccccgacccgtacgcgcgagtgccccggcgacgaggaggcggcggagaggggggagggggcagaaggcgcgggaggcggaggcctgtgctgtatgtcagatcgtgggagccggcgaggcggaggcggaggaggagactacggacacggtcagctcgcgaacccgctccaatggccgcagctaaggaaaaggcgtcggcatgctgcagccgcgatgcgcccgcgcgtgtcgctggtggcgcccctgtcgtccccatgcgagcgatcgccgcgtccccggtcggcaaggtcgtcgccctcgctgcgggaggcggtgagcgcgtggccgcgtcggccgcaggcgcaagcggcgccgtgatcgaggagatcgccgcggtccagcccaccacagcgaaggcctcctccaaagggataccaataatgacaagagcccagaggtgccaccctttagacccattatctgcagctgaaattgcagttgctgtagcaactgtaagagctgctggaagatctcctgaggaaagggacagcatgcgctttgttgaagttgtgctgttggagccagaaaagaatgtcgtggcattagccgatgcctacttctttccacctttccagccatcgctgctccctagaagcaaaggttctgctgttattccaagcaggttacctcctaggagggccagacttgttgtctacaataaacaatcaaatgagactagcatttggatagtggaactatctgaagtgcatgcagctactaggggtggacatcacagagggaaggtgatatcatctgaagttgttccagatgttcaacctgcaatggatgctatggagtatgctgaatgtgaggctacagtcaaaagttaccctccatttattgaagctatgaagagaagaggtgtggatgacatggatcttgttatggtggatgcttggtgtgctggctactacagcgaagctgatgctccaagtcgcagacttggcaagcctctcatattttgcagaactgagagtgatagccccatggagaatggttatgctcgtcctgtggaaggaatccatgttgttgttgatatgcagaataatgctgtgatagagtttgaagataggaagttggttcctcttccccctccagatcatttgagaaactatactcctggggaaacaagaggtggtgttgatcgaagtgatgtaaaaccacttatcatcaatcagcctgagggtccaagtttccgcattaatggctattttgtggaatggcagaagtggaacttccgtattggcttcacccccaaagagggtttggttatctattctgttgcttatgttgatggtagccgtggacgtagacctatagcacataggctgagctttgttgagatggtcgttccttatggagatccaagcgaaccacattatcgtaagaatgcatttgatgctggagaagacggacttggaaaaaatgctcattctcttaagaagggatgtgattgcttggggtacataaaatattttgatgcacatttcacaaacttcactggtggtgtggagacaattgagaactgtgtttgtttgcatgaggaggatcatgggatcctttggaaacaccaagactggagaactggtttagcagaagtaaggcggtcaaggaggcttaccgtttcatttatctgtacagttgcaaactacgagtatggtttttactggcacttctatcaggatggaaaaatagaagcagaagtaaagcttactggaattctcagcttaggggccctgatgcctggggaatcaaggaaatatggcacaactattgcccctggtctgtatgcaccagttcaccagcatttctttgttgcccgtatggacatggctgttgattgcaaacctaacgaggctcataaccaggtggttgaggttaatgttaaagtggaaagtgcaggcacacataatgtgcataataatgctttctatgctgaagagaaattgttgaagtctgagttgcaagcaatgcgtgattgcgacccttcatctgcacgccactggattgtacgtaacacacggactgtaaatcggactgggcagccaactggttacaggctcgtgcctggttcgaactgcctgccattggctctgcctgaggcgaaatttctgaggagggctgggttcttgaagcacaatctctgggtgactcaatacaagcgcgacgagatgttccctggaggggagtttcccaaccagaatcctcgcatccacgagggtctgccaacatgggtcaagaaggataggcctctggaggaaactgatattgttctctggtacgtgttcggtctcacccatatccccaggctggaagattggccagtcatgccggtggagcatataggcttcatgctcatgccacatggattcttcaactgctcacctgcggtcgacgtgcctcccagctcgtccgatgcggatgtcaaggaagccgagtcgcccaaggccatccaaaatggcctcgtttcgaagctgtgagctttccaagggagaaatcagcgcgcggctgctctgcctatattttatcgtatttctcgaataaaaggaaaactgcacgagatccgtttgtttgctgtttggtaataacgttctgttagctacacttgtttctcttttttctaaaattggatttctatgcttgtcaatcagcgggctgtgaagctttacattgctcgcgtactaataaaatactgtttggacttgcttaatagcacattgaatatatttttgcc

SEQ ID NO: 5451 - DNA, 2857 bp, Musa acuminata
gtaacctcaggtcaagaaaccataacgaccctcctccccacctcttctcccttctccatcgttctccttctctcgagggcttgggtcttggaggccactgctctctccagtttcgtgacctctcctaaaacaaccttaaagaagagaatcaaatcgtgaagggagacagggggagggtttggtggagaggagtgagagagagaggaaggctacggaggcgcgctgcatgtcagattgcagtagcagagaggagggatactacgacggcggattcggtgagcttgccaaccctctacaatggccgcaactcaggaaaaagcgacgcccgcccacgcttccgtcggcgtcgccggtgccaaggccggaggggtccccggccccgtccaagaatgggttaccgcggccgttgagaagcaagcttctgcgccgccggtggaggccgttagcccgctgatcgcccccgtcgaggacgtacaggaccctcccgcgaagccctcctccaaaggaatcccagttatgatgagggctcaaacaagccaccctttggatccgttgtcttcggctgaaatatctgttgcagtagcaacagtcagggctgcaggggcaactccggaggtgagagatggtatgcggtttatagaagtagttctgttggaaccagagaaaaacattgtggcactggccgatgcctacttcttccccccatttcaaccatcactgctccccagaacgaaaggtggccctgtcatcccgagtaagcttcctcctaggagggctaggcttgttgtttataacaaaaggtcaaatgagacaagcatttggattgtcgaactgtcagaagtgcatgcagcaactcggggtggccatcacaggggaaaagtcatctcatctgaagttgtccatgatgtccagccctctatggatgccatggaatatgcagaatgtgaggctgctgtaaaaaattaccctgcatttatagaggcaatgagaaagagaggagtggaggatatggatcttgtaatggttgatgcttggtgtgttggttactacagtgatgctgatggtcctagccgcagacttgcaaaaccactaatattttgtagaacagagagtgactgccccatggagaatggttatgcacgtcctgtcgaaggcatacatgttcttgttgatattcaaaataatgtgataattgaatttgaagatagaaaattggtacctctacctccagcagatcctttgagaaactacactgcaggagaaatgcgaggaggcattgaccgaagtgatgtgaaacctttgcatattctgcagcctgaaggtccaagttttcgtgtaaatggttactttgtacaatggcagaagtggaatttccggattggtttcacccctagggagggattggtaatacattctgtggcctacattgatggtagtcgtggacggagacctattgctcacagattaagtttcgttgagatggtagttccttatggagatccaaatgagcctcattaccgtaagaatgcatttgatgctggagaagatggccttggaaaaaatgcacattctctcaaaaagggttgtgactgcttgggctacatcaaatactttgatgcccatttcactaactatactggtggtgtcgagactattgagaattgtgtgtgtttgcatgaagaagaccatgggattttgtggaagcatcaagactggagaacaggcttagcagaggttaggcggtcaagaaggctaagtgtgtctttcatatgtacagtggctaactatgagtatggctttttttggcacttctatcaggatggtaaaattgaggcagaagtaaaactgactggcattctaagcttaggagcattacaacctggtgaatcaagaaagtttggtacaacaatagctccaggtttatatgcaccagttcatcagcatttctttgttgctcgcatgaatatggctgttgattgtaaacccaatgaagccttcaatcaggtggttgaggtgaatgttaaagttgaagaacctggcaaggataatattcacaataatgcattttatgctgaagaaaagcttctcagatctgagttgcaggctatgcgtgattgccaacctttgtcggcacgacactggattgtgaggaacaccagaactgtaaatcgaactggtcaacctgcaggatacaagctgatgcctggttccaattgccttccgttagctgggccagaggcaaaatttttgagaagagctgcatttttaaagcataacctttgggttacatcatataaacatgatgagatgtatccaggaggagagtttcccaatcaaaatccacgcataaacgagggactagctacatgggttaggaagaataggtcccttgaggaaactgacattgtcctatggtacgtattcggaatcacccacatcccaaggctggaagactggcccgtcatgcctgttgagcatattggctttatgctcatgccgcatggtttcttcaactgctccccggcagttgacgtgcctcctagtcccaatgaggcagacaaggagtgtggagcacctaagttgatgcacaatggacttgttgcgaagctttgaggaaagatgagaagtaaacctatccggtaaggagggcctgtaaattagggaagaacttaaaaaaatatgttgctgctctatgttctgtttacattgtgcaatgaatgctgctagttgatcgaatttgatttatggcatcatggtcagcatgcttttactgtaaacgctctcacgacagaggttttgagaaaaaggtatggttgtttctctgtttgttgtgagaaaaaggtatggtagttctttg

SEQ ID NO: 5452 - DNA, 2436 bp, Mimulus guttatus
gctaatgattttcttattcaggtattcaagtcatgccaagggctcaaaccaaacatcctttggatcctttatctgctactgaaatctctgtggctgtggcaaccgtcagagcagctggagctacccccgaggtcagagatagtatgcgatttgttgaagtggttctgttggaaccagagaagcaagttgtggctctggctgatgcatacttctttcctccttttcaaccttcattgttgcctaggacaaaaggagggcctgctatccctagtaagcttccaccaaggcgagccagacttattgtctacaataagaagtctaacgagactagtctgtgggttgttgagttgacagaagtacatgcaacaactcgaagtggacttcatcgaggaaaagtcatttcctctaaagttgtccctgatgttcagccaccaatggatgctgtagaatatgctgaatgcgaagctgttgtgaaagattaccctccatttatagaggcaatgaggaagaggggaatcgatgacatggatttagtcatggttgatccttggtgtgttggttaccatagcgaggctgatgctcctagtaggagacttgcaaaaccacttctattttgccggatcgagagcgattgccccctcgaaaatggttatgcacgacctgttgaaggaattcatgtgcttgttgatatgcaaaatatggttgtaattgagtttgaagatcgtaagattgttcccttgcctccagctgatccgttgagaaattatacttctggtgaaacaaggggtggcgtcgatagaagtgatgtgaagccccttcaaattattcagcctgaaggtccaagctttcggatcaaaggacagtatgttgagtggcagaagtggaatttccgcattggtttcacaccgagggagggtttggtcattcattcagttgcctatgttgatggcagtaggggtaggagacccatagcccataggttgagttttgtggagatggttgtgccctatggggacccaaatgatcctcactacaggaaaaatgcattcgatgctggggaagatggcttagggaagaatgctcactctctcaagaagggatgtgattgcttgggatatataaaatacttcgatgctcattttacaaactttactggaggagttgagacaattgagaactgtgtatgcttacatgaagaagatcatggaatcctatggaagcatcaagattggagaactggccttgcggaagttcgaagatcgaggcgtctaactgtttcgtttatttgcactgtggcgaattatgaatatgggttctactggcacttctaccaggcaagtggaatgcattcactacttggagcttgcgatgggaaaattgaggcggaagttaaactcactggaattcttagtttagggtctctgcaacctggagaatttagaaaatatggtacgacaattgcacctggattatatgctccagttcatcaacatttttttgttgcccgtatggatatggcagtggactgtaagccaggagaaatgcacaaccaggttgttgaagtgaatgtcagagtcgaagaacctggggaagagaatgttcacaacaatgccttctacgctgaggaaactttacttagatccgagctagaagccatgcgtgattgtgatccattatccgctcgtcattggatcataaggaacacaagaactgtcaatcgtagtggagaactgacaggctacaaattggttcctggttcaaattgtttgcctttggctggccccgaagctaaatttctacgaagagctgcatttctgaagcataatctttgggttacacaatatgcacctggtgaagattttcccggaggagagtttcctaatcagaatccacgtgttggggaagggttggtttcttgggtgaaacagaaccggcctttggaagaaactgatgttgttctctggtacgtatttggcattacacatgttcccagattggaagattggcctgttatgcccgtggaacacattggttttgtgcttcagccgcacggtttcttcaattgctctcctgccgttgatgttccgcccagtgcatgcgagttggaagcaaaagagaacgacgtgaaagatagtgctgcagctaataaggcgagttcgtcgtctggtctagtaatggcaaagctgtgaagggaaagacatttatcggtgttatatcaatgtgtgcgaaaataggcctggtattgagagtcaataatggtgggtttcggcgtgcctgtacatatgcgtggatttaatttcagttgtttgttttgctagtttgttttgagactaaatatttgcttgtaccatatattatgactgttgtgagaactttgtctgaatgagtttgaagaagaaataaaacgcacaagattccacagcttcattattttaa

SEQ ID NO: 5453 - DNA, 2715 bp, Tropaeolum majus
ctacactatactcttcaaacaatccaaaatctcccctttaaatttcgttacatttcgttttctcgatcaatactgattatactccatcccagatcaagaaactcatcgtagggacgaagaggatttgctgtatgtcagtggattgtgtggagacttattgcggtggatttggagagctcgctaaccctctgcaatggcctcagctacggaaaaaacgacgtcatgttgccttcgcaagacccccacggattcaggtccagctgtcgttgtcgctgtcgatgccaatgtggtctcgaatcagtctgcgggaccttccgatcgtcgccatgatgagcgtgccaataagggaggggaaaaatatttccgccgtacgccctgattccatttctgaggctttccgttattccttctaccaaaggagtccctgtcatgttgagggcccacacaagacaccctttggatcctttgtctgcagctgaatctcgaatagcagtggctactgtgaggtctgcgggagccacacctgaggttagagacagcatgcgctttgttgaactagttctgctggaaccagacaaaagtgtcgttgcactggctgatgcatatttcttccctcctttccaatcttcattacttcccagaaccaaaggaggggctgtaattcctagcaagctccctccaaggcacgcaagggattgactacacaaaaaatcgaacgagacaagtatatggattgtcgaattatcagaagttcatgctctcactcgaagtggacatcatcgggggaaagtgatctcatcagaaattgttccagatgttcaggctcccatggatgctatagaatatgctgaatgtgaagctgttgtaaaagacttccctccatttatagaggcaatgaagaagaggggaatcgaagatatggatcttgtgatggttgatgcctggtgtgtcggttatcatagtgatgctgatgcccctagtcgaagacttgccaagccacttatattttgtagaactgaaagtgactctccaatggaaaatggctatgcacgccccgttgagggtatgcatatacttgtagatatgcaaaacatggtagttgttgaatttgaagacagaaaacttattcccctaccttctgctgatccactgaggaattatacccctggtgaaactagaggtggtgttgatcgaagtgacgttaagcctttgcagattatccagcctgaaggtccaagctttcgtgtcaatgggtactttgtagaatggcagaagtggaatttccgtattggctttactcccagagagggtttagtcctatattctgttgcttatgttgatggtagtcgaggtcggagacctgttgcccatagattgagttttgttgaatggttgtcccttatggggatcccaatgatccacattacagaaagaatgcttttgacgcaggggaagatggtctcgggaaaaatgcacactctcttaagaagggctgtgattgtttaggcgatatcaagtactttgatgcacacttcacaaatttcactggaggagttgaaacagttgagaattgcgtatgtatgcatgaagaagaccacggacttctctggaagcatcaagattggagaactggactggcggaagttcgaaggtcaagacggctgacagtttcttttgtgtgtactgttgccaactacgaatatgggtttttctggcacttctatcaggatggaaagatcgaagctgaggttaaacttacaggaatcctcagtttaggagcattgcaacctggagaaactcgaaaatacgggacattgattgcgccaggtttatacgcacctgtccatcagcacttctttgttgctcgcatggacatggcagttgattgtagacccggtgaagcgttaaatcaggttgttgagataaatgctaaagtcgaggaacctggtgaaaataacattcaccataatgcattctatgctgaagagacgctgcttcgatcagaactggaagcaatgcgtgattgtaatccgcaaagtgctcgctcctggattgtgaggagcacgagagctgtaaacaggacaggtcagtggacaggttataagctagctcccggctcaaactgtttgccgttagctagaccagaagccaagtttctgagaagagctgctttcttgaagcataatctttgggtgacagcatataagcgcgatgagaagtatcctggaggagagtttcctaaccaaaatccacgtgttggtgagggattggcttcatgggttaagcagaatcgatcaattgaagaagctaacatcgttctttggtatgtatttggaatcacacatgttcctcgactggaagattggcctgtcatgccagtggagcacattggattcacgcttgagccttgtggattctttaactgttctcctgcagtagatgtccctcctagtgcctgcgaattggatacgaaagaaaagcctgtccaaaatgtgttgctggcgaagctctgaagcgctaatttgggaagtgatcggtttggtaatgaagttatgtgagattggatcttttggcttgtctataagttcaattagttgtagttgatctgttccttaaactatggcttgtgtttcccgagacactgtttatatgtttcttcttcgtttgtaatactatgcgcgagttggtactttctcctttcttcctatttaacgc

SEQ ID NO: 5454 - DNA, 2117 bp, Trifolium pratense
cctcttctaatgtttctcaacagaaacagcaaccacctttcatttcggctgtcgattcccgccttgatccgcctccgaaatctgcttcttccaaaggtattacagtaatggcgaaagctcaaactctccatcctttggatcctcttacagctgctgaaatatcagtagctgtagcaactgttcgagcagccggagcaacacctgaggtgagggatagcatgaggttcatagaagttgacttggtagaacccgaaaagcaagttgttgcattagcagatgcatacttctttcctcctttccaaccctcgttgcttccgaggacaaaaggtggacctgtgattccatcgaaacttcctccgaggaaagcgagattggttgtctataataagaagtcgaatgagacaagcatatggattgttgaacttacagaagttcatgcaacgactcgtggtggacatcataggggcaaagttatttcttctacaattgttccggatgttcagcctcccatggatgccgttgagtatgctgagtgtgaagctgttgtaaaggactatcctccgtttcgagaggcaatgaagaaaagaggaatcgaagatatggatctcgtgatggtggatccttggtgtgccggatatcacagcgaaggtgatgctccaagccgcagacttgctaaaccgctattcttttgtaggaccgagagtgactgtcctatggaaaatggctatgctcgtcctgttgaagggatacatgtacttgtcgacatgcaaaatatggttgtcctcgagtttgaagatcgtaagctcgttccactcccacaggctgatccgctaagaaattatacttctggtgaaacccggggaggagttgaccgaagtgatgtgaaaccgttacagattattcagccagacggtccaagttttcgtgtcaatgggaacttcgttcaatggcagaagtggaactttcgtattggattcactcctagggagggtttggttgtttattcagtagcttatattgatggaagccgtggccgaagacctgtggcacacagattgagttttgttgagatggttgtcccttatggagatccaaatgatcctcactatagaaaaaatgcttttgatgccggagaagatggcctcggtaaaaatgctcattcactcaagaagggttgtgattgtttaggatatatcaagtacttcgatgcacactttacgaacttttatggcagtgttgaaacaattgagaattgtgtttgcatgcatgaagaagatcatggcatgttatggaagcatcaagattggagaacaggtttagctgaagttcgacgttctagaaggctgacagtgtcttttatatgcactgtggctaactatgagtatggattttactggcacttttatcaggatggaaaaatagaagccgaggtcaagctgacgggaatactcagcttaggtgcattgcaacaaggcgagactcgaaaatatggtacaactattgcgcctggattatacgcgcctgtccatcaacacttttttgttgctcgtatggacatggcagttgattgcaagcccggcgaagcatttaatcaggttgttgaggtgaatgtgaaagttgaagagccaggaaagaataatgttcacaataatgcattttatgctgaggaaaaactgcttaaatcagaattagaagcaatgcgcgattgcgaccctttatctgctcgtcattggattgttaggaacacgaggagtgtgaaccgaaccggtcatctaaccggttacaaactagttcctggttcaaattgtttacctttagctggatcagaggctaagtttttaagaagagcagctttcttgaagcacaatctttgggttactccttacgcacgcgacgaattgcatcctggaggagagttccctaatcaaaatcctcgcgttggtgagggtttggctacttgggttaagcaaaatcgaccactcgaagaagctgatatagttctttggtacgtatttggggtgacacacattcctcgattggaagactggcctgttatgcctgtggagcacattggttttatgcttatgccacatggatttttcaattgctcaccagca

SEQ ID NO: 5455 - DNA, 2458 bp, Trifolium pratense
atggccacaactcaggaaaaaacgacgcccgacccatctctggatccgacccgaaacactacttcccttgattcattccctcctaaaaccactcctacttccaaaggtttcccagtcatgatgagagttcaaacccaccatcctttagatccactatctgcggctgaaatatcagtagctgtagcaactgttcgggcagccggggcaacccctgaggtgagggatagcatgcgctttgttgaagtagtcttagtagaacctgttaagcaagttgttgcactggcagatgcatatttctttcctcctttccaaccgtcattgctccctaggaccaaaggaggaggacctttgattcctactaaacttcccacaaggaaagcgcggctagttgtttacaataaaaggtcaaatgagacaagcttatggattgtcgaacttcgagaagttcatgcagcaactcgaggtggccctcataggggcaaagtaatttcttctcaagtggtgccaaatgttcagccaccaatggatgctatggagtatgcagaatgtgaagctgttgtgaaggacttccctccattccgagaagcaatgaagagaagagggattgaggatatggatctcgtaatggtggatgcctggtgtgttggatatcacagtgaagctgatgctccgaaccgcaggcttgctaaaccactaatcttttgtagaagtgagagcgactgccctatggaaaatggctatgcccgtcccgttgaaggaatctatatacttgttgacatgcaaaatatggttgttcttgagtttgaagaccgtaaactgatcccccttccacctactgatccactaagaaattatacttctggtgaaactcggggaggagttgatagaagtgatgtgaaacccttacagattattcagcctgaaggtccaagctttcgtgttaacgggcactttattcaatggcagaagtggaacttccgtattggtttcactcctagggaaggtttggttatttattcagtggcatatattgatggaagtcgagggcgaaggccagttgcacacaggttaagttttgttgaaatggtggtcccatacggagatccaaatgatccccactataggaagaatgcatttgatgccggagaagatggccttggtaaaaatgctcattctctcaagaagggttgtgattgtttaggctatattaagtactttgatgctcacttcacaaactttaccggaggtgttgaaacaatagagaattgtgtttgcttgcatgaagaggatcatggtattttgtggaagcatcaagattggagaacaggtttggccgaagttcgaaggtctagaaggttgacagtgtcatttatatgcactgtagctaactatgaatatggatttttctggcacttttatcaggatgggaaaatagaagctgaggtaaagctcacaggaattctcagcttaggagcaatgcaaccaggtgaaactcgaaaatatggcacgactattgcaccgggattatatgcgcctgtccaccaacacttttttgttgctcgtatggacatggctgttgattgcaagcccggtgaagcatttaatcaggttgttgaggtggatgtcaaagttgaagatccgggaaagaataacgttcacaacaatgcattctatgccgaggagaaactgctcaaatcagaattggaggcaatgcgtgattgtaaccctttatctgctcgacattggattgttagaaacacacggatggttaaccgtaccggacagctaacaggttacaggctagtacctggttcaaactgtttacctttagctggttcagaagccaaatttctgcggagagcagctttcttgaagcacaatctttgggtcactccttatgttcacaatgaaatgcatcctggaggagagttccctaatcaaaatccgcgtgttggagatggtttggctacgtgggttaagcaaaatagatcgctggaagaagctgatatagttctttggtatgtatttggagtgacacacattccacgattggaagactggcctgttatgccagtggaacgcattggttttatgcttatgccacatggatttttcaattgctccccagctgtagatgttcccccaagtgcaggtgatttggatgataaggagattggaatgcctgctaagcccattcagaatgagctcattgcaaagctctgagtgagctaaaagtataaacaattgttatgtttatcctatctgagtgagctatattgaaatttgggttggtcgatgtagatacattttcaggtcgtatctcatttaatgtgagactcttaacacagtgtgtcagtgagtgtgcaacaatttgatttagttctattacttgctagttaaactaattaaatgttaactgttaagcttcatgggggatatttaagagtttctatttagc

SEQ ID NO: 5456 - DNA, 2666 bp, Phaseolus vulgaris
atcccaccacaactctcattatcattatctgtaataaaaaacaaaacctcccttcttcttcttctttaatttatactactttcctcctgtcatcccatttacagcgtcactcagtcactgagttcctgcacttcctgctagtggtggtggcggcggtggcttactctcgaaacaactggcattattgctgtatgtcagtggaatattacactggaatttactacgctgagctcgctaaccctctccaatggccacagctcaggaaaaaacgacgccatgttgcgccaccggaactaccaaaccgtcttcttctgcgccgccccaacaacaacaacggccctccgttgccaccttcattcccgccatcaatcctcctcccaaaaccgcttctgccaaaggtatctcagtcatggtgagagcccaaaccagccatcctctggatccactatctgctgctgaaatatcagtagctgtggcaaccgttcgagcagctggggcaacacctgaggtgagggatggcatgcgctttattgaagtagacctggtagaaccagaaaagcaagttgttgcattagcagatgcatatttcttccctcctttccaaccatcactgctccccaggacaaaaggtggacctgtgattccaaccaaacttcctctaaggaaagcaagattagttgtttacaataaaaagtcaaatgagacaagcatatggatcgttgaacttagagaagttcatgcagcaactcgaggtggacaccataggggcaaagttgtttcatctacagttgttccagatgttcagcctccaatggatgctgtggagtatgctgagtgtgaagctatagtcaaggactttcctccatttcgtgaagcaatgaagaagagaggcattgaggatatggatctcctgatggtggatccctggtgtgctggatatcacagtgaagttgatgctcctagccgaagacttgctaaaccactaatcttttgtagaactgaaagcgactgccccatggaaaatggctatgcccgtccagttgagggaatccacgtacttgttgacatgcaaaatatggttgttcttgaatttgaagaccgtaaacttgttccccttccacctgctgatccactaagaaattatacttctggtgaaacccggggaggagttgaccgaagtgatgtgaaacccttacagattattcagcctgaaggtccaagttttcgtgttaatggacgcttcattgaatggcagaagtggaactttcgtattggattcactcctagggagggtttggttattcattcagtagcctatattgatggaagtcgaggacgaagaccagtggcccacagattgagctttgttgagatggtggtcccgtatggagatcctaatgatcctcactataggaaaaatgcttttgatgctggggaagatggcctgggtaaaaatgctcattctctcaagaagggctgtgattgtttaggttatatcaaatactttgatgcacacttcactaacttctatggaggtgttgaaacaattgagaactgtgtttgcttgcatgaggaagatcatggtattttatggaagcatcaagattggagaacaggtttggctgaagttcgaaggtctagaagattgacagtgtctttcgtatgcactgtggctaactatgagtatggatttttctggcacttttatcaggatggaaaaatagaagcagaggtcaagctcacaggtattctcagcttaggagcattacggccgggtgaaactcgaaaatatggcacaaccattgcacctggactatatgcgcctgtccaccaacatttttttgttgctcgtatggacatggcagtagattgcaaacctggcgaagcatttaatcaggttgttgaggtgaatgtcaaaattgaagagccaggagacaataatgttcataacaatgcattttatgctgaggaaaaactgcttaaatcagaattggaagcaatgcgtgattgtgatcctttatccgctcgtcactggattgttaggaacacaaggactgtaaacagaactgggcatctaactggttacaagctagtacctggctcaaattgtttacctttagctggctctgaggccaagtttttgagaagagcagctttcttgaaacacaacctttgggttactccctatgcacgcgatgaaatgcatccaggcggagagttccctaatcaaaatccacgcgttggagagggtttggccacatgggttaagcaaaaccgatcgctggaggaagctgatatagttctctggtacgtctttggagtgacacacattcctcgactggaagactggcctgttatgccagtggaacacattggtttcatgcttatgccgcatggttttttcaactgctccccagcaatagatgttccaccaaatccaggtgatttggatgataaggagaataatggcttgcctaccaaacctaatcaaaatgggctaattgccaagctttgaaatgattgaaaacctagacaatcaggctctggcctctctacgtggttatgttcaaataataggctctggcctctctacgtggttatgctcaaataattcaatgttaaatactactctttgtactggtgtagtcttcaacctggctgggtaa

SEQ ID NO: 5457 - DNA, 2343 bp, Fragaria vesca
gcggcggcacctccatcaaatgccgtcgttttggcctccaccgcaggcatccccatcatggttagggctcaatcaaggcatcctttggaacctttatgtccagctgaaatctctgtggcagtggcgactgtcagggcagctggagcaacacctgaggtcagagatggtatgcgttttgctgaagtggttctactagaaccagataagcatgttgtcgcattagcagatgcgtacttcttccctcctttccaaccctcgttacttccgagaaccaaagggggacatatgataccctctaagcttcctccgaggcgagctagacttgttgtttacaacaagatgtcaaacgagacaagtacatggattgttgagctttcagaagtgcatgcagctactcgtggtggacatcacagaggaaacgtaatatcatcacaagttatccatgacgttcagccttcaatggatgctgtggaatacgctgaatgtgaagctgttgtgaaggactttcccccatttagagaggctatgaagaagaggggcattgaagatatggatctcgtgatggttgatgcctggtgtgttggttatcatagcgaggctgatgctcctagcaaaagacttgctaaaccattgatattctgtagaactgagagcgactgccccatggaaaatggttacgcacgccctgttgagggaatctatatacttgttgatatgcagaacatggaggtgatagagtttgaagaccgtaagctggttcctctacctccagccgatccattgagaaactatacttgtgctgaaacaagaggaggtgttgatcgaagtgatttgaagcctttaaaaattgttcaggctgagggtccaagttttcgtgtggatggatactttgtagagtggcagaagtggaactttcgtgttggatttactccgaaagagggactagtcgtatattcaattgcgtacgatgatggcagcagggggcggaggcctgtagcgcataggctgagctttgtggaaatggtggtgccttatggagatcccaatgatccacattacagaaaaaatgcttttgacgctggagaagatggccttggtaaaaatgcacattctctaaggaaggggtgtgattgttctggctatgtcaaatattttgatgctcattttacaaactttactggaggtgttgaaacaattgagaattgtgtatgtttgcacgaagaggaccatggcatgttgtggaagcaccaggactggagaacaggctttgcagaagtgcgcaggtcaagaaggcttacagtttcttttctatgtactgtggctaattacgaatacggattcttctggcacttttatcaggatgggaagattgaagctgaagttaaactcactggaatactcagcttaggagcactacaacctggagaagttcgaaaatatggtactgttattgcaccagggttatatgcaccagttcatcagcacttctttgttgctcgtatggatatggctgttgattgcaaacctggggaagcatacaatcaggttgtagaggtagatgttaaagttgaagaccctggagagaataacgtccacagcaatgcattttatgctgaggagagacttcttagaactgaatcggaggcaatgcgagactgtaatgccttatctgcccgccactggattgtaaggaacacaagaactgttaacaggactggacagttaactggctacaagcttgtacctggttcaaattgcttgccattagctggttctgaggccaagtttttgagaagggcagcttttttgaaacataatctttgggttacacaatattcacctgatgagatgtttcctggaggagaattccccaaccaaaacccacgagtcggtgaaggattggcgacatgggttcagaagaatcgatctcttgaagaaactgacattgtcctttggtacgtgtttgggataactcacgtccccaggttagaagactggcctgtaatgccagtggagcacattggctttaagcttgtgccgcatggattcttcaactgctctcctgcagtggacgttcctcctagtgcttgtgaatcgaaagccaaagaagatgatgttaaagacaatgggttgatggcaaagctttgaagagatgctgtgttggtcttttagaattcgaccaaaaaagggagaagttcttgggaagactggcaaagcacctaagaacacatattttgtagctatgcatggtttgtttttttatgtagatcataaggttttgttgtcagatcaatttatgaataaattttgctatggtgatttaataacactggtccattctac

SEQ ID NO: 5458 - DNA, 2640 bp, Phalaenopsis aphrodite
atcggagcgctttcccttctcggcggcggcgttggtggcgcagagggaggagaaagaggaggggaaagggaaagacggtgacgaggtctgctgtatgtcagatcgtagtgaagagggatactacggcgaattcggcgagctcgcaaacccattgcaatggccgcagctgaggaaaaggcgacgcctagattccctagtgccgaagctgtcagcggaggcacagttaggggaaaggctgctggagttggagcggcggcaggatgggttgctgaggatgccgctggagggggcggcggtacaaagactatgaacgccggtgttcttatccggcctgtcgatgatctgccggatcctccggcaaagccttctaccaagggcatccaggtgatgccgagggctcagtcaagccacccattagacccgttatcagctgctgaaatttctgtggcagtagcaacagttagagctgctgggaggacccctgaggtgcgagatagcatgagatttgttgaagtagttcttttggaaccggagaaaagtgttgtggcacttgcggatgcctactatttccctccatttcaaccatctctgctcccaaggacaaaaggtggtcctgtcatacccagtaagcttccacctaggagggctaggcttgttgtgtacaacaagaagtctaatgagaccggtatatggattgttgagctgacagaagtacatgcagcaactagaggtgggcatcacaggggaaaggtcatctcgtcagatgtagttccggatgtccaacctcctatggatgctatggaatacgcagaatgtgaagctacagtaaaagatttccttccattcagggaagctatgaggaagcgaggcattgaggacatggatctagttatggttgatgcatggtgtgttggttactatggcgaagcggacgcccctagccgcagattggctaaaccgttgatcttttgtagaactgagagtgactgccccatggagaatggttatgctcgtcctgttgaaggcattcatattgtcgttgatattcagaatatggttattattgaatttgaggatagaaagctggtacctctacctcctgctgatccgttgagaaactacactccaggggaaacacggggaggtgttgaccgaagtgacttgaagcctctacacattcatcagcctgaaggcccaagttttcgtgtcaatggttactttgttgagtggcagaagtggaacttccgaattggtttcactcctagagagggtttggtaatccattctgttgcatatattgatggtagtcgtggacgtaggtctatagctcatcggctgagttttgttgaaatggttgttccatatggagatccaaatgaaccacactaccgaaagaatgcatttgatgctggtgaagatgggcttgggaaaaatgcacattctctaaagaagggttgcgactgtttgggttacatcaaatattttgatgctcattttacaaattacactggtggtgtagaaactattgaacaatgtgtatgcttgcatgaagaggaccacggcgttttgtggaagcatcaggattggagaactggccttgcagaagttagacgttcaaggaggctttctgtatcattcatatgtacggtggctaactatgaatatggtttcttttggtatttttaccaggatggaaaaattgaagctgaggtaaagctaactggagttctaagcttgggagcattgctacccggtgaatcaagaaaatatggtactacaattgctcctggcttatatgcgcccgttcatcaacatttctttgttgctcgcatggacatggcagttgattgcaaaccgaatgaaacttttaatcaggttgtggaggtgaatcttaaagttgaagaaccgggcaaaaataatgttcacaataatgcattctatgcagaagaaacagttcttaggacagaattgcaagcaatgcgtgattgtaatcctctatcagcacgacattggattgtgaggaacacaagaaccgtcaatcgaacgggacagtttactggctacaaactattacctggttcaaattgcctgccattagctggcccagaggcaaaatttctaagaagagctgcctttttgaagcacaatctttgggttacatcatatagccgcgatgaaacgttccctggaggagaatttcccaatcagaatccgcgtataaatgagggattggctacatgggttaagaagaatagatcactcgaggaaacggatattgttctctggtatgtatttggaattacgcacattcctaggttggaagattggccagtcatgcctgttgatcgcctggggtttacgcttatgcctcatggtttcttcaattgctcccctgctgtggatgtgccgcccagcgatattgagctgaaggagaacgcaatctcgaagccaatccataatggtttgctaagtaagatgtgaggaaatgctgagaagccagcgttatttatctaaaacattctgttgactgaataagtggtcttataatgaataatgttgtgctataagttgctttaactacaatcttgctttgaaacttcttatttactgtttgaaattttgaaggtaatgaaattaaat

SEQ ID NO: 5459 - DNA, 2616 bp, Zea mays
cgaggcggaggcggaggaggagactacggacacggtcagctcgcgaacccgctccaatggccgcagctaaggaaaaggcgtcggtatgctgccgcgatgcgcccgcgcgtgtcgctggcgccccagtcgtccccatgcgcgcgatcgccgcgtccccggtcggcaaggtcgtcgccctcgccgcgggaggcggtgagcgcgtttctgcgtcggctgctggctcaagcggcgccgtgatcgaggagatcgccgcggtccagcccaccaccgcgaaggcatcctccaaagggataccaataatgacaagagcccagaggtgtcaccctttggacccattatctgctgctgaaattgcagttgctgtagcaactgtaagagttgctggaagatctcctgaggaaagagacagcatgcgctttgttgaagctgtgctgttggagccagaaaagaatgttgtggcactggccgacgcctacttctttccacctttccaaccatcactgctccctagaagcaaaggttctgctgttattccaagcaggctacctcctaggagggccagacttgttgtctataacaaacaatcaaatgagacaagtatttggatagtggaactatctgaagtgcatgccgctactaggggtggacatcacagagggaaggtgatatcatctgaagttattccggatgttcaacctgccatggatgctatggagtatgctgaatgtgaggctactgtcaaaagttatcctccatttattgaagctatgaagagaagaggtgtggatgacatggatcttgttatggtggatgcttggtgtgctggctactacagcgaagctgatgctcctagtcgcagacttggcaagcctttgatattttgcagaactgagagtgatagccccatggagaatggttatgctcgtcctgtagaaggaatccatgttgttgttgatatgcagaataatgctgtgatagagtttgaagataggaagttggttcctctaccccctccagatcatttgagaaactatactcctggggagacaagaggaggtgttgatcgaagtgatgtaaaaccacttatcatcaatcagcctgagggtccaagttttcgaattaatggctattttgtggaatggcagaagtggaacttccgtattggcttcacccccaaagagggtttggttatctattctgttgcttatgttgatggtagccgtggacgtagacctatagcacataggctgagctttgttgagatggttgttccttatggagatccaagtgaaccacattatcgcaagaatgcatttgatgctggagaagatggacttggaaaaaatgctcattctcttaagaagggatgcgattgcttgggctacataaaatattttgatgcacatttcacaaacttcactggtggtgtggagacaattgagaactgtgtttgtttgcatgaggaggatcatgggatcctttggaaacatcaagactggagaactggtttagcagaagtaaggcggtcaaggaggctcactgtttcatttatctgtacagttgcaaactatgagtatggtttttactggcacttctatcaggatgggaaaatagaggcagaagtaaagcttactggaattctcagtttaggggccttgatgcctggggaatcgaggaaatatggcacaactattgcccctggtctgtatgcaccagttcatcagcatttctttgttgcccgtatggacatggctgttgattgcaaacctaatgaagctcataaccaggtggttgaggttaatgttaaagtggaaagtgcaggcacacataatgtgcataataatgctttctatgctgaagagaagttgctcaaatctgagttgcaagcaatgcgtgattgcgacccttcatctgcccgccactggattgtacgcaacacacgaactgtgaatcggacggggcagccaactggctacaggctcgtacctggttcgaactgcctgcctttggctctgcctgaggcgaaatttctgaggagggctgggttcttgaagcacaacctctgggtcactcaatacaagcgtggcgagatgttccctggaggggagtttcccaaccagaatcctcgcatccatgagggtctgccaacatgggtcaagaatgataggcctctggaggaaaccgacattgttctctggtacgtgttcgggctcacccatatccccaggctagaagattggccagtcatgccggtggagcacataggcttcatgctcatgccacatggattcttcaactgctcgcctgcggtcgacgtgcctcccagctcgtccgatgcggatgtcaaggaagccgagtcgcccaaggccatccagaatagcctcatatcgaagctgtgagctttgctgttctgccgaggaaaaaggatccgcgcgcggctgctctccctactatttttttatcgtattccgcgagtaaaaaggaaaactgctcgatgtccttttgtttgttgcttggtaataccgttctgtttgctataattatcgatcagcgggatgtgaagtactgtttacattgctcgcgttctaataaagtactgtttggacttgcttaaca

SEQ ID NO: 5460 - DNA, 2736 bp, Brassica rapa
gtttgtttcttcctcccaccaccacgggaaaggtacgatcacactcatacttaaagagagagagaagctcagatcaaattgaacttcggagctggtggagagaagggaagggaaggggggagatcacgccgacggatagagataggttttgctgtatgtcattggattgcgttgagacttactttggtggatttggcgaactcgtgaaccctattcaatggcctcagcttcgaaaacggcgtcggtttgtgctcacggcggaggaggctttgctccgtctccgaagctcgtctccgccgtggccaatacaaggtccgtcggaagctccgagagtgacgatcggcgagattctaaggttgctgtggattccgtagtccgccccgtcgattcgatgcctgatacggccaagaaacctgctaacaaaggaatctctgtgatgccaatgccaaggacggaaacaaagcaccctttggatcctctctccgctgcagaaatatctgttgctgtggccactgttcgcgcggctggtgctaaccctgaggttagagatagcatgcgttttattgaggtggcgtctgtggaaccggagaagaatgttgtggcgttggcagatgcgtattttttccctccgttccagccatcactacttccaagaactaaagctggacctgtgatacctatgaggcttcctccaaggcgagcaaaacttgttgtgtacaacaagaagtctaatgagacgagtgtgtggattgttgagttgtccgaggttcatgctgtgactagaggtggacatcacaggggaagagttgtttcctcggaagtgatacctgatgttcagccgcccatggatgccgctgagtatgctgaatgtgaagcgattgtcaaagacttccccccattcatcgaggcaatgaagaggagaggtattgatgacatggatctagtgatggttgatccctggtgtgttggctatcatagcgaagctgacgctccaagtcgtaggcttgcgaagccccttatatactgtcgtactgatagtgattcccctatggaaaatggctatgctcgtccagttgagggcatttatgtacttgtagacatgcagaacatggtggtgatcgagtttgaagaccgtaagtttgtgccacttcccccacctgaccctttgaggaattacacaccaggtgagagtagaggaggtgttgatagaagtgatgttaagcctctccagattattcagcctgaaggtccaagcttccgcgtaaggggttactttgtcgagtggcagaagtggaactttcgtattgggttcactccaagggaaggtttagtcatacattcggtagcatatgttgatggcagtcgaggtcgaaggcctgttgcacacaggctaagttttgtggagatggttgtgccttatggtgatccgaatgagccacattacaggaaaaatgcttttgatgcaggggaggatggtcttggaaaaaacgcacattcgcttaagaaggggtgcgactgtctcggaactattaagtacttcgatgctcatttcacaaatttcactggaggggttgaaacaattgagaactgtgtatgcttgcatgaagaggaccatgggatcttgtggaaacatcaggactggagaacaggattagctgaagtgcgaagatctaggaggctaactgtctcctttttatgcactgttgctaactacgagtatggattttactggcacttctaccaggatgggaaaatcgaagctgaagtaaaacttactggtatcctcagtttaggagcgctacagccaggagaaactcgaaagtacggtactactattgctcctgggttgtacgcaccagttcatcaacatttctttatcgctcgtatggatatgtctgttgactgtaaacctggtgaagctttcaatcaggtagttgaggtaaatgtcagagttgacgagcaggtgagaacaatatccacaacaatgcgttttatgcggaagagaagttacttagatccgaggcagaggcgatgcgtgactgtgacccttttagtgctcgccactggattgtaaggaacacaaggacagtgaacaggacggggcaattaacgggatacaaacttgttccgggctcaaactgtttgccattagctcgacccgaggccaagtttctaagaagagcagcgttcctgaagcataatctttgggttacccgttatgaccctgaagagaagtttccaggaggagagtttccaaaccaaaacccacgttctggtgaaggtcttgccacgtgggtgaaacagaaccgttccttggaagagtctgacgtcgttctttggtatgtgtttgggatcatacatgttcctagacttgaagattggccggttatgccagttgaacatattggtttcacactaatgccacatggatttttcaactgctcaccagccgtggatgttccaccgaatccagcatgcgaattggagaccaaggacagtgaggtcaaagaggtagtagcagcacccaagcctggtttactttcaaagctttgagcatgaaagactttttttttataatttggagacactgctgttgctctattcattttcggattggaaaccgttgttatttggtgtgtgtttgttgcaaactaaaagacatttgtcattggaatgttctttgcttttgtcaaacattatcgttcattactaatacatagttttatcccaataatc

SEQ ID NO: 5461 - DNA, 2810 bp, Echinacea purpurea
atatacatatacatccactatatatatacacacacagtgtttgtgcagctactgtacgccattggagcacctaccacagtggtgactccggcggttacagtgacaatcacaaccatctgcaatggcctcaacgtcggaaaaccctccgcctcttctccgccgtgaggctacttccgacgttgtccaggactggaccaccgatccttccgtcggcgatcagattcgccaccgcggtactgctgcttccgtcgataactccactcgtcctgtcgttgttgctcaaacttccgctgctaccgctgctgctaaaggacctgggccaaccagtatggttaaagcacaaactcgccatccactcgatcctttagcggctgccgaaatttccatagcagtggcaaccgttagagctgcaggagcaacaccagaggtaagggatagcatgcggtttatagaggtggtacttgtggaaccatcaaaaagtgtggttgcattagcggatgcatatctttttccaccttttcaaccgtcattgttgcctagaacaaagggaggtccaataattccgaccaaacttccacctcgacaagctagactaattgtttataataagatatcaaatgaaactagtatatggattgttgagctatcagaagttcatgccctgactcgtggtggtcaccatagagggaaagtcatttcttctaaagtggtgcctgatgtacaacctccaatggatgctgtggaatatgctgaatgtgaagccgttgtaaaagacttccctccatttagggaggccatgaagaggaggggtattgaagatatggaccttgtgatggtagatccctggtgtgttggttatcacagcaaagctgatgctcctaaccgtagactagcaaaaccccttattttctgtagaacagaaagtgactgtcccatggaaaacggttatgcccgcccagttgaaggaattgatgttttagttgatatgcaaaatatggtggtgatcgaatttaaagaccgcaaactcattcctctaccgccagccgatccactgagaaattacacagctggcgaaacgagaggcggtgtagatcgaagtgatgtgaaaccactaaacattgttcagcccgatggcccgagcttccgcgtgaatggccattttgtacagtggcagaagtggaacttccgtattggattcactcctagggagggtttagtcatccattctgttgcatatgttgacggtaaccgaggtcggaggcctgtagcccacagattaagctttgtagaaatggtggttccttatggtgaccccaacgatcctcattacagaaagaatgcatttgatgcaggggaagatggactaggtaaaaatgcgcattctctgaaaaagggttgtgattgtttggggtatgtcaagtattttgatgcacacttgacaaatttcacggggggtgttgaaacaattgaagattgcgtttgcttacatgaagaagatgatggaattttgtggaagcatcaagattggagaactggtttagctgaagtaagacggtccagaaggctagtagtgtcttttatatgtactgttgccaactatgaatacgggttttattggtatttttatcaggatggaaaaatagaagctgaggtgaaattaactggaattctcagcttaggagctttacaacctggtgaaactagaaaatacgggactacaattgcccctggactctatgctcctgttcatcaacacttctttgttgctagaatggatgtgtctgttgactgtaagcccggtgaatcccacaatcaggtggttgaggtggatgttaaagtggaagaaccaggagatgcaaatttgcacaacaacgcgttctacgctgaagaaaaactgttaaaaactgaacttgaagcaatgcgtgattgtaatccttcatctgcccgacactggattatcaggaacacaagaacagtaaaccgaaccggtcaattgaccggctacaaactagtacctggatcaaattgtttaccattagcggggacggaggctaagtttttgaggagagctgcttttttgattcacaatttgtgggtcacacaatatgatcctgaagaaatgtttcctggtggagagttccctaatcagaatccacgagtcggtgagggattggctacttgggtcaagaaaaatcgatctctagaagaaaccgatctggttctttggtatgtatttggagtgacacatgttcctcgactggaagattggcctgttatgcctgtagaacacattggcttccgtctcatgccacatggattcttcaactgctcaccagcaatcgatgtacccccgagctcgttagctgacatggaaatgaaggaaaatggagtggtagataagtcgtgtcataacggtctcgtttcaaagatgtaaagaaaagatttcccacgcccgtgatttgaaaaactgttgtgatttaggtctcttatggtgtctgctcaatatcaacctgtattttgttacaacatgaaccaaaataatgtgaaatagtggacactggacagattaggatataatgagttatatcccaccttctgcctcaaccactgtgaatactccccgagtaatcgctacaaggtaggttgccgaggcccgagtactctaggtttacactgaatactcgtcgtcgagtactttccgactaggccctgtactcccgggtactctcaatttcgactagtgagcgtttaacgagttttgcttgacactggttttatgtcagtaccgccacacgttcggttcgtttaaa

SEQ ID NO: 5462 - DNA, 2667 bp, Trifolium pratense
ttcttcttcttctttgcagtttcagagagtgagagatagatagagaagtatttgctgtatgtcagtagaatactacagtacagttttctacggtgagcttgctaaccctttacaatggccacaactcaggaaaaaacgacgcccgacccatctctggatccgacccgaaacactacttcccttgattcattccctcctaaaaccactcctacttccaaaggtttcccagtcatgatgagagttcaaacccaccatcctttagatccactatctgcggctgaaatatcagtagctgtagcaactgttcgggcagccggggcaacccctgaggtgagggatagcatgcgctttgttgaagtagtcttagtagaacctgttaagcaagttgttgcactggcagatgcatatttctttcctcctttccaaccgtcattgctccctaggaccaaaggaggaggacctttgattcctactaaacttcccacaaggaaagcacggctagttgtttacaataaaaggtcaaacgagacaagcttatggattgtcgaacttagagaagttcatgcagcaactcgaggtggcccccacaggggcaaagtaatttcttctcaagttgtaccaaatgttcagccaccaatggatgctatggagtatgctgaatgtgaagctgttgtgaaggacttccctccattccgagaagcaatgaagagaagagggattgaggatatggatctcgtaatggtggatgcctggtgtgttggatatcacagtgaagctgatgctccgaaccgcaggcttgctaaaccactaatcttttgtagaagtgagagcgactgccctatggaaaatggctatgcccgtcccgttgaaggaatctatatacttgttgacatgcaaaatatggttgttcttgagtttgaagaccgtaaactgatcccccttccacctactgatccactaagaaattatacttctggtgaaactcggggaggagttgatagaagtgatgtgaaacccttacagattattcagcctgagggtccaagctttcgtgttaacggccactttattcaatggcagaagtggaacttccgtattggtttcactcctagggaaggtttggttatttattcagtggcatatattgatggaagtcgagggcgaaggccagttgcacacaggttaagttttgttgaaatggtggtcccatacggagatccaaatgatccccactataggaagaatgcatttgatgccggagaagatggccttggtaaaaatgctcattctctcaagaagggttgtgattgtttaggctatattaagtactttgatgctcacttcacaaactttactggaggtgttgaaacaatagagaattgtgtttgcttgcatgaagaggatcatggtattttgtggaagcatcaagattggagaacaggtttggccgaagttcgaaggtctagaaggttgacagtgtcttttatatgcactgtagctaactatgaatatggatttttctggcacttttatcaggatgggaaaatagaagctgaggtaaagctcacaggaattctcagcttaggagcaatgcaaccaggtgaaactcgaaaatatggcacaactattgcacctggattatatgcgcctgttcaccaacacttttttgttgctcgtatggatatggctgttgattgcaagcccggtgaagcatttaatcaggttgttgaggtggatgtcaaagttgaagatccgggaaagaataacgttcacaacaatgcattctatgccgaggagagactgctcaaatcagaactggaggcaatgcgtgattgtaaccctttatctgctcgacattggattgttagaaacacacggatggtaaaccgtaccgggcagctaacaggttacaggctagtacctggttcaaactgtttacctttagctggttcagaagccaaatttctgcggagagcagctttcttgaagcacaatctttgggtcactccttatgttcacaatgaaatgcatcctggaggagagttccctaatcaaaatcctcgtgttggagacggtttggctacttgggttaagcaaaatagatcactggaagaagctgatatagttctttggtatgtatttggagtgacgctcatcccacgattagaagactggcctgttatgcctgtggaacgcattggttttatgcttatgccacatggatttttcaattgctccccagctgtagatgttcccccaagtgcaggtgatttggatgataaggagattggaatgcctgctaagcccattcagaatgagctcattgcaaagctctgagtgacctaaaagtacagacatttggtgttatgtttatcctatctctaacataatatttgggttggtctaactcaaccctgtcgaatcgaaccactttgtaatgtgagatatgtttccgcttatatagatacattttcaagttatatctcatttaatgtgagactcttaatacagtgtcagtgagtgtgcaacaatttgatttagttttattacttgcttcatgggggatatttaagagtttctatttagctaatgcatctgatctcattggaaaattatactatttagggcatatttcgaattagtgagtttaatgaaatcatgttaata

SEQ ID NO: 5463 - DNA, 2245 bp, Brassica napus
ctgtaacgccaaggtcggaaacaaagcacccgttggatcctctatctgctgcagagatatcagttgctgtggccactgttcgcgccgctggtgctaaccctgaggttagggatagtatgcgtttcatcgaggtggcgtcagtggagccagagaaacatgttgtggcgctggctgatgcttacttcttccctcctttccagccgtcactgcttccaagaaataagtctggtcctgtgatccctatgaagctccctccaaggcgagcgagacttgttgtgtacaacaagacttctaatgagacaagtgtgtggatcgtggagttgtcttcggttcatgctgtcactaggggtgggcatcacagggggagagtggtttcctcgcaagtgatacctgatgtccagccaccgatggacgcggaagaatatgcggaatgtgaagcgattgtcaaagacttccctccattcattgaggctatgaagaggagaggtatcgatgacatggatcttgtgatggttgatccctggtgtgtgggttatcatagtgaagctgacgctcctagtcgtaggcttgcgaagcctcttatatactgtcgaacagatagtgactgcccaatggaaaatggctatgctcgtccagttgagggaatttatgttcttgtggacatgcaaaacatggtggtgatcgagtttgaagaccgtaagtttgtgccacttcccccacctgaccctttgaggaattatacaccaggtgagagcagagggggtgttgatagaagtgatgttaaacctctcgagattattcagcctgaaggtccaagttttcgcgtaaggggttactttgtcgagtggcagaagtggaactttcgtattgggttcactccgagggaaggtttggtcatacattcggtagcatatgttgatggcagtagaggtcgaaggcctgttgcacacaggctaagttttgtggagatggttgtgccttatggtgatccgaatgagccacattacaggaagaatgcttttgatgcaggggaggatggtcttggaaaaaacgcacattcgcttaagaaggggtgtgactgtctgggatctatcaagtactttgatgcacatttcacaaacttcactggaggagttgaaacaattgagaactgtgtatgcttgcatgaagaggaccatgggattttgtggaaacatcaggactggagaacaggattggccgaagtgcgaagatctaggaggctaactgtctctttcttttgtactgtggctaactacgagtatggattttactggcacttctaccaggatggaaaaatcgaagctgaagtaaaacttactggtatcctcagtctaggagcgctgcagccaggagaaactcgaaagtatggtactactattgctccggggttgtatgcaccagtccatcaacatttctttatcgctcgcatggatatgtccgttgactgtaaacctggtgaagcttataaccaggtagtcgaggtcaatgtcaaagttgacgagcccggtgagaacaatatccacaacaatgctttttacgcagaagagaagttacttagatctgaggcagaggcgacgcgtgactgcgacccttttagtgctcgccattggattgtaaggaacacaaggacagtaaacaggacgggtcagttaacgggatacaaacttgttccgggctcaaactgtttgccattagctcgaccagaggccaagtttctaagaagagcagcattcctgaagcataatctgtgggttacccgttatgcacctgacgagaagtttccaggaggagagttcccaaaccaaaacccacgtgctggtgaaggtctcgctacatgggtgaaacagaatcgctccctggaagaatctgatgtcgtcctctggtatgtgtttgggatcatacatgttcctagacttgaagattggccggttatgcccgtggaacatattggtttcacactaatgccacatggatttttcaactgctcaccagccgtagacgttccaccaaatcctgcatgcgaattggatactaaggacagtgaggtcaaagaggttgtagcaccgaagcctcttcagagtggtttactttcaaagctttgaaacatgacatactttagacttcttataaattggagacattattgttgctcaatttagtttcgaattggaatctttcttgtttggtttgttggttggagactaaaagagtgttccatattaaa

SEQ ID NO: 5464 - DNA, 2527 bp, Brassica napus
aaaaggaggtgcgatcacagttgcctcagcgaaactcagatccggcgagagagaggttttgctgtatgtcagtagattgtgctgagacttactttggtggatttggagaactcgtaaaccctattcaatggcctcagcttcgcaaaagacgacgccatgtgctcaccacggagcctctgctccgcctcctccgaaactcctctccgccgtggagtccgtaatccgccctgtcgattcgatccctgacacggccaagaaacctgcgaacaaaggaatctctgtaacgccaaggtcggaaacaaagcacccgttggatcctctatctgctgcagagatatcagttgctgtggccactgttcgcgccgctggtgctaaccctgaggttagggatagtatgcgtttcatcgaggtggcgtcagtggagccagagaaacatgttgtggcgcttgcagatgcttacttcttccctcccttccagccatctttgcttccaagaactaaagctggacctgtgatccctatgaagctccctccaaggcgagcgagacttgttgtctacaacaagacttctaatgagacaagtgtgtggatcgtggagttgtcttcggttcatgctgtcactcggggcgggcatcacagggggagagtggtttcctcgcaagtgatacctgatgtccagccacccatggatgcggaagaatatgcggaatgtgaagcgattgtcaaagacttccctccattcattgaggcaatgaagaggagaggtatcgatgacatggatcttgtgatggttgatccctggtgtgtgggttatcatagtgaagctgacgctcctagtcgtaggcttgcgaagcctcttatatactgtcgaactgatagtgactgcccaatggaaaatggctatgctcgtccagttgagggaatttatgttcttgtggacatgcaaaacatggtggtgatcgagtttgaagaccgtaagtttgtgccacttcccccacctgaccctttgaggaattatacaccaggtgagagcagagggggtgttgatagaagtgatgttaagcctctcgagattattcagcctgaaggtccaagtttccgcgtaaggggttactttgtcgagtggcagaagtggaactttcgtattgggttcactccgagggaaggtttagtcatacattcggtagcatatgttgatggcagtcgaggtcgaagacccgttgcacacagactaagttttgtggagatggttgtgccttatggtgatccgaatgagccacattacaggaagaatgcttttgatgcaggggaggatggtcttggaaaaaacgcacattcgctcaagaaggggtgtgactgtctgggatctatcaagtactttgacgcccatttcacaaatttcactggaggagttgaaacaattgagaactgcgtatgcttgcatgaagaagaccatgggattttgtggaaacatcaggactggagaacaggattggctgaagtgcgaagatctaggaggctgactgtctctttcttttgtactgtggctaactacgagtatggattttactggcacttctaccaggatggaaaaatcgaagctgaagtaaaacttactggtatcctcagtctaggagcgctgcagccaggagaaactcgaaagtacggtactactattgctccggggttgtatgcaccagtccatcaacatttctttatcgctcgcatggatatgtccgttgactgtaaacctggtgaagcttataaccaggtagttgaggtaaatgtcaaagttgacgagcccggtgagaacaatatccacaacaatgctttttacgcagaagagaagttacttagatctgaggcagaggccacgcgtgactgcgacccttttagtgctcgccattggattgtaaggaacacaaggacagtaaacaggacgggtcagttaacgggatacaaacttgttccggggtcaaactgtttgccactagctcgacccgaggccaagtttctaagaagagctgcattcttgaagcataatctgtgggttacccgttatgcacctgacgagaagtttccaggaggagaattcccaaaccaaaacccacgtgctggtgaaggtctcgctacatgggtgaaacagaatcgctccctggaagaatctgatgtcgttctctggtatgtgtttgggatcacacatgttcctagacttgaagattggccggttatgcccgtggaacatattggtttcacgctaatgccacatggatttttcaactgctcaccggccgtagacgttccaccgaatcctgcatgcgaattggatactaaggacagtgaggtcaaagaggttgtagcaccgaagcctcttcagagtggtttactttcaaagctttgaaacatgacagacttagacttcttataaattggagacattattgttgcaatttagtttcgaattggaatcttttcttgtttggtttgttggttggagactaaaagagtgttccatattaaagagttg

SEQ ID NO: 5465 - DNA, 2514 bp, Panax ginseng
aattttctggggaaaacagaaggagcaggcgaagagagaaaaagggatagagagggggaaaaattgatctgaaaatttgttgtatgtcagtggagtgcaactgctgtgacaaggactacggcgcttacactgagctcgcaaacccattgcaatggcctcagctccggaaaaagcgacgcccctctccgccgatccactggccgccgatcagatccgtctcaccaagagaactcccatggccgctaccttgattcgtcccgttgattccattcctcaaccttccactaatcctacttccgccaaaggactcccaagtctgttcagggctcaaacccgccatcctttggagcctttagcggctgctgaaatatctgtggctgtggcaactgtcagggctgctggagcaactcctgaggtgagagatagcatgcgttttgtcgaggtggtcttggtggaaccagataaacacgtggttgcattagcagacgcatattttttcccacctttccaaccatctttgctccccagaacgaaaggcggacccataattcccactaaacttcctccaaggcaagccagacttgttgtttacaacaaaaagtcaaatgagacgagcatatgggttgttgaactatcagaagttcatgctgtaactagaggtggccatcacaggggcaaagtaatttcttccaaagttgtgcctgatgtacaacctcccatggatgctacagaatatgctgaatgtgaagccattgtaaaggaatttcttccattccgagaggcaatgaagagaaggggtattgaggatatggatcttgttatggtagatccctggtgtgttggttatcacagtgaagttgatgctccgaaccgcagacttgctaaaccacttatcttctgtagaacggagagtgactgtacattggaaaatggttatgcacgtccagtcgaaggaattcatgtattagttgatatgcagaatatgattgtggtagagtttgaagatcgtaaacttgttcctctaccaccagctgatccattgagaaattatactgctggtgaatcaagaggaggtgttgaccgaagtgatgtgaaacccctacatattatccagcctgaaggtccaagtttccgtgtcaatgggtactttgttgaatggcagaagtggaattttcgtattgggttcactcccagggagggtttggtgatttattcggttgcatatgttgatggtagccgaggccgtagacctgtggctcacaggttaagctttgttgagatggttgtcccttatggagatcctaatgatccacattacaggaaaaatgcatttgatgcgggggaagatgggcttggtaaaaatgcccattctcttaagaagggttgcgattgtttaggctttatcaaatactttgatgcacacttcacaaatttcactggaggtgttgaaactatagaaaattgtgtttgcttgcatgaagaggatcatgggatcttatggaagcaccaagattggagaacaggtttagctgaagtacggcggtcaagacggctaacagtgtcttttatttgtacggtggctaattatgagtatggcttcttctggcatttttatcaggatgggaaaattgaagctgaggtcaagctgactggcattctcagcttaggagctctgcaacctggggaaatccgaaaatatgggacaacaatagctcccggattatatgcaccggttcatcagcacttttttgttgcccgtctcgacatggctgtagattgtaagcctggtgaagcacataatcaggttgttgaggtggatgtgaaagttgaagaaccaggggaaaacaatgttcacaacaatgcattctacgctgaagagaaactgctaagatctgaactagaagcaatgcgtgattgtaattccttatctgcccgacattgggttatcagaaacacaagaaccgtcaaccgaactgggcagctaactggttacaagttactaccaggttccaattgtttaccattagctggtgccgaggcaaaagtcctgagacgggctgcttttttgaagcataatctttgggtcacaccttatgcacgtgatcagatgtttccaggaggagagtttcccaatcagaatccacgtgttggagagggattggcaacttgggttaagcagaacaggtctctggaagaaactgatgttgttctttggtatgtatttggaatgacgcatgtgcctcgattggaagactggccagtaatgccagtggaacacattggcttcatgctcatgccacatgggttctttaattgctcgccggcagtggacgtacccccaagctcaggtgacacggatctgaaggacaatgggttggtagcaaaggcatgccatgatgggctgatagcaaagctctgaaagattgttgaggaagtaaaactcacaatttaactatctacataccaaatctgttttaatctatctgtctatctaatatatatatatatatatat

SEQ ID NO: 5466 - DNA, 2148 bp, Nicotiana benthamiana
aatctgaattttacaggactgcctaccttgttgagggctcaaagtcaccaccccttggaccccctaactgccgctgaaattaccgtggctgttgcaactgtcagggcagctggcagtactcctgaggtgagagatagcatgcgctttgttgaggctgttttggtggaaccagacaagagtatgattgctttagctgatgcatacttcttccctcctttccaaccatcgttgttgccgagaacgaaaggtgggcctgtaattcctagtaaacttcctcccaggaaagctagactaattgtttataacaagaaatcaaatgagaccagcatatggattgttgagctctcggaggttcatgctgtgactcgaggaggccaccaccggggcaaagtcatttcatctaaggttgtgcctgatatacagcctccaatggacgctgctgaatatgctgaatgtgaagctgttgtgaaggatttccctccttttcatgatgcaatgaagaagagaggactcgatgatatggaacttgtgatggtcgatgcctggtgtgcaggttacttcagtgaggctgatgcacctaaccgccgtctaggaaaacctctaatattttgcagaactgaaagcgactgtccaatggaaaatggctatgctcgaccagttgaaggaattcatatactggttgatatgcagaatatggttgtgatagagtttgaagatcgtaaagtggttccattaccaccagctgatccattgagaaattacactcctggtgaaacaagaggaggggttgacagaagtgatgttaaacctcttcttataagtcagcctgaaggtcctagcttccgtgtcagtgggcattttgttgaatggcagaagtggaactttcgtatcggttttacccccagggagggtctggttatctattctgttgcatatgttgatggtagtagaggccgtagacctattgcgcataggctgagcttcattgaaatggtagttccctatggggatccaaatgagccacattacaggaaaaatgcttttgatgcaggggaagatgggcttggtaaaaatgcacattccttaaagaagggttgtgattgcttaggctatattaagtatttcgatgcgcattttacaaatttcacaggcggtgttgacacaatcgaaaattgtgtctgcctgcatgaggaggatcatggaatcttatggaagcatcaagattggagaacaggtttagctgaagcacgacgttcgcgacgactaacagtgtctttcatctgtactgttgcgaactatgaatatggattttactggcacttttatcaggatgggaaaatcgaggctgaagttaagctgactggaattctcagcttaggtgctcttctacctggggaagttcgaaaatatgggacaactattgcacctggcttgtatgcacctgtacatcagcacttctttgtggctcgcatggatatggctgttgactgcaaaccaggggaagcacataaccaggtggttgaagtaaatgcaagagttgagccaccaggagaaaaaaatgttcacaataatgcgttttatgctgaagagagattgcttagaactgaattggaagcaatgcgtgattgtagtcctctaactgctcgccattggattatccggaatacaagaacagtcaatcgcaccgggcagttaactggttacaagctagtaccaggtacaaactgtctgccactagctggatcagaggcaaaattcttgagaagagctgctttcttaaagcataatctttgggtcaccccttactctggtgacgagatgtttcctggaggagaatttcctaatcaaaatcctcgtattggtgagggattggctacttgggttaagcagaatcgatccctggaagaaacacagatagttctttggtatgtttttggacttgtacatgttccacgcctagaagactggcccgttatgcctgtggagcacattggttttatgctgcagcctcatgggttcttcaattgctctccagctgttgatgttcctcccagcacagctgactcagatatcaaggaaaatggggtagtggcaaagtcttgccacgatggtggtataatggctaagctttgatagattcaagctagc

SEQ ID NO: 5467 - DNA, 3030 bp, Panicum virgatum
cggaagaaccgagcccacccacaggccacagcgcacgcccagcggctcgggtcacttttcccctcgccttttttctataaatccacgtgagcccccgacgcatcgctctccaaatcacccggcagtcgggcaccctccttcccgagtccctcaccgccaccgccacaccactgcaaacccgagttcccctccccggcggcggctcgctgacggagagaactccgctcgcttacctagggttcccgtaaccctagccccgacccgtacacgcgagggccccggcgacacgaggaggaggcggcggagaggggagggggcagaaggcgcgggaggcgcaggcctgtgctgtatgtcagatcgtgggagccggcgaggcggaggaggaggcggagactacggacacggtcagctcgcgaacccgctccaatggccgcagctcaggaaaaggcggcggcatgctgccgcgccgcgcccgcgcgcgtcgctggaggcgcccctgccgtccccgtgcgggcgatcgccgcgccaccgcccgggaaggtcgtcgccctcgccgcggggtccggtgagcgcgtggccgcgtccgccgccggcgcgggtggcgccgtgatcgaggagatcgccgcggtccagcccacaacggcgaaggcctcctccaaagggataccaataatgacaagagcccagaggtgccaccctttagacccattatctgccgctgaaattgcagttgctgtagcaactgtaagagctgctggaagatctcctgaggaaagagatagcatgcgctttgttgaagttgtactgttggagccagaaaagaatgtggtggcattagctgatgcctacttcttcccacctttccaaccatcactgctcccgagaaccaaaggttctgctgttattccaagcaggttgcctcctaggagggccagacttgttgtctacaataaacaatcaaatgagactagcatctggatagtagaactatctgaagtgcatgcagctacaaggggtgggcatcacagaggaaaggtgatatcatctgtagttgttccagatgttcaacctgcaatggatgctatggagtatgctgaatgtgaggctactgtcaaaagttacccaccatttattgaagctatgaagagaagaggcgtggacgacatggatcttgttatggtagatgcctggtgtgccggctactatggtgaagctgatgctcccagtcgcagacttggcaagcctctgatattttgcaggactgagagtgatagccccatggaaaatggttatgcccgtcctgtggaaggaattcatgttgttgttgatatgcagaataatactgtaatagagtttgaagataggaagttggttcctctccccccaccagatcatttgaggaattatactcctggggaaacaagaggtggtgttgatcgaagtgatgtaaaaccacttattatcaatcagcccgagggtccaagtttccgcatcaatggctattttgtggaatggcagaagtggaacttccgtattggcttcacccccaaagagggtttggttatctattctgttgcgtatgttgatggtagccgtggacgtcgacctattgcgcataggctgagctttgttgagatggttgttccttatggagatccaaatgaaccacattatcgcaagaatgcatttgatgctggagaagatggacttggcaaaaatgctcattctcttaagaagggatgtgattgcttgggatacataaaatattttgatgcacatttcacaaacttcactggtggtgttgagacaattgagaactgtgtttgtttgcatgaggaggaccatggaatcctctggaaacaccaagactggagaactggtttagcagaagtaaggcggtcaaggaggctcactgtctcatttatctgtactgttgcaaactacgaatatgggttttactggcacttctatcaggatggaaaaatagaagcagaagtaaagcttactgggattctcagcttaggagccctgatgcccggggaatcaaggaaatatggcacaactattgcccctggtctgtatgcaccagttcatcagcatttctttgttgcccgtatggacatggctgtggattgcaaacctaatgaggctcataatcaggtggtcgaggttaatgttaaagtggaaagtgcaggcacgcataatgtgcataacaatgctttctatgctgaagagaagttgctgaagtctgagctgaaagcaatgcgggattgtgacccttcatctgcacgccattggattgtaaggaacacgcgaactgtaaaccgcactgggcagccaactggttacaggctcgtgcctggttcaaactgcctgccattggctctgccggaggcgaaatttctgaggagagctgggttcttgaagcacaatctctgggtcacccaatacaagagcgacgagatgttccctggaggggagtttcccaaccagaatcctcgaatccacgagggtttggctacatgggtccagaaggataggcccctggaggaaaccaacattgttctctggtacatgttcgggcttacccatatcccaaggctggaagactggccggtcatgccggtagagcgcatcggcttcatgctcatgccacacggattcttcaactgctcgcctgcggtcgacgtgcctcccagctcctccgatgccgacgtcaaagaagccgagtcgcccaaggccatccagagtggcagtctcatctcgaagctgtgagcttcgctgttcctcgaattaagtgacaaccagggtgctgctgctcctactattctattgtgttgctctaataaaaggaaaactgttttccactgtcctgtggttttttgatgccctgtaatatcgtttcgttcgctatgcttgttaaatgtttatcggcaaactgttgaacagctgcattgctagcttacaataaagtttggactcgcataatatccctggttgtctgcagccctgcaccaatgaaatcatgat

SEQ ID NO: 5468 - DNA, 2788 bp, Panax ginseng
aagcagtggtatcaacgcagagtacatggggacgggagacctacatttacgaccaaaacccaaaaaatataggcagcctgcagccatatctctctctgctagattggcgttattgtagctaaataagtcagccatcataattaattttctggggaaaacagaaggagcgggcgaagagagagaaagggatagagaggggaaagaattgatctgaaaatttgttgtatgtcagtggagtgcaactgctgtgacaaggactacggcgctttcactgagctcgcaaacccattgcaatggcctcagctccggaaaaagcgacgcccctctccgccgatccactggccgccgatcagatccgtctcaccaagagaactcccatggccgataccttgattcgtcccgttgattccattcctcaaccttccactaatcctacttccgccaaaggactcccaagtctgttcagggcccaaacccgccatcctttggagcctttagcggctgctgaaatatctgtggctgtggcaactgtcagggctgctggagcaactcctgaggtgagagatagcatgcgttttgtcgaggtggtcttggtggaaccagataaacacgtggttgcattagcagacgcatattttttcccacctttccaaccatctttgctccccagaacgaaaggcggacctataattcccactaaacttcctccaaggcaagccagacttgttgtttacaacaaaaagtcaaatgagacgagcatatgggttgttgaactatcagaagttcatgctgtaactagaggtggccatcacaggggcaaagtaatttcttccaaagttgtgcctgatgtacaacctcccatggatgctacagaatatgctgaatgtgaagccattgtaaaggaatttcttccattccgagaggcaatgaagagaaggggtatcgaggatatggatcttgttatggtagatccctggtgtgttggttatcacagtgaaattgatgctccgaaccgcagacttgctaaaccacttatcttctgtagaacggagagtgactgtacattggaaaatggttatgcacgtccagttgaaggaattcatgtattagttgatatgcagaatatgattgtggtagagtttgaagatcgtaaacttgttcctctaccaccagctgatccattgagaaattatactgctggtgaatcaagaggaggtgttgaccgaagtgatgtgaaacccctacatattatccagcctgaaggtccaagtttccgtgtcaatgggtactttgttgaatggcagaagtggaattttcgtattgggttcactcccagggagggtttggtgatttattccgttgcatatgttgatggtagccgaggccgtagacctgtggctcacaggttaagctttgttgagatggttgtcccttatggagatcctaatgatccacattacaggaaaaatgcatttgatgcgggggaagatgggcttggtaaaaatgcccattctcttaagaagggttgcgattgtttaggctttatcaaatactttgatgcacacttcacaaatttcactggaggtgttgaaactacagaaaattgtgtttgcttgcatgaagaggatcatgggatcttatggaagcaccaagattggagaacaggtttagctgaagtacggcggtcaagacgactaacagtgtcttttatttgtacggtggctaattatgagtatggcttcttctggcatttttatcaggatgggaaaattgaagctgaggtcaagctgactggcattctcagtttaggagctctgcaacctggggaaatccgaaaatatgggacaacaatagctcccggattatatgcaccggttcatcagcacttttttgttgcccgtctcgacatggctgtagattgtaagcctggtgaagcacataatcaggttgttgaggtggatgtgaaagttgaagaaccaggggaaaacaatgttcacaacaatgcattctacgctgaagagaaactgctaagatctgaactagaagcaatgcgtgattgtaattccttatgtgcccgacattgggttatcagaaacacaagaaccgtcaaccgaactgggcagctaactggttacaagttactaccaggttccaattgtttaccattagccggtgccgaggcaaaagtcctgagacgggctgcttttttgaagcataatctttgggtcacaccttatgcacgtgatgagatgtttccaggaggagagtttccgaatcagaatccacgtgttggagagggattggcaacttgggttaagcagaaccggtccctggaagaaactgatgttgttctttggtatgtatttggaatgacgcatgtgcctcgattggaagactggccagtaatgccagtggaacacattggcttcatgctcatgccacatgggttctttaattgctcgccggcagtggacgtacccccaagctcaggtgacacggatctgaaggacaatgggttggtagcaaaggcatgccatgatgggctgatagcaaagctctgaaagattgttgaggaagtaaaactcacaatttaactatctacatgggaaatctgttttaatctgtctgtctgtctgtctgtctgtctatctatctatctatctatatatatatatatatatatatatatatattgcaatttctggtattggtgggaataaacgtaaggctgtaatatagggatttgctactgctgtctgctgccgcattaaaaatagagacctgtttg

SEQ ID NO: 5469 - DNA, 2494 bp, Panax ginseng
tcataattaattttctggggaaaacagaaggagcaggcgaagagagaaaaagggatagagaggggaaagaattgatctgaaaatttgttgtatgtcagtggagtgcaactgctgtgacaaggactacggcgctttcactgagctcgcaaacccattgcaatggcctcagctccggaaaaagcgacgcccctctccgccgatccactggccgccgatcagatccgtctcaccaagagaactcccatggccgataccttgattcgtcccgttgattccattcctcaaccttccactaatcctacttccgccaaaggactcccaagtctgttcagggcccaaacccgccatcctttggagcctttagcggctgctgaaatttctgtggctgtggcaactgtcagggctgctggagcaactcctgaggtgagagatagcatgcgttttgtcgaggtggtcttggtggaaccagataaacacgtggttgcattagcagacgcatattttttcccacctttccaaccatctttgctccccagaacgaaaggcggacctataattcccactaaacttcctccaaggcaagccagacttgttgtttacaacaaaaagtcaaatgagacaagcgtatgggttgttgaactatcagaagttcatgctgtaactagaggtggccatcacaggggcaaagtaatttcttccaaagttgtgcctgatgtacaacctcccatggatgctacagaatatgctgaatgtgaagccattgtaaaggaatttcttccattccgagaggcaatgaagagaaggggtatcgaggatatggatcttgttatggtagatccctggtgtgttggttatcacagtgaaattgatgctccgaaccgcagacttgctaaaccacttatcttctgtagaacggagagtgactgtacattggaaaatggttatgcacgtccagttgaaggaattcatgtattagttgatatgcagaatatgattgtggtagagtttgaagatcgtaaacttgttcctctaccaccagctgatccattgagaaattatactgctggtgaatcaagaggaggtgttgaccgaagtgatgtgaaacccctacatattatccagcctgaaggtccaagtttccgtgtcaatgggtactttgttgaatggcagaagtggaattttcgtattgggttcactcccagggagggtttggtgatttattccgttgcatatgttgatggtagccgaggccgtagacctgtggctcacaggttaagctttgttgagatggttgtcccttatggagatcctaatgatccacattacaggaaaaatgcatttgatgcgggggaagatgggcttggtaaaaatgcccattctcttaagaagggttgcgattgtttaggctttatcaaatactttgatgcacacttcacaaatttcactggaggtgttgaaactacagaaaattgtgtttgcttgcatgaagaggatcatgggatcttatggaagcaccaagattggagaacaggtttagctgaagtacggcggtcaagacgactaacagtgtcttttatttgtacggtggctaattatgagtatggcttcttctggcatttttatcaggatgggaaaattgaagctgaggtcaagctgactggcattctcagtttaggagctctgcaacctggggaaatccgaaaatatgggacaacaatagctcccggattatatgcaccggttcatcagcacttttttgttgcccgtctcgacatggctgtagattgtaagcctggtgaagcacataatcaggttgttgaggtggatgtgaaagttgaagaaccaggggaaaacaatgttcacaacaatgcattctacgctgaagagaaactgctaagatctgaactagaagcaatgcgtgattgtaattccttatctgcccgacattgggttatcagaaacacaagaaccgtcaaccgaactgggcagctaactggttacaagttactaccaggttccaattgtttaccattagctggtgccgaggcaaaagtcctgagacgggctgcttttttgaagcataatctttgggtcacaccttatgcacgtgatgagatgtttccaggaggagagtttccgaatcagaatccacgtgttggagagggattggcaacttgggttaagcagaaccggtccctggaagaaactgatgttgttctttggtatgtatttggaatgacgcatgtgcctcgattggaagactggccagtaatgccagtggaacacattggcttcatgctcatgccacatgggttctttaattgctcgccggcagtggacgtacccccaagctcaggtgacacggatctgaaggacaatgggttggtagcaaaggcatgccatgatgggctgatagcaaagctctgaaagattgttgaggaagtaaaactcacaatttatccatctacatgggaaatctgttttaatctgtctg

SEQ ID NO: 5470 - DNA, 2639 bp, Echinacea purpurea
ccactatatatatacacacacagtgtttgtgcagctactgtacgccattggagcacctaccacagtggtgactccggcggttacggtgacaatcacaaccatctgcaatggccacaacgtcggaaaaacctccgcctcttctccgccgtgaggctacttccgacgttatccaggattggaccaccgatccttccgtcggcgatcagattcgccaccgcggtactgctgcttccgtcgataactccactcgtcctgtcgttgtcgctcaaacttccgctgctaccactgctactaaaggacctgggccaaccagtatggttaaagcacaaactcgccatccactcgatcctttagcggctgccgaaatttccatagcagtggcaaccgttagagctgcaggagcaacaccagaggtaagggatagcatgcggtttatagaggtggtacttgtggaaccatcaaaaagtgtggttgcattagcggatgcatattttttccaccttttcaaccgtcattgttgcctagaacaaagggaggtccaataattccgaccaaacttccacctcgacaagctagactaattgtttataataagatatcaaatgaaactagtatatggattgttgagctatcagaagttcatgccctgactcgtggtggtcaccatagagggaaagtcatttcttctaaagtggtgcctgatgtacaacctccaatggatgctgtggagtatgctgaatgcgaagccgttgtaaaagacttccctccatttagggaggccatgaagaggaggggtattgaagatatggaccttgtgatggtagatccctggtgtgttggttatcacagcaaagctgatgctcctaaccgtagactagcaaaaccccttattttctgtagaacagaaagtgactgtcccatggaaaacggttatgcccgcccagttgaaggaattgatgttttagttgatatgcaaaatatggtggtgatcgaatttaaagaccgcaaactcattcctctaccgccagccgatccactgagaaattacacagctggcgaaacgagaggcggtgtagatcgaagtgatgtgaaaccactaaacattgttcagcccgatggcccgagcttccgcgtgaatggccattttgtacagtggcagaagtggaacttccgtattggattcactcctagggagggtttagtcatccattctgttgcatatgttgacggcaaccgaggtcggaggcctgtagcccacagattaagctttgtagaaatggtggttccttatggtgaccccaacgatcctcattacagaaagaatgcatttgatgcaggggaagatggactaggtaaaaatgcgcattctctgaaaaagggttgtgattgtttggggtatgtcaagtattttgatgcacacttgacaaatttcacggggggtgttgaaacaattgaagattgcgtttgcttacatgaagaagatgatggaatattgtggaagcatcaagattggagaactggtttagctgaagtaagacggtccagaaggctagtagtgtcttttatatgtactgttgccaactatgagtacgggttttattggtatttttatcaggatggaaaaatagaagctgaggtgaaattaactggaattctcagcttaggagctttacaacctggtgaaactagaaaatacgggactacaattgcccctggactctatgctcctgttcatcaacacttctttgttgctagaatggatgtgtctgttgactgtaagcccggtgaatcccacaatcaggtggttgaggtggatgttaaagtggaagaaccaggagatgcaaatttgcacaacaacgcgttctacgctgaagaaaaactgttaaaaactgaacttgaagcaatgcgtgattgtaatccttcatctgcccgacactggattatcaggaacacaagaacagtaaaccgaaccggtcaattgaccggctacaaactagtacctggatcaaattgtttaccattagcggggacggaggctaagtttttgaggagagctgcttttttgattcacaatttgtgggtcacacaatatgatcctgaagaaatgtttcctggtggagagttccctaatcagaatccacgtgtcggtgagggattggctacttgggttaagaaaaatcgatctctagaagaaaccgatctggttctttggtatgtatttggagtgacacatgttcctcgactggaagattggcctgttatgcctgtagaacacattggcttccgtctcatgccgcatggattcttcaactgctcaccagcgatcgatgtacccccgagctcgttgactgacatggaaatgaaggaaaatggagtggtagataagtcgtgtcataacggtctcgtttcaaagatgtaaacaaaagatttcccacgcgcgtgatctgaaaaactgttgtgtgttaggtctcttgtggtgtctgctcaatatcaacctgtattttgttacaacatgaaccaaaataatgtgaaagagtggacactggacagattaggatataatatgagttatatcccaccttctgcctcaaccactgtgaatactccccgagtaatcgctacaaggtacgttgccgagg

SEQ ID NO: 5471 - DNA, 2549 bp, Cyclamen graecum
tagagagagaggtggattccggcggttattgctgtatgtcagtggagtggtgtactggattcacagccgagctcgttaaccctctccaatggcctcagcttcgaaagagacgacgcttgctgaagcagctccggcctccgcggaggtggtgctgcaggattggccggtcggcggagagcgaggcggcgatcggatcattcagaagcccgcttccggtgttctgtctaaaggtatagttacaacgataagggctcaaaccagtcatccattagacccgctaactgctgctgaaatcaaggtggctgtggcagccgtgagggcagctggagccacacctgagataagagatagtgtgcgatttattgaagtggtacttttggagccacccaagaatattgttgctttagcagatgcctatttcttccctcctttccaaccatcactactaccccgaaccaaaggtgggcctatgattcctagtaagcttcctccaaggcaagcgagattgattgtctacaacaaaaagtcaaacgagacaagcatatggattgttgaactaagtgaagtgcatgcaacaactcgaagtggacaccacaggggaaaagttgtgtcatcagaagttgttcctgacgttcagcctcccatggatgctgtagaatatgctgaatgtgaagctgttgtgaaagattatcctccatttcaggaggcaatgaagaagagaggcgttgaggacatggaccttgtcatggtcgatccctggtgtgctggttatcacagtgatgctgatgctcctaaacgtagacttgccaagccgctaatattttgcagaacagaaagtgattgtcccttggaaaatggttatgcacgcccagtcgaaggtattcatgtaattgtagatatgcaaaacatggtggtgattgagtttgaagaccgcaaacttgtcccattgcccccagctgatcctctacggaactatacccctggggaaacaagaggtggaattgatagaagtgatataaagcctttactaattgatcaaccagagggtccaagctttcgtgttaggggtaactatgttgagtggcagaagtggaattttcgtattggtttcactccgagggagggtttggttatacattctgtcgcttatgtggatggcagtcggggtcgaaggcctgtagctcataggttgagttttgtggaaatggtagttccctatggagatccaaatgaaccacattatagaaagaatgcatttgatgcaggtgaagatggtcttggaaaaaatgcacattcccttaagaagggatgtgactgtttgggttatatcaaatattttgatgctcatttcacaaatttcaccggaggtgttgaaacaattgaaaactgtgtttgtatgcacgaagaggattatggtatcctttggaagcaccaagactggagaactggcttggcagaagttcggaggagcagaaggctaacagtttctttcctgtgcactgtggcaaattatgaatatggattcttctggcacttctatcaggatggtaaaatcgaggctgaagtcaaactaactggtatactcagcttgggtgccctgctgcctggagaaattcggaaatatggtaccatgattgctccagggttatatgcaccagttcaccaacacttctttgttgctcggatggatatggctgttgattctaaacctggagaagcacacaatcaggttgtagaggtgaatgtaaaagttgaagagcctggaaagaataatattcatcacaatgcattttattgtgaggagacactgcttagatcggaaacacaagccatgcgtgatattaaccctttgtctgctcgacactggattgtccggaatacaagacaagtcaataggaccggacagctgactggatacaaacttatacctggttcaaactgtctgccactggctggtgctgaggctaagtttctgagaagagctgccttcttgaagcataacctttgggttacacaatatgcacatgatgagaattttcccggaggggagtttcctaatcaaaaccctcgagctggtgagggattggcaacctgggtcaagcaaaatagatctctggaagaaactgacattgtcttatggtatgtgtttgggattactcatgttcctcgtctcgaagactggccagttatgccagtggaacacattggttttacacttcagccacatgggtttttcaactgctctcctgcggttgatgttcctcctagtgcatgtgacatggataccaaagccgacaatggagcagcaaagccgatgatggcgaagctataaactttgttatatcaccatgtcttgtgttctttttagaactcgctatgtttgatgagtagttctctcacaacatagtttttcttttacattctgggaattttgtcgaactttgcttagtttggaactccgtcaggtgtatgataatgggtatgtcaataaacggacttttgatgaaaaacgcgtctaattaccattgcaattgaaatgaaggcgagat

SEQ ID NO: 5472 - DNA, 2751 bp, Lupinus angustifolius
aaagaacagaaaattagttgtaaaagtagctatatatctacttacatgtatcttctgaattaactcactcaccaactttctctctctcggccgtgagtatcagttttttgtggttgtggcggtggcggcggcggcggtggagagtggtggtgacttgcattcttcatcctgtatgtcagtggaacattacagttggattttttactgcggtgagtttgctaatcctttacaatggcctcaactcagaaaaaaacgacgccttgttgttcccccggagttattaacaacaaccccacaacaccttcttctcctcccatctccgccttcatctccgccgttgattccctctccgatactcctcccaaaaccccttctgccaaaggtatccctgtcatggtgagagctcaaacctgccaccctttggatccactttctgctgctgaaatatcagtagctgtagcgactgttcgggcagccggcgcgacacctgaggtgagggatggcatgcgctttgtcgaagtagcattgatagaaccggataagcaagttgttgcattagcggatgcatacttcttccctcctttccagccatcactgcttccgaggacaaaaggtgggcctgtgattccatctaaacttcctccgagaaaagcaagactcattgtttacaataaagggtcaaatgagacaagcatatggattgttgaactctcagaagttcatgctgcaactcgaggtggacaccatagaggcaaagtcatttcttctaaagttgttcccgatgttcagcctccaatggatgctgtggagtatgctgaatgtgaagctgttgtaaaggacttccctccatttcaagaagcaatgaagaagagaggaattgaggatatggatcttgtgatggtagatccctggtgtgctggatatcacagtgaagctgattctcctagccgaagacttgctaaaccactaatcttttgtaggactgagagtgactgccctttggaaaatggctatgctcgtccagttgaaggaatccatgttcttgttgatatgcaaaatatggttgttcttgagtttgaagaccgtagacttgtaccccttccgccagctgatccactaaggaattacacctctgccgaaacccgaggaggagttgaccgaagtgatgtgaaacctttacaaattattcagcctgaaggtccaagttttcgtgtcaatgggcacttcattcaatggcagaagtggaactttcgtattggattcactcctagggagggtttggttatttattcagtagcctatattgatggaagtcgaggtcgaaggccagtggcccacagactgagttttgttgagatggtggtaccttatggagatccgaatgatcctcactataggaaaaatgcttttgatgctggcgaagatggccttggtaaaaatgctcattctctcaagaagggatgtgattgtttaggctacatcaagtactttgatgcgcacttcacaaacttttatggaggtgttgaaacaattgagaattgtgtttgcttgcatgaagaagatcatggaattttatggaagcatcaagattggagaacaggtttggccgaagttcgacggtctagaagactaacagtgtcttttatatgtactgtagctaactatgagtatggatttttctggcacttttatcaggatggaaaaatagaagctgaggtcaaactcacaggagttctcagcttaggagcattgcaacctggtgaaactcgaaaatatggcacaactattgcacctggattgtatgcgcctgtccaccaacacttctttgttgctcgtatggacatggcagttgattgcaagcccggtgaagcgtttaatcaggttgttgagatgaatgttaaagttgaagagccaggaaataataatgttcacaacaatgcattttatgctgaggaaaagctgcttaaatcagaattggaagcaatgcgtgattgtgattcttcatcggctcgtcattggatcgttaggaacactaggacggtgaaccgaactgggcatctaacaggtttcaagcttgtacctggctcaaactgtttaccgtttgccggttcagaggccaagtttctgagaagagcggctttcttaaagcacaatctctgggtcactgcttatgctcatgacgaaatgtatcccggaggagagttccctaatcaaaacccgcgtgccggggagggtttggctacttgggtcaagcaaaatcgaccactggaagaagctgacatagttctttggtacgtgttcggagtgacacacattcctcgactggaagactggccaatcatgccagtcgatcgcatcggctttatgcttatgccacatgggtttttcaattgttcaccagcagtagatgttcctccaagcacaagtgagttggatgagaaagagaatagtattcatcacaacaaacctattattcagaatggcttcattgccaagctttgaaaccatcaccaaaagcttcaattactattgtttcaatcttaataataataaaaaaataccactcttgttaaataatcaaagattgaagaagttgcttagattgatttgcatgtactatgatgtttgtagaattcaaatgataattcttctatatatgataactcttcactatagttgtatttccacacaccaaaaggtcattaagaaattaaaatttagatccccaatataatatttctatatttagac

SEQ ID NO: 5473 - DNA, 2878 bp, Echinochloa colona
acggagagaacccggccccgctccctcccctagggttcccggaaccctagcccccgacccgtacgcgcgagtgccccggcgacgaggaggcggcggcggagaggggagggggcagaaggcgcgggaggcgcaggcctgtgctgtatgtcagatcgtgtgtgccggggaggcggaggcggaggcggagagtacggacacggtcagctcgcgaacccgctccaatggcctcagctaaggaaaaggcgtcggcatgctgccgcaccgcgcccgcgcgtgtcgctggaggcgcgcccaccgtcgcccccgtgcgggcgatcgccgcgtccccgcccgggaaggttctcgccatcgccgcggggggcggtgagcgcgtggccgcgtccgccgctggcgcaggcggcgccgtgatcgaggagatcgccgcggcccagcccaccaccgcgaaggcctcctccaaagggataccaatcatgacaagagcccagaggtgccaccctttagacccattatctgctgctgaaattgctgttgctgtagcaactgtaagagctgctggaagatctcctgaggaaagagacagcatgcgttttgttgaagctgtgctattggagccagaaaagaatgttgtggcattagctgatgcctacttcttcccacctttccaaccatcactgctcccgagaagcaaaggttctgctgttattccaagcaggttgcctcctaggagggccagacttgttgtttacaacaaacaatcaaacgagactagcatttggatagtagaactatctgaagtgcatgcagctactaggggtggacatcacagagggaaggtgatatcagctgaagttgttccagatgttcaacctgcaatggatgctatggagtatgctgaatgtgaggctactgtcaaaagttacccgccgtttattgaagctatgaagagaagaggtgtagatgacatggatcttgttatggtggatgcctggtgtgctggctactacagtgaagctgatgctcccagtcgcagacttgccaagcctctaatattctgtaggaccgagagtgatagtcccatggagaatggttatgctcgtcctgttgaaggaatccatgctattgttgatatgcagattaatgctgtgatagagtttgaggacaggaagttggttcctctgccccctccagatcatttgagaaattatactcctggggaaacaagaggcggtgttgatcgaagtgacgtaaaaccacttattatcaatcagcctgaaggtccaagtttccgcattaacggctattttgtggaatggcagaagtggaacttccgtattggcttcaccccaaaagagggtttggtcatctattctgttgcttatgttgatggtagccgtggacgtcgacctatagcgcataggctgagctttgttgagatggttgttccatatggagatccaagtgaaccacattatcgaaagaatgcatttgatgctggagaagatggacttggaaaaaatgctcactctcttaagaagggatgtgattgcttgggctacattaaatattttgatgcacatttcacaaacttcactggtggcgtggagacaattgagaactgtgtttgtttgcatgaggaggatcatggaatcctttggaaacatcaagactggagaaccggtttagcagaagtaaggcgatcaaggaggctcactgtctcatttatctgtacagttgcgaactatgagtatggtttttactggcacttttatcaggatggaaaaatagaagcagaagtaaagcttactggaattctcagcttaggagcccttatgcctggggaatcaaggaaatatggcacaactattgcccctggtctgtatgcaccagttcatcagcatttctttgttgcccgtatggacatggctatcgattgcaaacctaatgaggctcataatcaggtggtcgaggttaatgttaaggtggaaagtgaaggcacgcataatgtgcataacaatgctttctatgccgaagagcagttgctgaagtctgagttgcaagcaatgcgtgattgtgatccttcatctgcacgccactggattgttaggaacacacgtaccgtcaataggaccgggcagccaactggttacaggctcgtgcccggttctaactgcctaccgctggctctccccgaggccaaatttctgaggcgagctgggttcctgaagcacaacctctgggtcactcaatacaggagcgacgaaatgttccctggaggggagtttccaaatcagaatcctcgtatccacgagggtctgcctacatgggtgaagaaggataggcccctggaggaaaacgacattgttctctggtatgtgtttgggcttacccatattccaagaatggaagactggccggtcatgccggtggagcacatcggcttcatgctcatgccacatggattcttcaactgctcgcctgctgtcgacgtgcctcccagctcggccgatgccgacgtcaaggaagccgagtcgcccaaggccatccagaccgtcggcctcatctcgaagctgtgagcttcgctacttctcggagtgacaaccgacgtgctgttcctccgtctactattttaccgtattttggtccaataaataaaaggaaactgtggtgacaaccggcgtgctgttcctccgtctagtattttaccgtattttggtctaataaaaggaaaactgtttcctttgtcttgtggtttgtttggttctctctctgtaataccgttcagtttgctatgtatgcttcggcgagctgtgaacttctacattgctcgcaacgcatgaataaagtttgacttgttagtcgtggtgtggtcggcgtctct

SEQ ID NO: 5474 - DNA, 2902 bp, Echinochloa colona
ccaaatcacccgacgccaaacacaaccaccccttccttccagtcctcaccggcgccaccctaccaccccactgcaaaccccagtgtccaccggcttccccctccctcgtcggcggctcccggcccggacggagagaacccggccccgctccctcccctagggttcccggaaccctagcccccgacccgtacgcgcgagtgccccggcgacgaggaggcggcggcggagaggggagggggcagaaggcgcggggggcgcaggcctgtgctgtatgtcagatcgtgtgtgccggggaggcggaggcggaggcggagagtacggacacggtcagctcgcgaacccgctccaatggcctcagctaaggaaaaggcgtcggcatgctgccgcaccgcgcccgcgcgtgtcgctggaggcgcgcccaccgtcgcccccgtgcgggcgatcgccgcgtccccgcccgggaaggttctcgccatcgccgcggggggcggtgagcgcgtggccgcgtccgccgctggcgcaggcggcgccgtgatcgaggagatcgccgcggcccagcccaccaccgcgaaggcctcctccaaagggataccaatcatgacaagagcccagaggtgccaccctttagacccattatctgctgctgaaattgctgttgctgtagcaactgtaagagctgctggaagatctcctgaggaaagagacagcatgcgttttgttgaagctgtgctattggagccagaaaagaatgttgtggcattagctgatgcctacttcttcccacctttccaaccatcactgctcccgagaagcaaaggttctgctgttattccaagcaggttgcctcctaggagggccagacttgttgtttacaacaaacaatcaaacgagactagcatttggatagtagaactatctgaagtgcatgcagctactaggggtggacatcacagagggaaggtgatatcagctgaagttgttccagatgttcaacctgcaatggatgctatggagtatgctgaatgtgaggctactgtcaaaagttacccgccgtttattgaagctatgaagagaagaggtgtagatgacatggatcttgttatggtggatgcctggtgtgctggctactacagtgaagctgatgctcccagtcgcagacttgccaagcctctaatattctgtaggaccgagagtgatagtcccatggagaatggttatgctcgtcctgttgaaggaatccatgctattgttgatatgcagattaatgctgtgatagagtttgaggacaggaagttggttcctctgccccctccagatcatttgagaaattatactcctggggaaacaagaggcggtgttgatcgaagtgacgtaaaaccacttattatcaatcagcctgaaggtccaagtttccgcattaacggctattttgtggaatggcagaagtggaacttccgtattggcttcaccccaaaagagggtttggtcatctattctgttgcttatgttgatggtagccgtggacgtcgacctatagcgcataggctgagctttgttgagatggttgttccatatggagatccaagtgaaccacattatcgaaagaatgcatttgatgctggagaagatggacttggaaaaaatgctcactctcttaagaagggatgtgattgcttgggctacattaaatattttgatgcacatttcacaaacttcactggtggcgtggagacaattgagaactgtgtttgtttgcatgaggaggatcatggaatcctttggaaacatcaagactggagaaccggtttagcagaagtaaggcgatcaaggaggctcactgtctcatttatctgtacagttgcgaactatgagtatggtttttactggcacttttatcaggatggaaaaatagaagcagaagtaaagcttactggaattctcagtttaggagccctgatgcctggggaatcaaggaaatatggcacgactattgcccctggtctgtatgctccagtgcatcagcatttctttgttgcccgtatggacatggctatcgattgcaaacctaatgaggctcataatcaggtggtcgaggttaatgttaaggtggaaagtgaaggcacgcataatgtgcataacaatgctttctatgccgaagagcagttgctgaagtctgagttgcaagcaatgcgtgattgtgatccttcatctgcacgccactggattgttaggaacacacgtaccgtcaataggaccgggcagccaactggttacaggctcgtgcccggttctaactgcctaccgctggctctccccgaggccaaatttctgaggcgagctgggttcctgaagcacaacctctgggtcactcaatacaggagcgacgaaatgttccctggaggggagtttccaaatcagaatcctcgtatccacgaaggtctgcctacatgggtgaagaaggataggcccctggaggaaaacgacattgttctctggtatgtgttcgggcttacccatattccaagaatggaagactggccggtcatgccggtggagcacatcggcttcatgctcatgccacatggattcttcaactgctcgcctgctgtcgacgtgccgcccagctcgtccgatgccgatgtcaaggaagccgagtcgcccaaggccatccagaccggcggcctcatttcgaagctgtgagcttccctgctcctcggagtgacaaccgacgtgctgctgctccgtctactattttaccgtattttgctccaataaaaggaaaactgtttccgctgtcttgtggtttgtttggtactctgtaataatatcgttccgtttgctatgcttgtggaccggcgagctgtgaactgatgctcgcaacgcatacaataaagtttggact

SEQ ID NO: 5475 - DNA, 2499 bp, Chrysanthemum coronarium
cacacacacttcaaaaacacacactaactaactaactaaccgttttctgttagtgtgtgtaacaaactaaccaacacacacacacagtcactcacaatggctgacaaattatcatcatcaaccgtcgttctccgccgcgaagtgacgtcatcttccgccgctgatgacgtcgttgtcaaaccttccgtagccgttactgctcctactaaaggtgggcccacgaatatggttaaggcacagactcgccacccgatggatcctcttgctgctgctgaaatctccatagctgtggcaactgttagggctgcgggagcgactcctgaggtaagagacagtatgcggtttatagaggtagtccttgtggaaccagacaaaaatgtggttgcattggcagatgcatattttttcccaccttttcaaccgtcactgttgccaaggacaaagggaggacccataatcccgacaaaacttccacctcgacaagctagacttattgtttacaacaagaaatcaaatgaaacgagtatatggatcgttgagttatcagaagttcatgctctaactcgaggtggccatcatagaggcaaagttatttcatctaaagtagtgcctgatgtgcaacctcctatggatgctgtggagtatgctgaatgtgaagccattgtaaaggagtaccctcctttccgagaggctatgaagaggaggggtattgatgatttggatctcgtaatggtagatccatggtgtgttggttaccatagtgaggctgatgctcctaatcggagattggctaaaccgctcatattctgtcgaacagaaagtgactgtcccatggagaatggttatgctcgtccggttgaaggaattgatgtattagttgacatgcaaaatatggtggttatcgagttcaaagaccgcaaactagttcctctaccaccagcagacccattaagaaattatacagctggtgaaacaaggggaggcgttgatcgaagtgatgtgaaaccactaaatattgttcaacctgatggtcctagttttcgtgttaatggtcattttgttcagtggcagaagtggaatttccgtattggcttcacacctagggagggtctggtcatatattctgttgcatatgttgacggaaaccgaggtcggaggcccgtagcccacagattaagcttcgtagaaatggtggttccttatggtgaccccaatgaccctcattacaggaagaacgcatttgatgcaggggaagatggacttgggaaaaacgctcattcgcttaaaaaaggctgtgactgtttgggctacatcaaatattttgacgcacacttaaccaattttaccgggggcgttgaaacaattgaagactgtatttgcttgcatgaagaggatcatggaattttgtggaagcatcaggactggagaactggtttagccgaagttcgacggtcaagaaggctagtggtgtcttttatctgtactgtggctaattatgagtatgggttttactggtatttttatcaggatggaaaaatagaagctgaggtgaagttaactggaatattaagcttaggagctcttcaacctggcgaagttagaaaatacgggactatgattgctcctggactctatgctcctgtccatcaacacttctttgttgctcgtatggatatgtctgttgactgtaagcctggtgaatcccacaatcaggtagttgagttggatgttaaagttgaagaacccggagatgcaaatgtgcacaacaacgcattttatgctgaagagacactgttaaagtcggaacttgaagcaattcgtgattgtaattctgcttgtgcccgacactggattatcaggaatactagaactgtaaatcgaactggccagttgacaggctacaaactagtacctggatcaaattgtttaccgttaggtggggcagaggccaagtttttgagaagagctgctttttgatgcacaatctgtgggtcacggcgtatgatcctgaagaaatgtttcctggtggagagttccctaatcagaatccacgtgttggagagggtttagctacttgggttaagaagaatcgctctctagaagaaactgaccttgttctctggtatgtctttggagtgacacacgttcctcgactagaagattggcctgttatgccagtagaacacattggattccgcctcatgccacatggattcttcaactcctcaccagcggtggatgttcctccaagttcaatgaccgattcggaactgaaagaaaatggtttggtagataagtcttgccatactggtctcgttgctaaaatgtgaaaggatttattaccacgtaagtgcactccactagaaagccattttatctgtgttttcgagatgttatacattattgggtccgttttcaccctatccgattaatttcatatgaaagacgtgatggttatgatgtttgtagcaattaccatctgttttgcttgtaaatatc

SEQ ID NO: 5476 - DNA, 2633 bp, Arnica chamissonis
gagagagtgctgttgatgtatgtcagtggagtactaccgcagtggtgagtggtgactacggcgcttacggtgagaatcataaccatctgcaatggcctcaacttcggaaaaagcgacgcctattctccgccgtgaggttacttcctcatccgccgccgatgttgtgccggattggaccacggatccgtccgtcggagatcagattcgccaccgcggcactgctgcttccgtcgataactcgactcgtcctgtcgttactcaaacttccgctgctgccactgctgctaaaggaactgggccaaccagtatggttaaagcacaaactcgccatccactcgatcctctagctgctgctgaaatctccatagcagtggcaactgttagagctgcaggagcaacaccagaggtaagagatagcatgcgatttatagaggtggtgcttgtggaaccagcaaagagtgtggttgcattagcggatgcatatttttttccaccttttcaaccgtctttattgcctagaacaaagggaggtcccataatcccaacgaaacttccacctcggcaagctagacttattgtttataataagaaatcaaatgaaactagcatatggattgttgagctatcagaggttcatgctcttactcgtggtggccaccatagagggaaagtcatttcttctaaagttgtgcctgatgtccaacctcctatggatgctgtggaatatgctgaatgtgaagccattgtaaaggagttccctccatttagggaggccatgaagaggaggggtattgaagatatggaccttctgatggtagatccctggtgtgttggttatcacagtgaagctgatgctcctaatcgtagactagcaaaaccacttattttctgtagaacagaaagcgactgtcccatggaaaacggttatgcccgcccagttgaaggaattgatgttttagttgacatgcaaaatatggtggtgattgaatttaaagaccgcaaacttgttcctctacctccagctgatccattgagaaattacacagctggcgaaacaagaggtggtgtagatcgaagtgatgtgaaaccactaaacattgttcagcccgatggcccgagttttcgtgtgaatggccattttgttcaatggcagaagtggaattttcgtattggtttcactcctagggagggtttggtcatttattctgttgcatatgttgatggtagtcgaggtcgaaggcccgtggcccacagattaagctttgtagaaatggttgttccttatggtgaccccaatgatcctcattacagaaagaatgcatttgatgcaggggaagatggactaggtaaaaacgctcattctcttaaaaagggctgtgattgtttggggtatgtcaagtattttgatgcacacttaacaaatttcactggaggtgttgaaacaattgaagactgtgtttccttacatgaagaagatgatggaatattatggaagcatcaagactggagaactggtttagctgaagtaagacggtcaagaaggctagtagtgtcttttatatgtactgttgccaactatgagtacgggttttactggtatttttatcaggatggaaaaatagaagctgaggtgaaattaactggaattcttagcttaggagctttacaacctggtgaatctagaaaatatgggactacaattgcccctggactctatgctcctgttcatcaacacttttttgttgctagaatggatgtctctgtcgactgtaagcccggtgaatcccacaatcaggtggttgaggtggatgttaaagttgaaggaccgggagacgcaaatgtgcacaacaacgcgttctatgctgaagaaaaactgttgaaatctgaacttgaagcaatgcgtgattgtaatccttcatcggcccgacattggattatcaggaacacgagaaccgtaaaccgaaccggtcaattgaccggctacaaactagtacccggatcaaactgtttaccattaggcggggccgaggctaagtttttgaggagagctgcttttttgatgcacaatctgtgggtcacaccatatgaacccgaagaaatgtttcctggtggagagttccctaatcaaaatccacgtgtcggtgagggattggctacttgggtaaagaaaaaccggtctctagaagaaaccgatctggttctttggtatgtatttggattgacacatgttcctcgactggaagattggcctgttatgcctgtagaacacattggcttcagtctcatgccacacggattcttcaactgctcaccagcaattgatgttcccccgagctcgttggctgacattgaaatgaaggaaaatgtaatggtagataaatcatgccataacagtctcgtttcaaagatgtgaaagaaaactattcaaaccgaacattatttgccgtggagtttggcctgtgatctgaaaaactgttgtgcttgagacccgtcacaccctacactcttacggtgtcggtgtatgtataatattaacatgtatctttgtagaacttgaaccaaaatatgtaatatcaaagtaacgaagtcgaggatgtaattggattgttacttgtaactgtgttcctcacttc

SEQ ID NO: 5477 - DNA, 2602 bp, Helianthus annuus
tacggcggttacagtgagaaccataaccctcagcaatggcctcaacttccgaaaaaccgccaccacttctccgccgtgaagccacttcctcctccgccaccgccgatgttgttcaggactggaccaccgatccgtccgtcggcgatcagattcgcctccgcggtactgctgcttccgtcgataactctactcgtcctgtcgttgctcaaacttccgctgcttccgctgctgctaaaggacctgggccaaccagtatggttaaagcacaaactcgccatccactcgatcctctagcggctgctgaaatttccatagcagtggcaaccgttagagctgcaggagcaacaccagaggtaagagacagcatgcggtttatagaggtggtacttgtggaaccagcaaaaagtgtggttgcattagcggatgcatatttttttccaccttttcaaccgtcgttactacctagaacaaagggaggtcccataatcccaactaaacttccacctcgacaagctagacttattgtttataataagaagtcgaatgaaactagcgtatggattgttgagctatcagaagttcatgctttgactcgtggtggtcaccatagagggaaagttatttcttctaaagtggtgcctgatgtacaacctccaatggatgcagtggaatacgctgaatgcgaagccattgtaaaggacttccctccatttagggaggccatgaagaggaggggtattgaagatatggaccttgtgatggtagatccctggtgtgttggttaccatagtgaagctgatgctcctaaccgtagactagcaaaaccgcttattttctgtagaacagaaagtgactgtcccatggaaaacggttatgcccgcccagttgagggaattgatgttttagtcgatatgcaaaatatggtggtgatagaattcaaagacaggaaactcgtccctctaccgccagccgatccattgagaaattacacagctggcgaaacaagaggcggtgtagatcgaagtgatgtgaaaccactaaacattgttcaacccgacggccctagctttcgcgttaatggccattttgtacaatggcagaagtggaatttccgtattggattcactcctagggagggtttggtcatttattctgtcgcatacgttgacggtaaccgaggtcggaggcctgtggcccacagattaagctttgtagaaatggtggtcccttatggtgaccccaatgatcctcattacagaaagaacgcatttgatgcaggggaagatggactcggtaaaaacgcccattctcttaaaaagggttgtgattgtttggggtacgtcaagtattttgacgcacacttaacaaatttcacggggggtgtggaaacaattgaagattgtgtttgtttacatgaagaagatgacgggatattgtggaagcatcatgattggagaaccggtttagctgaagtaagacggtccagaaggctagtagtgtcttttatatgtactgttgccaactatgaatacggcttttactggtatttttatcaggatggaaaaatagaagcggaggtgaaactaaccggaattcttagcttaggagctttacaacctggtgaatctagaaaatacgggactacaattgcacctggactctatgctcctgttcatcaacacttctttgttgctagaatggatatgtctgttgactgtaagcccggtgaatcccacaatcaggtggttgaggtggatgttaaagttgaaggaccaggagatgcaaatgtacacaacaacgcgttctacactgaagaaaaactgttgaaatctgaactcgaagcaatacgtgattgtaatccttcatctgcccgacattggattatcaggaacacaagaactgtaaaccgaaccggtcaattgaccggctacaaactagtacctggatcaaactgtttaccattaggtggggccgaggctaagtttttgaggagagctgcttttttgatgcacaatttgtgggtcacacaatatgaacccgaagaaatgtttcctggtggagagttccctaatcagaatccacgtgtcggcgagggattggctacttgggttaagaaaaatcgatctcttgaagaaacggatctggttctttggtatgtatttggagtgacacatgttcctcgactggaagattggcctgttatgcctgtagaacacattggcttccgtctcatgccacatggattcttcaactgctcaccagcaattgatgttcccccgagctcgtcggctgacatggaaatgaaggaaaatggaatggtagataaatcgtgccatagcagtctcgtttcaaagatatgaagaaaatatatgcgacgcctgtgatctgaaaaactgttgtgctgtaggtccttatgatgtctgcacaatattattaacttgtatttttttacaacatgaacctaaatactgtgaaattgtggacagattaggatgtaacagaagttatatcccatgttctatctcaactcttatcaatttgcattgtagacttgtacggtacaacttaataatatacggtacaaaatacaaatcataaaaag

SEQ ID NO: 5478 - DNA, 2429 bp, Brassica oleracea
gtggatttggagaactcgtaaaccctattcaatggcctcagcttcgcaaaagacgacgccatgtgctcaccacggagcctctgctccgcctcctccgaaactcctctccgccgtggagtccgtactccgccctgtcgattccatccctgacacggccaagaaacctgcgaacaaaggaatctctgtaacgccaaggtcggaaacaaagcacccgttggatcctctatctgctgcagagatatcagttgctgtggccactgttcgcgccgctggtgctaaccctgaggttagggatagtatgcgtttcatcgaggtggcgtcagtggagccagagaaacatgttgtggcgctggctgatgcttacttcttccctcctttccagccatcattgcttccaagaaataagtctggtcctgtgatccctatgaagctccctccaaggcgagcgagacttgttgtgtacaacaagacttctaatgagacaagtgtgtggatcgtggagttgtcttcggttcatgctgtcactcggggcgggcatcacagggggagagtggtttcctcgcaagtgatacctgatgtccagccaccgatggacgcggaagaatatgcggaatgtgaagcgattgtcaaagacttccctccattcattgaggctatgaagaggagaggtatcgatgacatggatcttgtgatggttgatccctggtgtgtgggttatcatagtgaagctgacgctcctagtcgtaggcttgcgaagcctcttatatactgtcgaacagatagtgactgcccaatggaaaatggctatgctcgtccagttgagggaatttatgttcttgtggacatgcaaaacatggtggtgatcgagtttgaagaccgtaagtttgtgccacttcccccacctgaccctttgaggaattatacaccaggtgagagcagagggggtgttgatagaagtgatgttaagcctctcgagattattcagcctgaaggtccaagtttccgcgtaaggggttactttgtcgagtggcagaagtggaactttcgtattgggttcactccgagggaaggtttagtcatacattcggtagcatatgttgatggcagtcgaggtcgaaggcctgttgcacacaggctaagttttgtggagatggttgtgccttatggtgatccgaatgagccacattacaggaagaatgcttttgatgcaggggaggatggtcttggaaaaaacgcacattcgctcaagaaggggtgtgactgtctgggatctatcaagtactttgacgcccatttcacaaatttcactggaggagttgaaacaattgagaactgcgtatgcttgcatgaagaagaccatgggattttgtggaaacatcaggactggagaacaggattggctgaagtgcgaagatctaggaggctaactgtctctttcttttgtactgtggctaactacgagtatggattttactggcacttctaccaggatggaaaaatcgaagctgaagtaaaacttactggtatcctcagtctaggagcgctgcagccaggagaaactcgaaagtacggtactactattgctccggggttgtatgcaccagtccatcaacatttctttatcgctcgcatggatatgtccgttgactgtaaacctggtgaagcttataaccaggtagtcgaggtaaatgtcaaagttgacgagcccggtgagaacaatatccacaacaatgctttttacgcagaagagaagttacttagatctgaggcagaggcgacgcgtgactgcgacccttttagtgctcgccattggattgtaaggaacacaaggacagtaaacaggacgggtcagttaacgggatacaaacttgttccgggctcaaactgtttgccactagctcgaccagaggccaagtttctaagaagagcagcattcctgaagcataatctgtgggttacccgttatgcacctgacgagaagtttccaggaggagagttcccaaaccaaaacccacgtgctggtgaaggtctcgctacatgggtgaaacagaatcgctccctggaagaatctgatgtcgttctctggtatgtgtttgggatcatacatgttcctagacttgaagattggccggttatgcccgtggaacatattggtttcacgctaatgccacatggatttttcaactgctcaccggccgtagacgttccaccgaatcctgcatgcgaattggatactaaggacagtgaggtcaaagaggttgtagcaccgaagcctcttcagagtggtttactttcaaagctttgaaacatgacatactttagacttcttataaattggagacattattgttgcaatttagtttcgaattggaatcttttcttgtttggtttgttggttggagactaaaagagtgttccatattaaagag

SEQ ID NO: 5479 - DNA, 2729 bp, Brassica rapa
accgtagtgcatccacgtcactatccaacctgtatatacacttgatatataagaaaggtagagcccacaagtaggctttggcagcttctgcttggactgtataaagcaaattgaatcactctctcttcctcccaccacgggaaaaaaggtgcgatcacagttgcctcagagaaactcagatccggcgagaagaatccaccgctagagagtgagtgagaggttttgctgtatgtcagtagattgtgctgagacttactttggtggatttggagaactcgttaaccctcttcaatggcctcagcttcgcaaaagacgacgccatgtcctcaccacggagcctctgctccgcctcctccgaaactcctctccgccgtggactccgtactccgccctgtcgattcgatccctgacacggctaagaaacctgcgaacaaaggaatctctgtaacgccaaggtcggaaacaaagcacccgttggatcctctatctgctgcagagatatcagttgctgtggccactgttcgcgccgctggtgctaaccctgaggttagggatagtatgcgtttcatcgaggtggcgtcagtggagccagagaaacatgttgtggcgctggctgatgcttacttcttccctcctttccagccgtcactgcttccaagaaataagtctggtcctgtgatccctatgaagctccctccaaggcgggcgagacttgttgtgtacaacaagacttctaatgagacaagtgtgtggatcgtggagttgtcttcggttcatgctgtcactcggggcgggcatcacagggggagagtggtttcctcgcaagtgatacctgatgtccagccaccgatggacgcggaagaatatgcggaatgtgaagcgattgtcaaagacttccctccattcattgaggctatgaagaggagaggtatcgatgacatggatcttgtgatggttgatccctggtgtgtgggttatcatagcgaagctgacgctcctagtcgtaggcttgcgaagcccctcatatactgtcgaacagatagtgactgcccaatggaaaatggctatgctcgtccagttgagggaatttatgttcttgtggacatgcaaaacatggtggtgatcgagtttgaagaccgtaagtttgtgccacttcccccacctgaccctttgaggaattatacaccaggtgagagcagagggggtgttgatagaagtgatgttaagcctctcgagattattcagcctgaaggtccaagtttccgcgtaaggggttactttgtcgagtggcagaagtggaactttcgtattgggttcactccaagggaaggtttagtcatacattcggtagcatatgttgatggcagtcgaggtcgaaggcctgttgcacacaggctaagttttgtggagatggttgtgccttatggtgatccgaatgagccacattacaggaagaatgcttttgatgcaggggaggatggtcttggaaaaaacgcacattcgctcaagaaggggtgtgactgtctgggatctatcaagtactttgacgcccatttcacaaatttcactggaggagttgaaacaattgagaactgcgtatgcttgcatgaagaagaccatgggattttgtggaaacatcaggactggagaacaggattggctgaagtgcgaagatctaggaggctaactgtctcctttttatgcactgttgctaactacgagtatggattttactggcacttctaccaggatggaaaaatcgaagctgaagtaaaacttactggtatcctcagtctaggagcgctgcagccaggagaaactcgaaagtacggtactactattgctccggggttgtatgcaccagtccatcaacatttctttatcgctcgcatggatatgtccgttgactgtaaacctggtgaagcttataaccaggtagtcgaggtaaatgtcaaagttgacgagcccggtgagaacaatatccacaacaatgctttttacgcagaagagaagttacttagatctgaggcagaggcgacgcgtgactgcgacccttttagtgctcgccattggattgtaaggaacacaaggacagtaaacaggacgggtcagttaacgggatacaaacttgttccgggctcaaactgtttgccactagctcgaccagaggccaagtttctaagaagagcagcattcctgaagcataatctgtgggttacccgttatgcacctgacgagaagtttccaggaggagagttcccaaaccaaaacccacgtgctggtgaaggtctcgctacatgggtgaaacagaatcgctccctggaagaatctgatgtcgttctctggtatgtgtttgggatcatacatgttcctagacttgaagattggccggttatgcccgtggaacatattggtttcacactaatgccacatggatttttcaactgctcaccggccgtagacgttccaccgaatcctgcatgcgaattggatactaaggacagtgaggtcaaagaggttgtagcaccgaagcctcttcagagtggtttactttcaaagctttgaaacatgacatactttagacttcttataaattggagacattattgttgctcaatttagtttcgaattggaatcttttcttgtttggtttgttggttggagactaaaagagtgttccatattaaagagttgattattttattatgaatagtaatcgatcatacata

SEQ ID NO: 5480 - DNA, 2612 bp, Brassica napus
agaggaaggggggaggagatcacgccgacggatagagataggttttgctgtatgtcattggattgcgttgaggctacttggtggatttggcgaactcgtgaaccctattcaatggcctcagcttcgaaacggcgacggtttgtgctcacggaggaggaggctcttcgaaactcgtctccgttgcggcggatacggttgccggaaggtccgagggtgaggatcggcgagattcttctaagtttggtttggaatccgtgatccgccccgtcgattcgatgcctggtacggccaagaaacctgcgaacaaaggaatctctgtgatgccaatgccaaggacggaaacaaagcaccccttggatcctctatccgctgcagaaatatcagttgctgtggccacagttcgcgcggctggtgctaaccctgaggttagggatagcatgcgttttattgaggtagcgtctgtggaaccggagaagaatgttgtggcgttggcagatgcttactttttccctccgttccagccatcactacttccaagaactaaagctggacctgtgatacctatgaggcttcctccaaggcgagcaaaacttgttgtgtacaacaagaagtctaatgagacgagtgtgtggattgttgagttgtccgaggttcatgctgtgactagaggtggacatcacaggggaagagtagtttcctcggaagtgatacctgatgtacagccacccatggatgcggctgaatatgctgaatgtgaagcaattgtcaaagacttccccccattcattgaggcaatgaagaggagaggtattgatgacatggatctagtgatggttgatccctggtgtgtgggttatcatagcgaagctgacgctccaagtcgtaggcttgcaaagcctcttatatactgtcgtactgatagtgattcccctatggaaaatggctatgctcgtccagttgagggcatttatgtacttgtagacatgcaaaacatggtggtcatcgagtttgaagaccgtaagtttgtgccacttcccccacctgaccctctgaggaattacacaccaggtgagagtagaggaggtgttgatagaagtgatgttaagcctctccagattattcagcctgaaggtccaagcttccgcgtaaggggttactttgtcgagtggcagaagtggaactttcgtattgggttcactccaagggaaggtttagtcatacattcggtagcatatgttgatggcagtcgaggtcgcaggcctgttgcacacaggctaagttttgtggagatggttgtgccttacggtgatccgaatgagccacattacaggaaaaatgcttttgatgcaggggaggatggtcttggaaaaaacgcacattcgcttaagaaggggtgcgactgtctcggaactattaagtacttcgatgctcatttcacaaatttcactggaggggttgaaacaattgagaactgtgtatgcttgcatgaagaggaccatgggatcttgtggaaacatcaggactggagaacaggattagctgaagtgcgaagatccaggaggctaactgtctcctttttatgtactgttgctaactacgagtatggattttactggcacttctaccaggatgggaaaatcgaagctgaagtaaaacttactggtatcctcagtttaggagcgctacagccaggagaaactcgaaagtacggtactactattgctcctgggctgtacgcaccagttcaccaacatttctttatcgctcgcatggatatgtctgttgactgtaaacctggtgaagcttttaatcaggtagttgaggtaaatgtcagagttgacgagcccggtgagaacaatatccacaacaatgcgttttatgcggaagagaagttacttagatctgaggcagaggcgatgcgtgactgtgacccttttagtgctcggcattggattgtaaggaacacaaggacagtgaacagaacggggcagttaacgggatacaaacttgttccgggctcaaactgtttgccattagctcgacccgaggccaagtttctaagaagagcagcattcctgaagcataatctttgggttacccgttatgaccctgaagagaagtttccaggaggagagttcccaaaccaaaacccacgttctggtgaaggtctcgccacatgggtgaaacagaaccgctccttggaagagtctgacgtcgttctttggtatgtgtttgggatcatacatgttcctagacttgaagattggccggttatgccagttgaacatattggtttcacactaatgccacatggatttttcaactgctcaccagccgtggatgttccaccgaatccagcatgcgaattggagaccaaggacagtgaggtcaaagaggtagtagcagcacccaagcctggtttactttcaaagctttgagcatgaaagactttttttttataatttggagacactgctgttgctctattcattttcggattggaaaccgttgttatttggtgtgtgtttgttgcaaactaaaagacatttgtcattggaatgttctttgcttttgtcaaacattatcgttcattactaatacatagttttatc

SEQ ID NO: 5481 - DNA, 2304 bp, Brassica napus
tccgccccgtcgattcgatgcctgatactgccaagaaacctgctaacaaaggaatctctgtgatgccaatgccaaggacggaaacaaagcaccctttggatcctctctccgctgcagaaatatctgttgctgtggccactgttcgcgcggctggtgctaaccctgaggttagagatagcatgcgttttattgaggtggcgtctgtggaaccggagaagaatgttgtggcgttggcagatgcgtattttttccctccgttccagccatcactacttccaagaactaaagctggacctgtgatacctatgaggcttcctccaaggcgagcaaaacttgttgtgtacaacaagaagtctaatgagacgagtgtatggattgttgagttgtccgaggttcatgctgtgactagaggtggacatcacaggggaagagttgtttcctcggaagtgatacctgatgttcagccgcccatggatgccgctgagtatgctgaatgtgaagcgattgtcaaagacttccccccattcatcgaggcaatgaagaggagaggtattgatgacatggatctagtgatggttgatccctggtgtgttggctatcatagcgaagctgacgctccaagtcgtaggcttgcgaagccccttatatactgtcgtactgatagtgattcccctatggaaaatggctatgctcgtccagttgagggcatttatgtacttgtagacatgcagaacatggtggtgatcgagtttgaagaccgtaagtttgtgccacttcccccacctgaccctttgaggaattacacaccaggtgagagtagaggaggtgttgatagaagtgatgttaagcctctccagattattcagcctgaaggtccaagcttccgcgtaaggggttattttgtcgagtggcagaagtggaactttcgtattgggttcactccaagggaaggtttagtcatacattcggtagcatatgttgatggcagtcgaggtcgaaggcctgttgcacacaggctaagttttgtggagatggttgtgccttatggtgatccgaatgagccacattacaggaaaaatgcttttgatgcaggggaggatggtcttggaaaaaacgcacattcgcttaagaaggggtgcgactgtctcggaactattaagtacttcgatgctcatttcacaaatttcactggaggggttgaaacaattgagaactgtgtatgcttgcatgaagaggaccatgggatcttgtggaaacatcaggactggagaacaggattagctgaagtgcgaagatctaggaggctaactgtctcctttttatgcactgttgctaactacgagtatggattttactggcacttctaccaggatgggaaaatcgaagctgaagtaaaacttactggtatcctcagtttaggagcgctacagccaggagaaactcgaaagtacggtactactattgctcctgggttgtacgcaccagttcatcaacatttctttatcgctcgtatggatatgtctgttgactgtaaacctggtgaagctttcaatcaggtagttgaggtaaatgtcagagttgacgagccaggtgagaacaatatccacaacaatgcgttttatgcggaagagaagttacttagatccgaggcagaggcgatgcgtgactgtgacccttttagtgctcgccactggattgtaaggaacacaaggacagtgaacaggacggggcaattaacgggatacaaacttgttccgggctcaaactgtttgccattagctcgacccgaggccaagtttctaagaagagcagcgttcctgaagcataatctttgggttacccgttatgaccctgaagagaagtttccaggaggagagtttccaaaccaaaacccacgttctggtgaaggtcttgccacgtgggtgaaacagaaccgttccttggaagagtctgacgtcgttctttggtatgtgtttgggatcatacatgttcctagacttgaagattggccggttatgccagttgaacatattggtttcacactaatgccacatggatttttcaactgctcaccagccgtggatgttccaccgaatccagcatgcgaattggagaccaaggacagtgaggtcaaagaggtactagcagcacccaagcctggtttactttcaaagctttgagcatgaaagactttttttttataatttggagacactgctgttgctctattcattttcggattggaaaccgttgttatttggtgtgtgtttgttgcaaactaaaagacatttgtcattggaatga

SEQ ID NO: 5482 - DNA, 2774 bp, Musa acuminata
aagccgaacgcccatcgcctccggctctcttcgccgaacttggaaggcccatattggatccattgccacaccctctcttcctcttcgagaagaaggaaaggcggtgggttcttccgcgagatctgtgtctcccgcgagatctggacagccagaggaggcttggaaaggggagggagggaggaagaaggaaggactcgacagaggaagcacgccaaccgagggttgctgcatgtcagatcgtggcaacggtgagggccactactacggcggattcggtgagcttgccaaccctctgcaatggccacaactgaggaaaaagcgacgccttgctgttctcccaacctcctgcctcccaaggccagcggcgccaagggaggagcgcctcggagcgaggcggcggtcggggaatggatcgcggcggcggatccaaagcggtccgcctcggcagcgacggccatgagcccgctcgtccccgtcgaggacgtcaaggaccctcccgccaaggcttcccttccgggcatccccatgatgatgagggctcagacaaggcaccccctggatccattgtctgctgctgaaatctctgttgcagtagcaactgttaggtctgctggtgcaactccggaggtcagagatagtatgcggtttgttgaagtagttcttttggagccagagaaaaatattgtggcattagctgatgcctactttttcccccctttccaaccatcactacttcccagaacaaagggtggtcctgtcatcctgagtaagcttccacccaggagggcaaggcttgttgtctataacaaaaagtcaaatgagacaagcatctggatagttgagctgtctgaagtacatgcagcaactcgtggtggtcatcacaggggaaaagtcatctcctctgaagttgttcctgatgtacagcctcctatggatgctatagaatatgcggagtgtgaagctgctgttaaaaactatcctccattcatagaggcaatgagaaagagaggagtagatgatatggatcttgtaatggtagatgcttggtgtgctggttaccacagtgatgccgatgctcctagccgcaggcttgcaaaaccactaattttttgtcggacagagagtgactgccctgtggagaatggttatgcacgtcctgttgaaggcatctatattcttgttgacatgcaaaacaatctgataattgagttcgaagatagaaaattggtccctctgcctccagctgatccattgagaaactatacacctggagaaactcgtggaggtgttgacagaagtgatataaagcctctgcatattcttcagcctgaaggtccaagttttcgtataaatggttattttgtggagtggcaaaagtggagcttccgtattggtttcaccccaagggagggcttagtaatacactctgtggcatacattgatggcagtcggggacggagacctgtggcacataggttgagttttgttgagatggtagttccctatggagatccaaatgaaccacattatcgtaagaatgcatttgatgctggtgaagatggcctcgggaaaaatgctcactctcttaaaaggggttgtgactgcctgggctacatcaaatacttcgatgctcattttacaaattatactggtggtatagagactattgaaaattgtgtttgtttgcatgaggaggatcatggaatcttatggaagcatcaagattggcgaacgggcttagcagaagttaggagatcaagaaggctaactgtgtccttcatatgcacagttgctaactacgaatatggatttttctggcacttctatcaggatggtaagattgaagcagaagtaaaattgactggaattctcagcttaggagcattgcaacctggtgaatcaagaaaatatggtacaaccatcgctccaggcttatatgcgccagttcatcaacatttctttgttgctcgcatggacatggctgttgattgtaaacctaccgaagccttcaatcaggtgattgaggtaaatgccaaagtagaagatccaggtcaaaataatgttcataacaatgctttttatgctgaagaaaagcttctcaagtcagagctggaagctatgcgtgattgtgatcctttctctgcacgtcactggattgtaaggaacacaaggactgtaaatcggacaggtcaacctacaggttataagctcatgcctggtctgaattgcctcccattagctggtccagaagcaaaattcttgagaagagctgcatttttaaagcataatctatgggttacaccttacagtcgtgatgagatgtaccctggaggagagtttcccaatcagaatccccgcataaatgagggattagtgacatgggttaagaagaacaggtcccttgaggaagctgacattgttctatggtacgtatttggaatcacacacatacccaggttggaagattggcctgtcatgcctgtggatcggattggctttatgctcatgccgcatggcttctttaactgctccccagcagtggacgtgccaccgagtgctaatgaaatagacaaggatggtggatcgcccaagttgatccagaacggactgctcgctaagctttgagagggagggatgtaaaagctgaacatctaatatatcaatatgttaaataagcatcaccggtgagaccttgttgctagtgattctatgtttgcagtgtgctagattgtgacttggattaagtttgatcgtcgtgtgataccctttcccct

SEQ ID NO: 5483 - DNA, 2772 bp, Echinochloa colona
aggcggcggagaggggagggggcagaaggcgcggggggcgcaggcctgtgctgtatgtcagatcgtgtgtgccggggaggcggaggcggaggcggagagtacggacacggtcagctcgcgaacccgctccaatggcctcagctaaggaaaaggcgtcggcatgctgccgcaccgcgcccgcgcgtgtcgctggaggcgcgcccaccgtcgcccccgtgcgggcgatcgccgcgtccccgcccgggaaggttctcgccatcgccgcggggggcggtgagcgcgtggccgcgtccgccgctggcgcaggcggcgccgtgatcgaggagatcgccgcggcccagcccaccaccgcgaaggcctcctccaaagggataccaatcatgacaagagcccagaggtgccaccctttagacccattatctgctgctgaaattgctgttgctgtagcaactgtaagagctgctggaagatctcctgaggaaagagacagcatgcgttttgttgaagctgtgctattggagccagaaaagaatgttgtggcattagctgatgcctacttcttcccacctttccaaccatcactgctcccgagaagcaaaggttctgctgttattccaagcaggttgcctcctaggagggccagacttgttgtttacaacaaacaatcaaacgagactagcatttggatagtagaactatctgaagtgcatgcagctactaggggtggacatcacagagggaaggtgatatcagctgaagttgttccagatgttcaacctgcaatggatgctatggagtatgctgaatgtgaggctactgtcaaaagttacccgccgtttattgaagctatgaagagaagaggtgtagatgacatggatcttgttatggtggatgcctggtgtgctggctactacagtgaagctgatgctcccagtcgcagacttgccaagcctctaatattctgtaggaccgagagtgatagtcccatggagaatggttatgctcgtcctgttgaaggaatccatgctattgttgatatgcagattaatgctgtgatagagtttgaggacaggaagttggttcctctgccccctccagatcatttgagaaactatactcctggggaaacaagaggcggtgttgatcgcagtgatgtaaaaccacttattatcaatcagcctgaaggtccaagtttccgcattaacggctattttgtggaatggcagaagtggaacttccgtattggcttcaccccaaaagagggtttggtcatctattctgttgcttatgttgatggtagccgtggacgtcgacctatagcgcataggctgagctttgttgagatggttgttccatatggagatccaagtgaaccacattatcgaaagaatgcatttgatgctggagaagatggacttggaaaaaatgctcactctcttaagaagggatgtgattgcttgggctacattaaatattttgatgcacatttcacaaacttcactggtggcgtggagacaattgagaactgtgtttgtttgcatgaggaggatcatggaatcctttggaaacatcaagactggagaaccggtttagcagaagtaaggcgatcaaggaggctcactgtctcatttatctgtacagttgcgaactatgagtatggtttttactggcacttttatcaggatggaaaaatagaagcagaagtaaagcttactggaattctcagcttaggagcccttatgcctggggaatcaaggaaatatggcacaactattgcccctggtctgtatgcaccagttcatcagcatttctttgttgcccgtatggacatggctatcgattgcaaacctaatgaggctcataatcaggtggtcgaggttaatgttaaggtggaaagtgaaggcacgcataatgtgcataacaatgctttctatgccgaagagcagttgctgaagtctgagttgcaagcaatgcgtgattgtgatccttcatctgcacgccactggatagtaaggaacacacgtaccgtcaatcggactgggcagccaactggttacaggcttgtgcctggttctaactgcctgccactggctctccccgaggcaaaattcctgaggagagctgggttcctgaagcacaatctctgggtcactcaatacaggagcaacgagatgtttcctggaggggagtttccaaatcagaatcctcgtatccacgagggtctgcctacatgggtgaagaaggataggcccctggaggaaaacgacattgttctctggtatgtgttcgggcttactcatattccaaggatggaagactggccggtcatgccagtggagcacatcggcttcatgctcatgccacatggattcttcaactgctcgcctgctgtcgacgtgcctcccagctcggccgatgccgacgtcaaggaagccgagtcgcccaaggccatccagaccggcggcctcatctcgaagctgtgagcttcgctgcttctcggagtgaaaaccgacgtgctgttcctccgtctactattttaccgtattttggtccaataaataaaaggaaaactgtggtgacaaccggcgtgctgttcctccgtctagtattttaccgtattttggtctaataaaaggaaaactgtttcctttgtcttgtggtttgtttggttctctctctgtaataccgttcagtttgctatgtatgcttcggcgagctgtgaacttctacattgctcgcaacgcatgaataaagtttggacttgttccataa

SEQ ID NO: 5484 - DNA, 2456 bp, Phaseolus vulgaris
ttgtaatgttgcataggagtcactgcaatgacaaggccccaatccagccatcctttggaccctttaactgctgctgaaatatctgtggccgtggcaactgtgagggccgctggagctactcctgagcttagagatagtatgcgcttcattgaagtagttttactggagcccgataaaaatgttgttgcactagcagatgcatatttctttccacctttccaaccatcattacttcccagaactagaggaggacctctaattccaactaaactccctccaagatgtgctagacttgttgtttataataagaaatctaatgagactagtatatggattgttgagttgtcacaagtacatgcagtggtatcaacgcagagtggccattacggccggggaaaagtaattgcttcacatgttgttcctgatgttcaacctccaatggatgctgaggaatatgcagaatgtgaggctgtagtcaaaagttttcccccatttatagaggctatgaagaaaaggggtattgaagacatggaccttgtaatggtcgatccctggtgtgttggttattatagtgaagcagatgctcctgggagacgacttgccaaacccctcctattttgtcaatctgagagtgactgccccatggaaaatggctacgcccgcccagttgagggcatctatgttctagttgatatgcaaaacatggtggtgatagagtttgaggatcgtaaactagttccccttccaccagttgatcccttgaggaattatactcctggtgaaaccagaggtggctctgatagaagtgatgtaaaaccgttgcaaattattcagcccgaaggtccaagcttccgtgtcaatgggtattttgttgaatggcagaagtggaattttcgtattggattcacacccaaagaaggtttggttatatattctgttgcatatgttgatggtagtcatgggcgaaggcctgttgctcataggatgagttttgtggagatggttgttccctatggagacccgaacgaaccacattataggaaaaatgcttttgatgctggggaagacggcttgggaaaaaatgcacattccctcaagaagggatgtgattgtttaggatacatcaagtattttgatgctcacttcactaatttcactggtggggtggaaacaatagaaaattgtgtatgtttacatgaagaggatcacggaattctctggaagcatcaagactggagaactggcttagcagaagtccgaagatctagaagacttactgtttctttcatatgtactgtggctaattacgagtatggatttttttggcacttttatcaggatggaaggattgaagctgaagtcaagctaactggaattcttagcctaggagccttgctgcctggagagtttcgaaaatatggaaccatgattgcacctggtctatatgcaccagttcatcagcacttttttgttgctcgtatggacatgtctgttgattctaaaccaggtgaagctttgaatcaggttgtggaggtcaatatgaaagttgaggaaccaggtgagaataatgttcataacaatgctttctatgctgaagagactttgctcagatctgaattggaagccatgcgtgattgtaattctttgactgctcgacattggattgtaaggaacacaagaacatgcaatagaactggccagttgacaggatacaagctggttcctggctcgaactgcttaccattggcaggctcggaagccaagtttttaagacgagctgctttcttgaagcataatttttgggtaacaacatattcacgtaatgagatgtttcctggaggagaatttccaaatcaaaatccgcgtgatcgtgaaggactagctacatgggttaagcagaaccgatctttggaagaaactaatatagttctttggtatgtatttggaatcacacatgttcctcgtttggaagactggcctgttatgccagtagagcacattggttttatgctcacgcctcatggtttcttcaattgttcccctgcagtagatgtcccacctaatgcatgtgaaatggattctaaagataatgaaattaaggataatggttcttcgaagccaattcagaatgggttaacggcaaagctttaggaacttgccgaccaaaagttatgggtatgggctgctgtaagagaaacacacaagtactattttgacatcccctgaaatatgaagttgagcacattatattttctaatctagaatattgattaagctattggctaaaatcgtgatctcgtttattttggtaatattcgtttgacaattctcatttcaaatttgactttagatgcttgtaatgaaacagtgaattcgacgatattatttggtttaaaataaatggttcgatactgggtttggtaacaggattcaaggtatatatagttgtattgtga

SEQ ID NO: 5485 - DNA, 2165 bp, Chrysanthemum coronarium
gaggtcagagatggaatgagatttgtggaggtggttctatcagaaccggaaaaaatgtggtggcgcttgctgatgcctacttcttcccaccatttcaaccatcattgctacccagaagcaaaggaggagctttgttgcctttcaaacttcctccaaggagagctcgactcgttgtttataataaaaagtcaaatgagacgagtgtatggatcgtcgaattatctgaggtacatgcagcaactcgaggtgggcatcatagaggaaaagtcatttctacaagagttgtcccagatgtgcagcctcccatggatgctgtggaatatgctgaatgtgaagctgttgtgaaagattatcctccctttgtagaggctatgaagaagaggggtatagacgatatggacctcgtgatggttgatgcttggtgtgttggatatcacagtgatgctgatgctcctagccgcagattagcaaaaccacttatattttgtaggacagaaagtgacagtccaatggaaaatggatatgcacgcccagttgaagggatatatgttcttgttgatatgcaaaatatggtagttcttgaatttgaagatcgtaagcttgttcccttaccaccggctgatccgttgagaaattacactcctggtcatacacgaggtggtgttgaccgcagtgatgtgaaggctttacagatccttcagcctgatggaccaagctttcgtgtgaacgggaactatgtggagtggcaaaagtggaacttccgtattggtttcactccaagggaaggattggtaattcattcaattgcatatgttgatggtagtcgaggtagaagacccatagctcatagattgagcttcgtagagatggttgtgccgtatggtgatccaaatgagccacattacagaaagaatgcgtttgatgctggggaagatggccttggaaaaaatgctcattctctaaagaagggatgtgactgtttgggttatatcaagtactttgatgcgcattttaccaacttcattggtggagttgaaacaattgaaaattgtgtatgtatgcacgaagaagaccatggaatgctctggaagcatcaagactggagaacaggcttagcagaagttcgaagatcccgacgactcacagtttcttttgtatgtactgttgcaaactatgagtatggtttctattggcacttttatcaggacggtaagattgaagctgaagttaaactcactggaattttgagcttaggagccttgcagccaggtgaagttcgaaaatatggcacaaccatcgcaccaggactgtatgcacctgttcatcaacatttctttgttgctcgaatggacatggcggttgattgcaagcctggagaagcacacaatcaggttgtggaagttaatgttaaagttgaggaaccaggaaaggataatgttcacaacaatgctttttacacacaggagacattgcttaaatctgaatctcaagcaatgagggattgtaatcagttatctgctcgtcattggattgttcaaaacacaaggaatgtgaataggacagggcaactgacaggctacaagctggtacctggttcgaactgcttgcctttggcaggttcagaagccaagtttttgagaagagctgcctttctgaagcataatttgtgggtcacacagtatgcatctggtgaggattttcctggaggagagttccctaaccaaaatccacgtgttggtgaaggtttggcatcatgggtccagcaaaatcgatctcttgaggaaactgatatagtcctctggtatgtatttgggatcactcatgttcctaggttagaagactggcctgtgatgccagtggagcggattgggtttatgcttcagccacatgggttctttaattcctctcctgctgtagacgtcccccctggagcttgtgaatcggatgcgaaagactgccatgtaaaagacaaagacgcaattgttcccaagtcagtttcaaatgggttgatggccaagctttgattattttaccttccagctctttgtcttgtgtcttgaattcaagttaaactatgtaaagagagactgaatgttatgaaactggtgaaaccttgtgttttggtgtatgaatcttggccaatgtaatcctctagggtttctata

SEQ ID NO: 5486 - DNA, 3401 bp, Setaria italica
ccgacgcccaacaacacacccttcgagtcatcaccgccaccacggcacgccaccacaccactccaaacttccagtctcccaccggcttcccccacctcctcggcggcgcctcgcgggcggagagaaccccgctccctcccctagggttcccggaaccctagcccctacccgtacgcgcgcgcgagggccccggcggcacgaggaggcggcggcggcggcggagaggggagggggcacaaggcgcggaaggcgcaggcctgtgctgcatgtcagatcgtgggagccggcgaggcggaggcggaggcggagactacggacacggtcagctcgcgaacccgctccaatggccgcagctaaggaaaaggcgccggcatcatgctgccgcgccgcgcccgcgcgtgtcgccggtggcgcccccgccgcccccgtgcgggcgatcgccgcgccccctgccgggaaggtcgtcgccgtcgcctcggggggtggtgagcgcgtggccgccgctggcgcaggaagcgccgtgatcgaggagatcgccgcggtccagcccaccaccgcgaaggcctcctccaaagggataccaataatgacaagagcccagaggtgccaccctttagacccattatctgctgctgaaattgcagttgctgtagtaactgtaagagctgctggaagatctcctgaggaaagagatagcatgcgctttgttgaagctgtgttgttggagccgaataagaatgttgtggcgttagctgatgcctacttcttcccacctttccaaccatcactgctcccgagaaccaaaggttctgctgttattccaagcaggttgcctcctaggagggccagacttgttgtgtacaacaaacaatcaaatgagactagcatttggatagtagaactgtctgaagtgcatgcagctaccaggggtggacatcacagaggcaaggtgatatcagctgaagttgttcccgatgttcaacctgcaatggatgctatggagtatgctgaatgtgaggctactgtcaaaagttacccaccatttattgaagctatgaagagaagaggtgtggacgacatggatcttgttatggtagatgcctggtgtgctggctactatggcgaagctgatgctcccagtcgcagacttggcaagcctctaatattttgcaggactgagagtgatagccccatggagaatggttatgctcgtcccgtggaaggaattcatgtcgttgttgatatgcagaataatactgtgatagagtttgaagataggaagttggttcctctccccccaccagatcatttgaggaactacactcctggcgaaacaagaggtggtgttgaccgaagtgatgtaaaaccacttattatcaatcagcctgagggtccaagtttccgcatcaatggctattttgtggaatggcagaagtggaacttccgtattgggttcacccccaaagagggtttggttatctactcggttgcgtacgttgatggtaaccgtggacgtcgacctatagctcataggctgagctttgttgagatggttgttccttatggagatccaagtgaaccacattatcgcaagaatgcatttgatgctggagaagatggacttggcaaaaatgctcattctcttaagaagggatgtgattgcttgggctacataaaatattttgatgcgcatttcacaaacttcactggtgctgttgagacaattgagaactgtgtctgtttgcatgaggaggaccatggaatcctctggaaacaccaagactggagaactggtttagcagaagtaaggcgatcaaggaggctcactgtctcatttatatgtacagttgcaaactatgagtatggtttttattggcacttctatcaggatggaaaaatagaagcagaagtaaagcttactggaattctcagcttaggagccctgatgcccggggaatcaaggaaatatggcacaactattgcccctggtctgtatgcaccagttcatcagcatttctttgttgcccgtatggacatggctgtcgattgcaaacctaatgaggctcataatcaggtggtcgaggttaatgtcaaagtggaaagtgcaggcacgcataatgtgcacaacaatgctttctatgctgaagaggagttgctgaagtctgagttgcaagcaatgcgtgattgtgacccttcatctgcgcgccactggattgtaaggaacacacgaactgtaaatcgtactgggcagccaactggttacaggctggtgcctggttcaaattgcttgccgttggctttacccgaggctaaatttctgaggagagctgggttcttgaagcacaatctctgggtcacccaatacaagagtgatgagatgttccctggaggggagtttcccaaccagaatcctcgaattcatgagggtttgcctacatgggtcaagaaggataggcccctggaagaaaccgacattgttctctggtacgtgttcgggctcacccatatcccaaggctggaagactggccagtcatgccagtggagcacatcggcttcatgctcatgccacatggattcttcaactgctcgcctgcggtcgacgtgcctcccagctcctccgatgccgacgtcaaggaagccgagtcgcccaaggacatccagaccggtggcctcaattcgaagctgtgagcttcgctgttcctcgaagtggcaaccggcgtggtgctgcctcgtctactatttaattgtgttgctccaataaaaggaataactgtttccgctgccatgtgacttgtttggttctgcaatatcgttttgtttggttctctgtaataatcgtgttgctatgcatggttctctgtaatatcgtttcgccgatcaagcaggcttcctacatggcctgtaagattccgaacaaggagaagtatgaatttacagagaatatatcttctcgaattgtgttttgctcgaaagggcaacttcttagatgcagttccaggttgcgctacgcatgcttctacagaaccacgaggatgacaacggagttggccagatccggccgtccaccggccactcgcgcgcaacaggtgaggccgccatagaagggagcgtcggcgagcggaaggctgccaccaccccgagctcgacgaccggcaatacttcgattccgattggaagagacccgaggaggctattttcgttggaattcagttgctgccggtgattctaaccgagctcagggaggccaattttgttggtagccgcacaatattggaagggctgccgccatggggagctcgacacatcaggatgagcccccgattcgaggggcgcagctcttgattggaggggccgcacatcaattctgaagagggagaagggcaggcagccatgagccatg

SEQ ID NO: 5487 - DNA, 3372 bp, Setaria italica
ccgacgcccaacaacaccacacccttcgagtcatcaccgccaccacggcacgccaccacaccactccaaacttccagtctcccaccggcttcccccacctcctcggcggcgcctcgcgggcggagagaaccccgctccctcccctagggttcccggaaccctagcccctacccgtacgcgcgcgcgagggccccggcggcacgaggaggcggcggcggcggcggagaggggagggggcacaaggcgcggaaggcgcaggcctgtgctgcatgtcagatcgtgggagccggcgaggcggaggcggaggcggagactacggacacggtcagctcgcgaacccgctccaatggccgcagctaaggaaaaggcgccggcatcatgctgccgcgccgcgcccgcgcgtgtcgccggtggcgcccccgccgcccccgtgcgggcgatcgccgcgccccctgccgggaaggtcgtcgccgtcgcctcggggggtggtgagcgcgtggccgccgctggcgcaggaagcgccgtgatcgaggagatcgccgcggtccagcccaccaccgcgaaggcctcctccaaagggataccaataatgacaagagcccagaggtgccaccctttagacccattatctgctgctgaaattgcagttgctgtagtaactgtaagagctgctggaagatctcctgaggaaagagatagcatgcgctttgttgaagctgtgttgttggagccgaataagaatgttgtggcgttagctgatgcctacttcttcccacctttccaaccatcactgctcccgagaaccaaaggttctgctgttattccaagcaggttgcctcctaggagggccagacttgttgtgtacaacaaacaatcaaatgagactagcatttggatagtagaactgtctgaagtgcatgcagctaccaggggtggacatcacagaggcaaggtgatatcagctgaagttgttcccgatgttcaacctgcaatggatgctatggagtatgctgaatgtgaggctactgtcaaaagttacccaccatttattgaagctatgaagagaagaggtgtggacgacatggatcttgttatggtagatgcctggtgtgctggctactatggcgaagctgatgctcccagtcgcagacttggcaagcctctaatattttgcaggactgagagtgatagccccatggagaatggttatgctcgtcccgtggaaggaattcatgtcgttgttgatatgcagaataatactgtgatagagtttgaagataggaagttggttcctctccccccaccagatcatttgaggaactacactcctggcgaaacaagaggtggtgttgaccgaagtgatgtaaaaccacttattatcaatcagcctgagggtccaagtttccgcatcaatggctattttgtggaatggcagaagtggaacttccgtattgggttcacccccaaagagggtttggttatctactcggttgcgtacgttgatggtaaccgtggacgtcgacctatagctcataggctgagctttgttgagatggttgttccttatggagatccaagtgaaccacattatcgcaagaatgcatttgatgctggagaagatggacttggcaaaaatgctcattctcttaagaagggatgtgattgcttgggctacataaaatattttgatgcgcatttcacaaacttcactggtgctgttgagacaattgagaactgtgtctgtttgcatgaggaggaccatggaatcctctggaaacaccaagactggagaactggtttagcagaagtaaggcgatcaaggaggctcactgtctcatttatatgtacagttgcaaactatgagtatggtttttattggcacttctatcaggatggaaaaatagaagcagaagtaaagcttactggaattctcagcttaggagccctgatgcccggggaatcaaggaaatatggcacaactattgcccctggtctgtatgcaccagttcatcagcatttctttgttgcccgtatggacatggctgtcgattgcaaacctaatgaggctcataatcaggtggtcgaggttaatgtcaaagtggaaagtgcaggcacgcataatgtgcacaacaatgctttctatgctgaagaggagttgctgaagtctgagttgcaagcaatgcgtgattgtgacccttcatctgcgcgccactggattgtaaggaacacacgaactgtaaatcgtactgggcagccaactggttacaggctggtgcctggttcaaattgcttgccgttggctttacccgaggctaaatttctgaggagagctgggttcttgaagcacaatctctgggtcacccaatacaagagtgatgagatgttccctggaggggagtttcccaaccagaatcctcgaattcatgagggtttgcctacatgggtcaagaaggataggcccctggaagaaaccgacattgttctctggtacgtgttcgggctcacccatatcccaaggctggaagactggccagtcatgccagtggagcacatcggcttcatgctcatgccacatggattcttcaactgctcgcctgcggtcgacgtgcctcccagctcctccgatgccgacgtcaaggaagccgagtcgcccaaggacatccagaccggtggcctcaattcgaagctgtgagcttcgctgttcctcgaagtggcaaccggcgtggtgctgcctcgtctactatttaattgtgttgctccaataaaaggaataactgtttccgctgccatgtgacttgtttggttctgcaatatcgttttgtttggttctctgtaataatcgtgttgctatgcatggttctctgtaatatcgtttcgccgatcaagcaggcttcctacatggcctgtaagattccgaacaaggagaagtatgaatttacagagaatatatcttctcgaattgtgttttgctcgaaagggcaacttcttagatgcagttccaggttgcgctacgcatgcttctacagaaccacgaggatgacaacggagttggccagatccggtcgtccaccggccactcgcgtgcaacaggtgaggccgccatagaagggagcgtcggcgagcggaaggctgccaccaccccgagctcgacgaccggcaatacttcgattccgattggaagagacccgaggaggctattttcgttggaattcagttgctgccggtgattctaaccgagctcagggaggccaattttgttggtagccgcacaatattggaagggctgccgccatggggagctcgacacatcaggatgagcccccgattcgaggggcgcagctcttgattggaggggccgcacatcaattctga

SEQ ID NO: 5488 - DNA, 2633 bp, Euphorbia peplus
ctcctctcttactcttatataataatcacggatgagataagcataaagaaatcagtaactcacatgaataacttgaccttcacttcacaaagatgagttgagttgagttgagttgtataaatagaaaaagataatacaagattgatgtatgtatgtcactgaagtattacaatggcctcacctcagcaaaaacgaccccttcttcctcttctgctgattggactgctgccggagctcaggttcccgtccgggatagagctgctgccatggcgtccttgattcctcctgttgactccctctctgatcctactactgctactactactacagctacttcttcttcttctaaaggaacgagagtgcaaaccagccaccctttggaccctttaactgctgctgagatttctgtggcagtggcaacagttagggcagctggagcaactcctgaggtgagagatagcatgcgatttgttgaagtggttttactggagccagagaagaacgtagttgccttggcagatgcatatttcttccctccctttcagccttcattactccccagaagtaaaggtggacctgtgattcccacaaaacttcctccaaggaaagcaagacttgttgtttataacaaaagatcaaatgagactagcatatggattgttgaactatcagaagttcatgctgcaacacgaggtggtcaccacagaggcaaagtcaaatcatctaatgtcgttccaaatgttcagccgcccatggatgctgtggaatatgctgaatgtgaagctatagtgaaagaattccctccctttcttgaggcaatgaaaaaaaggggtatcgaggatatggatcttgtgatggttgacccctggtgtgtaggatatcacagtgaagctgatgctcctagccgcaggcttgctaaaccactaatcttctgcagaactgagagcgactgtcctattgaaaatggatatgctcgtccagttgaaggaatacatgtacttgttgacatgcaaaatatggttgtgattgaatttgaagatcgtaaacttgttcctctaccgccagctgaccccttaagaaattatactgccggtgaaactcgaggaggtgttgatagaagtgacgtgaagcctcttcaaatcattcaacctgaaggtccaagctttcgtgtaaatgggcactttattcagtggcaaaagtggaattttcgtatcggtttcacccccagggagggtttagttatctattctgttgcatatgttgatggtaatcgaggtcggagacctgtggcccacaggttaagttttgttgagatggtggtaccatatggggatccaaatgacccacattataggaaaaatgcatttgatgcaggagaagatggattgggaaaaaacgcacattctctgaagaagaattgtgattgtttgggcttcatcaagtacttcgatgcgcactttacaaatttctccggaggtgttgaaacgattgagaattgtgtttgtttacatgaagaggatcatggaatcttatggaagcatcaggattggagaacagggttagcagaagtccgacgttctagaaggctatcagtatcttctatatgcactgtggctaattatgagtatggatttttctggcatttttatcaggatggaaaaattgaagcagagattaaactgactggaattctaagcttaggagcattgcaacctggagaagtaagaaaatatggtacaacaattgctcctggattgtacgcacctgttcatcaacatttttttgtggctcgtatggatatggcagtcgactgtaaacctggcgaaacattcaatcaggttgttgaggtgaatgttaaagttgatgaacctggaaaagctaatgtccataataatgcattctatgcggaagaggaactgttgaaatcagaactgcaagcaatacgtgattgtaatccattaagtgctcgccattggatcatcagaaacacaagaactgtgaaccggactgggcagctcactgggttcaagttagtacctggttcaaattgcttacccctggcgggttcagaggcaaagttcctgaggagagctgcttttttgaaacataatctttgggtaacaccttatgcacgtgatgaaatgtatcctggtggagaattccctaatcaaaatccacgtaacgaagagggtctggctacatgggtgaagaaagatcgaccaattgaagaagcaaatgttgttctatggtatgtatttggagtgacgcacattccccgcttggaagactggcctgtgatgcctgtagaacgcatcggatttatgcttatgccacatggattctttaactgctccccggccgtggacgttcctccgagtgcaagtgatatggaactcaaggagaatgtgatcacagcaaaacctatacagaatgctcttcttgctgctaagctttgaaacaaggaaagaatcctgcaattcatgtacatttttccttgaataattgagccgtttctcctacttgtactatattgtttgttgtattttggatgtgttttgaaattctacagagtgttttgttttcatatagtatgtaatttcccataaataatgtagctttttttagtaaaagcg

SEQ ID NO: 5489 - DNA, 3044 bp, Secale cereale
tactccggcgcgagcccagccccagaccccgcccggcgcacgatcctcggctctctcgcggagaggagcgggtgcccgaaaccctggcccgatcccgtagaaccccccctagacgcggaggccctgacgcgggggagtgagagcgggagcggggggaggacgaaggcgcggggaggcggaggcctgtgctgtatgtcagatcgtgggatccggcgaggcggagacggcggaggagactacggacacggtcagctcgcgaacccgctccaatggcctcagctcaggaaaaggcggcgctctgctgcgggggccccgcgcgcgatgcccccagggcggcgatcgccgcgcccgggaaggtctccatgtccgcggccggcggtggtggtgagcgcgtcgtctccgctgccgggggcggcgccgtgatggacgacatcgcggcgtccgcggcccagcccactaccgccaaggcctcctctaaagggatacccataatgacgagagctcaaagattccaccctttggacccattatctgctgccgaaattgcagtggctgttgcaactgtaagagccgctggaaaatctcccgaggaacgcgacagcatgcgttttgttgaagctgtgctactggaaccagaaaagaatgttgtagcattagccgatgcctacttcttcccaccgttccaaccatcactgctccccagaaccaaaggctctgccgtcattccaagcaggttgcctccgaggagggccaagcttgttgtctacaacaggcattcgaatgagactaccatttggatagtagaactatctgaagtgcatgcagctactagaggtggacatcacagagggaaggtgatatcatctgaagttgttccagatgtacagcctgcaatggatgctatggaatatgctgagtgtgaagctactgtcaaaaattatcctccatttattgaagctatgaagaaaagaggtgtggatgacatggaacttgtcatggtagatgcctggtgtgctggctactacagtgatgcggatgctcctagtcgcagacttgccaggcctctaatcttttgccgaactgagagtgatagtcccatggagaatggttatgctcgtcctgtggaagggatccatgttgttgttgatatgcagaataatattgtcattgagtttgaagacaggaagtttgttcctctgcccccagcagatcatttgagaaactacactcctggggaaactagaggtggtgttgatcgaagtgatgtgaaacctcttattatcaatcagcctgagggcccaagcttccgtattaatggctattttgtggaatggcaaaagtggaatttccgtattggcttcacccctaaagagggtttggtcatctattctgttgcgtatgttgatggtagccgtggacgtagaccgatagctcacaggctgagctttgttgagatggttgttccttatggagatccaagtgaaccgcattatcgcaagaatgcattcgatgctggagaagatggacttggcaaaaatgctcattctctgaagaagggctgtgactgcttgggttacatcaagtattttgatgcgcacttcacgaactttaccggtcatgtggagacaattgagaactgtgtttgtctgcacgaggaggaccatggaatcctttggaaacaccaagattggagaactggtttagcagaagttaggcgatcaaggaggctcacagtgtcatttatctgcacggttgccaactatgagtatggtttttactggcacttctaccaggatggtaagatagaagctgaaataaaacttactggaattctgagtttgggagctctgatgcctggggaatcaaggaaatatggtacaactattgctcctagtctgtatgcacctgttcaccagcatttctttgttgcccgtatggacatggctgttgattgcaaacctaacgaggctcataatcaggtggttgaagtaaatgtcaaagtcgaaagtgcaggcacaaataatgtgcacaacaatgctttctatgccgaagagaaaatactgaaatctgagttgcaagcaatgagagattgtgacccttcatctgcgcgacattggattgttaggaacacaagggctgtaaatcgtaccggacaaccaactggtttcaggctggtgcctggttcaaactgtttgccatttgctctgcccgaggccaagtttcttcgaagagccgggttcttaaagcacaacctttgggtcacaccatacaagagcgatgagaagtttcctggaggggagtttcccaatcagaatccacgtcttcacgagggtttagctacttgggtcaagcaggataggcccttggaggaaaccgacatcgtcctctggtatgtatttgggctcacccacatcccaaggcttgaagactggccggtcatgccggtggaacgcattggcttcatgctcatgccacatggattcttcaactgctcgcccgctgtcgatgtgcctcctggcacttctgatgccgccgatgtcaaggaagcagagtcgcctaaggccgtccagaacgggggccttgtttccaagctctaatcttggcagctctcctcaaaagaaatgaacaaactagcaataaaagtttttatctcgtggtctgtttcgttttctgtaatatgtatgtttgctgcactgattgattgtgaatgttgagctgcacaagtagcatctaataatgtctggactggcataatgcctgcataaataaaagtgtgttgccatgccttcttttggggccaatggttattataagttaaaaaaaaaaaaaacaaaaaaaaaaaaacaaaaaaaaaaacaaaaaaaaaaaaaaaacaaaaacaaaaaaaaaaaaaaaacaacacacacacacacacacacacacacacacacagagagacacacacacacacagacagagagacagagacagagacagagacacacgagacacacacacacacacagagacatatactacagacgagtagacgagagacagtatag

SEQ ID NO: 5490 - DNA, 2780 bp, Triticum aestivum
ccaccaccaccactccggtgtgcgagccagccccagcctccgcctggcgcacgaccctcggctctctcgcggagaggacgggtgcccgaaaccctggcccgatcccgtagaacccctagacgcggaggccctgacgcgggggagtgagagcgggagcggggggaggacgaaggcgcggggaggcggaggcctgtgctgtatgtcagatcgtgggatccggcgaggcggagacggcggaggagactacggacacggtcagctcgcgaacccgctccaatggcctcagctcaggaaaaggcggcgctctgctgcgggggccccgcgcgcgatgcccccagggcggcgatcgccgcgcccgggaaggtctccatgtccgcggccggcggtggcggtgagcgcgtcgtctccgctgccgggggcggcgccgtgatggacgacatcgcgtccgcggcccagcccactaccgccaaggcctcctctaaagggatacccataatgacgagagctcaaagattccaccctttggacccattatctgctgccgaaattgcagtggctgttgcaactgtaagagccgctggaaaatctcctgaggaacgtgacagcatgcgttttgttgaagctgtgctactggaaccagaaaagaatgttgtagcattagccgatgcctactttttcccgccgttccaaccatcactgctccctagaaccaaaggctctgccgtcattccgagcaggttgcctcccaggagggctaagcttgttgtctacaatagacattcaaatgagactaccatttggatagtagaactatctgaagtgcatgcagctactagaggtggacatcacagagggaaggtgatatcatctgaagttgttccagatgtacagcctgcaatggatgctatggaatatgctgagtgtgaagctactgtcaaaaattatcctccatttgttgaagctatgaagaaaagaggtgtggacgacatggaacttgtcatggtagatgcctggtgtgctggctactacagtgatgctgatgctcccagtcgcagacttgccaggcctctaatcttttgccgaactgagagtgatagtcccatggagaatggttatgctcgtcctgtcgaagggatccatgttgttgttgatatgcagaataatattgtcatagagtttgaagacaggaagtttgttcctctgcccccaccagatcatttgagaaactacactcctggagaaactagaggtggtgttgatcgaagtgatgtgaaacctcttattatcaatcagcctgagggcccaagcttccgtattaatggctattttgtggaatggcagaagtggaatttccgtattggcttcacccctaaagagggtttggtcatctactctgttgcatatgttgatggtagccgtggacgtagacctatagctcataggctgagctttgttgagatggttgttccttatggagatccaagtgaaccacattatcgcaagaatgctttcgatgctggagaagatggacttggcaaaaatgctcattctcttaagaaggggtgtgactgcttgggttacatcaagtattttgatgcacacttcacgaactttaccggtcatgtggagacaattgagaactgtgtgtgtctgcacgaggaggaccatggaatcctttggaaacaccaagattggagaactggtttagcagaagttaggcgatcaaggaggctcacggtgtcatttatctgcacagttgccaactatgaatatggtttttactggcacttttatcaggatggtaagatagaagctgaagtaaaacttactggaattctgagtttgggagctctgatgcctggggaatcaaggaaatatggtacaactattgctcctagtctgtatgcacctgtccaccagcatttctttgttgcccgtatggacatggctgttgattgcaaacctaacgaagctcataatcaggtggttgaagtaaatgtcaaagtcgaaagtgcaggcacaaataatgtgcacaacaatgctttctatgctgaagaaaaaatactgaaatccgagttgcaagcaatgagagattgtgacccttcatctgcgcgacattggattgttaggaacacaagggctgtaaatcgtaccggacaaccaactggtttcagactcgtgcctggttcaaactgtttgccatttgctctgcccgaggcaaagtttcttcgaagagccgggttcctaaagcacaatctttgggtgacaccatacaagagcgatgagaagtttcctggaggggagttccccaaccagaatccacgtcttcacgagggtttagctacttgggtgaagaaggatagacccttggaggaaactgacatcgtcctctggtatgtatttgggctcacccacatcccaaggctggaagactggccggtcatgccggtggaacacatcggcttcatgctcatgccacatggattcttcaactgctcgcctgctgtcgatgtgcctcctggcacttctgatgccgccgatgtcaaggaagcagagtcgcctaaggccatccagaacggggcccttgtttccaagctctaagcttggcagctctcctcaaaagaacaaactggcaataaaagttgttatctcgtggtctgtttcgttttctgtaatatgtttgtttgctgcactgattgattgtgaatgttgagctgcacaagtagcatctaataatctctggactggcataatgcctgcataaataaaagtgtgttgcc

SEQ ID NO: 5491 - DNA, 3044 bp, Hordeum vulgare
cccggtcacctttcccctcgccttttataaatgcacgtgatccctccgtcgcctcgctctacagaacacccgacgcccctctctccgctcctctcctctccccaccgccaccaccactccggtccggtgttcgctagccgcagcctccaccgggcgcacgatcctctccgctcctcgatcggctctctcgcggacggagggaacgggctcgcgaaaccctggcccgatcccgtagaaccccccctagacgcggaggccctgacgcgggggagtgagagcggggggaggacgaaggcgcggggaggcggaggcctgtgctgtatgtcagatcgtgggatccggcgaggcggagacggcggaggagactacggacacggtcagctcgcgaacccgctccaatggcctcagctcaggaaaaggcggcgctctgctgcggcggccccgcgcgcgatgcccccagggcggccatcgccgcgcccgcgcccgggaaggtctccatgtccggcgctggtgaccgcgtcgtctccgctgccgggggcggcgccgtgatggacgacatcgcgtccgcggcccagcccaccaccgccaaggcctcctctaaagggatacccataatgacgagagctcaaagattccaccctttggacccattatctgctgccgaaattgcagtggctgttgcaactgtaagagccgctggaaaatctcctgaggaacgcgacagcatgcgttttgttgaagctgtgctactggaaccagaaaagaatgttgtggcattagctgatgcctactttttcccaccgttccaaccatcactgctccctagaaccaaaggctctgccgtcattccaagcaggttgcctcccaggagggccaagcttgttgtctacaatagacattcaaatgagactaccatttggatagtggaactatcagaagtgcatgcggctactagaggtggacatcacagagggaaggtgatatcatctgaggttgttccagatgtacagcctgcaatggatgctatggaatatgctgagtgtgaagctactgtaaaaaattatcctccatttgttgaagctatgaaaaaaagaggtgtggacgacatggaacttgtcatggtagatgcctggtgtgcgggctactacagtgacgctgatgctcccagtcgtagacttgctaggcctctaatcttttgccgaaccgagagtgatagtcccatggagaatggttatgctcgtcctgtggaagggatccatgttgttgtcgatatgcagaataatgttgtcatagagtttgaagacaggaagtttgttcctctgcccccaccagatcatttgaggaactacactcctggggaaaccagaggtggtgttgatcgcagtgatgtgaaacctcttattattaatcagcctgagggcccaagcttccgtattaatggctattttgtggaatggcagaagtggaatttccgtattggcttcacccctaaagagggtttggtcatctactctgttgcatatgttgacggtagccgtgggcgtagacctatagctcataggctgagctttgttgagatggttgttccttatggagatccaagtgaaccacattatcgcaagaatgctttcgacgctggagaagatggacttggcaaaaatgctcattctcttaagaagggctgtgactgcttgggctacatcaagtattttgatgcacacttcacaaactttaccggtcatgtggagacaattgagaactgtgtgtgtttgcacgaggaggaccatggaatcctttggaaacaccaagattggagaactggtttagcagaagttaggcgatcaaggaggctcacggtgtcatttatctgcacagttgccaactatgaatatggtttttactggcacttttaccaggatggtaagatagaagctgaagttaaacttactggaattctgagtttgggagctctgatgcctggggaatcaaggaaatatggcacaactattgctcctagtctatatgcacctgttcaccagcatttctttgttgcccgtatggacatggctgttgattgcaaacctaacgaggctcataatcaggtggttgaagtaaatgtcaacgtcgaaagtgcaggcacaaataatgtgcataacaatgctttctatgctgaagaaaaaatactgaaatctgagttgcaagcaatgagagattgtgacccttcatctgcgcgacattggattgttaggaacacgagggctgtaaatcgtaccggacaaccaactggtttcagactcgtgcctggttcaaactgtttgccatttgctctgcccgaggcgaagtttcttcgaagagccggattcttgaagcacaacctttgggtgacaccatacaagagcgatgagaagtttcctggaggggagttccccaaccagaatccacgtcttcacgagggtttggctacttgggtcaagcaggataggcccttggaggaaactgacatcgtcctctggtatgtatttggactcacccacatcccaaggctggaagactggccggtcatgccagtggaacgcatcggcttcatgctcatgccacatggattcttcaactgctcgcctgctgtcgatgtgcctcctggcacctctgatgccgctgatgtcaaggaagcagagtcgcctaaagccatccagaacggtggccttgtctccaagctctgaagcttcgcggctctcatcgaaagaacaaactggcaataaaagttatcttctcgtggtctgttttattttctgtaatatgtgtgtttgctgctctgaatgattgtgaatgttttgagctgcacaagtagcatctaataatgtctggactggcataatgcctttgttataaataaaagtgtgttgccatgccctcttttaggggcaatgattatcgtgccatcaatcatttgctggagtggcgtaatgcatgtaggcgtatttgttagctgctctgtcgtgtttgcaacccatcatccatgagaaactagtttgacatcatctcgc

SEQ ID NO: 5492 - DNA, 2811 bp, Solanum lycopersicum
tggaaatctaaacaaaataaactgtcacaaactttaagctctgagcatagtgccatagcacagacgtaacaaactattcgcagaagcagagtggcgagaaaaagcacaacagagtatttgctgatcgatcagtcactgattttgagtgtcgaagcgcgtgaataattaaaccttcagtacaccgtgatcatcacagtataagtagtagtcgcaatggctgaaacctcacaaaacgtgattcctactcctactaatactactgctgctgctgctgcttctttcatccctccgacctctgtttctgttgtccgtcgtgagaatactgccgtgtccgtttccgattccgctgttgactccgttgtcgtcgacaatcagaaggaacaaacaccggcaactgcgtctagcaaagggattcaaatcatgcatagagctcatacttgtcatcctttggaccctttaactgctgctgagatctctgtggctgtggcaaccgttagagctgccggtgatacgcctgaggtcagagatggcatgcggtttgttgaggtggttctgttggaaccagataaaacttttgttgcactggcagatgcctatttctacccacctttccaatcatcattgatgcccagaaccaaaggaggacttcttgttccttctaaactacctccaaggcatgctagacttattgtttacaataagaaaacaaatgagacaagcgtatggattgttcggctaactgaagtacatgctgctgttcgaggtggacaacacaggggaaaagtgatctcatcaaaagttattccagatgttcagccacctatggatgcacaagagtatgctgactgtgaatctgtggttaaaaattatcctccatttattgaagcaatgaagagaaggggtattgatgacatggaccttgtaatggttgacccctggtgcgttggttatcacagtgaagctgatgctcctagccgcaggcttgccaaaccactaatattctgcagaacagagagctactgcccaatggaaaatggatatgcaagaccagttgaaggtatacatgtgcttgttgatgtgcaaatcatgcaggtgatagagttcgaagaccgcaaacttgtacctttacttccagctgatccactgaggaattacactgcgggtgagacaagaggaggggttgaccgaagtgatgtgaaacccctacaaattattcagccagagggtccaagctttcgcgtcgatgggaactatgttcaatggcaaaagtggaatttccgagtaggtttcacccctagggagggtttggttatacactctgtggcatatcttgatggtagcaggggacgaagatccatagcccataggttgagttttgtggagatggttgtcccctatggggatccaaatgatccacattacagaaaaaatgcatttgatgcaggagaagatggccttggaaagaatgcccattcacttaagaggggatgcgattgtttaggatacataaagtactttgatgccaattttacaaattttactggaggagtagaaaccatcaaaaattgtgtatgtttgcatgaggaagatcacgggatgctttggaagcatcaggattggagaactggccttgctgaagttagacggtctagacgactgactgtttcttttatttgcactgtggccaattatgaatatggattctactggcacttttaccaggcaagaataagaaaatcatttatcaggaaatgttcatttgatgggaaaattgaagcagaagtcaaactcacaggaattctcagtttgggagcattgcaacctggagagtctcgaaaatatggcaccacaatatcaccaggattgtatgcacctgttcatcagcacttctttgttgctcgtatgaatatggcagttgattgtaagccaggagaagcacacaatcaggttgttgaagtaaatctcaaagttgaagaacctgggaaggaaaatgttcacaataacgcattctatgccgaagaaacacaacttaggtctgaattgcaagcaatgcgagactgtgatcctttatctgctcgtcattggattgttaggaacacaagaacatccaacagaacaggtcagctaacagggtacaagctggtacctggtcagaactgtttgccattggctggtcctgaggctaagttcttgagaagagcggcatttctgaagcacaatctgtgggttacacaatatgcacccggagaagattttccagggggagagttccctaatcaaaatccacgtgttggcgagggactagcttcttgggtcaaggaagatcgctctctggaagaaagtgatattgttctctggtatgtttttggaatcacgcatgttcctagattggaggactggcctgttatgcccgttgaacatatcggctttatgcttcagccgcatggattctttaactgctctccagctgtagatgtacctccaccacggggatgtgactcagaaagcaaagacagcgatgcttcagaaaatggtgaatcaaagcccactaccactggtttgactgccaagctttgaaggatttttggttcataaagtagtccttccgtattatctgctgcgcatacacagaaaacgtaaacttcaatttctgttttctttcaatagagtcctgagaattggtgcttccacatggatattgctactgtaaatgacatgttttagcaaagcatgtactgttcattgaccttgctcattcttatttcggaaaactaatatttctacgtattcaatgcacaaccaacttttcta

SEQ ID NO: 5493 - DNA, 2310 bp, Flaveria ramosissima
cggttctcctccgccgtgaggctacctcctccgccaccgctgccgatgtcgttcaggattggaccaccgatccgtccgtcggtgatcagattcgccaccgcggcacagctgcttccgtcgataactccactcgtcctgtcggtactcaaacttccgctgctaccactgctgttaaaggacctgggccaaccagtatggttaaagcacaaactcgccatccacttgatcctctagctgctgctgaaatctccatagcagtggcaactgttagagctgcaggagcaacaccagaggtaagagatagcatgcgatttatcgaggtggtacttgtggaaccatcaaaaaatgtggttgcattagcggatgcatattttttcccaccttttcaaccgtcattactgcctagaacaaagggaggtcccataatcccaactaaacttcctcctcgacaagctagacttattgtttataataagaaatcaaatgaaactagcgtatggattgttgagctatcagaagtacatgccctaactcgtggtggtcaccatagagggaaagtcatttcttccacagttgtgcctgatgtacaacctcctatggatgctgtggaatatgctgaatgtgaagccattgtaaaggacttccctccatttagggaggccatgaagaggaggggtattgaagatatggatcttgtgatggtagatccctggtgtgttggctatcacagtgaagctgacgctcctaaccgtagactagcaaaaccacttatcttctgtagaacagaaagtgactgtcccatggaaaacggttatgcccgcccagttgaaggaattgatgttttggttgatatgcaaaacatggtggtgattgaatttaaagaccgtaaacttgttcctctaccaccagctgatccattgagaaactacacagctggcgaaacaagaggtggtgtagatcgaagtgatgtgaaaccgctaaatattgttcagcctgatggtcccagttttcgtgttaatggccactttgttcaatggcagaagtggaatttccgtattggtttcactcctagggagggtttagttatttattctgttgcatatgttgatggtagccgaggtcggaggcctgtggctcacagattaagctttgtagaaatggtggttccttatggtgaccccaatgatcctcattacagaaagaatgcatttgatgcaggggaagatggactaggcaaaaacgctcattctcttaaaaagggttgtgattgtttgggttatgtcaagtattttgatgcacacttaacaaatttcaccgggggcgttgaaacaattgaagattgtgtttgtttacatgaagaagatgatggaatgttatggaagcatcaagactggagaactggtttagctgaagtaagacggtcaagaaggctagtagtgtcttttatatgcactgttgccaactatgaatacgggttttactggtatttttaccaggatgggaaaatagaagctgaggtgaagttaactggaattcttagcttaggagctttacaaccaggtgaaactagaaaatatgggactacaattgcccctggactctatgctcctgttcatcaacacttctttgttgctagaatggatgtatctgttgactgtaagcctggtgaagcccacaatcaggtggttgaggtcgatgttaaagttgaaggaccaggagatgcaaatgtccacaacaacgcgttctatgctgaagaaaagctgttgaaatccgaacttgaagcaatgcgtgattgtaatccttcatctgcccgacattggattatcaggaacacgagaactgtaaaccgaaccggtcaattaaccggctacaaactggttcctggatcaaattgtttaccattgggcgggagcgaggctaagtttttgagaagagctgcttttttgatgcacaatttgtgggtcacacaatatgaacctgaagaaatgtttcctggtggagagttccctaatcagaatccacgtgtcggcgagggattggctacttgggttaagaaaaaccgatctctagaagaaactgatctggttctttggtacgtatttggagtgacacatgttcctcgactggaagattggcctgttatgccagtagaacacattggcttccgtcttatgccccatggattcttcaactgctcccctgctgttgatgttcccccgagcccgttggctgacatggaaatgaaggaaaatggaatggtagataagtcgtgtcataatggtctcgtttcaaagatgtgagaaaccgatt

SEQ ID NO: 5494 - DNA, 2829 bp, Triticum aestivum
tacgacgcggaggccctgacgcggggagtgagagagcggagcgggggaggacgaaggcgcggggaggcggcggcctgtgctgtatgtcagatcgtgggatccggcgaggcggagacggcggaggagactacggacacggtcagctcgcgaacccgctccaatggcctcagctcaggaaaaggcggcgctctgctgcgggggccccgcgcgcgatgcccccagggcggcgatcgccgcgcccgggaaggcggtctccatgtccgcggccgccgccggcggttccgctgccgggggcggcgccgtgatggacgacatcgcgtccgcggcccagcccactaccgccaaggcctcctctaaagggatacccataatgacgagagctcaaagattccaccctttggacccattatctgctgccgaaattgcagtggctgttgcaactgtaagagccgctggaaaatctcctgaggaacgtgacagcatgcgttttgttgaagctgtgctactggaaccagaaaagaatgttgtagcattagccgatgcctactttttcccgccgttccaaccatcactgctccctagaaccaaaggctctgccgtcattccgagcaggttgcctcccaggagggctaagcttgttgtctacaatagacattcaaatgagactaccatttggatagtagaactatctgaagtgcatgcagctactagaggtggacatcacagagggaaggtgatatcatctgaagttgttccagatgtacagcctgcaatggatgctatggaatatgctgagtgtgaagctactgtcaaaaattatcctccatttgttgaagctatgaagaaaagaggtgtggacgacatggaacttgtcatggtagatgcctggtgtgctggctactacagtgatgctgatgctcccagtcgcagacttgccaggcctctaatcttttgccgaactgagagtgatagtcccatggagaatggttatgctcgtcctgtggaagggatccatgttgttgttgatatgcagaataatattgtcatagagtttgaagacaggaagtttgttccactgcccccaccagatcatttgagaaactacactcctggagaaactagaggtggtgttgatcgaagtgatgtgaaacctcttattatcaatcagcctgagggcccaagcttccgtattaatggctattttgtggaatggcagaagtggaatttccgtattggcttcacccctaaagagggtttggtcatctactctgttgcatatgttgatggtagccgtggacgtagacctatagctcataggctgagctttgttgagatggttgttccttatggagacccaagtgaaccacattatcgcaaaaatgctttcgatgctggagaagatggacttggcaaaaatgctcattctcttaagaaggggtgtgattgcttgggttacatcaagtattttgatgcacacttcacgaactttaccggtcatgtggagacaattgagaactgtgtgtgcctccacgaggaggaccatggaatcctttggaaacaccaagattggagaactggtttagcagaagttaggcgatcaaggaggctcacggtgtcgtttatctgcacagttgccaactatgaatatggtttttactggcacttttatcaggatggtaagatagaagctgaagtaaaacttactggaattctgagtttgggagctctgatgcctggggaatcaaggaaatatggtacaactattgctcctagtctgtatgcacctgtccaccagcatttctttgttgcccgtatggacatggctgttgattgcaaacctaacgaagctcataatcaggtggttgaagtgaatgtcaaagtcgaaagtgcaggcacaaataatgtgcacaacaatgctttctatgctgaagaaaaaatactgaaatccgagttgcaagcaatgagagattgtgacccttcatctgcgcggcattggattgttaggaacacaagggctgtaaatcgtaccggacaaccaactggtttcagactcgtgcctggttcaaactgtttgccatttgctctgcccgaggcaaagtttcttcgaagagcagggttcctaaagcacaatctttgggtgacaccatacaagagcgatgagaagtttcctggaggggagttccccaaccagaatccacgtcttcacgagggtttggctacttgggtgaagaaggatagacccttggaggaaactgacatcgtcctctggtatgtatttgggctcacccacatcccaaggcttgaagactggccggtcatgccggtggaacgcatcggcttcatgctcatgccacatggattcttcaactgctcgcctgctgttgacgtgcctcctggcacttctgatgccgccgatgtcaaggaagcagagtcgcctaaagccatccagaacggcagccttgtttccaagctctgaagcttcgcggctcctcaaaagaacaaactggcaataaaagttatcttctcgtggtctgtttcgttttctgtaatatgtttgttttgctgctctgaatgattgtgaatgttaagctgcactagtagcatctaataatgtctggactggcataatgcctgtataaatagaagtgtgttgccctttgggggcaatggttgccatgtcatcgatcatttgctggactggcgcactgcatgtcggcgtccacctggtggaggaggtggtggttagcctccgcctctgaatggatggagtcgaggatggcttgctgctctgccacctcctccgtttgggccatctcaaactctgccaac

SEQ ID NO: 5495 - DNA, 2971 bp, Secale cereale
gcgggggccccgcgcgcgatgcccccagggcggcgatcgccgcgcccgggaaggtctccatgtccgcggccggcggtggtggtgagcgcgtcgtctccgctgccggggccggcgccgtgatggacgacatcgcggcgtccgcggcccagcccactaccgccaaggcctcctctaaagggatacccataatgacgagagctcaaagattccaccctttggacccattatctgctgccgaaattgcagtggctgttgcaactgtaagagccgctggaaaatctcctgaggaacgcgacagcatgcgttttgttgaagctgtgctactggaaccagaaaagaatgttgtagcattagccgatgcctacttcttcccaccgttccaaccatcactgctccccagaaccaaaggctctgccgtcattccaagcaggttgcctccgaggagggccaagcttgttgtctacaacaggcattcgaatgagactaccatctggatagtagaactatctgaagtgcatgcagctactagaggtggacatcacagagggaaggtgatatcgtctgaagttgttccagatgtacagcctgcaatggatgctatggaatatgctgagtgtgaagctactgtcaaaaattatcctccatttattgaagctatgaagaaaagaggtgtggatgacatggaacttgtcatggtagatgcctggtgtgctggctactacagtgatgctgatgctccaagtcgcagacttgccaggcctctaatcttttgccgaactgagagtgatagtcccatggagaatggttatgctcgtcctgtggaagggatccatgttgttgttgatatgcagaataatattgtcatagagtttgaagacaggaagtttgttcctctgcccccagcagatcatttgagaaactacactcctggggaaactagaggtggtgttgatcgaagtgatgtgaaacctcttattatcaatcagcctgagggcccaagcttccgtattaatggctattttgtggaatggcaaaagtggaatttccgtattggcttcacccctaaagagggtttggtcatctattctgttgcgtatgttgatggtagccgtggacgtagaccgatagctcataggctgagctttgttgagatggttgttccttatggagatccaagtgaaccacattatcgcaagaatgcattcgatgctggagaagatggacttggcaaaaatgctcattctcttaagaaggggtgtgactgcttgggttacatcaagtattttgatgcgcacttcacgaactttaccggtcatgtggagacaattgagaactgtgtgtgtctgcacgaggaggaccatggaatcctttggaaacaccaagattggagaactggtttagcagaagttaggcgatcgaggaggctcacggtgtcatttatctgcacggttgccaactatgagtatggtttttactggcacttctaccaggatggtaagatagaagctgaaatcaaacttactggaattctgagtttgggagctctgatgcctggggaatcaaggaaatatggtacaactattgctcctagtctgtatgcacctgttcaccagcatttctttgttgcccgtatggacatggctgttgattgcaaacctaacgaggctcataatcaggtggttgaagtaaatgtcaaagtcgaaagtgcaggcacaaataatgtgcacaacaatgctttctatgccgaagagaaaatactgaaatctgagttgcaagcaatgagagattgtgacccttcatctgcgcgacattggattgttaggaacacgagggctgtaaatcgtaccggacaaccaactggtttcaggctggtgcctggttcaaactgtttgccatttgctctgcctgaggccaagtttcttcgaagagccgggttcttaaagcacaacctttgggtgacaccatacaagagcgatgagaagtttcctggaggggagtttcccaatcagaatccacgtctccacgagggtttagctacttgggtcaagcaggataggcccttggaggaaactgacatcgtcctctggtatgtatttgggctcacccacatcccaaggcttgaagactggccggtcatgccagtggaacgcattggcttcatgctcatgccacatggattcttcaactgctcgcccgctgtcgatgtgcctcctggcacttctgatgccgccgatgtcaaggaagcagagtcgcctaaggccatccagaacgggggccttgtttccaagctctaatcttggcagctctcctcaaaagaaatgaacaaactagcaataaaagtttttatctcgtggtctgtttcgttttctgtaatatgtatgtttgctgcactgattgattgtgaatcttgagctgcacaagtagcatctaataatgtctggactggcataatgcctgcataaataaaagtgtgttgccatgctttggcaggtatggtacaaaaaaaagaaagaaaaaagaaagagagagatagacagagacagtcatagtactagtacgacttacgtaggtacctacggaattccggacttaaggtaccgtaagtccggtaataccgttagtaccggtaagttccctaaggtcagtacgatcgtagcgatagttcgtaccgtaaggccgtaattcgtaccggattaccgaaggtttcaaccggtagttccggataaccgtcgtaaggtcctaggtaacctggtcctagttaacgcgttcggaactccggtatcggtactaacggtcttcgtacgtaaccgttgaaaccgtgtaccggtatacgtaccggtatttaacggccttacggtactacggtcggttaaactcgtacgggtacttaacgccgggtttgtaaaccccggtaggtttaaaacccccgtgggttttaaccacggttaccgtttaacgccggttaaaccgg

SEQ ID NO: 5496 - DNA, 2784 bp, Secale cereale
accactactccggcgcgagccagccccagccccagaccccgcccggcgcacgatcctcggctctctcgcggagaggacgggtgcccgaaaccctggcccgatcccgtagaaccccccctagacgcggaggccctgacgcgggggagtgagcgcgggagcggggggaggacgaaggcgcggggaggcggaggcctgtgctgtatgtcagatcgtgggatccggcgaggcggagacggcggaggagactacggacacggtcagctcgcgaacccgctccaatggcctcagctcaggaaaaggcggcgctctgctgcgggggccccgcgcgcgatgcccccagggcggcgatcgccgcgcccgggaaggtctccatgtccgcggccggcggtggtggtgagcgcgtcgtctccgctgccgggggcggcgccgtgatggacgacatcgcggcgtccgcggcccagcccactaccgccaaggcctcctctaaagggatacccataatgacgagagctcaaagattccaccctttggacccattatctgctgcagaaattgcagtggctgttgcaactgtaagagccgctggaaaatctcccgaggaacgcgacagcatgcgttttgttgaagctgtgctactggaaccagaaaagaatgttgtagcattagccgatgcctacttcttcccaccgttccaaccatcactgctccccagaaccaaaggctctgccgtcattccaagcaggttgcctccgaggagggccaagcttgttgtctacaacaggcattcgaatgagactaccatttggatagtagaactatctgaagtgcatgcagctactagaggtggacatcacagagggaaggtgatatcatctgaagttgttccagatgtacagcctgcaatggatgctatggaatatgctgagtgtgaagctactgtcaaaaattatcctccatttattgaagctatgaagaaaagaggtgtggatgacatggaacttgtcatggtagatgcctggtgtgctggctactacagtgatgctgatgctcctagtcgcagacttgccaggcctctaatcttttgccgaactgagagtgatagtcccatggagaatggttatgctcgtcctgtggaagggatccatgttgttgttgatatgcagaataatattgtcatagagtttgaagacaggaagtttgttcctctgcccccagcagatcatttgagaaactacactcctggggaaactagaggtggtgttgatcgaagtgatgtgaaacctcttattatcaatcagcccgagggcccaagcttccgtattaatggctattttgtggaatggcaaaagtggaatttccgtattggcttcacccctaaagagggtttggtcatctattctgttgcgtatgttgatggtagccgtggacgtagaccgatagctcataggctgagctttgttgagatggttgttccttatggagatccaagtgaaccacattatcgcaagaatgcattcgatgctggagaagatggacttggcaaaaatgctcattctcttaagaaggggtgtgactgcttgggttacatcaagtattttgatgcgcacttcacgaactttaccggtcatgtggagacaattgagaactgtgtgtgtctgcacgaggaggaccatggaatcctttggaaacaccaagattggagaactggtttagcagaagttaggcgatcaaggaggctcacggtgtcatttatctgcacggttgccaactatgagtatggtttttactggcacttctaccaggatggtaagatagaagctgaaatcaaacttactggaattctgagtttgggagctctgatgcctggggaatcaaggaaatatggtacaactattgctcctagtctgtacgcacctgttcaccagcatttctttgttgcccgtatggacatggctgttgattgcaaacctaacgaggctcataatcaggtggttgaagtaaatgtcaaagtcgaaagtgcaggcacaaataatgtgcacaacaatgctttctatgctgaagagaaaatactgaaatctgagttgcaagcaatgagagattgtgacccttcatctgcgcgacattggatcgtcaggaacactagggctgtaaatcgtaccggacaaccaactggtttcagactcgtgcctggttcaaactgtttgccatttgctctgcccgaggccaagtttcttcgaagagccgggttcttaaagcacaacctttgggtcacgccatacaagagcgatgagaagtttcctggaggggagtttcccaatcagaatccacgtcttcacgagggtttagctacttgggtcaagcaggataggcccttggaggaaactgacatcgtcctctggtatgtatttgggctcacccacatcccaaggcttgaagactggccggtcatgccggtggaacgcattggcttcatgctcatgccacatggattcttcaactgctcgcctgctgtcgatgtgcctcctggcacttctgatgccgccgatgtcaaggaagcagagtcgcctaaggccatccagaacgggggccttgtttccaagctctaagcttggcagctctcctcaaaagaacaaaccggcaataaaagttatctcgtggcctgtttcgttttctgtaatatgtttgtttgctgcactggttgactgtgaatgttgagctgcacaagtagcatctaataatgtctggactggcataatgcctgcataaataaaagtgtgctgccat

SEQ ID NO: 5497 - DNA, 2526 bp, Chrysanthemum coronarium
tcactgtcagcgcctgatttatcctctaccgttttctgttagtgtgtgtaacaaactaaccaacacacacacagtcactcacaatgactgacaaatcatcatcatcaaccgtcgttctccgccgcgaagtgacgtcatcttccgccgctgctgacgtcgttgtcaaaccttccgtagccgttactgctcctactaaaggtgggcccacgaatatggttaaggcacagactcgccacccgatggatcctcttgctgctgctgaaatttccatagctgtggcaactgttagggctgcgggagcgactcctgaggtaagagacagtatgcgattcatagaggtagtccttgtggaaccagacaaaaatgtggttgcattggcagatgcatattttttcccaccttttcaaccgtcattgttgccaaggaccaagggaggacccataatcccgacaaaacttccacctcgacaagctagacttattgtttacaacaaaaaatcaaatgaaacgagtatatggatcgttgagttatcagaagttcatgctctaactcgaggtggccatcatagaggcaaagttatttcatctaaagtagtgcctgatgtgcaacctcctatggatgctgtggagtatgctgaatgtgaagccattgtaaaggagtaccctcctttccgagaggctatgaagaggaggggtattgatgatttggatctcgtaatggtagatccatggtgtgttggttaccatagtgaggctgatgctcctaatcggagacttgctaaaccgctcatattctgtcgaacagaaagtgactgtcccatggagaatggttatgctcgtccggttgaaggaattgatgtgttagttgacatgcaaaatatggtggttatcgagttcaaagaccgcaaacttgttcctctaccaccagcagacccattgagaaattatacagctggtgaaacaaggggaggcgttgatcgaagtgatgtcaaaccactaaatattgttcaacctgatggtcctagttttcgtgttaatggtcattttgttcagtggcagaagtggaatttccgtattggcttcacacctagggagggtctggtcatatattctgttgcatatgttgatggaaacagaggtcggaggcccgtagcccacagattaagcttcgtagaaatggtggttccttatggtgaccccaatgaccctcattacaggaagaacgcatttgatgcaggggaagatggacttggtaaaaatgctcattcattaaaaaaaggctgtgattgcttgggttacatcaaatattttgacgcacacttaaccaattttaccgggggtgttgaaacaattgaagactgtatttgcttgcatgaagaggatcatggaattttgtggaagcatcaggactggagaactggtttagctgaagttcgacggtcaagaaggctagtggtgtcttttatctgtactgtggctaattacgagtacgggttttactggtatttttatcaggatggaaaaatagaagctgaggtgaagttaactggaatattaagcttaggagctcttcaacctggcgaagttagaaaatacgggactatgattgctcctggactctatgctcctgttcatcaacacttctttgttgctcgtatggatatgtctgttgactgtaagcctggtgaatcccacaatcaggtagttgagttggatgttaaagttgaagaacctggagatgcaaatgtgcacaacaacgccttttacgctgaagagacactgttaaaatcagaacttgaagcaattcgtgattgtaattctgcttgtgcccgacactggattatcaggaatactagaactgtaaaccgaactggccagttgacaggctacaaactagtacctggatcaaattgtttaccgttaggtggggcagaggccaagtttttgagaagagctgcttttttgatgcacaatctgtgggtcacggcgtatgatcctgaagaaatgtttcctggtggagagttccctaatcagaatccacgtgttggagagggtttagctacttgggttaagaagaatcgctctctagaagaaactgaccttgttctctggtatgtctttggagtgacacacgttcctcgactagaagattggcctgttatgccagtagaacacattggattccgcctcatgccacatggattcttcaactcctcaccagcggtggatgtccccccaagctcaatgaccgattcggaattgaaagaaaatggtttggtagataagtcttgccatactggtctcgttgctaaaatgtgaaaggatttattaccacgtaagtgtactccactagaaagccattttatctgtatttttgagatgttatactctttagggtccgtttacaccctatccgattagtttcatatgaaagacgtgatggttatgatgtttgtagcaattaccatctgttttgcttgtaaatatctaataagatcaatggaattttagataactctctttcctt

SEQ ID NO: 5498 - DNA, 2466 bp, Chrysanthemum coronarium
accgttttctgttagtgtgtgtaacaaactaaccaacacacacacagtcactcacaatgactgacaaatcatcatcatcaaccgtcgttctccgccgcgaagtgacgtcatcttccgccgctgctgacgtcgttgtcaaaccttccgtagccgttactgctcctactaaaggtgggcccacgaatatggttaaggcacagactcgccacccgatggatcctcttgctgctgctgaaatttccatagctgtggcaactgttagggctgcgggagcgactcctgaggtaagagacagtatgcgattcatagaggtagtccttgtggaaccagacaaaaatgtggttgcattggcagatgcatattttttcccaccttttcaaccgtcactgttgccaaggaccaagggaggacccataatcccgacaaaacttccaccccgacaagctagacttattgtttacaacaagaaatcaaatgaaacgagtatatggatcgttgagttatcagaagttcatgctctaactcgaggtggccatcatagaggcaaagttatttcatctaaagtagtgcctgatgtgcaacctcctatggatgctgtggagtatgctgaatgtgaagccattgtaaaggagtaccctcctttccgagaggctatgaagaggaggggtattgatgatttggatctcgtaatggtagatccatggtgtgttggttaccatagtgaggctgatgctcctaatcggagacttgctaaaccgctcatattctgtcgaacagaaagtgactgtcccatggagaatggttatgctcgtccggttgaaggaattgatgtgttagttgacatgcaaaatatggtggttatcgagttcaaagaccgcaaactagttcctctaccaccagcagacccattaagaaattatacagctggtgaaacaaggggaggcgttgatcgaagtgatgtcaaaccactaaatattgttcaacctgatggtcctagttttcgtgttaatggtcattttgttcagtggcagaagtggaatttccgtattggcttcacacctagggagggtctggtcatatattctgttgcatatgttgacggaaaccgaggtcggaggcccgtagcccacagattaagcttcgtagaaatggtggttccttatggtgaccccaatgaccctcattacaggaagaacgcatttgatgcaggggaagatggacttggtaaaaatgctcattcattaaaaaaaggctgtgattgtttgggttacatcaaatattttgacgcacacttaaccaattttaccgggggtgttgaaacaattgaagactgtatttgcttgcatgaagaggatcatggaattttgtggaagcatcaggactggagaactggtttagctgaagttcgacggtcaagaaggctagtggtgtcttttatctgtactgtggctaattacgagtacgggttttactggtatttttatcaggatggaaaaatagaagctgaggtgaagttaactggaatattaagcttaggagctcttcaacctggcgaagttagaaaatacgggactatgattgctcctggactctatgctcctgttcatcaacacttctttgttgctcgtatggatatgtctgttgactgtaagcctggtgaatcccacaatcaggtagttgagttggatgttaaagttgaagaacctggagatgcaaatgtgcacaacaacgccttttacgctgaagagacactgttaaaatcagaacttgaagcaattcgtgattgtaattctgcttgtgcccgacactggattatcaggaatactagaactgtaaaccgaactggccagttgacaggctacaaactagtacctggatcaaattgtttaccgttaggtggggcagaggccaagtttttgagaagagctgcttttttgatgcacaatctgtgggtcacggcgtatgatcctgaagaaatgtttcctggtggagagttccctaatcagaatccacgtgttggagagggtttagctacttgggttaagaagaatcgctctctagaagaaactgaccttgttctctggtatgtctttggagtgacacacgttcctcgactagaagattggcctgttatgccagtagaacacattggattccgcctcatgccacatggattcttcaactcctcaccagcggtggatgttcctccaagttcaatgaccgattcggaactgaaagaaaatggtttggtagataagtcttgccatactggtctcgttgctaaaatgtgaaaggatttattaccatgtaagtgtactccactagaaagccattttatctgtgttttcgagatgttatactctttagggtccgtttacaccctatccgattagtttcatatgaaagacgtgatggttatgatgtttgtagcaattaccatctgttttgcttgtaaatatctaataa

SEQ ID NO: 5499 - DNA, 2139 bp, Musa acuminata
atgttcagtggtttaactgcaggaatcccagttatgatgagggctcaaacaagccaccctttggatccgttgtcttcggctgaaatatctgttgcagtagcaacagtcagggctgcaggggcaactccggaggtgagagatggcatgcggtttatagaagtagttctgttggaaccagagaaaaacattgtggcactggccgatgcctacttcttccccccatttcaaccatcactgctccccagaacgaaaggtggccctgtcatcccgagtaagcttcctcctaggagggctaggcttgttgtttataacaaaaggtcaaatgagacaagcatttggattgtcgaactgtcagaagtgcatgcagcaactcggggtggccatcacaggggaaaagtcatctcatctgaagttgtccatgatgtccagccctctatggatgccatggaatatgcagaatgtgaggctgctgtaaaaaattaccctgcatttatagaggcaatgagaaagagaggagtggaggatatggatcttgtaatggttgatgcttggtgtgttggttactacagtgatgctgatggtcctagccgcagacttgcaaagccactaatattttgtagaacagagagtgactgccccatggagaatggttatgcacgtcctgtcgaaggcatacatgttcttgttgatattcaaaataatgtgataattgaatttgaagatagaaaattggtacctctacctccagcagatcctttgagaaactacactgcaggagaaatgcgaggaggcattgaccgaagtgatgtgaaacctttgcatattctgcagcctgaaggtccaagttttcgtgtaaatggttactttgtacaatggcagaagtggaatttccggattggtttcacccctagggagggattggtaatacattctgtggcctacattgatggtagtcgtggacggagacctattgctcacagattaagtttcgttgagatggtagttccttatggagatccaaatgagcctcattaccttaagaatgcatttgatgctggagaagatggccttggaaaaaatgcacattctctcaaaaagggttgtgactgcttgggctacatcaaatactttgatgcccatttcactaactatactggtggtgtcgagactattgagaattgtgtgtgtttgcatgaagaagaccatgggattttgtggaagcatcaagactggagaacaggcttagcagaggttaggcggtcaagaaggctaagtgtgtctttcatatgtacagtggctaactatgagtatggctttttttggcacttctatcaggatggtaaaattgaggcagaagtaaaactgactggcattctaagcttaggagcattacaacctggtgaatcaagaaagtttggtacaacaatagctccaggtttatatgcaccagttcatcagcatttctttgttgctcgcatgaatatggctgttgattgtaaacccaatgaagccttcaatcaggtggttgaggtgaatgttaaagttgaagaacctggcaaggataatattcacaataatgcattttatgctgaagaaaagcttctcagatctgagttgcaggctatgcgtgattgccaacctttgtcggcacgacactggattgtgaggaacaccagaactgtaaatcgaactggtcaacctgcaggatacaagctgatgcctggttccaattgccttccgttagctgggccagaggcaaaatttttgagaagagctgcatttttaaagcataacctttgggttacatcatataaacatgatgagatgtatccaggaggagagtttcccaatcaaaatccacgcataaacgagggactagctacatgggttaggaagaataggtcccttgaggaaactgacattgtcctatggtacgtattcggaatcacccacatcccaaggctggaagactggcccgtcatgcctgttgagcatattggctttttgctcatgccgcatggtttcttcaactgctccccggcagttgacgtgcctcctagtcccaatgaggcagacaaggagtgtggagcacctaagttgatgcacaatggactggttgcgaagctttgaggaaagatg

SEQ ID NO: 5500 - DNA, 2315 bp, Capsicum annuum
agggattcagatcatgcatagagctcatacttgtcatcctttggatcctttatctgctgctgagatatctgtggctgtggcaaccgttagagctgccggtgactcacctgaggtcagggatggcatgcggtttgttgaggtggttctgttggaaccagataaagcgtttgttgcactagcagatgcctatttcttcccaccctttcaatcatcattgatgccccgaaccaaaggaggccttcccgttcctactaagctacctccaaggcgagctagacttattgtttacaataagaaaacaaacgagacaagcatatggattgttcagctaactgaagtacatgctgctactcgtggtggacaacacaagggaaaagtgatttcatcaaaagttgttccagatgttcagccacctatagatgcacaagagtatgctgagtgtgaatccgtaattaaagattatcctccttttgtggaagcaatgaagaaaaggggtattgatgacatggaccttgtgatggttgacccctggtgtgttggttatcacagtgaagctgatgctcctagccgcaggcttgccaagccacttgtattctgcagaacagagagcgactgcccaatggaaaatggatatgcaagaccagttgagggaatacatgtgcttgttgatgtgcaaaagatgcaggtgctagagtttgaagaccgcaaacttgtacctttacctccagctgacccacttagaaattacactgctggtgagacaagaggaggggttgaccgtagtgatgtgaaacccctacaaattagtcagccagagggtccaagctttcgcatagatgggaactacgtacaatggcaaaagtggaacttccgagtaggtttcacccctagggagggtttggttatacactctgtgggatatcttgatggtagcaggggtcgaagatccatagcccataggttgagttttgtggagatggttgtcccctatggtgatccaaatgagccacattacagaaaaaatgcatttgatgcaggagaagatggccttggaaagaatgctcattcgcttaagaggggatgtgattgtttaggatacataaagtattttgatgccaattttacaaattttactggaggagtagaatccatcgaaaactgtgtatgtctgcatgaagaagatcatgggatgctttggaagcatcaagattggagaactggccttgctgaagttagacgatctagaagactgactgtttctttcatttgtactgtggccaattatgaatatggattctactggcacttttaccaggatgggaaaattgaagcagaagtcaaactcacaggaattctcagtttgggagcattgcaacctggagaatctcgtaaatatggcaccacaataaaaccaggattatatgcacctgttcatcagcacttttttgttgctcggatgaatatggcagttgattctaagccaggagatgcacacaatcagattgttgaagtaaatgtcaaggttgaagaacctgggaaggaaaatattcacaataatgcattctatgctgaagaaactctgcttaggtctgagttgcaagcaatgcgtgactgtgatcctttatctgctcgtcattggattgttaggaacacaagaacctccaacagaacaggtcagctaacagggtacaagctggtacctggtcaaaactgtttgccattggctggtcctgaggctaagttcttgaggagagcggcatttttgaagcacaatctatgggttacacaatatgcagctggagaagattttccagggggagagttccctaatcaaaatccacgtgttggcgagggattagcttcatgggttaaggaagatcgctctctggaagaaagtgatattgttctctggtatgtttttggaatcacgcatgttccccgattggaggactggcctgttatgccagttgaacatattggctttatgcttcagccacacggattctttaactgctcccccgctgtagatgtacctccacctcggggatgtgactcggaaagcaaagacagtgatgtgtcggaaaatggtgtagcaaagtccacttccactggtttgatggccaagctgtgaaggtttttggttcggagtagtagtccgcatataatatccacacatacatacaacacgtaatcttcagtttctttttcctttcaggagtcctgaaagttggtgcggccacttggattttgctattgtaaatgacatgtttgagtaaaccgtgtcctgtttattgatcttgatcattcttatttgg

SEQ ID NO: 5501 - DNA, 2577 bp, Sciadopitys verticillata
cagtggaggcggcgggggcaacgaggcttgctgtatgtcagatagtaaaaacaaaaacaagtgggagaagtagagagagggacggcttcggcgcacttgcaaatccatcgcaatggccccagctaagaaaaaaacggcggtatgctgtaaacaatcctcgtcccccaaggaattctcagacaaggaggcagaggcagccgcagcagcagcaggcactctgtctctgcggagggaggcggcctctgcggaggttccggtcggcgcagagtgggatgtcaatggagatgtcataggagatccgcgcaacagaatacctgcattgcccgatgcgtcgaagccttccaccaaaggtgcaggagtgcaaatgatgcgagctgaaacaaaacatcctttggatccattatctgcagcagaaattgctgtggcagttgcaacagtcagagcagctggggcgactcctgaggtgcgagatggtatgcgatttattgaagtggttcttaaagagccagacaagcacattgttgcattagcagatgcctatttttccctccttttcaaccttcgctacttccgaaaacaaaaggtggtccagtaattcctcgtcaacttccccccaggcaagctaggattgttgtttataacaagcgttcaaatgagaccagtgtttgggttgctgaattatctgaggtgcatgcggcaactcgtggtggccaccacagagggaaagttatatcatcaaaactgttgaaatgttcagccaccaatggatgcaatggagtatgctgattgcgaatctgttgtcaaggattatgcccctttaaggaagcaatgaagaagagaggtattgaagatatggatctggtaatggtggacccatggtgtgttggatatcatggggaagaggatgccccgagccgaagactagccagaccacttattttctgtagaactgaaagtgattgcccaatggagaatggatatgctcgaccggttgagggcatacatgttttggttgatatgcaaaaaatggaggtgattgagtttgaagatcggaagttggttcctttgccgcctccagatcctctcagaaactatactgcaggacaatcacgtggaggagtggatcgaagtgatgtcaagcctttgcatatattgcaaccagaaggaccgagttttcgtgttaatggctaccatgtagagtggcaaaagtggaactttcgggtaggttttactccaagggagggactggtgattcactctgttgcatacgatgatggtagcagaggtcgaaggtctgtggcccacaggctgagttttgtggagatggttgttccttatggtgatccaaatgtaccacattacaggaaaaatgcgtttgatgctggagaggatggtctgggtaaaaatgcgcattctttaaaaaaggggtgtgattgcttggggtatatcaagtattttgatgcacacttcacaaatttcactggaggagttgaaactattgagaactgtgtctgcttgcatgaggaagacaatggagttctttggaaacatcaggattggaggacaggcttagcagaggttcgcagatctaggcgtctaacagtgtcctttatatgcactgtagcaaattatgaatatggcttcttttggcacttttatcaggatggtaaaatagaagcagaagttaaacttacagggattctcagtctaggggcagtacagcaaggtgaaacaaggaaatatggaacaacaattgctcctgggttatatgcgcctgtgcaccaacacttttttgttgctcgtatggacatggctgtagactgcaaacctggtgaagcggtgaatcaggttgtggaggtgaatgtgaatgttgaagacctggtgccaataatattcacaacaacgcattttacgccaaagaagatttgctacgatctgaattacaagctcagagagattttaatccattgtctgcccggcactggattgttaggaacacaaggactgtaaacagaacaggtcagttgactggctacaagctagtaccaggcacgaattgcttgccattggcagggtctgaagctaagtttcttagacgagctgcttttttacagcataacctttgggtcacccagtataataaagatgaacaatttcctggcggtgaatttcctaatcaaaatcctcgtgttggagagggattgcctacttgggtgaagcaaaatcgacagcttgaagaggctgatattgttctttggtatgtgtttggcattactcatgttcctcgtttggaggattggccagttatgcctgttgaacatattggattcatgctcatgcctcatgggtttttcaactgttccccggcagtggatgttcctcccagtgttgctgagagtgaattgaaggaaaatagcacaccaaagcaaagtggaataatatcaaaactctaaaattcattagttagtgttcaactatgccattaactatgttatctattatgctatcaagataattttttgaagggacaaatttgcttttccatatgtaaatttttcagaaaaatttcaatagccg

SEQ ID NO: 5502 - DNA, 3337 bp, Cedrus atlantica
gacggtttaggtcgtagcaacagcgtttggttatggtttccgttgaagacattagtgtaaaaccgtactttggagtatacggaaggggaaaggtaggtatgagaggatgacagaaagttgacgactattataaatatttagcgagaggcccgcccgagtatgtttgaagaagattggttcaacgagcttatcgagagcaccaacaaaattttgatcgactgagcgagcaggcccccttagtgacatccaaagctcgatctggagaaaggcaaacgctgaaccaaaaaaagaaggaacgaagaaaaaacaattattttctccctgtttatgaaaaaagacctcttgagtactcagatctgaagcgggcccttcggcactgggcgggagaaaacgagagccgagtaaagatcaaagaatcgtctctgttgttgaaattggagattcaaaataagataaatacaaggcagatatagcagcgcaggaggtggggagcttcgaggcttgctgtatgtcagattgtaaaaccagcgggagcacaagagagaggaacggcttcggtgtagttgcaaatccattgcaatggcctcagcttcgaaagaaacgacgatatgctgccagtcaggcgcatccgccccggatttggccgctaaggcctcttcctcctcctcgccctctttgcggcgcgaggcggcctcggccgaggttcccctcgctgaagagtggggcgttaatacggatctcggtgaagagaagcggaagagaaacagtgaaaccagaattcctgctgcggttttaagttccatggatacaatagccgaagcgtccatagctgcagctaaaggtacagcaatgcaaatgttgcgagctcatccaaggcatcctttagatccattatctgcagctgaaattgctgttgcagtggcaacggtcagagcagcaggggctactcccgagatgcgggacggtatgcgtttcattgaagtggttcttaaagagccagacaagcacgttgttgcattagcagatgcatactttttccctcctttccaaccttcactgcttccaaaaaccaaaggtggtccggtgattcctcgtcaacttcctcctaggcaagctaggattattgtttacaataaacgatcgaatgaaactagtgtctggattgttgaactacttgaggtacacgccgcagctcgtggtggccatcatagaggcaaagttatttcatcgaaagttattgaagatgttcagccacctatggatgcaatcgagtatgctgattgtgaatctgttgtcaaagattatcctcctttcaaggaggcaatgaaaaagaggggcattgatgatatggatctggtaatggttgacccatggtgtgttggatattatctggaagaggatgctccaagtcgaagactagctagaccacttatattctgcagaactgaaagcgactgtccaatggaaaatggatatgctcgaccggttgaaggcatacatgttcttgttgatatgcaaaaaatggaagtagtggagttgaagatcaaaagcttgttcccttgcctcccccagatccccttagaaactacactgcaggagaaacacgtggtggagtggatcggagtgatgtcaaaccactgcaaataattcaaccagaaggacctagttttcgtgttaatggctaccatatagattggcaaaagtggaattttcggataggttttactccaagggagggactggtgatatattctgttgcatacgatgatggcagcagaggtcggagatctgtggcccaccgtctaagttttgtggagatggttgtaccttatggggatccaaatggtccacattataggaaaaatgcatttgatgctggggaggatggtctgggcaaaaatgctcattctttgaagaaggggtgcgactgtttagggtatatcaaatacttcgatgcacatttcacgaatttcactggaggggtcgaaactattgagaactgtgtttgcttgcatgaggaagatcatggaattctgtggaagcatcaagattggaggacaggcttagcagaagttagaagatctagacgtttaacggtgtcattcatatgcactgtagcaaattatgagtatggtttcttttggcatttttatcaggatggtaaaattgaagctgaagtcaagctgacagggattctcagtttaggggctctacaacatggagagacaaggaagtatggtacaatgattgctcctgggctctatgcacctgtgcaccaacacttctttgttgctcgaatggatatggctgtagattgcaagcctggtgaaccagtgaaccaggttgtggaggtaaatgtgaaagtggaagaacctggacccaataatattcataacaatgcattttatgcggaggaagaattgctacgaactgaatcacaagctcagcgtgactgtaatccattgtctgctcggcactggattgttcggaacacaaggactgtaaacagaacagggcagttaacaggctacaagctaatgccaggctcaaattgcttaccattggcagggtctgaagctaagtttcttaggcgagctgcctttttacagcataacctttgggtaactcaatataataaagatgagcaatatccaggaggtgaatttcctaatcaaaatcctcgtgttggagaaggattgcctacttgggtgaaacaaaatcgaaaccttgaagaggctgatgttgttctatggtatgtttttggagttactcatgttcctcgtccggaggattggccagttatgcccgtggaacgaattggattcatgctttcgcctcatggtttcttcaattgttccccagcagtggatgtgcctcctagtattggtgaatgtgagaaggaaagtgtagggccaaagattaatcaaactggaattatatccaagctatgaacatttaccactggtgttgtctctgaccaagatagtagtttgaaaggaatgcatttcctttgacattgtagttttccgattctttttcaaaagctggacagttagtattcagtgtttattgttagatttgtgtctattacagttttgtaacttccgagtttgttggtgtttgttactgaaaatcaagcaacaaccttgttaatttaagttcatacggaatgtttatcatttattactattctgtatatgctacaatttcatagtttctgagttgccataattttgtgtgactggacttgttaattcagtggaattacaacattatttatgtcctctaaacatttttctcccgacattaatttagtacagacatcagtaatagaaca

SEQ ID NO: 5503 - DNA, 2785 bp, Populus trichocarpa
tctctcttcacatttctctctacgagcaccacacctttctttcttcccttatttctataataaataagaggaattcctgtatttgctgtctttgaagatcagagggtggtaaagaagaagaagaagaaaagggagtgttgtatgtcagtaaattgtaaagagatttatctttgtgggattggtgagcttgtgaatcctttgcaatggcctcaacttcgaaaaagacgacgccttctcctccttgttgtgactctactactcccgctcctcctcccattcgccgtgacgccacctcctcctcctctttggttccgcaagattggacggttccctccgctgatcgccgccccgttgtcgattctcttccagaaccttccaaaacagcctccgctgttatcccagtcatgttaagggctcagaccagccatcctttggatcctttgtctgctgccgaaatctctgttgcagtggcaactgttagggctgctggagccactcctgagcttagagatagcatgcgtttcgttgaggtggttctgtttgaaccggataagcatgttgttgcactggcagatgcatatttctttcctcctttccaaccatcattgcttcccagatcaaaaggtggacctataattcctacaaagttgcctccaagaagggctagacttgttgtttacaacaaacggtcaaatgagacaagcttatggattgtggagctctctgaagtacatgcagcgactcgaggaggacatcataggggaaaagtgatttcatctcaagttgttccagatgttcagcctccaatggatgctgttgaatatgctgaatgtgaagctgttgtcaaagactttcctccatttagagaggcaatgaaaaaaagaggtattgaagacatggaccttctgatggttgatgcctggtgtgttggttaccacagtgatgctgatgctccaagcagaagacttgccaaaccacttatattttgtagaactgagagtgactgtccaatggaaaatggttatgcacgtccagttgagggcatccatgtacttgttgatatgcaaaacatgagggtcattgaatttgaagaccgtaaacttgttcccttacctccagctgatccattgaggaactatactcctggtgaaacaagaggtggtgttgatcgaagtgatgtgaaacctttacaaattatccagcctgaaggtccaagctttcgtgctaatggacactatgtagaatggcagaagtggaattttcgcattggattcactcctagggagggcttggttatacattcagttgcctatgttgatggtagtagagggagacgacctatagcccacaggttaagctttgtagagatggtagttccttatggagatccaaatgagccacattaccgaaagaatgcatttgatgcaggggaagatggccttggtaaaaatgcacattccctaaaaaagggctgtgattgtttgggctttattaaatactttgatgcacactttacaaacttcactggaggtattgaaacaattgaaaattgtgtatgtttgcatgaagaggatcatggaattctatggaagcatcaggattggaggacaggtttagcagaagtgcgaaggtctaggcggctgacggatggaaaaatcgaagctgaagttaagcttacgggaatccttagcttaggagcattacaacctggggagactcgaaaatatggtactaccattgccccaggtctttatgcaccagttcatcagcacttttttgttgctcgtatggacatggctgttgattgcagaccaggtgaagctttcaatcaggttgtggaggtaaatgttgaagttgagaaacctggggagaaaaatgtccacaataatgcattttatgccaaagagacgctgctccgatcagaattggaagcaatgcgtgcttgcaatccacaaacagctcgccattggattgttagaaacactagaacagtaaacagaactggacaattaacaggctacaagctagtacctggttccaattgtttgccattggctggttcagaggctaagtttttgaggcgagctgcatttttaaatcacaatctttgggttacaccttatacacatggtgagatgtttcctggaggagagttccctaatcaaaatccacgtgttgatgaaggactggctacatgggttaagcagaatcgacctttagaagaaactgatatagttctttggtatgtgtttgggatcacacatgttcctcggttggaagattggccggtcatgccagtggagcgcttaggctttatgcttatgcctcatgggtttttcaactgctctcctgctgtggatgttcctcccagcacatgcgaattggatgccaaagacaatgatgttaaagacaatggtgtaacgaagccacttcaaaatggggtgctagccaagctctaagccagttacaaactactgtagtctccaccaatcatcaaaagcacagaacctctgaatttgatgtgtttcggggaaggaactgcatgcagcaagtgctaaccaacatgctagatcaaagttattgtttcttgtacatcataaacatctggattgggctcttgtgctttgatttgacattttgttgatcgttgatgtgttgtggatttgaatgcttgattagtctatcgatgtataaaaaaaaccttgttttttgttttcgctagtagcagttgtttctctgtaaccattactagtgttgatactacggcaagttgtgttgaaaatca

SEQ ID NO: 5504 - DNA, 2317 bp, Chrysanthemum coronarium
cacacactaaaaacacacacttactgtgtgtgtaacaaactaactaacaatggctgacaaatcaaccgtcgtcctccgacgcgaagtgacgtcatcttccgccgctgctgacgtcgtcacgcaacaaccgtctgtacctgttactgcttctactaaaggaactgggcccacgaatatggttaaggcacagactcgccatccgatggatcctcttgctgctgctgaaatctccatagccgtggcaacagttagggctgctggagcgactccagaggtaagggatagcatgcgatttatagaggtagtccttgtggaaccagacaaaaatgtagttgccttagcagatgcatatttttttccaccttttcaaccgtcactgttgccaaggaccaagggaggacccataatcccgacaaaacttccacctcgacaagctaggcttattgtttacaacaagaaatcaaatgaaacgagtatatggatcgtcgagttatcagaagttcatgctctaactcgaggtggccatcatagaggcaaagttatttcatctaaagtagtgcctgatgtgcaacctcctatggatgctgtggagtatgctgaatgtgaagccattgtaaaggaataccctccattccgagaggccatgaagaggaggggtattgatgatttggatctcgttatggtagatccatggtgtgttggttaccatagtgaggctgatgctcctaatcggagactggctaaaccgctcatattctgtcgcacagaaagtgactgtccaatggagaatgggtatgctcgtccggtagaaggaattgatgtgttagttgacatgcaaaatatggtggttatcgagttcaaagaccgcaaactagttcctctaccaccagcagacccattgagaaattatacagctggtgaaacaaggggaggcgttgatcgaagtgatgtgaaaccactaaatattgttcaacctgatggtcctagttttcgtgttaatggtcattttgttcagtggcagaagtggaatttccgtattggcttcacacctagggagggtctggtcatatattctgttgcatatgttgatggaaacagaggtcggaggcccgtagcccacagattaagcttcgtagaaatggtggttccttatggtgaccccaatgaccctcattacaggaagaacgcatttgatgcaggggaagatggacttggtaaaaatgctcattcactaaaaaaaggctgtgactgcttgggttacatcaaatattttgacgcacacttaaccaattttaccgggggtgttgaaacaattgaagactgtatttgcttgcatgaagaggatcatggaattttgtggaagcatcaggactggagaactggtttagctgaagttcgacggtccagaaggctagtggtgtcttttatctgtactgtggctaattatgagtatgggttttactggtatttttatcaggatggaaaaatagaagctgaggtgaagttaactggaatattaagcttaggagctcttcaacctggcgaagttagaaaatacgggactatgattgctcctggactctatgctcctgtccatcaacacttctttgttgctcgtatggatatgtctgttgactgtaagcctggtgaatcccacaatcaggtagttgagttggatgttaaagttgaagaacctggagatgcaaatgtgcacaacaacgccttttatgctgaagagacactgttaaaatcggaacttgaagcaattcgtgattgtaattctgcttgtgcccgacactggattatcaggaatactagaactgtaaaccgaactggccagttgacaggctacaaactagtacctggatcaaattgtttaccgttaggtggggcagaggccaagtttttgagaagagctgcttttttgatgcacaatctgtgggtcacggcgtatgatcctgaagaaatgtttcctggtggagagttccctaatcagaatccacgtgttggagagggtttagctacttgggttaagaagaatcgctctctagaagaaactgaccttgttctctggtatgtctttggagtgacacacgttcctcgactagaagattggcctgttatgccagtagaacacattggattccgcctcatgccacatggattctttaactcctcaccagcggtggatgtccccccaagctcaatgaccgattcggaattgaaagaaaatggtttggtagataagtcttgccatactggtctcgttgcttaaatgtagaaggtatttattaccacgtagtgtactccactagaa

SEQ ID NO: 5505 - DNA, 2411 bp, Chrysanthemum coronarium
taaaaacacacacttactgtgtgtgtaacaaactaactaacaatggctgacaaatcaaccgtcgttctccgccgcgaagtgacgtcatcttcagccgcagctgacgtcgtcacgcaaccgtctgtacctgttactgcttctactaaaggaactgggcccacgaatatggttaaggcacagactcgccatccgatggatcctcttgctgctgctgaaatctccatagccgtggcaacagttagagctgctggagcgactccagaggtaagagatagcatgcgatttatagaggtagtccttgtggaaccagacaaaaatgtagttgccttagcagatgcatatttttttccaccttttcaaccgtcactgttgccaaggaccaagggaggacccataatcccgacaaaacttccacctcgacaagctaggcttattgtttacaacaagaaatcaaatgaaacgagtatatggatcgtcgagttatcagaagttcatgctctaactcgaggtggccatcatagaggcaaagttatttcatctaaagtagtgcctgatgtgcaacctcctatggatgctgtggagtatgctgaatgtgaagccattgtaaaggaataccctccattccgagaggccatgaagaggaggggtattgatgatttggatctcgttatggtagatccatggtgtgttggttaccatagtgaggctgatgctcctaatcggagactggctaaaccgctcatattctgtcgcacagaaagtgactgtccaatggagaatgggtatgctcgtccggtagaaggaattgatgtgttagttgacatgcaaaatatggtggttatcgagttcaaagaccgcaaacttgttcctctaccaccagcggacccattgagaaattatactgctggtgaaacaaggggaggtgttgatcgaagcgatgtgaaaccgctaaacatcgttcaacctgatggtcctagttttcgcgtcaatggtcattttgttcagtggcagaagtggaatttccgtattggcttcactcctagggagggtttggtcatatattctgttgcatatgttgatggaaaccgaggtcggaggcctgtagcccacagattaagcttcgtagaaatggtggttccttatggtgaccccaatgaccctcattacaggaagaatgcgtttgatgcaggggaagatggacttggtaaaaatgctcattctcttaaaaagggatgcgattgtttgggttatatcaagtattttgacgcacacttaaccaatttcaccgggggtgttgaaacaatcgaagattgtatttgcttgcatgaagaggatcatggaattttgtggaagcaccaggactggagaactggtttagctgaagttcgacggtcaagaaggctagtagtgtcgtttatatgtactgtggccaattatgaatatgggttttactggtatttttatcaggatggaaaaatagaagctgaggtgaagttaactggaatattaagcttaggagctcttcaacctggtgaagttagaaaatatgggactatgattgctcctggactctatgctcctgttcatcaacatttttttgttgctcgtatggatatgtctgttgactgcaagcctggtgaatcccacaatcaggtagttgagttggatgttaaagttgaagaaccgggagatgaaaatgtgcacaacaacgccttttatgcagaagagacactattaaaatcggaacttgaagcaattcgtgattgtaattctgcttgtgcccgacattggattatcaggaatacaagaactgtaaaccgaactggccagttgacaggctacaaactagtacctggatcaaattgtttaccattaggtggggcagaggccaagtttttgagaagagctgcttttttgatgcacaacctttgggtcacacaatatgaccccgaagaaatgtttcctggtggagagttccctaatcagaatccacgtgttggagagggtttagctacttgggttaagaaggatcgctctctagaagaaactgaccttgttctctggtatgtatttggagtgacacatgttccccgactagaagattggcctgttatgccagtagaacacattggattccgcctcatgccacatggattcttcaactcctcgccagctgtggatgttcccccaagctcaatgaccgattcggaattgaaagaaaatggtttggtagataagtcttgccatactggtctcgttgcaaaaatgtgaaaggaagtttattaccacgtaagtgtactccacgagaaagccattttatctgtgttttcgagatgttatactctattgggtccgttttcaccctatccgattagtttcatatgagagccgtgatggttatgatgtttgta

SEQ ID NO: 5506 - DNA, 2359 bp, Petroselinum crispum
gacaattaagacaacaagtaaaccgaccagtgtcccgtgcagtgcttgttagaagtgaagttgaagtgatggcatcatcggcaactacacaaaaggcaaagccactcgtcgccggcgctgatgccatcgccggtgatcagatccagctgagcaccagaacttcattggcttctgctttgattcgtcctgttgattccatctctcaaccttcttctgcttctacttccactaaaggaattgcaagcttgttcagggctcaaacacgtcacccgttggagcctttagcagctgctgaaatatcagtggctgttgcaactgtcagggctgctggagcaaccccagaggtgagagatagtatgcgatttgttgaggtggcccttgttgagccagataagcatgtggttgcattagcagatgcttatttctttcctcctttccaaccatcattgttgcccaggacgaaaggtggacctgtacttcccactaaactccctccaaggcaagctaggcttgttgtttacaataaaaaatcgaatgagacaagcatatggattgttgaattattggaagttcatgctgtgactagaggtggccatcacagaggcaaagtaatttcttccaaagttgtgcctgatgtacagcctcctatggatgctatggaatatgctgaatgtgaagccattgtaaaggaatttcctccatttcaagaggcaatgaagagaaggggtattgaggacatggatcttgtcatggtagacccgtggtgtgttggttaccacagtgaatctgatgcgccaaatcgcagacttgctaaaccacttatcttttgtagaacagagagtgactgcacattggaaaatggttatgcacgcccagttgaaggaattcatgtgttagttgatatgcagaacatgattgtggtagagtttgttgaccgcaaacttattccacttccaccagctgatccattgagaaattatgctgctgctgaatcaagaggaggtgttgatcgaagcgacgtgaaacctctgaatatcatccagccggaaggtccaagcttccgtgtcaatggtcactttgttgagtggcagaagtggaattttcgtatcggatttacacctagagagggtttagtgatttactctgttgcttatgttgatggtagccgaggccggagaccagttgctcatagattaagctttgttgagatggtggttccatatggagaccctaatgatccacattataggaaaaatgcgtttgatgcgggagaggatggtcttggcaaaaatgcccattctcttaagaagggttgcgattgtgtaggctttatcaaatactttgatgcacacttcacaaatttcactggcggtattgaaactatagaaaattgtgtttgcttgcatgaagaggatcatgggatcttatggaaacaccaagattggagaacgggtttagctgaagtccgtcggtcaagacgtttaactgtgtcttttatttgtactgtggcgaattatgagtatggcttcttttggcatttttaccaggatggaaagattgaagccgaggtaaagctcactggaattctcagcttaggcgctctgcaaccaggagaagtacgtaaatacgggacaacaatagcacctggattatatgcaccagttcatcaacacttttttgttgctcgtatggatatggctgtagattgcaagcctggtgaagcacataatcaggttgttgaggtgaatgtgattgttgaagaaccaggtgaaaacaatgttcacaataatgcattttacgctgaggagaaacttctgaaatctgaagaagaagcaatgcgtgactgtaattctttatctgcccgacattgggttatcaggaatacaagaactgtcaatcggactgggcagctaactggttacaagttgctaccaggatccaattgtttgccattagctggtgcggaggcaaaattcttgagaagagctgcttttctgaagcataacctctgggtcacaccttattcgcgtgatgagatgtttcctggtggagaatttccaaatcagaatccacgtgttggtgagggattggctacttgggttaagcagaaccggtccctggaagaaactgatgtggttctttggtatgtatttggagtgacacacgtgcctcgtttggaagactggcctgtgatgcctgtggatcgcattggttttatgctcttgccgcatggattcttcaatcgctcaccagcagttgatgtccctccagcaagctcaagtgactcggatctaaaggacgatgtgctagtagcaaaggtatgccatgatggcttgattgcaaagttgtaaaaagaaaa

SEQ ID NO: 5507 - DNA, 2320 bp, Musa acuminata
tgatgtttaatttaaggcatccccatgatgatgagggctcagacaaggcaccccctggatccattgtctgctgctgaaatctctgttgcagtagcaactgttaggtctgctggtgcaactccggaggtcagagatagtatgcggtttgttgaagtagttcttttggagccagagaaaaatattgtggcattagctgatgcctactttttcccccctttccaaccatcactacttcccagaacaaagggtggtcctgtcatcctgagtaagcttccacccaggagggcaaggcttgttgtctataacaaaaagtcaaatgagacaagcatctggatagttgagctgtctgaagtacatgcagcaactcgtggtggtcatcacaggggaaaagtgatctcctctgaagttgttcctgatgtacagcctcctatggatgctatagaatatgcggagtgtgaagctgctgttaaaaactatcctccattcatagaggcaatgagaaagagaggagtagatgatatggatcttgtaatggtagatgcttggtgtgctggttaccacagtgatgctgatgctcctagccgcaggcttgcaaaaccactcattttttgtcggacagagagtgactgccctgtggagaatggttatgcacgtcctgttgaaggcatctatattcttgttgacatgcaaaacaatctgataattgagttcgaagatagaaaattggtccctctgcctccagctgatccattgagaaactatacacctggagaaactcgtggaggtgttgacagaagtgatataaagcctctgcatattcttcagcctgaaggtccaagttttcgtataaatggttattttgtggagtggcaaaagtggagcttccgtattggtttcaccccaagggagggcttagtaatacactctgtggcatacattgatggcagtcggggacggagacctgtggcacataggttgagttttgttgagatggtagttccctatggagatccaaatgaaccacattatcgtaagaatgcatttgatgctggtgaagatggcctcgggaaaaatgctcactctcttaaaaggggttgtgactgcctgggctacatcaaatacttcgatgctcattttacaaattatactggtggtatagagactattgaaaattgtgtttgtttgcatgaggaggatcatggaatcttatggaagcatcaagattggcgaacgggcttagcagaagttaggagatcaagaaggctaaccgtgtccttcatatgcacagttgctaactacgaatatgggtttttctggcacttctatcaggatggtaagattgaagcagaagtaaaattgactggaattctcagcttaggagcattgcaacctggtgaatcaagaaaatatggtacaaccatcgctccaggcttatatgcgccagttcatcaacatttctttgttgctcgcatggacatggctgttgattgtaaacctaccgaagccttcaatcaggtgattgaggtaaatgccaaagtagaagatccaggtcaaaataatgttcataacaatgctttttatgctgaagaaaagcttctcaagtcagagctggaagctatgcgtgattgtgatcctttctctgcacgtcactggattgtaaggaacacaaggactgtaaatcggacaggtcaacccacaggttataagctcatgcctggtctgaattgcctcccattagctggtccagaagcaaaattcttgagaagagctgcatttttaaagcataatctatgggttacaccttacagtcgtgatgagatgtaccctggaggagagtttcccaatcagaatccccgcataaatgagggattagtgacatgggttaagaagaacaggtcccttgaggaagctgacattgttctatggtacgtatttggaatcacacacatacccaggttggaagattggcctgtcatgcctgtggatcggattggctttatgctcatgccgcatggcttctttaactgctccccagcagtggacgtgccaccgagtgctaatgaaatagacaaggatggtggatcgcccaagttgatccagaacggactgctcgctaagctttgagagggagggatgtaaaagctgaacatctaatatatcaatatgttaaataaagcatcaccggtgagaccttgttgctagtgattctatgtttgcagtgtgctagattgtgacttggattaagtttgatcgtcgtgtgagaccctttccccttgtttggaaattgcttctcttaatcttctttgtcttgaagtcatat

SEQ ID NO: 5508 - DNA, 2412 bp, Chrysanthemum coronarium
ccgttttctgttagtgtgtgtaacaaactaaccaacacacacacagtcactcacaatggctgacaaattatcatcatcaaccgtcgttctccgccgcgaagtgacgtcatcttccgccgctgatgacgtcgttgtcaaaccttccgtagccgttactgctcctactaaaggtgggcccacgaatatggttaaggcacagactcgccacccgatggatcctcttgctgctgctgaaatttccatagctgtggcaactgttagggctgcgggagcgactcctgaggtaagagacagtatgcggtttatagaggtagtccttgtggaaccagacaaaaatgtggttgcattggcagatgcatattttttcccaccttttcaaccgtcactgttgccaaggaccaagggaggacccataatcccgacaaaacttccacctcgacaagctagacttattgtttacaacaaaaaatcaaatgaaacgagtatatggatcgttgagttatcagaagttcatgctctaactcgaggtggccatcatagaggcaaagttatttcatctaaagtagtgcctgatgtgcaacctcctatggatgctgtggagtatgctgaatgtgaagccattgtaaaggagtaccctcctttccgagaggctatgaagaggaggggtattgatgatttggatctcgtaatggtagatccatggtgtgttggttaccatagtgaggctgatgctcctaatcggagacttgctaaaccgctcatattctgtcgaacagaaagtgactgtcccatggagaatggttatgctcgtccggttgaaggaattgatgtgttagttgacatgcaaaatatggtggttatcgagttcaaagaccgcaaacttgttcctctaccaccagcagacccattgagaaattatacagctggtgaaacaaggggaggcgttgatcgaagtgatgtcaaaccactaaatattgttcaacctgatggtcctagttttcgtgttaatggtcattttgttcagtggcagaagtggaatttccgtattggcttcactcctagggagggtttggtcatatattctgttgcatatgttgatggaaaccgaggtcggaggcctgtagcccacagattaagcttcgtagaaatggtggttccttatggtgaccccaatgaccctcattacaggaagaatgcatttgatgcaggggaagatggacttggtaaaaatgctcattctcttaaaaagggatgcgattgtttgggttatatcaagtattttgacgcacacttaaccaatttcaccgggggtgttgaaacaatcgaagattgtatttgcttgcatgaagaggatcatggaattttgtggaagcaccaggactggagaactggtttagctgaagttcgacggtcaagaaggctagtagtgtcgtttatatgtactgtggccaattatgaatatgggttttactggtatttttatcaggatggaaaaatagaagctgaggtgaagctaactgggatattaagcttaggagctcttcaacctggtgaagttagaaaatatgggactatgattgctcctggactctatgctcctgttcatcaacatttttttgttgctcgtatggatatgtctgttgactgcaagcctggtgaatcccacaatcaggtagttgagttggatgttaaagttgaagaaccgggagatgaaaatgtgcacaacaacgccttttatgcagaagagacactattaaaatcggaacttgaagcaattcgtgattgtaattctgcttgtgcccgacattggattatcaggaatacaagaactgtaaaccgaactggccagttgacaggctacaaactagtacctggatcaaattgtttaccattaggtggggcagaggccaagtttttgagaagagctgcttttttgatgcacaacctttgggtcacacaatatgaccccgaagaaatgtttcctggtggagagttccctaatcagaatccacgtgttggagagggtttagctacttgggttaagaaggatcgctctctagaagaaactgaccttgttctctggtatgtatttggagtgacacatgttcctcgactagaagattggcctgttatgccagtagaacacattggattccgcctcatgccacatggattcttcaactcctcaccagcagtggatgttcccccaagctcaatgactgattcggaattgaaagaaaatggtttggtagataagtcttgccatactggtctcgtttcaaaaatgtgaaaggaagtttattaccacgtaagtgtactccacgagaaagccattttatctgtgttttcgagatgttatactctattgggtccgttttcaccctatccgattagtttcatatgagagccgtg

SEQ ID NO: 5509 - DNA, 2691 bp, Abies balsamea
gagccgagtaagatcgaagaatagtcgctgttcttgaaattggagtttcaaaataagataaatacaaggcggatattgccagcgcaggaggcagggagatcagagccttgcgtatgtcagattgtaaaaccagcgggagcacaagagagagggacggcttcggtgtatttgcaaatccattgcaatggcctcagcttcgaaagaaacgacgatatgctgccagtcaggcgcatcctccccggatttggcgggtaatgtttcctcgtcctcctcgccctctttgcggcgcgaggcagcctcggccgaggttcccctcgccgcagagtgggacgttaataaagatctcgctgaagagaagcggaagagaagcactgaagcgagaattcctgctgcggttttgagttccatggatgcaatagccgaagcgtccaaggctgcagccaaaggtacagggatgcaaatgttgcgagctcatccaaggcatcctttagaaccattatctgcagctgaaattgctgttgcagtgtcaacagtcagagcagcaggagctactccagaggtgcgtgatggtatgcgattcattgaagtggttcttaaagagccagacaagcacattgttgcattagcagatgcatactttttccctcctttccagccttcattgcttccaaaaaccaaaggtggcccggtgattcctcgccaacttcctcctaggcaagctaggattattgtttacaataaacgttcaaatgaaactagtatctggcttgtggaactacttgaggtacatgccgcagcgcgtggtggccttcatagaggcaaagttatttcatcaaaagttattgaagatgttcagccaccaatggatgcaatggagtatgctgattgtgaatctgttgtcaaagattacccccctttcagggaggcaatgaaaaagaggggaattgatgatatggatctagtgatggttgacccatggtgtgttggatattatctggaagaggatgctccgagtcgaagactagctagaccacttatattctgcagaactgaaagtgactgtccattggaaaatggatatgctcgaccagttgaaggcatacatgttcttgtcgatatgcaaaaaatggaagtagtggaatttgaagatcaaaagctaattcccttgccacctccagatcccctcagaaactatactgcaggagaaacacgtggcggagtggatcggagtgatgtcaagccactgcaaataattcaaccagaaggacctagttttcgtgttaatggctaccatgtagagtggcaaaagtggaattttcggatcggttttactccaagggagggacttgtgatctattcaattgcatatgatgacggcagccgaggtcggagatctgtggcccaccgtctaagttttgtggagatggttgtaccttatggggatccaaacggtccacattataggaaaaatgcattcgatgctggggaggatggtctgggcaagaatgctcattcgttaaagaaggggtgcgactgtttaggctatatcaaatactttgacgcgcatttcacaaattttactggaggggttgatactattgagaactgtgtctgcttgcacgaggaagatcatggaattctgtggaagcatcaagattggaggacaggcttagcagaagttagaagatctaggcgtttaacagtgtcattcatatgcactgtagcaaattacgagtatggtttcttttggcatttttatcaggatggtaaaattgaagctgaagtcaagcttacagggattctcagtttaggggccctacaacatggagaatcaaggaagtacggtacaatgattgctcctgggctatatgcacctgtgcaccaacacttctttgttgctcgaatggatatggctgtggattgcaagcccggtgaaccagtgaaccaggttgtggaggtaaatgtgaaagttgaagaacctggatccgataatatccataataatgcattttatgctgaggaagaattgctacgaactgaatcgcaagctcagcgtgactgtaattcattgtctgctcgtcactggattgttcggaacacaaggaccgtaaacagaacagggcagttaacaggatacaagctagtgccaggctcaaattgcttaccattggcagggtctgaagctaagtttcttaggcgagctgcctttttacagcataacctttgggtaactcaatataataaagatgaacaatatccaggaggtgaatttcctaatcaaaatcctcgtgtcggggaaggattgcatacatgggtgaagcaaaatcgaaaccttgaagaggctgatgttgttctatggtatgtttttggtattactcatgttcctcgtttggaggattggccagttatgcctgtggaaagaattggattcatgctttcgcctcatggtttcttcaattgctccccagcagtggatgtgcctcctagtattggtgaatgtgagaaagaaagcgtagggccaaagattaatcaaactggaattatatccaagctatgaacatttactagtgatgttgtctctgaccaagagtattttgcgagaaatgcatttatcctcattaatattgtagttttcagattattagtcaaaagctggacaattagtattcagtgcttattattagattacta

SEQ ID NO: 5510 - DNA, 2756 bp, Manihot esculenta
cttgcaaaccccctacaatggcctcaactacgaaaaagacgacgcctccttcttcgtgttgtgcctctccaagtgactctgctcccattcgccgcggggctgctcctgcgccgtcttccgtggtgccgaatgcggtgctagattggagcgatcgccgactcgaggatcagcttggtgagaagactgccatcgcgtccttgattcgccctgtcgattcacttcccgaaccttccacaaaccccgctaccaaagctggcatgccagtcatgttgagggcccaaaccagccaccctttggatcctctatctgctgctgaaatctctgtggcagtggcaactgtccgggctgctggagccactcccgaggtcagagatagcatgagattcattgacgtggttcttttggaaccagataaacatgttgttgcattggcagacgcatatttcttcccccccttccaaccatcattgcttcccagaacaaaaggtggtcctgtaattcctacaaagttgcctccaaggcgagctagacttgttgtttacaacaaaaggtcaaatgagacaagtatatggattgtggagctatcagaagtacatgcggtgactcgtggtggacatcataggggaaaagtaattttgtcacaagtggttccagatgttcagcctccaatggatgctgttgaatacgctgaatgtgaagctgttgtaaaggatttccctccatttagagaggcaatgaagaaaagaggtattgaagacatggaacttgtaatggttgatgcctggtgtgttggctatcacagtgaagctgatgctccaagcaagagacttgctaaacctcttatattttgtagaactgagagtgactgcccaatggaaaatggttatgcacgcccagttgagggcatctatgtgcttgttgacatgcagaacatgaaggtgattgagttcgaagatcgtaaacttgttcccttacctccagctgatccattaaggaattatactcccggtgaaacaaggggtggtgttgatcgaagtgatgttaaacctctacaaattgttcagcctgaaggtccaagctttcgtgtcaatgggtactttgttgagtggcaaaagtggaattttcgtattggattcactcccagagagggtttggttatacattctgttgcatacattgatggcagcagggggcggaggcctgttgcccacaggttaagctttgtagagatggttgtgccttatggagatccaaatgatcctcattatcgaaaaaatgcttttgatgctggggaagatggcctcggtaaaaatgcacattctcttaaaaaggggtgtgactgtctgggctatatcaaatactttgatgctcactttacaaacttcactggaggtgttgaaacaattgaaaattgtgtatgcttgcatgaagaggatcatggaattttatggaagcatcaagactggagaactggcttagcagaagtacgaaggtctagacggctcacagtttcttttatatgtacagttgctaattatgagtatggattcttctggcacttctatcaggcaagtaggaaattacactatttctattccgatggaaaaattgaagcagaagttaaacttactggaatcctcagcttaggagcattgcaaccgggagaaactcgaaaatatggcacaactatagccccaggcctatatgcaccagttcatcaacatttctttgttgctcgtatgaacatggctgtagattgtaaacctggtgaagcgttcaatcaggttgttgaggtggatgttaaagttgagaaacctggggaaaacaatgtccataataatgcattttatgctgaagagacactgctcagatcagaattgcaagcaatgcgggaatgtaatcctctaacagctcgccattggattgtgagaaatactagaactgtcaataggatgggacaattagcagggtacaagctggtacctggttcaaactgtttgccattagctggtcctgaggccaaggttttgagaagagctgcatttttgaagcataatctttgggttacaccttatgcatatgatgagatgtttcctggaggggagttccctaaccaaaatccacgtgttggagaaggacttgctacatggttatttattattattaatactattattcagattgtctccttttttgctttttttggttgttcctactcaaatgttatgatgcttaatcttctaccttgctggtatgtatttgggatcacgcatgttcctcggttggaagactggccagtaatgcctgtagagcgcattggtttcatgcttatgccgcatgggttcttcaactgctctcctgctgtggatgttccacctaatgcatgtgaattggataccaaagagactgatgtcaaagacagtggtgtagccaagcctcttcaaactgttatgctggcaaagctttgaatcgcttccaaattattagtgacagtccaagtgaaagaatctctggatttcattgtgttggaaaggaacttgagaaagtagaaagtttccgcgttcctccatcaagtctcagcattggcaactaatcagtgaggcaagaacaatgtcaatggattttgtaacataaggatttttcagtggattgaggttttacgtgatgttgttgatcacttgatctgactttttgttgaagatgtattgtggatttaagtcctgttttaattgatgaaaggaatgtttttctttgtc

SEQ ID NO: 5511 - DNA, 2418 bp, Chrysanthemum coronarium
cacacactaaaaacacacacttactgtgtgtgtaacaaactaactaacaatggctgacaaatcaaccgtcgttctccgccgcgaagtgacgtcatcttccgccgcagctgacgtcgtcacgcaaccgtctgtacctgttactgcttctactaaaggaactgggcccacgaatatggttaaggcacagactcgccatccgatggatcctcttgctgctgctgaaatctccatagccgtggcaacagttagggctgctggagcgactccagaggtaagggatagcatgcgatttatagaggtagtccttgtggaaccatgcaagaatgtagttgcgttagcagatgcatatttttttccaccttttcaaccgtcactgttgccaaggaccaagggaggacccataatcccgacaaaacttccacctcgacaagctaggcttattgtttacaacaagaaatcaaatgaaacgagtatatggatcgttgagttatcggaagttcatgctctgactcgaggtggccatcatagaggcaaagttatttcatctaaagtagtgcctgatgtgcaacctcctatggatgctgtggagtatgctgaatgtgaagccattgtaaaggaataccctccattccgagaggccatgaagaggaggggtattgatgatttggatctcgttatggtagatccatggtgtgttggttaccatagtgaggctgatgctcctaatcggagactggctaaaccgctcatattctgtcgcacagaaagtgactgtccaatggagaatggttatgctcgtccggtggaaggaattgatgtgttagttgacatgcaaaatatggtggttatcgagttcaaagaccgcaaacttgttcctctaccaccagcggacccattgagaaattatactgctggtgaaacaaggggaggtgttgatcgaagcgatgtgaaaccgctaaacatcgttcaacctgatggtcctagttttcgcgtcaatggtcattttgttcagtggcagaagtggaatttccgtattggcttcactcctagggagggtttggtcatatattctgttgcatatgttgatggaaaccgaggtcggaggcctgtagcccacagattaagcttcgtagaaatggtggttccttatggtgaccccaatgaccctcattacaggaagaatgcgtttgatgcaggggaagatggacttggtaaaaatgctcattctcttaaaaagggatgcgattgtttgggttatatcaagtattttgacgcacacttaaccaatttcaccgggggtgttgaaacaatcgaagattgtatttgcttgcatgaagaggatcatggaattttgtggaagcaccaggactggagaactggtttagctgaagttcgacggtcaagaaggctagtagtgtcgtttatatgtactgtggccaattatgaatatgggttttactggtatttttatcaggatggaaaaatagaagctgaggtgaagttaactggaatattaagcttaggagctcttcaacctggtgaagttagaaaatatgggactatgattgctcctggactctatgctcctgttcatcaacatttttttgttgctcgtatggatatgtctgttgactgcaagcctggtgaatcccacaatcaggtagttgagttggatgttaaagttgaagaaccgggagatgaaaatgtgcacaacaacgccttttatgcagaagagacactattaaaatcggaacttgaagcaattcgtgattgtaattctgcttgtgcccgacattggattatcaggaatacaagaactgtaaaccgaactggccagttgacaggctacaaactagtacctggatcaaattgtttaccattaggtggggcagaggccaagtttttgagaagagctgcttttttgatgcacaacctgtgggtcacacaatatgatcccgaagaaatgtttcctggtggagagttccctaatcagaatccacgtgttggagagggtttagctacttgggttaagaaggatcgctctctagaagaaactgaccttgttctctggtatgtatttggagtgacacatgttccccgactagaagattggcctgttatgccagtagaacacattggattccgcctcatgccacatggattcttcaactcctcgccagctgtggatgttcccccaagctcaatgaccgattcggaattgaaagaaaatggtttggtagataagtcttgccatactggtctcgtttcaaaaatgtgaaaggaagtttattaccacgtaagtgtactccacgagaaagccattttatctgtgttttcgagatgttatactctattgggtccgttttcaccctatccgattagtttcatatgagagccgtgatggttatgatgtttgta

SEQ ID NO: 5512 - DNA, 2440 bp, Cucumis sativus
gtgttgttcctccaatgttgagggcacaatcaagacatcctctggaccccctatcagctgctgaaatctctgttgcagtggctaccgtcagggcagctggagccacgccagaggtcagagatagcatgcgtttcattgaagtggtgctactggaaccagaaaaacatgttgttgcactggcagatgcatattttttccctccattccaaccatctctgcttcctaaaactaaggggggaccggttattcccacaaagcttcctccaagaagggcaaggattgttgtttacaataagaaatcgaatgagacaagcatatgggtagttgagctgtcagaggttcatgcagtaacccgaggtggacatcacaggggaaaagttatatcttcttctgttgttcctgaggttcagcctcccatggatgctgctgagtatgcggaatgtgaggctattgtcaaagaatatcctccattcatcgaggctatgaagaagagaggtattgaagatatggatttggttatggttgatccttggtgtgttggttatcatagtgaagtagatgctcctggccgaagactagctaagcctcttatattttgtagaactgaaagtgactgcccaatggaaaatggatatgctcgcccagttgagggcatacatgttcttgttgatatgcaaaatatggtgattatagaatttgaagaccgaaaacttgttccactacctcctgctgatccattgaggaattacacttctggtgaaacaagaggtggggttgatcgtagtgatgtgaagcccttacaaatagttcagcctgaaggtccaagctttcgtgtcaatggctactatgtagaatggcaaaagtggaattttcgaattggtttcactcccagagagggtttggttatatattctatagcttatgttgatggaagcagagggcgaaggcctgtagcacatcgtttgagttttgtggaaatggttgtcccctatggagatccaaatgatccacattacaggaagaatgcttttgatgcaggagaggatggactgggcaaaaatgcgcattctctgaagaagggatgtgattgtctgggttacatcaaatattttgatgcccatttcacaaatttcactggtggtgttgaaacaattgaaaactgtgtgtgcatgcatgaagaggaccatggaattttgtggaagcatcaagactggaggacaggattggcagaagttagaagatcgaggcggctgacagtgtcctttatttgtactgtggctaattatgagtatggattcttttggcacttctttcaggcaagtcaaatcattcctctcttttggattggtgctgatcaagatggaaaaattgaagctgaagtcaaattaactggcattctcagcctaggagctttgcaacctggtgaatatcgaaaatatggcacaatgattgcaccaggtttatatgcaccagtgcatcaacatttctttgttgctcgaatggacatggccgttgattgcaagcctggtgaagctttcaatcaggtagttgaggtggatttgaaagttgaaggacctggggagaacaatgtccacaacaatgctttttacgctgaagagacattgctgaaatcagaaatgcaagctatgcgtgattgtagtcctttatctgctcgccactggatagtgcgaaatactagaactgtgaatcgaactgggcaattaacaggcttcaagcttttacctggctcaaattgtttgccattagctggttcagaggccaagtttcttagaagagcgtctttcttgaagcataatctttgggtgactcaatattctcgtgatgagatgtttcctggaggggagtttcccaatcagaatccacgcgtcggtgaagggttatcgacatgggttaaaaaggatcgacccttagaagaaactgatatagtcctttggtatgttttcgggatcacgcatgttcctcgattggaagactggcccgttatgcctgtggatcgcatcggttttacacttttgcctcacggtttcttcaactgctctcctgctgttgacgttcctcccagtacttgtgaattagattcaaaagattcaaaagatgcggaccctaaagaaaacgtggtgacaaaaccaattcaaactcccatcatcgctaagctctaaactctctcttcttcatcactgctcttttcattgctttaacaaactccaaatctctcttctacttactttgctttcagtcaatttgagttgctttctcttgttaatatcaaagaaccccaccacaaccttttcttcttcttcttctttcttttttggtcttttttagtagaacaactcgtaaaacgttatgaatgatgtgcatattattatatgatgaaaatcttcaaaataatcctaatctctacacagtttttgttggc

SEQ ID NO: 5513 - DNA, 3049 bp, Oryza sativa
agcccccgtctcctcctcctcctcctcctccaccgccaccaccaccattccaaactcgccaccggcttctctctctctctctctctctctctctcccccattcctcgtcggcttctctcgcggaggaggaggaaacgcacgaggccggcctggtccttccccttcgtcctagggttcgcggtagccctaagcccgtagaaaccccagaagccggaggaggaggaagcgggaggtggggggaggggaggggaggggaggacgaaggcgcgcgggagggcggaggcctgtgctgtatgtcagatcgtgtgagccggcgaggcggaggcggaggcggagaatacggacacggtcagctcgcgaatccgctccaatggccgcaactcaggaaaaggcgccggtcgtcgtctgctgcggcggtggcggcgctgcggctgctcggcgcgtcgacggcggccccgggtcgtcgtcacgcggggcgatcgtcgcggcgcccgcggctgctgctgctgctgggaaggtctccatggtctcgggcgatgatccccgcgtcgccgcggcggccgggggtggcggcggcgccgtgatggaggagatcgccgccgcggtccagcccaccaccgcgaaggtctcctcgaaagggatacctataatgaccagagcccagagaagccaccctttagatccattatctgctgctgaaattgcagtggctatagcaactgtaagagctgctggaaaatcgcctgaggaacgtgatggcatgcgttttgttgaagtggtgctattggagccagaaaagaatgtcgtggcattagctgatgcctactttttcccaccattccaaccatcactgcttcctagaaccaaaggctctgctgtcattccaagcaggttgccccctaggagggccaagctcacagtctacaatagacaatcaaatgagactagcatttggatagtagaactctctgaggtgcatgcggctactaggggtggacatcacagagggaaagtgatatcatctgaagttgttccagaagttcagcctgcaatggatgctatggagtatgctgaatgtgaagctactgtcaaaagctatcctccatttattgaagctatgaagagaagaggtgtagatgacatggaacttgtcatggtagatgcctggtgtgctggctactacagtgatgctgatgctcccagccgcagacttggcaagcctctaatcttttgcagaactgacagtgatagtcccatggagaatggttatgcacgtcctgtggaagggatccatgttattgttgatatgcagaataacgttgtcatagaatttgaagataggaagttggttcctctccccccaccagatcatctgagaaactacactcctggggaaacgagaggtggtgttgatcgaagtgatttgaaacctcttattatcaatcaacctgagggcccgagcttccgcattaacggatattttgtggaatggcagaagtggaacttccgtattggcttcacccctaaagagggtttggtcatctattctgttgcatatgttgatggcagccgtggacgtcggccgatagctcataggctcagctttgttgagatggttgttccttatggagatcccaatgaaccacattatcgcaagaatgcttttgatgctggagaagatggacttgggaagaatgctcattctcttaagaggggatgtgactgtttaggtttcataaagtattttgatgcacacttcacgaattttacgggtggtgtggaaacaattgagaattgtgtatgtttgcatgaggaagaccacggaatcctttggaaacaccaggattggagaactggtttagcagaagttaggaggtcaaggaggcttactgtttcatttatctgcacagttgccaactatgaatatggtttttactggcacttttatcaggatggcaagatagaagcagaagtaaaacttactggaattcttagtttgggagctctgatgcctggggaatcaagaaaatatggtacaaccattgctcctggtctgtatgcacctgttcaccaacacttttttgttgcccgtatggacatggctgttgattgtaaacctaacgaggctcataatcaggtggttgaggtaaatgtgaaagttgaaaatgcaggcacacataatgtgcacaacaacgctttctatgccgaggaaaaactactgaaatctgagctgcaagcaatgcgagattgtgacccttcatctgcacggcattggatcgtaaggaacacaagggctgttaatcgtactgggcagccaaccggctacaggctcgtgcctggttcaaactgtttgccgctggctctacccgaggcaaagtttctgaggagagcgggtttcctgaagcacaatctctgggtcacgcagtacaagagcgacgaggtgttccctggaggggagttccccaatcagaatccacgtatccacgagggcttagctacctgggtcaagaaggataggcccctggaggaaactgacattgttctctggtatgtgtttgggctcacccatatcccaaggctggaggactggcctgtcatgccagtggaacgcatcggcttcatgctcatgccacatgggttcttcaactgctcgccggcggtcgacgtgcctcccggctcctccgacgctgacatcaaggaagccgagtcgcccaaagtcatccagaacggcctcatctcgaagctctgaagagctttccgctgctcttcgtttcgaagaaatgcaactgtggcatgtcactgctacgtatgcttctcgtcactatattgccccaaataaaagctactcccatggtgttattcctgtgttctgtactgttatgactttcctgctgcgctgtttgatttgtgaaatgtgtcctgttgcgccatttgatttgtgaacttgagccacgtctggtgaaatttgggatggctgacgttaatgcctgtattaataaaagcgcgtgttagacagccttgtcatgtgcttatcattttctctgtgaag

SEQ ID NO: 5514 - DNA, 3221 bp, Pinus taeda
actactataaatattaggcacccatacgctagttcttgtggaagatcggtcttcgcaggatatcgagaggagcaacaaaattctgctcgagtgagcagggacccctagtgacatccaaagcccgatctggaaaaaaaacagacgctgcccaaaacaaaagaggaacgaagaaaaacaaatttgttcttgctgtttatgaaaagaatacctcttgtggactcagatctggagcgggcccttcggtactgggctggagaaaacgagagctgagtaagatcaaagaatcgtaattgttcttgaaattggagcttcaaaataagataaatacaaggcggatattgcagcgcaggaggcagggagctcagaggcttgctgtatgtcagattgtaaaaccagcgggagcataagagagagggacggcttcggtgtatttgcaaatccattgcaatggcctcaacttcgaaagaaacgacgatatgctgccagtcaggcgcatcctccacggatttggtcgctaaggcctcatcctcctccaccccttctttgcgccgagaggcggcctccgccgaggttccccttgctgcagagtggaacgttaatcaagatctcggtgaagaaaagcggaagagaaacagtgaagcaagaattccttctgcagttttaagttccatggatgcaatagccgaagcgtccaaggctgcaggtccagtgatgcaaatgttgcgagctcatccaaggcatcctttagatccattatctgctgctgaaattgctgttgcagtggcaacagtcagagcagcagggactactcctgaggtgcgggatggtatgcgattcattgaagtggtccttaaagagccagacaagcatgttgttgcattagcagatgcatatttttttcctcctttccagccttcactacttccaaaaaccaaaggtggtccagtgattcctcgtcaacttcctccgaggcaagccaggattattgtttacaatatgcgttcaaatgaaactagtgtctggattgttgaactgcttgaggtgcatgccgcagctcgtggtggccatcatagaggcaaagttatttcgtcgaaagttattgaagatgttcagccacctatggatgcaatagagtatgccgattgtgaatctgttgtcaaagattatccgcctttcaaggaggcaatgaaaaagaggggaattgatgatatggatctggtgatggttgatccatggtgtgttggttattataaggaagaggatgctcctagtcgaagactagctagaccacttatattctgcagaacagaaagtgactgccctatggaaaatggatatgctcgaccagttgaaggcatacatgtacttgttgatatgcaaaaaatggaagtagtggagtttgaagatcaaaagctaattcccttgccacccccagatcccctcagaaactatactgcaggagaaacacgcggtggagtggatcggagtgatgtcaagccactgcaaataattcagccagaaggacctagttttcgtgttaatggctaccatgtagaatggcaaaagtggaattttcgggtaggttttactccgagggagggactggtgatctattctattgcatatgatgatggcagcagaggtcggagatctgtggctcaccgtttaagttttgtggagatggttgtaccttatggggatccaaatggtccacattataggaaaaatgcatttgatgctggggaggatggtctgggcaaaaacgctcattctttaaagaaggggtgcgactgtttaggctatatcaaatactttgatgcacatttcacaaatttcactggaggggtagacactattgagaactgtgtctgcttgcatgaggaagatcatggaattctgtggaagcatcaagattggaggacaggcttagcagaagtcagaagatccaggcgtttaacagtgtcattcatatgcactgtagcaaattatgagtatggtttcttttggcatttttatcaggatggtaaaattgaagctgaagtcaagcttacagggattctcagtttaggtgctctacaacatggagagtcaaggaagtatggtacaatgattgctcctggattatatgcacctgtgcaccaacacttttttgttgctcgaatggatatggctgtagattgcaagcctggtgaaccagtgaaccaggttgtggagttaaatgtgaaagttgaagaacctggacccaataatatccacagcaatgcattttatgccgaggaacaagtgctacgaactgaatcgcaggctcagcgtgactgtaatccactgtctgctcggcactggattgtccggaatacaaggactgtaaacagaacagggcagttaacaggctacaaactagtcccaggctcaaattgcttgccgttggcagggtctgaagctatgtttcttaggcgagctgccttcttacagcataacctttgggtaactcaatatcataaagatgaacaatatccaggaggtgaatttcctaatcaaaatcctcgtgttggagaaggattgcctacttgggtgaagcaaaatcgaaaccttgaggaggctgatatcgttctatggtatgtttttggccttactcatgttcctcgtttggaggactggccagttatgcctgtggaacgaattggattcatgcttatgcctcatggtttcttcaattgttccccagcagtggatgtgcctcctagtattggtgaatgtgagaaggaaagtgtagggccaaagattaatcaaactggaatcctttccaagctatgaacatttactattggtgttggctctgaccaagataatatttgcaaggaatgcatttatcttctttagcgttgtagttttcatattcttcttcaaaaccttgacaattagtactttgctcttattattatattaatattgtgtctattacagttttgtaaattctgagtttggttgcgtttgttactgaaaatcaagcaacaactttgttaatttgtattataatttattacaattctgtatataatatgctatgatttcatagtttctgagttgtcataactgtgtgactaaacttgtcaattcagtggaatttaaatgtaatctatggtttaagtcaagatccgggtatatctgtatagaccatttatgtgattttcgattgataacatgaatcatttgtctttctc

SEQ ID NO: 5515 - DNA, 2396 bp, Chrysanthemum coronarium
cactaaaaacacacacttactgtgtgtgtaacaaactaactaacaatggctgacaaatcaaccgtcgttctccgccgcgaagtgacgtcatcttccgccgcagctgacgtcgtcacgcaaccgtctgtacctgttactgcttctactaaaggaactgggcccacgaatatggttaaggcacagactcgccatccgatggatcctcttgctgctgctgaaatctccatagccgtggcaacagttagggctgctggagcgactccagaggtaagagatagcatgcgatttatagaggtagtccttgtggaaccatgcaagaatgtagttgcgttagcagatgcatatttttttccaccttttcaaccgtcactgttgccaaggaccaagggaggacccataatcccaacaaaacttccacctcgacaagctaggcttattgtttacaacaagaaatcaaatgaaacgagtatatggatcgttgagttatcggaagttcatgctctgactcgaggtggccatcatagaggcaaagttatttcatctaaagtagtgcctgatgtgcaacctcctatggatgctgtggagtatgctgaatgtgaagccattgtaaaggaataccctccattccgagaggccatgaagaggaggggtattgatgatttggatctcgtgatggtagatccatggtgtgttggttaccatagtgaggctgatgctcctaatcggagactggctaaaccgctcatattctgtcacacagaaagtgactgtcccatggagaatggttatgctcgtccggttgaaggaatcgacgtgttagttgacatgcaaaatatggtggttatcgagtttaaagaccgcaaacttgttcctctaccaccagcggacccattgagaaattatactgctggtgaaacaaggggaggtgttgatcgaagcgatgtgaaaccgctaaacatcgttcaacctgatggtcctagttttcgcgtcaatggtcattttgttcagtggcagaagtggaatttccgtattggcttcactcctagggagggtttggtcataaattttgttgcatatgttgatggcaaccgaggtcggaggcctgtagcccacagattaagcttcgtagaaatggtggttccttatggtgaccccaatgaccctcattacaggaagaatgcgtttgatgcaggggaagatggacttggtaaaaatgctcattctcttaaaaagggatgcgattgtttgggttatatcaagtattttgacgcacacttaaccaatttcaccgggggtgttgaaacaatcgaagattgtatttgcttgcatgaagaggatcatggaattttgtggaagcaccaggactggagaactggtttagctgaagttcgacggtcaagaaggctagtagtgtcgtttatatgtactgtggccaattatgaatatgggttttactggtatttttatcaggatggaaaaatagaagctgaggtgaagttaactggaatattaagcttaggagctcttcaacctggtgaagttagaaaatatgggactatgattgctcctggactctatgctcctgttcatcaacatttttttgttgctcgtatggatatgtctgttgactgcaagcctggtgaatcccacaatcaggtagttgagttggatgttaaagttgaagaaccgggagatgcaaatgtgcacaacaacgccttttatgccgaagagacactattaaaatcggaacttgaagcaattcgtgattgtaattctgcttgtgcccgacattggattatcaggaatacaagaactgtaaaccgaactggtcagttgacaggctacaaactagtacctggatcaaattgtttaccattaggtggggcagaggccaagtttttgagaagagctgcttttttgatgcacaacctttgggtcacacaatatgaccccgaagaaatgtttcctggtggagagttcccaaatcagaatccacgtgttggagagggtttagctacttgggttaagaaggatcgctctcttgaagaaactgaccttgttctctggtatgtatttggagtgacacatgttcctcgactagaagattggcctgttatgccagtagaacacattggattccgcctcatgccacatggattcttcaactcctcacctgcagtggatgttcccccaagctcaatgactgattcggaattgaaagaaaatggtttggtagataagtcttgccatactggtctcgttgcaaaaatgtgaaaggaagtttattaccacgtaagtgtactccacgagaaagccattttatctgtgttttcgagatgttatactctattgggtccgttttcaccctatccgattagtttcatatgagagccgtg

SEQ ID NO: 5516 - DNA, 3122 bp, Panicum virgatum
atgttttgctggaccaaaaatatgcagggataccaataatgacaagagcccagaggtgccaccctttagacccattatctgctgctgaaattgcagttgctgtagcaactgtaagagctgctggaagatctcctgaggaaagagatagcatgcgttttgttgaagttgtactgttggagccagaaaagaatgtggtggcattagctgatgcctacttcttcccacctttccaaccatcactgctcccgagaagcaaaggttctgctgttattccaagcaggttgcctcctaggagggccagacttgttgtctacaacaaacaatcaaatgagactagcatttggatagtagaactatctgaagtgcatgcagctactaggggtggacatcacagaggaaaggtgatatcatctggagttgttccagatgttcaacctgcaatggatgctatggagtatgctgaatgtgaggctactgtcaaaagttacccaccatttattgaagctatgaagagaagaggtgtggacgacatggatcttgttatggtagatgcctggtgtgccggctactacggtgaagctgatgctcccagtcgtagacttggcaagcctctaatattttgcaggactgagagtgatagccccatggaaaatggttatgctcgtcctgtggaaggaattcatgttgttgttgatatgcagaataatactgtgatagaatttgaagataggaagttggttcctctccccccaccagatcatttgaggaattatactcccggggaaacaagaggtggtgttgatcgaagtgatgtaaaaccacttattatcaatcagcccgagggtccaagtttccgtatcaatggctattttgtggaatggcagaagtggaacttccgtattggcttcacccccaaagagggtttggttatctattcggttgcatacgttgatggtagccgtggacgtcgacctatagctcataggctgagctttgttgagatggttgttccttatggagatccaaatgaaccgcattatcgcaagaatgcatttgatgctggagaagatggacttggcaaaaatgctcattctcttaagaagggatgtgattgcttgggatacataaaatattttgatgcacatttcacaaacttcactggtggtgttgagacaattgagaactgtgtttgtttgcatgaggaggaccatggaatcctctggaaacaccaagactggagaactggtttagcagaagtaaggcgatcaaggaggctcactgtctcatttatctgtaccgttgcaaactacgaatatgggttttactggcacttctatcaggatggcaaaatagaagcagaagtaaagcttactgggattctcagcttaggagccctgatgcccggggaatcaaggaaatatggcacaactatcgcccctggtctgtatgcaccagttcatcagcatttctttgttgcccgtatggacatggctatcgattgcaaacctaatgaggcttataatcaggtggtcgaggttaatgttaaagtggaaagtgcaggcacgcataatgtgcataacaatgctttctatgctgaagagaagttgctgaagtctgagctgcaagcaatgcgggattgtgacccttcatctgcacgccattggattgtaaggaacacgcgaactgtaaaccgcactgggcagccaactggttacaggctggtgcctggttcaaactgcctgccattggctctgcccgaggcgaaatttctgaggagagctgggttcttgaagcacaatctctgggtcacccaatacaagagcgacgagatattccctggaggggagtttcccaaccagaatcctcgaatccacgagggtttggctacatgggtccagaaggataggcccctggaggaaaccaacattgttctctggtacatgttcgggcttacccatatcccaaggctggaagactggccggtcatgccggtagagcgcatcggcttcatgctcatgccacacggattcttcaactgctcgcctgcggtcgacgtgcctcccagctcctccgatcccgacgtcaaggaagccgagtcgcccaaggccatccagaatggcagtctcatctcgaagctgtgagccacagcttcgttgctcctcgaattaagtgacaaccagggtgctgctgctcctactattttattgtgttgctctaataaaaggaaaactgttttccactgtcctgtggttttttgatgccctgtagtatcgtttcgtttgatatggttcttgaatgttgatcggcaaactgttgaacagctgcattgctcgcatagtatatgtggttgtctgcagccctgcaccaacgaaatcatgatgcagaagcagaacatcttcgtgtgtttttgctatgctcttcgttgaaacttgatttaataataagtactactttgtgttgcttgaaacaagcagcagtggaccgtttctggatctggaattgcgatgaaaacagtctcgaaccgatcaagtattcaagtagggtgtaaaaaagggttatattgaaaaagtgcccctctaaaatttaaaaattgagccctcttctcccccggtgatccgctcgcgctggcgtcatggtgtcgctggaggccctggcgactagcaggtgcgctagcctcgcaggcttctcgacccgcacctgcgggcttcccgtttccgacccttcacccgccgtctttctcgtggtggtaataatagcggatccaggtcgaggaggaggacgagcgtggacgcggtcgccatggtatccgagaacggcgccggctcgggttggcgtgtcgttgccgctgcagctgccgtcgccggcggcggctgctctgggttgcgcctctgctcctgatgctgctccgtggccagccgatcttccactcgctggagggaggtgaagaagccgtcatgccgagagaagggctgccgccggccgcatcgtgccgtcgccgggggttccccgccgccagcggtttggtcggtcacggcctcacggtgatgagaggagattggactggaacgaatggtttgattgtttgtacggcagatgaaagtgaacgaatcacgcgcaaatcg

SEQ ID NO: 5517 - DNA, 2592 bp, Capsicum annuum
ggagtacatatatttctgttaaaataggcaaaggattacaaagagtgaaccaactttgactaataacataaaagttgatagttaaccaattgagttatggttactaagatatgtacattttcatcttcaaaggaggtatgcaacaagaacattttcatatatggtgtttacacttaccaaccaatgtgtagttgatttaaaattcattgcttaaagttccaatgtttatggtgcaggtatccaaatcatgccaagggctcagacctgccatccgttggaccctttatctgctgctgagatctctgtggctgtggcaggtgaaacacctgaggtcagagatgggatgcgatttattgaggtggttctgttggaaccagataaaagtgttgttgctttggcggatgcatatttcttcccacctttccaatcatcattgatgcccaaaaccaaaggaggatctctgattccgactaagcttcctccaaggagatctagacttatcatttacaataagaaaacaaatgagacaagcatatggattgttgagctaactgaagtacatgctgctgctcgaggtggacatcacagaggaaaagttatctcatctaatgttgtcccggatgttcagccacccatagatgctcaagaatatgctgaatgtgaagctgtggtgaaaaattatcctccctttagagaagcaatgaagagaaggggtattgatgacatggatctcgtgatggttgatccttggtgtgttggttatcatagtgaggcagatgctcctagctgcaggcttgcaaaaccactagtattctgcagaacagagagtgattgtccaatggaaaatggatatgcaagaccagttgaaggaatatatgtgcttgttgacgtgcaaaacatgcagattatagaatttgaagatcgaaaacttgtcccgttacctccagttgatccactgaggaattatacagctggtgagacaagaggaggggttgacagaagtgatgtgaaacccctgcatattattcagcccgagggtccaagctttcgcatcagtgggaactatgtagaatggcaaaagtggaactttcggataggttttacccctagagagggtttagttatacactctgttgcatatcttgatggtagcagaggtcgtagacccatagcacatagattgagttttgtggagatggttgtcccctacggcgatccaaatgatccacattatagaaagaatgcatttgatgcaggagaagatggcctgggaaagaatgctcattcactgaagaggggatgtgattgtttaggatacatcaagtactttgatgcacattttacaaatttcatgggaggagttgaaacaacagaaaattgtgtatgcttgcatgaagaagatcatgggattctttggaagcatcaagattggagaactggccttactgaagttagacggtctagacgactgacagtgtcttttgtttgtacagtggccaattatgaatatgcattctactggcacttttaccaggatggtaaaattgaagcagaagttaaactcacgggaattcttagtttaggagcattgcaacctggagaatctcgcaaatatggcaccacaataaaaccaggattatatgcacctgttcatcagcacttttttgttgctcggatgaatatggcagttgattctaagccaggagatgcacacaatcagattgttgaagtaaatgtcaaggttgaagaacctgggaaggaaaatattcacaataatgcattctatgctgaagaaactctgcttaggtctgagttgcaagcaatgcgtgactgtgatcctttatctgctcgtcattggattgttaggaacacaagaacctccaacagaacaggtcagctaacagggtacaagctggtacctggtccaaactgtttgccattggctggtcctgaggcaaaatttttaagaagggctgcatttctgaagcacaatctatgggttacacaatatgcacctggagaagattttccaggaggagagttccctaatcaaaatccccgtgctggcgaaggattagcttcttgggtcaagcaagaccgtcctctggaagaaagtgatgttgttctctggtacatttttggaatcacgcacattcctcgcttggaagactggcctgttatgccagtggaacacattggttttatgcttcagccacatggattctttaactgctctccagccgttgatgtccctccgcctcttggatgtgacttagaaagcagagacagtgatgtcacagaaaatagtgtagcaaagcacactcccactggtttgatggctaagctttgaaagaatttttcatatgacatgagcctccctctcttattactgcaccaacggatatacagaaaataaaacttcatttttcttttgatggagtattgaattagtaggtgcagggacatgggatattactagtctagtatatggcatgtttaagcaaagaaagccatgttttgtattaatcttgaacaatgtcacaagaaaaactaataaaagccggtcttggagcaactatcggtctttgcatt

SEQ ID NO: 5518 - DNA, 2115 bp, Trifolium pratense
tgttgttccaaggttgctactgttactgctactgttgctgcaagtgcaacctcttctaatgttcttcaacagaaacagcaaccaccttttatttcggctgtcgattcccgccttgatcctcctcctaaatccgcttcttccaaaggtattacagtaatggcgaaagcacaaacactccatcctttggatcctcttacagctgctgaaatatcagtagctgtagcaactgttcgagcagccggagcaacacctgaggtgagggatagcatgaggttcatagaagttgacttggtagaacccgaaaagcaagttgttgcattagcagatgcatacttctttcctcctttccaaccctcgttgcttccgaggacaaaaggtggacctgtgattccatcgaaacttcctccaaggaaagcgagattggttgtctataataagaagtcaaatgagacaagcatatggatcgttgaacttacagaagttcatgcaacgactcgtggtggacatcataggggcaaagttatttcttctacaattgttccggatgttcagcctcccatggatgccgttgagtatgctgaatgtgaagctgttgtaaaggactatcctccgtttcgagaggcaatgaagaaaagaggaatcgaagatatggatctcgtgatggtggatccttggtgtgccggatatcacagtgaaggtgatgctccaagccgcagacttgctaaaccgctattcttttgtaggaccgagagtgactgtcctatggaaaatggctatgctcgtcctgttgaagggatacatgtacttgtcgacatgcaaaatatggttgtcctcgagtttgaagatcgtaagctcgttccactcccacaggctgatccgctaagaaattatacttctggtgaaacccggggaggagttgaccgaagtgatgtgaaaccgttacagattattcagccagacggtccaagttttcgtgtcaatgggaacttcgttcaatggcagaagtggaactttcgtattggattcactcctagggagggtttggttgtttattcagtagcttatattgatggaagccgtggccgaagacctgtggcacacagattgagttttgttgagatggttgtcccttatggagatccaaatgatcctcactatagaaaaaatgcttttgatgccggtgaagatggcctcggtaaaaatgctcattcactcaagaagggttgtgattgtttaggctatatcaagtacttcgatgcgcactttacgaacttttatggcagtgttgaaacaattgagaattgtgtttgcatgcatgaagaagatcatggcatgttatggaagcatcaagattggagaacaggtttagctgaagttcgacgttctagaaggctgacagtgtcttttatatgcactgtggctaactatgagtatggattttactggcacttttatcaggatggaaaaatagaagccgaggtcaagctgacgggaatactcagcttaggtgcattgcaacaaggcgagactcgaaaatatggtacaactattgcgcctggattatacgcgcctgtccatcaacacttttttgttgctcgtatggacatggcagttgattgcaagcccggcgaagcatttaatcaggttgttgaggtgaatgtgaaagttgaagagccaggaaagaataatgttcacaataatgcattttatgctgaggaaaaactgcttaaatcagaattagaagcaatgcgcgattgcgaccctttatctgctcgtcattggattgttaggaacacgaggagtgtgaaccgaaccggtcatctaaccggttacaaactagttcctggttcaaattgtttacctttagctggatcagaggctaagtttttgagaagagcagctttcttgaagcacaatctttgggttactccttacgcacgcgacgaattgcatcctggaggagagttccctaatcaaaatccccgcgttggtgagggtttggctacttgggttaagcaaaatcgaccactcgaagaagccgatatagttctttggtacgtatttggggttacacacattcctcgattggaagactggcctgttatgcctgtggag

SEQ ID NO: 5519 - DNA, 2784 bp, Brachypodium distachyon
cctctcctcttcccaccgcagccaccaccaccgccaccaccaggcccagggctagctcctccctccgcccgtttaccccctttcctcctcgcctctcgcgacgagaacgccccctcctcgagaccctggcccgatcccgcagaacccctagacgcgcaggtccggacgaggagtgagcggaagagggggaggggtgaggcgcggggaggcggaggcctgctgtatgtcagatcgtgggaaccggcgagccggaggcggagactacggacacggtcagctcgcgaacccgctccaatggcctcagctcaggaaaaggcgacggactgctgccgccccgcgcgcgacgcccccggggcccgcagggtgatcgccgcgcccgggaaggtttccatggccccacgcggtgaacgcgtcgctgcggcggccggaggcggcgccgtgatggaagagatcgccaccgcggtccagcccacaaccgcgaaggcctcctctaaagggattcctataatgacaagggcccagagattccaccctttagacccgttatctgctgctgaaattgcagtggctgttgcaactgtaagagctgctggaaaatctcctgaggaacgagacagcatgcgttttgttgaagctgtgctattggaaccagaaaaaaatgttgtagcattagctgatgcctacttttttccacctttccaaccctcactgctccctagaaccaaaggctctgctgtcattccaagcaggttgcctcccaggagggccaagcttgttgtctacaacagacattcaaatgagactaccatttggatagtagaattatctgaagtgcatgcagctactagaggtggacatcacagagggaaggtgatatcatctgcagttgttccagatgttcagcccgcaatggatgctatggagtatgctgaatgtgaagctactgtgaaaaattatcctccatttattgaagctatgaagagaagaggtgtggatgacatggagcttgtcatggtcgatgcctggtgtgctggctactacactgatgctgatgctcccagtcgcagacttgcccggcctctaatcttttgccgaactgagagtgatagtccaatggagaatggttatgcacgtcctgtggaagggatccatgttgttgttgatatgcaaaatgatgttgtcatagaatttgaagataggaagtttgttcctctgcccccaccagatcatttgagaaactacactcctggagaaacaagaggcggtgttgatcgaagtgatgtgaaacctcttattatcgatcagcctgagggcccaagcttccgtattaatggctattttgtggaatggcagaagtggaacttccgcattggcttcacccctaaagagggtttggttatctattctgttgcatatgttgatggcagccgtggacgtcggcctatagctcataggctgagctttgttgagatggttgttccttatggagatccaaatgaaccacattatcgcaagaatgcatttgatgctggagaagatgggcttggcaaaaatgcacattctcttaagaagggatgtgactgcttgggttacataaagtattttgatgcacacttcacaaattttacgggtcatgtggaaacaattgagaattgtgtttgtttgcatgaggaggaccatggaatcctttggaaacaccaagattggagaacaggtttagcagaagttaggcgatcaaggaggctcactgtgtcatttatctgcacagttgccaactatgaatatggtttttactggcacttttatcaggatggtaagatagaatctgaagtaaaacttactggaattctaagtttgggtgctctaatgcctggggagtcaaggaaatatggtacaactattgctcctagtctgtatgcacctgtgcaccagcatttcttcattgcccgtatggacatggctgttgattgcaaacctaacgaggctcataatcaggtggttgaaataaatgtgaaagttgaaagcgcaggcacacataacgtgcacaacaatgctttctttgccgaggaaaaaattctgaaatctgagttagaagcaatgcgagattgcgacccttcgtctgcacgacattggattgtaaggaacacaaggactgtaaatcgtactggtcaaccaactggttacaggcttgtgcctggttcaaattgtttgccgttagctttacctgaagcaaagtttcttagaagagccgggttcttgaaacacaatctctgggtcacaccatacaatagtgacgagaagttccctggaggggagttccccaatcagaatccacgcattcacgagggtctagctacttgggtcaagaaggatagacccttggaggaaaccgacattgtcctttggtatgtatttggactcacgcatatcccaaggctggaagactggcctgtcatgccagtggaacgtatcggcttcatgctcatgccagatggattcttcaactgctcgcctgcggtcgatgtacctcccggctcttctgatgtcgatgccaaagaagctgagtcgcctaaagccatccagaacggcggccttgtttccaagctctgagcttcgtagctcctctatcgaactcaataaataagtattgctccaataaaaacagaaacgctttggtttgttgtggtctgtttggtgctctgtaataatacctttatttgctgcactgattgagttgcaacctacaatgttcataggagcaatgccatttactggactggcgga

SEQ ID NO: 5520 - DNA, 2827 bp, Brachypodium distachyon
acacccaaacctctcctctcctcttcccaccgcagccaccaccaccgccaccaccaggcccagggctagctcctccctccgcccgtttaccccctttcctcctcgcctctcgcgacgagaacgccccctcctcgagaccctggcccgatcccgcagaacccctagacgcgcaggtccggacgaggagtgagcggaagagggggaggggtgaggcgcggggaggcggaggcctgctgtatgtcagatcgtgggaaccggcgagccggaggcggagactacggacacggtcagctcgcgaacccgctccaatggcctcagctcaggaaaaggcgacggactgctgccgccccgcgcgcgacgcccccggggcccgcagggtgatcgccgcgcccgggaaggtttccatggccccacgcggtgaacgcgtcgctgcggcggccggaggcggcgccgtgatggaagagatcgccaccgcggtccagcccacaaccgcgaaggcctcctctaaagggattcctataatgacaagggcccagagattccaccctttagacccgttatctgctgctgaaattgcagtggctgttgcaactgtaagagctgctggaaaatctcctgaggaacgagacagcatgcgttttgttgaagctgtgctattggaaccagaaaaaaatgttgtagcattagctgatgcctacttttttccacctttccaaccctcactgctccctagaaccaaaggctctgctgtcattccaagcaggttgcctcccaggagggccaagcttgttgtctacaacagacattcaaatgagactaccatttggatagtagaattatctgaagtgcatgcagctactagaggtggacatcacagagggaaggtgatatcatctgcagttgttccagatgttcagcccgcaatggatgctatggagtatgctgaatgtgaagctactgtgaaaaattatcctccatttattgaagctatgaagagaagaggtgtggatgacatggagcttgtcatggtcgatgcctggtgtgctggctactacactgatgctgatgctcccagtcgcagacttgcccggcctctaatcttttgccgaactgagagtgatagtccaatggagaatggttatgcacgtcctgtggaagggatccatgttgttgttgatatgcaaaatgatgttgtcatagaatttgaagataggaagtttgttcctctgcccccaccagatcatttgagaaactacactcctggagaaacaagaggcggtgttgatcgaagtgatgtgaaacctcttattatcgatcagcctgagggcccaagcttccgtattaatggctattttgtggaatggcagaagtggaacttccgcattggcttcacccctaaagagggtttggttatctattctgttgcatatgttgatggcagccgtggacgtcggcctatagctcataggctgagctttgttgagatggttgttccttatggagatccaaatgaaccacattatcgcaagaatgcatttgatgctggagaagatgggcttggcaaaaatgcacattctcttaagaagggatgtgactgcttgggttacataaagtattttgatgcacacttcacaaattttacgggtcatgtggaaacaattgagaattgtgtttgtttgcatgaggaggaccatggaatcctttggaaacaccaagattggagaacaggtttagcagaagttaggcgatcaaggaggctcactgtgtcatttatctgcacagttgccaactatgaatatggtttttactggcacttttatcaggatggtaagatagaatctgaagtaaaacttactggaattctaagtttgggtgctctaatgcctggggagtcaaggaaatatggtacaactattgctcctagtctgtatgcacctgtgcaccagcatttcttcattgcccgtatggacatggctgttgattgcaaacctaacgaggctcataatcaggtggttgaaataaatgtgaaagttgaaagcgcaggcacacataacgtgcacaacaatgctttctttgccgaggaaaaaattctgaaatctgagttagaagcaatgcgagattgcgacccttcgtctgcacgacattggattgtaaggaacacaaggactgtaaatcgtactggtcaaccaactggttacaggcttgtgcctggttcaaattgtttgccgttagctttacctgaagcaaagtttcttagaagagccgggttcttgaaacacaatctctgggtcacaccatacaatagtgacgagaagttccctggaggggagttccccaatcagaatccacgcattcacgagggtctagctacttgggtcaagaaggatagacccttggaggaaaccgacattgtcctttggtatgtatttggactcacgcatatcccaaggctggaagactggcctgtcatgccagtggaacgtatcggcttcatgctcatgccagatggattcttcaactgctcgcctgcggtcgatgtacctcccggctcttctgatgtcgatgccaaagaagctgagtcgcctaaagccatccagaacggcggccttgtttccaagctctgagcttcgtagctcctctatcgaactcaataaataagtattgctccaataaaaacagaaacgctttggtttgttgtggtctgtttggtgctctgtaataatacctttatttgctgcactgattgagttgcaacctacaatgttcataggagcaatgccatttactggactggcggatgtctgtatgcatactcgattgctatctt

SEQ ID NO: 5521 - DNA, 2781 bp, Avena sativa
tcctcccaccgccaccagcccaccactccggggctcgctccactctccacccggccggcaccccaaccctctccgctcctcggcccctcgcggagagaacgccccctcctctcccgatcccggaaccctggcccgatcccgtagaacccctagaggtcctgccgaggaggagtgagagcggaggggggaggacgaaggcgcggggcggcggaggcctgtgctgtatgtcagatcgtgggatccggctaggcggagacggagattacggacacggtcagctcgccaacccgctacaatggcctcagctcaggaaaaggcgacgtcctgctgcctccccgcgcgcgacgcccccgggggccgcagagcgatcgccgtggccgggaaggtatcctccatgtccgcggccggaggaggtgagcgcgtcgtctccgcggccgggggcggcgccgtgatggaggatagcgcggccgcggtccagcccacaaccgccaaggcctcatctaaagggataccaataatgacgagagcccagaggttccaccctttagacccgttatctgctgccgaaattgcggtagctgttgcaactgtaagagctgctggaaaatctcctgaggaacgagacggcatgcgctttgttgaagctgtgctattggaaccagaaaagaatgttgtagcactagctgatgcttactttttcccacctttccaaccatcactgctccctagaaccaaaggctctcctgtcattccaagccggctgcctcccaggagggccaagcttgttgtctacaacagacgttcaaatgagacaaccatttggatagttgaactatctgaagtgcatgcagctacgagaggtggacatcacagagggaaggtgatatcatctgaagttgttccagatgttcagcctgcaatggatgcaatggagtatgctgagtgtgaagctactgtaaaaaattatcctccatttattgaagctatgaaaaaaagaggcgtggacgacatggagcttgtcatggtagatgcctggtgcgcgggctactacagtgatgctgatgctcccagtcgcagacttgccaggcctctaatcttttgcctaactgagagtgatagtcccatggaaaatggttatgctcgtcctgtggaagggatccatgttgttgttgatatgcagaatagtgttgtcatagagtttgaggataggaagtttgttcctttgcccccacctgatcatttgagaaattacactcctggggaaacgagaggtggtgttgatcgaagtgatctgaaacctcttattatcgagcaacctgagggcccaagcttccgtattaatggctactttgtggaatggcagaagtggaacttccgcattggcttcacccctaaagagggtctggttatctactctgttgcatatgttgatggtagccgtggacgtcgacctatagctcataggctgagctttgttgagatggttgttccttatggtgatccgagtgaaccacattatcgcaagaatgcatttgatgctggagaagatggacttggaaaaaatgcccattctcttaagaaggggtgtgactgtttgggttacataaagtattttgatgcacacttcacaaattttacgggtcatgtggagacaatagaaaactgtgtgtgtttgcatgaggaggaccatggaatcctttggaaacaccaagactggagaactggtttagcagaagttaggcgatcaagaaggctgacagtttcatttatctgcacagttgccaactatgaatatggtttttactggcacttttatcaggatggtaagatagaggctgaaataaaacttactggaattcttagtttgggagcgctgatgcctggggaaacaaggaaatatggtacaactatcgctcctagtttgtatgcacctgttcaccagcatttctttattgcccgtatggacatggctgttgattgcaaacctaacgaggctcataatcaggtggttgaagtaaatgtcaaagtagaaaatgcaggcacacataatgtgcacaacaatgctttctatgctgaagaaaaaatattgaaatctgagttggaagcaatgagggattgcgacccttcatctgctcggcactggatcgtgaggaacacaagggctgtcaaccgtaccggccaaccaactggctacaggctcgtgcctggttcaaactgtttgccattcgctctaccggaggcaaagttccttcgacgagccgggttcctaaagcacaatctctgggtcacaccatacaagagtgacgagaagttccccggaggggagttccccaatcagaatccacgtcttcacgagggtttacctacctgggtcaagaaggatagacccctggaggaaactgacatcgtcctctggtatgtatttggactcacccacatcccaaggctggaggactggcctgtcatgccagtggaacgcattggcttcatgctcatgccgcatggattcttcaactgttcgcccgcggttgacgtgccacctggcacttctgatgccgctgatgtcaaggaagctgactcgcctaaagtcatccagaacggcagccttgtttccaagctctgagctttgctgctcctcaaaggaatggaccggcgtctactaccgtactactacaaatattgctccgaataaaatttgttttccttgtggtgtgtttggttttctgaaacctctctttgctgtgcggattgaacgttgagctacaacaagtaccatgttat

SEQ ID NO: 5522 - DNA, 2555 bp, Nicotiana benthamiana
gatcacacttggcattttcattccattcgcaatggccgcaactttgcacaaggtgactcctcctcctccgattactactgcttcttgctgcccttcggcttccggttctgtcatccgtcgtgagtccgccgcagcctccgtcgtggaggacgatcagcagaaacaaacgccggcgctgacgtcatcggttaactctcaacctccttcctccaatccctccggcaaagggaaacaaatcatgccaagagctcatacatgccatcctttggaccctttatcagctgtttgtggctgtggcgaccgtcagagctgccggtgaatcacccgaggttagagatggcatgcgctttattgaggtggttctactggaacctgataaaagtgttgttgcactggctgatgcctatttcttcccacctttccaatcttcattaatgtccagaaggaaaggaggtcttcccattcctaataagcttcctccaaggcgagctagacttattgtatataataagaaaacaaatgagacaagcatatggattgttgagctagctgaagtacatgctactgctcgaggtggacatcacaagggaaaagtgatttcatccaatgttgttccagatgttcagccagcaatggatgcacaagagtatgctgactgtgaagctgcagttaaaaattatcctccttttagggaagcaatgaagagaaggggtattgatgacatggatcttgtgatggtcgacccctggtgcgttggttttcacagtgaggctgatgcgcctagccgcaggcttgccaaaccgctagtattctgcagaacagagagtgactacccaatggaaaatggatatgcaagaccggttgaaggaatatatgtacttgttgatgtgcaaaacatgcaggtgatagagtttgaagaccgcaaacttgtacctttaccaccagctgattcactgaggaattacactgctggtgagacaagaggaggggtcgatcgaagtgatgtgaaacccctccagattattcagccagagggtccaagctttcaagtcaatgggaactatgtggagtggcaaaagtggaacttccgagtaggtttcacccctagggagggtttggctatacactctgtggcatatcttgacggtagtaggggtcggagaaccatagcccataggttgagttttgttgagatggttgtcccctatggggatccaaatgacccacattacagaaagaacgcttttgatgcaggagaagatgggctcggaaagaatgctcattcacttaagaggggatgcgattgtttaggatacataaagtacttcgatgccaattttgcaaattttaccggaggagtagaaaccactgaaaattgtgttgtttgcatgaagaagatcacgggatgctctggaagcatcaagattggagaactggccttgcagaagttagacagtctagacgacttacagtttcttttatttgcactgtggccaattatgaatatggattctactggcacttttaccaggatgggaaaattgaagcagaagtcaaactcacaggaattctcaggttgggagcattgcctcccggagagtttcataaatatggcaccacaatagcaccgggattgtatgcacctgttcatcaacacttctttgttgctcgtatggatatggcagttgattgtaaaccaggagaagcacacaatcaggatgttgaagttaatgttagagttgaagaacctggggaagaaaatgttcacaacaatgcgttctatgctaaggaaacagtgcttacatctgaatgcaagaatgcgtgactgtgatgctgtatttgctcgtcattggattgttaggaacacaagaacatccaatagaacaggacagctaacagggtacaagctggtacctggccctaactgtttgccattggctggtcctgaggctaagtttttgacaagagctgcatttttgaagcacaatctatgggttacaagatatgcacccggagaagattttccggggggagagttccctaatcaaaatccacgtgttggtgagggattagcttcttgggttaagcaagatcgttctctggaagaaagtgatgttgttctctggtatgtttttggaatcacacatgttcctcggttggaggactggcctgttatgccagttgaacatatcggttttattcttcagccacatggattctttaactgctctcccgatgtagatgtacctcctcctcggggatgtgacatggaaatcaaagacagtgatggttcagaaaatggtgtagcaaagcccactcccagtagtttgatggcgaagctttgaaagctttctgattcagaaaatagacctctcgtattatctgcacagacacacaacaggcaaacttccatcttctgtttctttcggtacagtcctgaattagttggtgctaccacatggatgttgctatatttcagatatcgtgtttaagcaatgcatgtcctgttttctattgaccttgagcatcgttatacagaaaaactaataatgttc

SEQ ID NO: 5523 - DNA, 2574 bp, Cephalotaxus harringtonia
taagtaggtaggtaggaggtcggtggggggtttagaggcttgctgtatgtcagatagtaaaaacaacagtgggagaaggagagagagggacggcttgggcgcacttgcaaacccatcgcaatggcctcagctcagaaaaaacgacgctatgctgcgcgacagccgcatcatcctctgacatctcaagcaaggctaatgtcatggcagcgcctgcacagggccatgctgcctcgctgtcactgcgacgcgaggcggcttctggcgaggtgccattggcgtcggagtggggagacgtgaatggagatctcatcggagatcagcgccagagaaatgtcgccgcaagaatgccggacgcctccaagcctgttacagccaaagggacaggagtgcaaatgatgcgagctgaaacaaaacatcctttagatccattatctgcagctgaaattgctgtggcagttaccacagtcagagcagctggggcaactcccgaggtgcgggatggcatgcgatttattgaagtggttctcaaagagccagacaagcacatcgttgcattagcagatgcctacttttttcctccttttcaaccttcgctacttccgaaaaccaaaggtggtccagtgattcctcgtcaacttcctcctaggctagctaggattgttgtttataataagcgttcaaatgagaccagtgtttggtctgtagaattatctgaggtgcatgcggcagctcgtggtggccaccatagagggaaagttatttcatcaaaagttgttgaagatgttcagccacctatggatgcaatggagtatgctgattgtgagtctgttgtgaaggattatgcccctttcaaggaagcaatgaagaagagaggtattgaagatatggatctggtaatggtggatccatggtgtgtcggatatcatggtgaggaggatgccccaagccgaaggctagctagaccacttatattctgcagaactgaaagtgattgtccaatggagaatggatatgctcgaccagttgagggcatccatgttttggttgatatgcaaaaaatgatggtgattgagtttgaagatcgaaagttgattcctttgccgcctccagatcccctcagaaactatactgcaggagaaactcgtggaggagtggatcgaagtgatgtgaagcctttgctcataatgcaaccagaaggtccaagtttccgtgttaacggttaccatgtagagtggcaaaagtggaattttcgggtaggttttactccaagggagggattggtgattcactctgttgcatatgatgatggtagtagaggtcggagatctgtggcgcaccggctgagttttgtggagatggttgttccttatggggatccaaatgcgccacattataggaaaaatgcatttgatgctggagaggatggtctgggtaaaaatgcccattctttaaagaaggggtgcgattgtttgggttatatcaaatattttgatgcacacttcacaaatttcactggaggagtcgaaactattgagaactgtgtctgtttgcatgaggaagatcatggaattctttggaagcatcaggattggaggacaggcttagcagaggttcgaagatctaggcgtttaacagtgtcatttatatgcactgtggcaaattatgaatatgggttcttttggcacttttatcaggatggtaaactagaagcagaagtaaaacttacagggattctcagtctaggggcattacagcaaggtgaaacaaggaaatatggaacaatgattgctcctggtttatatgcacctgtgcaccagcaactttttgttgctcgtatggatatggctgtagactgcaaacctggcgaagcagtgaatcaggttgtggaggtgaatgtggatgttgaagaacctggggccaataatattcacaacaatgcattctatgctaaagaagatttgctacgaactgaattgcaagctcagcgagattgtaatccattgtctgcacgtcactggattgttaggaacacaaggactgtaaacagaacaggacagttaactggctacaagctagtacctggctcaaattgcttgccattggcagggtctgaagctaagtttcttaggcgagctgcctttttacagcataacctttgggtcactccgtataataaagatgaacaatttcctggaggtgaatttcctaatcaaaatcctcgtgttggagagggattacctacctgggtgaagcaaaatcgacagcttgaagatgctgatattgttctctggtatgtttttggtattacgcatgtccctcgcttggaggattggccagttatgcccgttgaacggattggatttatgctcatgcctcatgggtttttcaactgttccccaggagtggatgttcctcccaatactggtgagagtgacttgaaggaaaatggtggaccgaagcagaatggaataatctcgaagctttaaaattctttagtgatttactattgcaatcaagatagtttttgaaagtgatgaatttgttttctttgaacacaatgtgtttcagattttt

SEQ ID NO: 5524 - DNA, 3797 bp, Pseudotsuga menziesii
tcggatttaatttcattaataatgatagttataagccatgaacattctgataaagaaattaagtgtttaaataaaattataaaccaacaataacactatcaattttcaatcgctatacgcggaaagtcttggtacattcaaccaaacaatacaaccatagttgaaaacaagtctgtacaataaattctgcgtttggaattctaaaggaaactgttcaagattcgaacagaacctgatatgagaagtaaaattcatgcaaagacggggttgctactatggcgtaaattcataagaaagatctcttgttcaccagtcacaaatcacagtcggatcgcagcaacactcatccagaaggcagcaacaacacagagccgcaaggcatccctccaaaaagccttgctgtcgcggcggttgcgcctgaccgtaagccggcggtgcctgaacaggcggcgcttgtggtggataaccctgggcgtaaccttgaggataaccttggggataaccttggggatatcctggagcggggtatggataggcgtatttaggatccgacatgatgaacggctcttctttaagcttttctctccgagaaaagaaaattcaccgaaagaacctctgccgagactcgaacttccgactgagtaaaggaaaatcaccaaaagaacctcggccggaaaacgatctggcgactgatgaaataaaaatctccaagagaacctctgcccagacgcaaatcgatcactgggaggctcagaaaaacgagagcacgcagcgagcagaaatcttgaaatgccaaggaggaacgaagaaaaacaaatattgtcttgctgtttgtaaaaaaagacctcttgtgtactcagatctgaagcgggcccttcagcactggacggaagaaaacgagagccgagtaagatcaaagaatcgtcgttcttgaaattggagcttttaaataagatcaatacaaggcggatattgcagcgcaggaggcggggagcttagaggtttgctgtatgtcagattgtaaaaccagcgggagcacaagagagagggacggcttcggtgtatttgcaaatccattgcaatggcctcaacttcgaaagaaacgacgatatgctgcaagtcaggcgcaccctccccggatttggccgctaaggactcctcctcgtcctccgcgccttctttgcggcgcgaggcggcctctgccgaggttccccttgtcacagagtgggacgttaataaagatctccctaaagacaagcggaatagaagcagtgaagcgagaattccttctgcggttttaagttccatggatgcgatagccgaagcgtccaaggctgcagctaaaggtacagtgatgcaaatgttgcgagctaatccaaggcatcctttagatccattatctgcagctgaaattgctgttgcagtgtcaacggtcagagcagcgggggctactcctgaggtgcgggatggtatgcgattcattgaagtggttcttaaagagccagaaaaacacattgttgcgttagcagatgcatacttcttccctccttttcaaccttcactgcttccaaaaaccaaaggtggtccagtgattcctcgtcaacttcctcctaggcaagctaggattattgtttacaatatgcgttcaaatgaaactagcgtctggcttgttgaacttcttgaggtacatgctgcagctcgtggtggccaccatagaggaaaagttatttcatcaaaagttatcgaagatgttcagccacctatggatgcaatggagtatgctgattgtgaatctgttgtcaaagattacacccctttcaaggaggcaatgaaaaagaggggaattgatgatatggatctggtgatggttgacccatggtgtgttggttattatctggaagaggatgctcctaggcgaagactagctagaccacttatattctgcagaactgaaagtgattgtccaatggaaaatggatatgctcgtccagttgaaggcatacatgttcttgttgatatgcaaaaaatggaagtagtggagtttgaagatcaaaagctaattcccttgccacctccagatcccctcagaaactatactgcaggagaaacacgtggtggagtggataggagtgatgtcaagccactgcaaataattcaaccagaaggacctagttttcgtgttactggctaccatatagagtggcaaaagtggaattttcggataggttttactccgagggagggactggtgatctattctgttgcatatgatgatggaagcagaggtcggagatctgtggcccaccgcctaagttttgtggagatggttgtaccttatggggatccaaatgctccacattataggaaaaatgcatttgatgctggggaggatggtctgggaaaaaatgctcattctttaaagaaggggtgtgactgtttaggctatatcaaatacttcgatgcacatttcacaaatttcactggaggggtcgaaactattgagaactgtgtctgcttgcatgaagaagatcatggaattctgtggaagcatcaagattggaggtcaggcttagcagaagttagaagatctaggcgtttaacagtgtcattcatatgcactgtagcaaattacgagtatggtttcttttggcatttttatcaggatggtaaaattgaagctgaaatcaagcttacagggatactcagtttaggggccctacaacatggagagtcaaggaagtatggtacgatgattgctcctggtctatatgcacctgtgcatcaacacttctttgttgctcgaatggatatggctgtagattgcaagcccggtgaaccggtgaaccaggttgtggaggtaaatgtgaaagttgaagaacctggacccaataatattcataataatgcattttatgctgaggaagaattgctacgaaatgaattgcaagctcagcgtgactgtaatccattgtctgctcggcactggattgttcggaacacgaggactgtaaacagaacagggcagttaacaggctacaagttagtgccaggttcaaattgcttaccattggcagggtctgaagctaagtttcttaggcgagctgcctttttacagcataacctttgggtaactcaatataataaagatgagcaatatccaggaggtgaatttcctaatcaaaatccacgtgttggagaaggattacatacctgggtgaagcaaaatcgaaaccttgaagaggctgatattgttctatggtatgtttttggtattactcacgttccccgtttggaggattggccagttatgcccgtggaacgaattggattcatgctttcgcctcatggtttctttaattgttctccagcagtggatgtgcctccaagtatcggtgaatgtgagaaggaaagtgcagggtcaaagattaatcaaaccggaattatatccaagctatgaacatttactagtggcgttgtctctgaccaaaatagtattttgcaaggaatgcatttatcttctttaccatcatagttttcagattgttcttcattagctggacagatagtatttagtgcttattgttatattactattttgcgtctactacagttttgtaaattcctagtttggttggcgtttgttacagaaaatcaagcttgttgattcaagttcatttgaaatgttttatcattaatactattctgtatatgttgtaatatcttagtttctatgagttgtcattattaattcagtaaaatttaaatggaatctatgtttcaagtcattgacatttttc

SEQ ID NO: 5525 - DNA, 2510 bp, Chrysanthemum coronarium
tcagcgcctgatttatcctctaccgttttctgttagtgtgtgtaacaaactaaccaacacacacacagtcactcacaatgactgacaaatcatcatcatcaaccgtcgttctccgccgcgaagtgacgtcatcttccgccgcagctgacgtcgtcacgcaaccgtctgtacctgttactgcttctactaaaggaactgggcccacgaatatggttaaggcacagactcgccacccgatggatcctcttgctgctgctgaaatttccatagctgtggcaactgttagggctgcgggagcgactcctgaggtaagagacagtatgcgattcatagaggtagtccttgtggaaccagacaaaaatgtggttgcattggcagatgcatattttttcccaccttttcaaccgtcattgttgccaaggacaaagggaggacccataatcccgacaaaacttccacctcgacaagctagacttattgtttacaacaaaaaatcaaatgaaacgagtatatggatcgttgagttatcagaagttcatgctctaactcgaggtggccatcatagaggcaaagttatttcatctaaagtagtgcctgatgtgcaacctcctatggatgctgtggagtatgctgaatgtgaagccattgtaaaggaataccctccattccgagaggccatgaagaggaggggtattgatgatttggatctcgtgatggtagatccatggtgtgttggttaccatagtgaggctgatgctcctaatcggagactggctaaaccgctcatattctgtcgcacagaaagtgactgtccaatggagaatgggtatgctcgtccggtagaaggaattgatgtgttagttgacatgcaaaatatggtggttatcgagttcaaagaccgcaaacttgttcctctaccaccagcggacccattgagaaattatactgctggtgaaacaaggggaggcgttgatcgaagtgatgtgaaaccgctaaacatcgttcaacctgatggtcctagttttcgcgtcaatggtcattttgttcagtggcagaagtggaatttccgtattggcttcactcctagggagggtttggtcatatattctgtagcatatgttgatggcaaccgaggtcggagacctgtagcccacagattaagcttcgtagaaatggttgttccttatggtgaccccaatgaccctcattacaggaagaatgcatttgatgcaggggaagatggacttggtaaaaatgatcattctcttaaaaaagggtgtgattgtttgggttctatcaaatattttgacgcacacttaaccaatttcaccggcggtattgaaacaatggaagattgtatttgcttgcatgaagaggatcatggaattttgtggaagcaccaggactggagaactggtttagctgaagttcgacggtcaagaaggctagtagtgtcgtttatatgtactgtggccaattatgaatatgggttttactggtatttttatcaggatggaaaaatagaagctgaggtgaagttaactggaatattaagcttaggagctcttcaacctggtgaagttagaaaatatgggactatgattgctcctggactctacgctcctgttcatcaacactttttttgttgctcgtatggatatgtctgttgactgcaagcctggtgaatcccacaatcaggtagttgagttggatgttaaagttgaagaaccgggagatgaaaatgtgcacaacaacgccttttatgcagaagagacactgttaaaatcggaacttgaagcaattcgtgattgtaattctgcttgtgcccgacattggattatcaggaatacaagaactgtaaaccgaactggtcagttgacaggctacaaactagtacctggatcaaattgtttaccattaggtggggcagaggccaagtttttgagaagagctgcttttttgatgcacaacctgtgggtcacacaatatgaccccgaagaaatgtttcctggtggagagttccctaatcagaatccacgtgttggagagggtttagctacttgggttaagaaggatcgctctctagaagaaactgaccttgttctctggtatgtatttggagtgacacatgttcctcgactagaagattggcctgttatgccagtagaacacattggattccgcctcatgccacatggattcttcaactcctcacccgcagtggatgttcccccaagctcaatgactgattcggaactgaaagaaaatggtttggtagataagtcttgccatactggtctcgtttcaaaaatgtgaaaggaagtttattaccacgttagtgtactccactagaaagccattttatctgtgttttcgagatgttatactctattgggtccgttttcaccctatccgattagtttcatatgagagccgtgatggttatgatgtttgtagcaattaccatatgttttgcttgtaaatatctaataaagatcatatggaaaata

SEQ ID NO: 5526 - DNA, 2877 bp, Pennisetum glaucum
gccaccacggcacggcaccacaccactccaaacttccagtcctctcccaccggcatcccccacctcctcggcggcgcctcgcgggcggcccggtccctcccctagggttcccggaaccctagccccccgactccgtaggcgcgagggccccggcggcactaggacgaggcggcggcggagaggggagggggcacaaggcgcgggaggcgcaggcctgtgctgcatgtcagatcgtggtagccggcgaggcggaggcggaggcggagactacggacacggtcagctcgcgaacccactccaatggccgcagctcaggaaaaggcgccggcatcatgctgccgcgccgcgcccgcgcgtgtcgccggtggcggccctgctgcctcatccgtgcgggcgatcgccgcgccccctgccgggaaggtcgtcgccgtcgccgcagcgggcggtgagcgcgtggccgccgctggcgcgggcggcgccgtgatcgaggagatcgccgcggtccagcccaccaccgcgaaggcctcctccaaagggataccaataatgacaagagcccagaggtgccaccctttagacccattgtctgctgctgaaattgcagttgctgtagcaactgtaagagctgctggaagatctcctgaggaaagagatagcatgcgctttgttgaagctgtgttgttggagccgaataagaatgttgtggcgttagctgatgcctacttcttcccacctttccaaccatcactgctccctagaaccaaaggttctgctgttattccaagcaggctgcctcctaggagggccagacttgttgtgtacaacaaacaatcaaatgagactagtatttggatagtagagctgtctgaagtgcatgcagctaccaggggtggacatcacagaggcaaggtgatatcagctgaggttgttcctgatgttcaacctgcaatggatgctatggaatatgctgaatgtgaggctactgtcaaaagttatccaccatttattgaagctatgaagagaagaggtgtggacgacatggatcttgttatggtagatgcctggtgtgctggctactatggtgaagccgatgcgcccagtcgcagacttggcaagcctctaatattttgcaggactgagagtgatagccccatggagaatggttatgctcgtcctgtggaaggaattcatgtcattgttgatatgcagaataatactgtgatagaatttgaagataggaagttggttcctctccccccaccagatcatttgaggaattacactcctggcgaaacaagaggtggtgttgaccgaagtgatgtaaaaccacttattatcagtcagcccgagggtccaagtttccgcatcaatggctattttgtggaatggcagaagtggaacttccgtattggcttcacccccaaagagggtttggttatctattcggttgcgtatgttgatggtagccgtggacgtcgacctatagctcataggctgagctttgttgagatggttgttccttatggagatccaagtgaaccacattatcgcaagaatgcatttgatgctggagaagatggacttggaaaaaatgctcattctcttaagaagggatgtgattgcttgggctacataaaatattttgatgcacatttcacaaacttcaccggtggtgttgagacaattgagaactgtgtttgtttgcatgaggaggaccatggaatcctctggaaacaccaagactggagaactggtttagcagaagtaaggcgatcaaggaggctcactgtctcatttatatgtacagttgcaaactatgagtatggtttttattggcacttctatcaggatggaaaaatagaatcagaagtgaagcttactggaattctcagcttaggagccctgatgcccggggaatcaaggaaatatggcacaactattgcccctggtctatatgcaccagttcaccagcatttctttgttgcccgtatggacatggctgtcgattgcaaacctaatgaggctcataatcaggtggtcgaggttaatgtcaaagtggaaagtgcaggcacacataatgtgcacaacaatgctttctatgctgaagaagaattgctgaagtctgagttgcaagcaatgcgtgattgtgatccttcatctgcacgccactggattgtaaggaacacacgaactgtgaaccgtactgggcagccaactggttacaggctggtgcctggttcaaactgcctgccgttggctctgcctgaggcgaaatttctgaggagggctgggttcttgaagcacaatctctgggtcacacaatacaagagcgacgagatgttccctggaggagagtttcccaaccagaatcctcgaattcacgagggtttgcctacatgggtcaagaaggataggcccctggaggaaaccgacattgttctatggtacgtgttcgggctcacccatatcccaaggttggaagactggccagtcatgccagtggagcacattggcttcatgctcatgccacatggattcttcaactgctcacctgccgttgacgtgcctccgagctcctctgatgccgacatcaaggaagccgagtcgcccaaggccatccagaccggtggcctcatttcgaagctgtgaacttcactgttcgtcgaagtggcaaccggggtgttgttgcctcgtcctactatttaattgtgttgctccaataaaaggaaaactgtttccgctgtcatgtatcgccttgtttggttttctgtaatatcgttttgccgatcaagcagacttcctacatggcctgtaaggttccgaacagggagagttttcagagaatatatcttctcaaattgtgttttgctcgaaaaa

SEQ ID NO: 5527 - DNA, 2536 bp, Musa acuminata
tatgttttttttttaatgtgttgccagtgcagctgtattaaatcaacgaaaaataacgatgaaaaaaaaagaaaaagtaacatcaaaacgaagaacttttcccgaaaatttgcgcttcattatgtgagtactgttagtacgttggacagtgagaagaccgaaagctgcctcttcccctctctctctctctctctctctctctctctgtcctacgtggtgctttgtcacatctttgataaagacgtcgagccagcaaataagtacgggtttggtttcgctgtccatccacctccgccacccaatcctattgcactaccaccaattccgattgtgatgagagctcaaaatagccatcctttagatccactgtctgcagctgagatattagttgcagtagcaacagtcagggctgctggtgcaactccagaggttagagatggtatgcgatttatagaagttgttctgttggaaccagagaagaacgttgtggcattggctgatgcctacttctttcccccttttcaaccatcactactccccagaacaaaaggtggtcctgtcatcctgggtaagcttcctcctcggagggctaggcttgttgtttacaacaaaaggtcaaatgagacaagcatttggatcgtcgaactctcagaagttcatgcggctactcggggtggccgtcacaggggaaaagtcatctcctctgaagttgttccggtagtccaaccctccatggatgccatggagtatgcggaatgtgaagctgctgtaaaaagtcaccttccattcatagaggcaatgagaaagagaggagtagaggatatggatcttgtgatggttgattcttggtgtgttggtttctacagtgatgctgatggtcctaatcgcagacttgcaagaccactaatattttgcagaactgagagtgactgccccatggagaatggttacgcacgtcccgttgaaggcatacatgttcttgtggatattcaaaataatgttataatcgaatttgaagatagaaaattggtgcctctacctccagcagatcctttgagaaactatactcctggagaaacacgaggaggcattgaccgaagtgatgtgaaacctctacaaattcttcagcctgaaggtcccagttttcgtgtaaatggttactttgtgcaatggcaaaagtggaatttccggattggtttcacgccaagggagggattagtcatacattctctagcatatgttgatggtagtcgtggacggagacctattgctcacaggctaagcttcgtggagatggtagttcctcatggagatccaaatgaacctcattaccgtaaaaatgcatttgatgctggggaagatggccttggaaaaaatgcacactctcttaaaaagggctgtgactgcttgggttacatcaaatactttgatgcccatttcacaaactacactggtggtgttgaaactattgagaattgtgtttgtttgcatgaagaggaccatgggatcctatggaagcaccaagattggagaacaggcttagcagaagttaggcgatcaagaaggctaagtgtgtccttcatatgtacagttgctaattatgaatatggctttttctggcacttctatcaggatggtaaaattgaggcagaagtaaagataactggaattctcagcctaggggctttgggacctggtgaatcaagaaagtatggtacaacaatagcaccgggtttatatgcgccagttcatcagcatttctttgttgctcgcatggatatggctgttgactgtaaacctaatgaagccttcaatcaggtggttgaggtgaatgtcaaagttgaagaacctggcctgcataatattcacaataatgcattctatgctgaagaaaagcttctcagatcggagttgcaggctatgcgtgactgcaatccttcatctgcacgacactggattgtaaggaacaccagaactgtaaatcgaactggtcaacctgcgggctacaagctcatgcctggtcccaattgccttccattagctggtccagaggcaaaattttttagaagagctgcatttttaaagcataacctttgggttacatcatataaacatgacgagatgtatccaggaggagagtttcctaatcaaaatccacggataaatgagggactagccacatgggttaagaagaataggtcccttgaggaaactaacattgttctgtggtatgtatttggagtcacccacatcccaaggttggaagactggcctgtcatgcctgttgagcgcataggttttatgctcatgccgcatggttttttcaactgctctccttcggttgatgtgcctcccagtcccagtggagcagaggaggagagtgtagcgccaaagttggtcccaagtcttcttctcgccaagctttgatgaatgatgaaaagccgatgatgcatctgtatcctggtcatatataaagcgacacctcaaaagcatatgtcttggttttgttccaacggtatggaagcctcaagccaac

SEQ ID NO: 5528 - DNA, 2521 bp, Musa acuminata
atgtgttgccagtgcagctgtattaaatcaacgaaaaataacgatgaaaaaaaaagaaaaagtaacatcaaaacgaagaacttttcccgaaaatttgcgcttcattatgtgagtactgttagtacgttggacagtgagaagaccgaaagctgcctcttcccctctctctctctctctctctctctctctctgtcctacgtggtgctttgtcacatctttgataaagacgtcgagccagcaaataagtacgggtttggtttcgctgtccatccacctccgccacccaatcctattgcactaccaccaattccgattgtgatgagagctcaaaatagccatcctctagatccactgtctgcagctgagatattagttgcagtagcaacagtcagggctgctggtgcaactccagaggttagagatggtatgcgatttatagaagttgttctgttggaaccagagaagaacgttgtggcattggctgatgcctacttctttcccccttttcaaccatcactactccccagaacaaaaggtggtcctgtcatcctgggtaagcttcctcctcggagggctaggcttgttgtttacaacaaaaggtcaaatgagacaagcatttggatcgtcgaactctcagaagttcatgcggctactcggggtggccgtcacaggggaaaagtcatctcctctgaagttgttccggtagtccaaccctccatggatgccatggagtatgcggaatgtgaagctgctgtaaaaagtcaccttccattcatagaggcaatgagaaagagaggagtagaggatatggatcttgtgatggttgattcttggtgtgttggtttctacagtgatgctgatggtcctaatcgcagacttgcaagaccactaatattttgcagaactgagagtgactgccccatggagaatggttacgcacgtcccgttgaaggcatacatgttcttgtggatattcaaaataatgttataatcgaatttgaagatagaaaattggtgcctctacctccagcagatcctttgagaaactatactcctggagaaacacgaggaggcatcgaccgaagtgatgtgaaacctctacaaattcttcagcctgaaggtcccagttttcgtgtaaatggttactttgtgcaatggcaaaagtggaatttccggattggtttcacgccaagggagggattagtcatacattctctagcatatgttgatggtagtcgtggacggagacctattgctcacaggctaagcttcgtggagatggtagttcctcatggagatccaaatgaacctcattaccgtaaaaatgcatttgatgctggggaagatggccttggaaaaaatgcacactctcttaaaaagggctgtgactgcttgggttacatcaaatactttgatgcccatttcacaaactacactggtggggttgaaactattgagaattgtgtttgtttgcatgaagaggaccatgggatcctatggaagcaccaagattggagaacaggcttagcagaagttaggcgatcaagaaggctaagtgtgtccttcatatgtacagttgctaattatgaatatggctttttctggcacttctatcaggatggtaaaattgaggcagaagtaaagataactggaattctcagcctaggggctttgggacctggtgaatcaagaaagtatggtacaacaatagcaccgggtttatatgcgccagttcatcagcatttctttgttgctcgcatggatatggctgttgactgtaaacctaatgaagccttcaatcaggtggttgaggtgaatgtcaaagttgaagaacctggcctgcataatattcacaataatgcattctatgctgaagaaaagcttctcagatcggagttgcaggctatgcgtgactgcaatccttcatctgcacgacactggattgtaaggaacaccagaactgtaaatcgaactggtcaacctgcgggctacaagctcatgcctggtcccaattgccttccattagctggtccagaggcaaaattttttagaagagctgcatttttaaagcataacctttgggttacatcatataaacatgacgagatgtatccaggaggagagtttcctaatcaaaatccacggataaatgagggactagccacatgggttaagaagaataggtcccttgaggaaactaacattgttctgtggtatgtatttggagtcacccacatcccaaggttggaagactggcctgtcatgcctgttgagcgcataggttttatgctcatgccgcatggttttttcaactgctctccttcggttgatgtgcctcccagtcccagtggagcagaggaggagagtgtagcgccaaagttggtcccaagtcttcttctcgccaagctttgatgaatgatgaaaagccgatgatgcatctgtatcctggtcatatataaagcgacacctcaaaagcatatgtcttggttttgttccaacggtatggaagcctcaagccaac

SEQ ID NO: 5529 - DNA, 2363 bp, Chrysanthemum coronarium
gatcctcttgctgctgctgaaatctccatagccgttgcaacagttagagctgctggagcgactccagaggtaagagatagcatgcgatttatagaggtagtccttgtggaaccagacaagaatgtagttgccttagcagatgcatattttttcccaccttttcaaccgtcactgttgccaaggaccaagggaggacccataatcccaacaaaacttccacctcgacaagctaggcttattgtttacaacaagaaatcaaatgaaacgagtatatggatagttgagttatcggaagttcatgctctaactcgaggtggccatcatagaggcaaagttatttcatctaaagtagtgcctgatgtgcaacctcctatggatgctgtggagtatgctgaatgtgaagccattgtaaaggaataccctccattccgagaggccatgaagaggaggggtattgatgatttggatctcgttatggtagatccatggtgtgttggttaccatagtgaggctgatgctcctaatcggagactggctaaaccgctcatattctgtcacacagaaagtgactgtcccatggagaatggttatgctcgtccggttgaaggaatcgacgtgttagttgacatgcaaaatatggtggttatcgagttcaaagaccgcaaacttgttcctctaccaccagcggacccattgagaaattatactgctggtgaaacaaggggaggtgttgatcgaagcgatgtgaaaccgctaaacatcgttcaacctgatggtcctagttttcgcgtcaatggtcattttgttcagtggcagaagtggaatttccgtattggcttcactcctagggagggtttggtcatatattctgttgcatatgttgatggaaaccgaggtcggaggcctgtagcccacagattaagcttcgtagaaatggtggttccttatggtgaccccaatgaccctcattacaggaagaatgcatttgatgcaggggaagatggacttggtaaaaatgctcattctcttaaaaagggatgcgattgtttgggttacatcaagtattttgacgcacacttaaccaattttaccgggggtgttgaaacaattgaagattgtatttgcttgcatgaagaggatcatggaattttgtggaagcaccaggactggagaactggtttagctgaagttcgacggtcaagaaggctagtagtgtcgtttatatgtactgtggccaattatgaatatgggttttactggtatttttatcaggatggaaaaatagaagctgaggtgaagttaactggaatattaagcttaggagctcttcaacctggtgaagttagaaaatatgggactatgattgctcctggactctatgctcctgttcatcaacacttttttgttgctcgtatggatatgtctgttgactgcaagcctggtgaatcccacaatcaggtagttgagttggatgttaaagttgaagaaccgggagatgaaaatgtgcacaacaacgccttttatgcagaagagacactattaaaatcggaacttgaagcaattcgtgattgtaattctgcttgtgcccgacattggattatcaggaatacaagaactgtaaaccgaactggtcagttgacaggctacaaactagtacctggatcaaattgtttaccattaggtggggcagaggccaagtttttgagaagagctgcttttttgatgcacaacctgtgggtcacacaatatgaccccgaagaaatgtttcctggtggagagttccctaatcagaatccacgtgttggagagggtttagctacttgggttaagaaggatcgctctctagaagaaactgaccttgttctctggtatgtatttggagtgacacatgttcctcgactagaagattggcctgttatgccagtagaacacattggattccgcctcatgccacatggattcttcaactcctcgccagctgtggatgttcccccaagctcaatgaccgattcggaattgaaagaaaatggtttggtagataagtcttgccatactggtctcgttgcaaaaatgtgaaaggaagtttattaccacgtaagtgtactccacgagaaagccattttatctgtgttttcgagatgttatactctattgggtccgttttcaccctatccgattagtttcatatgagagccgtgatggttatgatgtttgtagcaattaccatctgttttgtttgtgaatatctaataaagatcatatggaaaatagataactctctttactttctgtatatttgtttatcttttgtcgatactcaagtctttgtagctactcttttctactccaaataaccagtttag

SEQ ID NO: 5530 - DNA, 4093 bp, Triticum aestivum
aagctttctgttgctttctatctaacgtggaagatggagtctgttgcctgatgattgctaccgtgacacctttctcgcactctagcacagtgtcatctgcagaatttgaaaggcgcaagagagcaattcctttgttgtctgccatgtctcgcaacttgaagagccctgtccagacccagatgggagtttcagccttgagcagctcgctgatcggtgattaccctgccaaaactagaagcgaggggagggctgttggatggaaacgtgtttttgtccagactgacactgggtttgtactgcctgttcaactagatcgtggtgacagtgtacacacagtcaaaagaaagctgcaggtggccctcaatgttcccactgaggagagttctctgacactcggtgatcatgtcctcaagaatgatctcagcagcatccgaaatgattccccactgctcctgaccaagaccttcatgcatcggagttcctccagcccatgtctatctcctacaagcaaggatctccagcagcaaagggataggggcagtccaattgaagttttagtatgtccaacccgctgcattcaggcaaagcagcttgttaaggatgttgctagggccataagaaacggtgtggatccaaaacttgtcaatagtgggcttggtggtgcctactatttcaagaacagtaaaggtgagaatgctgccattgtgaagccaaatgatgaggagccatttgcacccaacaatccaaaaggttttactgggagagcccttgggcagccaggcctcaaaagatcagttcgagttggtgagaccggttttagagaggttgctgcataccttctggactatgataactttgctaatgtccccccgacagttcttgtcaagatttcacatcctgtatttaatgtgaatgaaggcgtcggctctaccaacaagaaggcttctgtgggtgatccgcgaactgtcagtaagattgcctcatttcagcagttcgctcctcatgattttgatgctagtgaccttggcacttcaagcttccctgtagctgctattcacaggattggtattcttgacatccgaatcttcaacactgatagacatgctggaaatcttctggtaagaaaggtgacaggagcagatcaatttggaaatctgactgagctgattcctattgaccatggtctctgcctgccagagtgtttagaggatccatattttgaatggattcactggccgcaggcgtcaatcccattctctgaggatgagcttgagtacatagggaaacttgatccagtgaaagatgctgagatgcttcgcatggagctgcctatgatcagggaagcgtgcctccgtgtgctagtcctctcaaccatatttctgaaagaaggcacattatttggtctttgccttgcggagattggtgagatgatgagcagggaatttaacgggatggatgatcagccaagtcagctagaggttgtctgcatggaggcaaggaggctagcaactgaacgagaagaatgttccacagaacatgattctgcagatgaagatgtgacccaatttgaacttgactgtgaagatcatgaaatgccaaaaacaccaccagcctaccattttgaatttaaggggggaagctccagaaacccgctgtctaaattggaagaggccattgaagaagaggaagatgacattcaggaagaggaagaaagcaatgcagaaaagttagcttgccccaagcctgtcaataagtggcttcctaacatttccaagctatcaacctcactgagcagtgtcagtctcatggacaaaagccagcgtcaggtgcctgctattccgaagggtgcggattctgtgaaaacctctgaaaacaaccaagttggtaactggaggaccgcaaatgaacagctcccaacaagcgcaagctttgtgaagcttgccgacatgggtgtggatgcatggggcctgttccttgagaagttccaggagctgctccctggcgcattccgcgcgcacaagctcggcgccaccgggcagagggggaggctgaggatgggtacttcttgtcagttttgagttagtgcaggagtagagaagtcagtttggtcaaggtatgtggtcggtcgtcgaataaagccatcctttacaatagggtttgagcgttgaatatgcctgcttcagaggtccatgttcagatgatggcctttcctgtacatagttttccttcttcttttttcctttttttcttttctagctagttgcctggaggaggttgggatgtgatgtctgcccagttcttggccacccaattcctccatgcatgatatgcattcaaaggtgccattcaaataaaatagacatgcaagaaaaagtttctggtgtggtaattaaacattgtccagatttcagagtaatgttatatttcaacttgaaaggtttttattgtgctgtcagttgtcattgttctcatgtcatttatatatactgtacctgttgtcacagatgtttcagtggtgtgtaccttgcactctattattgatgcagttaaactcttctgtctctgctaggttatgctgctgtgatatttattgtctagttcatgcagcaacattatgaacataaggtcagcatgcagtttaatgtccccttcatcgatttacactttctagcatttgttactagagtgttcatattaccaatttgccagtctatcaattgagagacggtcatcctgccaaactctaccttcaggattatttacatctattccaacccaagttagacaccttcaaaggccaaaactaactgatgatttcatcaaatagcaaggagggacttcaggctcctaccggcgtgagttctttcatgccggcgagatcgctgagctccacgtgctggtactctatcctccttagcacggtcctggtctcgctcctcggcaaagtcatctgccgctgccttagccttgaaatggcctgggtgacctctgatatccatggccgcttccttgggctcctgttgatgcaccggtaggcgacatcggcaaggacccttgcctcttccggaatgctcccaccaaggaggttcttgtcgagtatctcatcccagtccacctttccttcccctccaatcgctgctaggtcaatgtactccattaagccttgttgtggatttatggctgttatgagttcaaaaagtattatgccgaaactgtaaacatcgctcttctttgtgaacttgttggtggacatgtaatcagggtccatatatccataggtgcccttgagacctgacttacttccatcaaatacttcctcctttgatagaccaaagtctgcaaccttggccctcattgattcgtccaagagtatattagcagactttaggtctcggtgaataacaggcgggacagccccttcatgcaggtactcaatcccatgagagacgtcgtgagctatttgtagcctctcttgccagctcaaactccgtttattatcaccatacagaagagttgccagattcccgttgctcatgtactcatacatcagaatgtgttggcctttttccacgcaatatccaaccaaattgacaagatttctatgatgcagccggctaagcaaaattacctctgtctggaactctctttccccttgcgtagaatcgctcgcgagaacctttacagccacgacttcaccggtagccattacagccttgtacacaggaccaaacgacccttgccccagaatcgtggtgaagttgttggtagccttctgcagatccttgtagtggtacttggggatcccggagacggagaggggctggtccctggcgttggtggcgccccgccagccccagaaggcgacgcgcttccccggcggcagcgggttgtggccccagtcggcgacgccctcggagacaacggagatggagacgctggagtcgaggctcggggtggagccgttggcccgcagcgtggccgtggaggactcgagcgaccgcgtccgcgtccgcgccacaacgctggcccgccgccggtacatccagatggccaggaacacgcacgccgccgcgagcaccgccgcgcccacgcc

SEQ ID NO: 5531 - DNA, 2779 bp, Hordeum vulgare
cccccacccccacccagcctcctcgcaagctctcgcgctcgcacgctcgctcaggcacgagagagcgagggaagaagaaggggggcgagaagtcaggacccgggaggcggaggcggcggagtgccgtgccggggagtgggaggagccgctccaacgccggacgccggacgaaagaggcggctgcggcgcacctgccagatctgcggccccgccggcggcgggccgccatttccaggtctccgcattggttcagggtcttattatccaaaagttgggtttaccgggtttcgtgacagcttccaattgtagctttctgctgctttctatctaacgtggaagatggcgtccgttgcctgatgattgctaccgtgacacctttctcgcactctaggacagcgtcatctgcagagtttgaaaggcgcaagagagcaattcctttgttgtctgccatgtctcgcaacttggagagccctgtccagacccagatggcagtttcagccttgagcagctctctgatcggtgattaccctaccaaaactagaagcgaggggagggctgttggatggaaacgtgtttttgtccagactgacactgggtttgtactgcctgttcaactagatcgtggtgacagtgtacacacagtcaaaagaaagctgcaggtggccctcaatgttcccactgaggagagttcactgacacttggtgatcatgtcctcaagaatgatctcagcagcatccgaaacgattccccgctgctcctgaccaagaccttcatgcatcggagttcctccagcccatgcctgtctcctacaagcaaggatctccagcagcaaagggataggggtggtccgattgaagttttagtatgtccaagccgctgctttcgggcaaagcagcttgttaaggatgttgctaggggcataagaaacggtgtggatccaacacttgtcaatagtgggcttggtggtgcctactatttcaagaacagtaaaggtgagaatgctgccatcgtgaagccaaatgatgaggagccgtttgcacccaacaatccaaaaggttttactgggagagcccttgggcagccaggcctcaaaagatcagttcgagttggtgagactggttttagagaggttgctgcataccttctggactatgatagcttcgccaatgtccccccgacagttcttgttaagatttcacaccctgtatttaatgtcaatgaaggtgttagttcaagcaagaagaaggctcctgtgggtgatccgcgagctgtcagcaagattgcctcatttcagcagttcgctcctcatgattttgatgctagtgaccttggcacttcaagcttccctgtatctgctattcacaggattggtattcttgacatccgtatcttcaacactgatagacatgctggaaatcttctggtaaaaaagatgacaggaacaggtcaattcgggaatcagactgagctgattcctattgaccatggtctctgcctgccagagtgtttagaggatccttattttgaatggattcactggccgcaggcgtcaattccattctctgaggatgagcttgagtacatagggaaacttgatccagtgaaagatgctgatatgcttcgtatggagctgcctatgatccgggaagcatgcctccgtgtgctagtcctctcaaccatatttctgaaagaaggcacattatttggtctttgccttgcagagattggtgagatgatgagcagagaatttaacgggatggaagatcagccaagtcagctggaggttgtctgcatggaggcaaggaggctagcaactgaacgtgaagaatgttccacagaacatgattctgcagatgaagatgtgacccaatttgaacttgactgtgaagatcatgaaatggcaaaaacgccaccagcctaccatcttgagtttaaggggggaagctccagaaacccgctctctaaattggacgaggccattgaagaagaggaggatgacacccaggaagaggaagaaagcaatgcagaaaagttagcttgccccaagcctgtcaataagtggcttcctaacatttccaagctatcaacctcactgagcagtgtcagtctcatggaaaaaagccagcgtcagctgcctgccattcccaagggtgcggattctgcaaaaacctctgagaacaaccaagttggtaactggaggagcgcgaatgaacagctcccaacgagcgcaagctttgtgaagctggccgacatgggtgtggagacatggggcctgttcctcgagaagttccaggagctgctccctggtgcattccgcgcgcacaagctcggcgccactgggcaaagggggaggctgaggctgggcacttcttgccagttttgagttagtggaggagtagagaagtcgtttggctgctgctgtttgctgtggctttcttttaggtgtcaaggtatgcggtctgtcgtcgaataaagccatcctttacaaatagggtttgagcgttgaatatgcctgcttcagaggtccatgttcagatggtggccttttctgtacatagttttcctttttctttcttttcttttcttttctagctagttgcttggaggaaagttgggatgtgatgtctgcccagttcttggccacccaattcctccatgcattatatgcattcaaaggtgttatttcattcaaataaaatagacattcaagaaaaagtttctggtctagtgattaaacattgtctagatttcagagtaatgttatatttcaacttcaaa

SEQ ID NO: 5532 - DNA, 2126 bp, Secale cereale
gccttgagcagctctctgatcggtgattaccctaccaaaactagaagtgaggggagggctgttggatggaaacgtgttttcgtccagacggacactgggtttgtactgcctgttcaactagatcgtggtgacagtgtacacacagtcaaaagaaagctgcaggtggccctcaatgttcccactgaggagagttctctgacactcggtgatcgtgtcctcaagaatgatctcagcagcatccgaaacgattccccactgctcctgaccaagaccttcatgcatcggagttcctccagcccatgcctgtctcctacaagcaaggatctccagcagcaaagggataggggtggtccaattccaattgaagttttagtatgtccaacccgctgctttgaagcaaagcagcttgttaaggatgtttctaggggcataagaaacggtgtggatccaatacttgtcagtagtgggcttggtggtgcctactatttcaagaacagcaaaggcgagaatgctgccattgtgaagccaaatgatgaggagccatttgcacccaacaatccaaaaggttttactgggagagcccttgggcagccaggcctcaaaagatcagttcgagttggtgagaccggttttagagaggttgctgcataccttctggactatgataactttgctaatcgtccccccgacagttcttgttaagatttcacatcctgtatttaatgtgaatgaaggcgtcggctctaccaacaagaaggcttctgtgggtgatccgcgaactgtcagcaagattgcctcatttcagcagttcgctcctcatgattttgatgctagtgaccttggcacttcaagcttccctgtgtctgctattcacaggattggtattcttgacatccgaatcttcaacactgatagacatgctggaaatcttctggtaagaaaggtgacaggagcagatcaattcgaaaacctgactgagctgattcctattgaccatggtctctgcctaccagagtgtttagaggatccttattttgaatggattcactggccgcaggcatcaatcccattctctgaggatgagcttgagtacatagggaaacttgatccagtgaaagatgctgagatgcttcgtatggagctgcctatgatccgggaagcatgcctccgtgtgctagtcctctcaaccatatttctgaaagaaggcacattatttggtctttgccttgcggagattggtgagatgatgagcagagaatttaacgggatggatgatcagccaagtcagctagaggttgtctgcatggaggcaaggaggctagcaactgaacgagaagaatgttccacagaacatgattctgcagatgaagatgtgacccaatttgaacttgactgtgaagatcatgaaatgccaaaaacaccaccagcctaccattttgaatttaagggaggaagctccagaaaccctctgtctaaactggacgaggccattgaagaagaggaagatgacattcagggggaggaagaaagcaatgcagaaaagttagcttgccccaagcctgtcaatgagtggcttcctaacatttccaagctatcaacctcactcagcagtgtcagtctcatggataaaagccagcgtcagctgcctgctattccaaagggtgtggattctgcaaaaacctctgagaacaaccaagttggtaactggaggaccgcgaatgaacagctcccaacaagcgcaagctttgtgaagctggccgacatgggtgtggagacatggggcctgttccttgagaagttccaggagctgctccctggtgcattccgcgcgcacaagcttggcgccaccgggcagagggggtggctgaggatgggtacttcttgtcagttttgagttagtgcaggaggtagagaagtcagtttggctgctgctgtttgctgtggccttcttttaggtgtcaaggtctgcggtcggtcgtcgaataaagccatcctttacaatgggcttcagaggtccatgttcagatgatggcctttcctgtacatagttttccttcttctttttcttcttttcttttctagctagttgcctggaggaggttgggatgtgatgtctgcccagttct

SEQ ID NO: 5533 - DNA, 2400 bp, Lolium multiflorum
cgcactctgcacgaacgcgcacgcacggaggcaccgggagagcgagcgcggcgagcactcggagtcaggaaggcggcggcggggcgtcgtgccggggagcgggaggcaggccctggtgacgcgccggacgccggagggaagacaggggcggctgcggcgcacccgccagatctgcggccccgccggcggcgggccgccatttccgaggctccgcattggttcaggcacgcgccagcgctcgttccaccgtttcctctgggatctagctgtctaaaggctgggcttatcggttttgcaatagcttcccactgtaggggagatcactgctgccttaaccttccttaggtgtctttgctgctctatatctaatgcggaagatgtcactcgttgcctgatgattgctactgtctcgcactcgaccactgcggcatctgcagagtttgacaggcacaagggagtggactggagtaagaagggtgccatcgttgcagctgcctctagtgtgttggcctcaattcctttgctgtcagccatgtctcgcaacttggagggcccagtccagacccagatggcagtttcagccttgagcagctctctgattggtgaccctagcaaaactagaagcgacgtgagggctgttggatggaagcgtgtttttgtccagactgacactggctttgtactggctgttcagctagatcgtggtgacaatgcacacaccgtcaaaaggaagctgcagctggctctgaatgttcccactgaggagagctctctcacatttggtgatcatgtcctgaagaacgatctcagcagcgtccgaaatgactccccactgcttctgaccaagaccttcatgcatcggagttcctccaccccatgcctgtctcctacaagcaaggatctccagcagcaaagggataggagtggtccaatcgaagttctagtatgtccaagccgctgctctcgggcaaagcagcttgttaaggatgttgctagggccataagaaatggtgtcgatccaacacctgtcaatagtgggcttggtggtgcctactatttcaggaacagcaaaggtgagaatgctgccattgtgaagccaaatgacgaggagccatttgcacccaacaatccaaaaggttttacggggagagcccttgggcagccaggcctcaaaaggtcagttcgagttggtgagactggttttagagaggttgcagcataccttctggactatggtaactttgctaatgtccccccgacagttcttgttaagatttcacatcctgtattcaatgtgaatgaaagtgtaagctctaccaacaagaaggcttctctgggtgctgcacgagctgttagcaagattgcctcacttcagcagtttgctcctcatgattttgatgctagtgaccttggcacttcaagcttccctgtatctgcagttcacaggattggtattcttgacatccgaatcttcaacactgatagacacggtggaaatattctggtaaggaaggtgactggagcaggaaaattcgggaatgagactgagctgattcctattgaccatggtctctgcctcccagagtgtttagaagatccttattttgagtggattcactggccgcaagcgtcaatccccttctctgaggatgagcttgagtacatagcaaatcttgatccagtgaaagatgctgacatgctccgcgcggagcttcccatgatccgggaagcatgcctccgagtgctaatcctctcaaccatatttctgaaagaaggcgcatcatttggtctttgccttgcggagattggtgagatgatgagcagagaatttaccagggtggatgaccagccaagtgagttagaggttgtctgtatggaggcaaggaggctagcagcagaacgagaagaatgttccacagaacatgattctggtgatgaggatataactcaatttgaacttgatagtgaagatgatcatgaaatacataaaacaccatctgcctaccattttgaatttaagggtgggagctccagaaacccgctttcaaaattgaatgaggccattgaagaggaggaagatgacattgaggaggaagaaagcagtgcagaaaagttagcttgccccaagcctgtcaataagtggcttcctaacatttccaagctatcgacctcactgagtggtgtcagcctcatggagaaaagccagcgtcaactgcctgctgttccaaagggtgcagattctgtgaaaacttctgagagcaacaaccgtactggccctcaagttggtaactggaggagcgcgaacgagcagctcccgacgagtgcaagctttgtgaagctggctgacatgggtgtggagacatggggcatgttcctcgagaagttccaggagctgctccc

SEQ ID NO: 5534 - DNA, 2867 bp, Brachypodium distachyon
taaccccactatagaacccatctcccctctccggccctcagtatcgcgcaccacccctcccctctcacgcgctcgcgcacccacaagcaagcacgcacgaggagagcgagaggagaagcaggggcgaggttctcagtaggcagaggttgcggggtgttgtgttggggagggagtcggaggtagtgccgccgcgccggtcgccagggaagcacaggcggctgaggcgcacctgccagatctgcggccccgccggcggcgggccgccatctccgaggctcggcattggatcaggatctacttatccaaaggttgggcttatcggggttttgtaacggattccaattgtaggggaggttactgctgccttagccttccttatttgttgctttctagctaatgtggaagatgtcattctttgcctgatgattgctactgtgacacttgtctcacactctggcaccacattggctgcaaaatttgttgggcacacgagaaaggactggagtgagaagggcataattgggcagctgcctctagtgcattgaccctatttcctttctcctctaccatgcctcgcaatttggagagcccagtccagacccagatggcagtttcagccttgaaaagctctctgattggtgattactctgacaaaactagaagtgaaggaaggggtggtggatggaaacgtgttttcgtccaaaccgatactggttttgtactggctgttcaactagatcgtggtgacaatgcacacaccgtgaaaagaaagctgcagctagccctcaatgtgcccactggggaaagttctctgacatttggtgatcatgtccttaagaatgacctcagcaatgtacggaatgattctccactgcttctgaccaagaacttcatgcataggagttcctccaccccatgcctgtctcctacaagcaaggatctccagcagcaaagagataagggtggtccaattgaagttttagtatgcccaagccgctgctttcggacaaagcagcttgttaaggatgttggtagggccataagaaacggtgtggatccaatacctgtcaatagtgggcttggtggtgcctactatttcaggaactgtaaaggtgagaatgctgcaattgtgaagccaaatgatgaggagccatttgcgcccaacaaccctaaaggttttacagggagagcccttgggcagccaggcctcaaaagatcagttcgagtcggtgagactggctatagagaggttgctgcataccttctggactatgataattttgctaatgtccctcccacagttcttgtgaagattgcacatcctgtatttaatgtgaatgaaggtgtcaggtctaccaaaaagaaggtttccgggggtgatccacaagctgttagcaagattgcctcatttcagcagtttgctccccatgattttgatgctagtgaccttggcacctcaggttttcctgtatcttctgttcataggattggcattcttgacatcagaatcttcaacactgatagacatgccgggaatcttctggtaaggaacctgactggagcagggaaatttgggaatcaaactgagctgatacctattgaccatggtctctgcctcccagagtgcttagaggatccttattttgaatggattcactggccacaggcgtcaatcccattctctgaggatgagctcaagtacatagcagatcttgatccagttaaagatgctgacatgcttcgtatggagctgcctatgatccgtgaagcatgtctccgagtgctaatgctctcgaccatatttctgaaagaagccacatcatttggtctttgtcttgcggagattggtgagatgatgagcagagaatttactggggcggaagatcagccaagtgagctagaggttgtctgtatggaggcaaggaggctagcaacagaacgagaagaatgttcaacagaaaatgaatctggagatgaagatgtaactcaatttcaacttgattatgaagatcatcatgaaatgccaaaaggaccatcggcgtaccattttggatttaaggggggaagctgcagaaacccactgtctaaattggatgaggccattgaagaagaggaagatgacactgaggctgaggaggaagaaagcaatgcagaaaagttagcttgccctaaacctgtcaataagtggcaacctaacattttgaagctatcaacctcgctgagcagtttcagtctcactgacaaaagccagcgtcaactgcctgctgttccgaagggtactgatcctggtaactggaggagcgcaaatgaacagctcccaacaagtgcaagctttgtcaagctagccgacatgggcatggagacatgggggctattccttgagaagttccatgagctgctccctggcgcattcaactcgcgcaagtgtggcgccacagggcaaagggcgaagcagaggctgggaacctcttgccagttttgagttagttcaggagtagttcgtgcaataaaaccatcctttgcaggctcgcaataggatcattgagcgcgtgacagcatcagaggtccatgttgagttgatgcctttctgtacaaagtttttttttctgttcttttcttttctagctagtagctgggaagagtttgggatgtgatgcctgcccagttcttggccacccaactcttcccattcatcatatgcattcaaaggcttctttcacatagacattcaacaaagtttctggtgtggtaattaaacattgtccagacttcagagtaatgttatagctcaacttgaaagggttttattttgtttgttcggttggtcattttgcatgttatatgtactgaacctgtggtcacagata

SEQ ID NO: 5535 - DNA, 2903 bp, Brachypodium distachyon
taaccccactatagaacccatctcccctctccggccctcagtatcgcgcaccacccctcccctctcacgcgctcgcgcacccacaagcaagcacgcacgaggagagcgagaggagaagcaggggcgaggttctcagtaggcagaggttgcggggtgttgtgttggggagggagtcggaggtagtgccgccgcgccggtcgccagggaagcacaggcggctgaggcgcacctgccagatctgcggccccgccggcggcgggccgccatctccgaggctcggcattggatcaggatctacttatccaaaggttgggcttatcggggttttgtaacggattccaattgtaggggaggttactgctgccttagccttccttatttgttgctttctagctaatgtggaagatgtcattctttgcctgatgattgctactgtgacacttgtctcacactctggcaccacattggctgcaaaatttgttgggcacacgagaaaggactggagtgagaagggcataattgggcagctgcctctagtgcattgaccctatttcctttctcctctaccatgcctcgcaatttggagagcccagtccagacccagatggcagtttcagccttgaaaagctctctgattggtgattactctgacaaaactagaagtgaaggaaggggtggtggatggaaacgtgttttcgtccaaaccgatactggttttgtactggctgttcaactagatcgtggtgacaatgcacacaccgtgaaaagaaagctgcagctagccctcaatgtgcccactggggaaagttctctgacatttggtgatcatgtccttaagaatgacctcagcaatgtacggaatgattctccactgcttctgaccaagaacttcatgcataggagttcctccaccccatgcctgtctcctacaagcaaggatctccagcagcaaagagataagggtggtccaattgaagttttagtatgcccaagccgctgctttcggacaaagcagcttgttaaggatgttggtagggccataagaaacggtgtggatccaatacctgtcaatagtgggcttggtggtgcctactatttcaggaactgtaaaggtgagaatgctgcaattgtgaagccaaatgatgaggagccatttgcgcccaacaaccctaaaggttttacagggagagcccttgggcagccaggcctcaaaagatcagttcgagtcggtgagactggctatagagaggttgctgcataccttctggactatgataattttgctaatgtccctcccacagttcttgtgaagattgcacatcctgtatttaatgtgaatgaaggtgtcaggtctaccaaaaagaaggtttccgggggtgatccacaagctgttagcaagattgcctcatttcagcagtttgctccccatgattttgatgctagtgaccttggcacctcaggttttcctgtatcttctgttcataggattggcattcttgacatcagaatcttcaacactgatagacatgccgggaatcttctggtaaggaacctgactggagcagggaaatttgggaatcaaactgagctgatacctattgaccatggtctctgcctcccagagtgcttagaggatccttattttgaatggattcactggccacaggcgtcaatcccattctctgaggatgagctcaagtacatagcagatcttgatccagttaaagatgctgacatgcttcgtatggagctgcctatgatccgtgaagcatgtctccgagtgctaatgctctcgaccatatttctgaaagaagccacatcatttggtctttgtcttgcggagattggtgagatgatgagcagagaatttactggggcggaagatcagccaagtgagctagaggttgtctgtatggaggcaaggaggctagcaacagaacgagaagaatgttcaacagaaaatgaatctggagatgaagatgtaactcaatttcaacttgattatgaagatcatcatgaaatgccaaaaggaccatcggcgtaccattttggatttaaggggggaagctgcagaaacccactgtctaaattggatgaggccattgaagaagaggaagatgacactgaggctgaggaggaagaaagcaatgcagaaaagttagcttgccctaaacctgtcaataagtggcaacctaacattttgaagctatcaacctcgctgagcagtttcagtctcactgacaaaagccagcgtcaactgcctgctgttccgaagggtactgatcctggtaactggaggagcgcaaatgaacagctcccaacaagtgcaagctttgtcaagctagccgacatgggcatggagacatgggggctattccttgagaagttccatgagctgctccctggcgcattcaactcgcgcaagtgtggcgccacagggcaaagggcgaagcagaggctgggaacctcttgccagttttgagttagttcaggagtagttcgtgcaataaaaccatcctttgcaggctcgcaataggatcattgagcgcgtgacagcatcagaggtccatgttgagttgatgcctttctgtacaaagtttttttttctgttcttttcttttctagctagtagctgggaagagtttgggatgtgatgcctgcccagttcttggccacccaactcttcccattcatcatatgcattcaaaggcttctttcacatagacattcaacaaagtttctggtgtggtaattaaacattgtccagacttcagagtaatgttatagctcaacttgaaagggttttattttgtttgttcggttggtcattttgcatgttatatgtactgaacctgtggtcacagatactccagtggctctttattgattcagttaaaacctct

SEQ ID NO: 5536 - DNA, 3223 bp, Oryza sativa
tacttgagtagacagccaccacccacagcgcacgctcgctctcgctcacgcacgcacgcacgcacccacccggagcgcgagaggacggcggcgagcggcgaggaggaggcggggaggtgggagcgagctcgctagcttaggcggagggcggcggcggcggcggcctgccgtcggcgaagcgtgccgggggcgttcgctgcctgctgccggagcgggggaagggaagtgtggtgcggcggcggcgcgctcgccagatctgcggacccgccggcggcgggccgccattcccgtcgctcagcattggatcaggatccggttatctaccgaaattgagcttgttgggttttgtagcagctcccctttgtaggggaggttactgcagtcttcaactctctgatttgttgttgctttctggtgccctcgagctagtgttcaagatgtcctttgtcgcctgatgattgctgctgtgacatctctctcgcaccctagcaccgcgtcatctgccaagtttgacgggcgcaggagcgaagagaggcgtaagaagggcctcattgttgcagctgcctctagtgcattgacctccattcctttgtcattgttagccatgtctcgcaacttggagagcccagttcagacccagatggcagtttcagccttgaaccgtgctctgagcagcgagtacccttcgaaaagtagaagtgagggcagagctagtgggtggaagcgtatttttgtccaaactgacaccggctgtgtactggctgttcaattagatcgaggtgacaatgcacacacagtcaaaagaaagctgcagcttgccctgaatgttccaacagaagagagttctctgacatttggtgatcgtgtgcttaagaatgatctcagcactatccggaatgattctccattgcttctgaccaagactttcatgcatcgaagctcctccaccccatgcttgtctcctactggcaaggatatccagcagcaaagggataggggtggtccaattgagttgttagtatgcccaagccgttgttctcggactaagcagcttgtgaaggatgttgctagggctataagaaatggtgtggatccaatacctgtcaatagtgggcttggtggtgcctactatttcagaaacagcaaaggtgagaatgctgccattgtgaagccaaatgacgaggagccatttgcacccaacaatccaaaaggttttacagggaaagcccttgggcagcctggccttaaaagatcggttcgagttggtgagactggttttagagaggttgctgcctaccttctggattatgataactctgctaatgttcccccaacggttcttgttaagatctctcatcctgtatttaatgtgaatgaatgcgtcagttcagccaacatgaaggcttctaaggactatccaggggctgtaagcaagattgcatcatttcagcagttcattcctcatgattttgatgccagtgaccatgggacttcaagctttcctgtctctgctgttcataggattggtattcttgacattagaattttcaacaccgataggcatgctggaaatcttctggtcaggaagcttactggaccaggaaaatttgggaatcagactgaactgatccctattgatcatggtctctgcctcccagagtgcttggaggatccttattttgaatggatccattggccacaggcgtccattccattctctgatgatgaacttgattacatagctaatcttgatccgatgaaagatgctgacatgcttcgtatggagcttcctatgatccgtgaagcatgccttagagtgctaatactctccaccatatttctgaaagaagccacatcatttggtctttgccttgcagagattggtgagatgatgagcagggaatttaccgggatggaagatcagccaagtgagttagaggttgtctgtatggaagcaaggaggctggcaattgaacgtgaagagagctccactgaaattgattctggtgatgaggatgcaactcaatttgaacttgattgtgaagatgatcatgaaatgctgaaagcacaaccagcctatcattttgaacttaaggggggaagctcaagaaacccactgtctaaactggatgaagccattgaagaagaggaagatgacattgaggaggaagaaagcaatgcagaaaagttaggttaccctaaagctatcaacaagtggcttcctaacatttccaagctatcaacctcactgaatggagtgcgtctcggcgacaaaatccagtgtcagctccccgctgctccaaagataatggatcctgtgaaaattttcgagggcaacagcaaccacagtggctcccaggttggcaactggaggagtgcaaacgagcaacttccgacgagtgcgagcttcgtcaagctggccgacatgggatcggagacatgggcgctattcctcgagaagttccaggagctccttcccgaggcattccgctcgcgcaagtgcggcgccgcggggcaaagggcaaggcagaggcttggcacttcttgccagttttgagttagcgcaggagtaggggaggtgaagaatacttgtggtttggctgctgctgtttggttgtggctttcttgcaggtgttcgagctatgcagctgtagaataaaagccatccttttacaggcttgcaatagggtttgagcaacaactgctatcgcctgtgccagaggtccatgttgtgatgatggccttttttctgtacataatctttttattttcttcttttttttcttttctagttagacatgagttgcttgaaggaagttgggatgatcagcctgcccagtcattggccgcccagttcttccactcatgatatgcattcaaagatgtcattcaaataaaacattaaaaaaaaagggtttcctgatgtgatcattgaacatttgttcagtcttcagagtactctactgttaaagctcgacttgcagggttttttgttgtgttctccatgtcatgttgtgtatactgaataaacccccttgtggtcacacagatgtatcagtggtttactgatgcagttttactctcagtctgctgttcatgctgctgggattcttggaatcaacttccttttcatatggtactatacaagtttgatgctctcatgaattgcatctgaaaatatggctaattaactgcagcctaatgtcttcctgtcagcctgcgt

SEQ ID NO: 5537 - DNA, 2648 bp, Sorghum bicolor
ccccccacccccgcgcccggccccggtggccgctgtctgatgatggcgtgtccggtgctctgctccgtgctcccgctcccgcacggccacgggccacgggccacggccacggcgaagccccagcccgtgacaggatgacagcaacgccgcaccgtcgcggggatacgaaatttcgcgagccctggcgccttgtggcggcgcggtggaccacgcgagacagcccgcacgaggggcggtcgtgtccagcacgtgcgtgcaacagccgttccacccggttcggctaggctacgagaaaaaaaaaacacaacaagcaaagggcaggtgcatgtcctcctcgcaaaaaaaaggtgcacatctccgttggttattcaactccctgatcggtagcctcaagctgaagctccatggaaatggggccaagaatacgacaccaacagtcgagatgtgcaggtgcacgaatccaagccctctggatgcctatataaggtcctcagcacccaccacgcatcaccacacacttacaatcacaagtattccagataagcacggtccgtccgaggagaatggctccaccgatatccgccgatgccttggtggtggaggctgcctcggccatcgccgcgtccccagccatcgcgccgaacggaatggtttcccgcaaggacgtggcggcggcggcggcgccggccatctctgtcgtctcgaagcagacggttcggcctgccgcgggcgcgtcggcgccggtcgtcggaggagacctcaggctctcggtgtccgacatgccgatgctatcgtgccactacatccagaaggggctgttcttcccgcctccgcctcccagcgtgctcacgacgacggcctcgctggtgtcgtcgctcgtgacggcgctctcccgcgcgctcggcgtcttcccggcgctcgccggccgcctcgtcacgctccacgacgacagcatcgtgatacggtgcggcggcggaggcgacgacgcggacgcggccgtcgagttctaccacgccgtcgcgccgtccctgtcgcttggcgacttcctagtgcccggcgccgacgtgccgacgagtctcacgaatgcgctgttccccatggaccggacggtgagctacggcggccacgcgcgcccgctctcgtcgttccagctcaccgagctcggcgacggcgccgtgttcgtcggcttcgtcgccaaccacgccgtcgtggatggcacctccttctggcacttcttcaacacgtgggcggggctgtgccgcggcggcggcgcgccgatccgggagcccgatttccgccgcaacttctttggcgaatccaccgccgtcctacgcttccccggaggcgtgggcccggccgtcacgttcgactccgaggcgccgctgcgcgaacgaattctccacttcagtgctgccgcgatccgggagctgaaggcgacggcgaaccactcgaaaagaacaggtcatcaagacgccgaggctaacggcaagctcgcacatgacgactccaaactcctccatgggcgttgttccggtgaaatctcatcgttccaatcgctgtgcgcgcacatctggagggccgtgacgcgcgcgcggcggctgctggcggccgacaagacgacgacgttccgtatggccgtgaactgccggcaccgcctgcgcccggcgatctccccgctctacttcggcaacgcgatccagagcgtggcgacgacggcgaccgtggccgagctggcgtccaacgacctgggctgggcggcggcgcggctgcacgccaccgtgacgtcgcacgaggacggcgcgatccggcgcgccgcggcggagtgggaggccgcgccccgttgcttcccgctgggcaaccccgacggcgcggcgctcaccatggggagctcgcctcggttcccgatgtacgacgggaacgacttcgggtggggccgcgcgctcgccgtgcggagcggacgcgcgaacaagttcgacggcaagatgtccgcgttccccggccaggcgggggacgggagcgtcgacgtggaggtgtgcctcgcgccagacaccatggctcgtctcctcctcgacgaggagttcttgcagtacgtgtcctcccctgcaccgtgatacggtgacagagagaaagcgtctgatgtgtgccatgttgctgcgcagctcctggatttgtacccttccagaagacatcaagtgtttgtcagcttgaatgagagtttgagtgaccatgtagagatgctgttctgctgtttccttcgtgatgatgccgttgtaggctagcagcactagttatggcctccgagcagcggtgcaaaaacggttatgataggcggatatggtttttaggtccgtttagaacgtggattttttcttttttgagtcaaggatttctcatgttaaactcatgttaaattaagttgtattcttgtgaaatagacaaggacagtgatagatacttgtatattttttctctcccttatcctatgcacgggggtcgcacacgacattttagttgggcaaacatgtgttcactttgactcataagtcatagcaggatgtactgttcgctgatttattaagagagagaaatactgctaaatgattggcagattcggctaataaattcaagcgggttcaaatgaaaagcag

SEQ ID NO: 5538 - DNA, 1877 bp, Setaria italica
actacaaattgctccagataagcgcggtccgaggatggctccaccgatacccgccgccgatgccgtggtggaggctgcctcggccgtcggcgcggccccggccatcgcgccgaacggaatggcccgcaaggacgtgccggcgccgccgccgatctccgtcgtctcgaagcagacggttcggccggccggcacatcggcggttggagacctcaggctctcggtctcggacatgcccatgctttcgtgccactacatccagaaggggctcttcttccggcctcccggcgtggtgatggcctcgctggtgccgtcgctcgtcgcggcgctctcacgcgcgctcggtgtcttccctgccctcgccggccggctcgtcacgctcgacgacgacagcatcgtgatccgctgcggcggcgacgcggccgtcgagttctaccacgccgtcgcgccggctctgtcgctcggcgactttctcgtgcccggcgccgacgttccgatcaggctcacgaacggcctgttccctatggaccggacggtgagctacggcggccacggccgccctctcacgtcgttccagctcaccgtgctcggcgacggcgccgtgttcgtcggcttcgtcgccaaccacgccgtcgttgacggcacctccttttggcacttcttcaacacgtgggcggggctgtgccgcggcgcgccggtccgggagccagacttccgccgcaacttctttggcgactccaccgccgtcctgcgcttccccggcggcgtgggcccggccgtgacgttcgacgccgaggcgcccctccgcgagcgaatcctccacttcagtgccgccgcgattcgcgagctgaaggcgacagccaaccgctggaaaagaaccggtcaagactccgaggttaacggcaaggtcacgcacgactccaaggttcagtgcgggtgccgcgaaatctcgtcgttccagtcgttgtgcgcgcacgtatggagggcggtgacacgcgcgcgccggctgttggcggccgacaagacgacgacgttccgcatggccgtgaactgccggcaccgcctgcgcccggcgatctccccgctctacttcggcaacgccatccagagcgtggcgacgaaggcgaccgtggccgagctagcgtccaacgacctgggctgggcggcggccaagctgcacgcgaccgtggcggcgcacgaggacggcgcgatccggctggcggcggcggagtgggaggcagcgccacggtgcttcccgctgggcaaccccgacggcgcggcgctcacgatggggagctcgccacggttcccgatgtacgacgggaacgacttcgggtggggccgcgccctcgctgtgcggagcggccgcgcgaacaaattcgacggcaagatgtcggcgttcccgggccaggctggggatggcagcgtcgacgtggaggtttgcctcgcgcctgacaccatggcttgcctcctccgcgacgaggcgttcttgcagtacgtgacagagtgaagcatctgatgtgcgacatgcttgttgccgcgcagctccaccgttactggatttgcacgctttcaaaagatatcaagtgcttgtgagttgtggccttgtagttgtagagatgtcgtactgctggttccttcgtgatgccgttgtaggctagtacttggtgacttgtgtttgtgagtagggtgcaaactaggatgatgtacggatgcattcactactccctccgtttcaaattgtaggtcgttttgatttttctaggttcattattctccaacactcccccttacgtgcagtctcatttagggcgtatacgtggaaattggagtgggctgcaattatttttttaaccgcccccgacatgatttgaactcaa

SEQ ID NO: 5539 - DNA, 1872 bp, Setaria italica
caaattgctccagataagcgcggtccgaggatggctccaccgatacccgccgccgatgccgtggtggaggctgcctcggccgtcggcgcggccccggccatcgcgccgaacggaatggcccgcaaggacgtgccggcgccgccgccgatctccgtcgtctcgaagcagacggttcggccggccggcacatcggcggttggagacctcaggctctcggtctcggacatgcccatgctttcgtgccactacatccagaaggggctcttcttccggcctcccggcgtggtgatggcctcgctggtgccgtcgctcgtcgcggcgctctcacgcgcgctcggtgtcttccctgccctcgccggccggctcgtcacgctcgacgacgacagcatcgtgatccgctgcggcggcgacgcggccgtcgagttctaccacgccgtcgcgccggctctgtcgctcggcgactttctcgtgcccggcgccgacgttccgatcaggctcacgaacggcctgttccctatggaccggacggtgagctacggcggccacggccgccctctcacgtcgttccagctcaccgtgctcggcgacggcgccgtgttcgtcggcttcgtcgccaaccacgccgtcgttgacggcacctccttttggcacttcttcaacacgtgggcggggctgtgccgcggcgcgccggtccgggagccagacttccgccgcaacttctttggcgactccaccgccgtcctgcgcttccccggcggcgtgggcccggccgtgacgttcgacgccgaggcgcccctccgcgagcgaatcctccacttcagtgccgccgcgattcgcgagctgaaggcgacagccaaccgctggaaaagaaccggtcaagactccgaggttaacggcaaggtcacgcacgactccaaggttcagtgcgggtgccgcgaaatctcgtcgttccagtcgttgtgcgcgcacgtatggagggcggtgacacgcgcgcgccggctgttggcggccgacaagacgacgacgttccgcatggccgtgaactgccggcaccgcctgcgcccggcgatctccccgctctacttcggcaacgccatccagagcgtggcgacgaaggcgaccgtggccgagctagcgtccaacgacctgggctgggcggcggccaagctgcacgcgaccgtggcggcgcacgaggacggcgcgatccggctggcggcggcggagtgggaggcagcgccacggtgcttcccgctgggcaaccccgacggcgcggcgctcacgatggggagctcgccacggttcccgatgtacgacgggaacgacttcgggtggggccgcgccctcgctgtgcggagcggccgcgcgaacaaattcgacggcaagatgtcggcgttcccgggccaggctggggatggcagcgtcgacgtggaggtttgcctcgcgcctgacaccatggcttgcctcctccgcgacgaggcgttcttgcagtacgtgacagagtgaagcatctgatgtgcgacatgcttgttgccgcgcagctccaccgttactggatttgcacgctttcaaaagatatcaagtgcttgtgagttgtggccttgtagttgtagagatgtcgtactgctggttccttcgtgatgccgttgtaggctagtacttggtgacttgtgtttgtgagtagggtgcaaactaggatgatgtacggatgcattcactactccctccgtttcaaattgtaggtcgttttgatttttctaggttcattattctccaacactcccccttacgtgcagtctcatttagggcgtatacgtggaaattggagtgggctgcaattatttttttaaccgcccccgacatgatttgaactca

SEQ ID NO: 5540 - DNA, 2170 bp, Panicum virgatum
ttctggttggcttcgctgctccgtcgtcgggtaaagcttcaacttctctatcatccatcgggtagcctgaccagaaaactgaagctccacggaaatgggcccgagaacacgacacgaccagtcgattatgcgcaggtgcacgaatcccagctctccggatgcctatatataatgtcctcactcagcaccaccacacaccgcaatcggctccagataagcgccgtccgaggatggctccaccggtacccgccgacgccgtggtgcaggccgcctcggccgtcgccgagaacggaatggctcgcaaggacgccccggcgccggcgatctccgtcgtctcgaggcagacggttcggccggccgccggcgcctcgccggtcggggacctcaggctctcggtctcggacatgcccatgctgtcgtgccactacatccagaaggggctcttcttcccgcctcccggcgtggccatggccccgctggtggcggcgctagcggcggcgctctcccgcgcgctcggcgtcttccccgccctcgccggccggctcgtcacgctcgacgacggcagcatcgtgatccggtgcggcggcgacggcgcggccgtcgagttccaccacgcggtcgcgccggctctgtcgctcggcgacttcctcgtgcccggcgccgacgtgcccaccaggctcaccaacggcctgttccccatggaccgcacggtcagctacggcggccacgcccgcccgctcacgtcgttccagctcaccgtgctcggcgacggcgccgtgtttgtcggcttcgtcgccaaccacgccgtcgtcgacggcacctccttctggcacttcttcaacacgtgggcggggctgtgccgcggcgcgccggtccgcgagccggacttccgccgcaacttcttcggcgagtccaccgccgtcctgcgcttcccctgcggcgggggcccggccgtgacgttcgacgccgatgcgcccctccgcgagcgaatcctccacttcagcgccgccgcgattcgcgagctgaaggcgacggccaaccgctggaaagggacaggtcaagactccgaggttaacggcaaggccacgcatgactccaaggttcagggtggtcgcggccaaatctcgtcgttccagtccttgtgcgcgcacatatggagggcggtgacgcgcgcgcgccggctgctggctgccgacaagacgaccacgttccgcctggccgtgaactgccgccaccgtctgcacccgccgatctccccgctctacttcggcaacgccatccagagcgtggccacgacggcgaccgtggccgagctggcgtccaacgacctgggctgggcggcggccaagctgcacgccaccgtggcggcgcacgaggacggcgcgatccggcgcgccgcggccgagtgggaggccgcgccgcggtgcttcccgctgggcaaccccgacggcgcggcgctcacgatggggagctcgcctcggttccccatgtacgacgggaacgacttcgggtggggccgcgcgctcgccgtgcggagcggccgcgcgaacaagttcgacggcaagatgtcggcgttcccaggccaggccggggatggcagcgtcgacgtggaggtgtgcctcgcgccggacaccatggcttgcctcctccgcgacgaggcgttcttgcagtttgtgtccacccctgcaccgtgacagagtgaagcatctgatgggcggcatctgatggggatggtagtgcttgctactattttaaaggattgggagtgaccatgtgtccatatagagatgatgtgctcctgctggttccttcgtgaagcgatgtacgctagtgtggttatgactttgtgaatctgtttagatactggaaaaaagatgaacgttccggcttcatccttctcgggaggaaaaataagaccacactacaatttgtagcatctggtactcaagcaccaacacatagcaccaaaaaaggtcccaacgtaaaatcgattctaaaagaaaataggcatccatataactcaaagaaacgcatttagttgacattttgtccttacaatatttattgttcaataaaaatatttagtttaaaaacatttggtaaacatttgtcttgaatatgtaaaatttgaatccgcaaatcgccttggttctttgcctagtgcaactgt

SEQ ID NO: 5541 - DNA, 3312 bp, Panicum virgatum
cggacggtggggatcgccgacctgcgtgtccgtcgagttggtggcggtctgatgcagccttgccggggtacggtacacatgggtggggcagctagcaacctagcatcccctgcgccctggtgccgcggggggtccctgcaaacgtggtaggacacgggcgtaggagcagggagggatggaggattgggtcggtacggaggcaaggcacggcatcggatggtcctccagcctccaggaacacgtatcgtagaggacagaggtggtatctggtctctggtgtggccgtggggagaacggagtggactggcggagggaggcaagcagcaaatggctgcgctggcagtagcttgggctcatacggggtaaatggaactaaagtactgggcttcatgccagaatccctttaggcccatggttgctttcgtttcttaagagtgggccctggtttcaactcaggcccgcattcactacgcttgctgggcccatcaacttgacaagttgatcagattggcagccacggacggcccgatgggacaacgacgacgcaggtgtgctagcccgtcgcgcggcgcggcgcgtcggtgttgctcccggccgacgccccgtcgctaccgcgcggcggcagggcggcgtgcggcaccatgccgcctacagcgtaccgtccacgaggccaccgaacccccgacgcgagaggctgtggctccgccgcttccacgccgcgcccgcggcgaactggggcctcgggggccatgtgcgccgccagaccgccacccgccgcgaacctcggccgcgcgtgggcgctgccccccggcccggcccgggtggccgctgtagtgtccggtgccccctccccactcccgtgcggccacggccagcccgtgacaggctgacagcaacgccgcaccgccgcggggatacgaattttggcggcttgcggcggcggcggtggaccacgcgacaggccgcacgagggccggtcgcgcccagcacgtgcgcgccacggccacccgtcggagcacgagcaccacccccgacccctgttcggcccacgagacaggagcacggcgggacaggcaggccctgggagactgatgcctgtgtcttggttggcttcgctgctccgtcgtcgggtcgggtaagcttcaacttctctatcatccatcgggtagccggaaaactgaagctccacggaaatgggcccaagaacacgacacgaccagtcgattatgcgcaggtgcacgaatccaagctctccggatgcctatatataatgtcctcactccgcaccgtgcatcaccaccacacaccgcaatcgctgcagataagcgcggtccgaggatggctccaccggtacccgccgagaacgggatggctcgcaaggacgccctggcgccggcgatctccgtcgtctcgaagcagacggttcggccggccgccggcgcctcggcggtcggggacctcaggctctcggtctcggacatgcccatgctgtcgtgccactacatccagaaggggctcttcttcccgcctcccggcgtggcgatgggcccgctggtgtcgtcgctcgcggcggcgctctcccgcgcgctcggcgtcttccctgccctcgccggccggctcgtcacgctcgacgacggcagcatcgtgatccggtgcggcggcgacggcgcggccgtcgagttctgccacgcggtcgcgccggctctgtcgctcggcgacttcctcgtgccaggcgccgacgtgcccaccaggctcacgaacgccctgttccccatggaccggacggtgagctacggcagccacgcccgcccgctcacgtcgttccagctcaccgtgctccgcgacggcgccgtgttcgtcggcttcgtcgccaaccacgccatcgtggacggcacctccttctggcacttcttcaacacgtgggcggggctgtgccgcggcgcgccggtccgcgagccggacttccgccgcaacttctttggcgagtccaccgccgtcctgcgcttccccggcggcgggggcccggccgtgacgttcgacgccgatgcgcccctccgcgagcggatcctccacttcagtgccgccgcgatccgcgagctgaaggcgacggccaaccgctggaaaggaacaggtcaagactccgaggttaacggcaaggccacgcatgactccaaggttcagggtggccgcggccaaatctcgtcgttccagtcgttgtgcgcgcacatatggagggcggtgacgcgcgcgcgccggctgttggctgccgacaagatgacgacgttccgcatggccgtgaactgccgccaccgtctgcacccgccgatctccccgctctacttcggcaacgccatccagagcgtggccacgacggcgaccgtggccgagctggcgtccaacgacctgggctgggcggcggccaagctgcacgccaccgtggcggcgcacgaggacggcgcgatccggcgcgccgcggcggagtgggaggccgcgccgcggtgcttcccgctgggcaaccccgacggcgcggcgctcacgatggggagctcgccccggttccccatgtacgacgggaacgacttcgggtggggccgcgcgctcgccgtacggagcggccgcgcgaacaaattcgacggcaagatgtcggcgttcccgggccaggctggggatggaagcgtcgacgtggaggtgtgcctcgcgccggacaccatggcttgcctcctccgcgacgaggcgttcttgcagtttgtgtccacccctgcaccgtgacagagtgaaaaacatctgatgggcggcggcattttgccgcgcatgccaccgttcctggatggctggatttgtacgcttgcagaagatagtgcttgctactattttttaaggattgggagtggccatgtgttcatatatagatgatttgctgctggttccttcatgatgccgttgtaggctagtggttatgacttgtgaatatgtaaatctatatcgctcgaagaaagggagcccatccggcgctcggcgcgtccttgctgcacacctgttctccatgcgtcgctggcagccatccgtacttcgcgttggtcgtacgcgatgcgaggaacatgccgcgggagtcctccttgtccggtgagctaatcgtgtttgcctggttcatcttttttgcgccctctccctcccttctctctctccctcttccttcccccaccacgccgccactcttccgccaccggcttgccctcctcgagctccaccccgtcggcgcggaccacgaagctcgtggcggaggtcgaggacgcggcgcgaccccctcctcct

SEQ ID NO: 5542 - DNA, 8133 bp, Oryza sativa
ccggctccctctctccctcacatcgacaagtgggaccgtgggacccacctgtcaggtccatccccaacctccatccaagccagccggcaactgccgaagccgccatggacggccgttgccgcccacgtcgccgccgattccgggtcctcccgctcacgccctcgcgcccaaaccgcataaaatcgattcccctccacctcctctactgctctacactctccctacgtttcccccaaaaatcgtgccgggatagagctccacttcgcccacgatttcacccacgtcgccggccgttgccgcccaaatccgccacgcccggcaacggttttccctccccaagcatgtaaaatccatccccgggctcccttctctcgtttcccccccttgccggcgcttccctcgccttctcccgctctccccacgccgctccccatcgctgccgcttgccagcgaccttcagtcggccgctgccgccgcgctagtcgtcgccgcacctcgccgccggcaccggcggcttcactgcatcaagccccaccctggccgctgctctgctcctccaaaccaccacccaaacgccccctccccgtgcatccgagccgccaccacctctgccacgctccagccgcccgccacagccgctgtaaccaccaccgccacctgcagcttcgccgcaccgcgtagcaccccgtcctccactccttttacccctcgtcgccaccgaaacgccgccccactacaaaaccgagccaccgtcgcctccctcggctccgcaaggacgaggagaacctgggccatcccttcccatcgccagaaactcactggacgtccgttttcccgtgcgccgccgctgctcgtccactccgtcccgagcgccgcccgtcgccggagtgccgccgtctccctccgccctgagcttcgccggccgcctccctccatcgccataccccacgcgagtagattccgtcgtttcggaagtccacagtcttaaggataagagttcggaagattgttcgaagaagcaaggcaagtcacacattctccttgagtatattgagcctatttttttaatgttttaccgtttgcaaataaatatgcatgttttgctaattacatgggatcagggtttacctacctgctcgcttgtgccgtgtttacttgatgtatgtcctttgtcgaccttgggtgataaatcggctagctgttgttacttatgttgacatagctagaactatatgcttagccatgcttaattaccactagctcacttgatgggataattacaattttagacatctagtatcttgacgagttgtgtgctcgagacatctggccatggttcatggtcgtaattatccaactaaaatgcgactgaatggtgggctgtgggtgcatggttttgctagtcgcacccatgccaattaaggaccggttcacgggaaaccctaaaagacttacagtgcttaccacaagcgggagtgggtaactacttgatctgaagtatagctcgaccatttcctaggcaccggtggtgagggtgggcgtgatgaagttgggtcgaccggggtgtccggttgtccagctgccggattcaccacggtgcacgaggggactgcccacctccggggtagggggtgggggtgaaaccttagcgtggtgtggatggttaggggagggttatatgaagggtcttgtcacaatcactcgacatggtgacgtgtcaggcctgccgcgatgacatgctgatggattgtgtcttgtgggtacagttgtgcacctctggccagagtaaaactattcgaatagccgtgcccgcagttatgggcgatcgaccagattcaccgtgattagtcccacacttaataaattgacccaatgcacagtagttcaggtgggttggttcggcctgttcaatgtggtatagcattgttcagtggagatttaatattaccttaattactcaatcgttttactgttttgctcaataaaatgttttacaactgcctttatgcaaatagccacaagcctctccttgtatccccttgcacgtttgtatcgtaggtgtggcttgctgagtacggtggttgtactcagccttgttattatttcccccttttcagaagtgtagtgcttctgagctgaagacgaagttagaggaccaaggctcaaaccccagttgagttttgcctgtggagtggagctgaagccccgctaggataacctttttccgctgttgtcgttctcttttggtgtgaggacaaagtgcctcttctataagtattttacgctttatttacgtttggaactgtttattacttgtcgttttatgtaccctagctggtcctggacagagattttaatacacaaaatagtctgaaaatttgggctgaatttctgggcatgacacatcgcctgcatgccactccagccattgcctgcacgccgcagtcgccgttccagccctcggccgccgccaccaccgatgcgtccaaagggagaagagaaaagagagagaagggggagagagagaggaaggaggaagggaaggagaaaggatgacatgtgggccccacatgtcggtgggtcgcaatttttttgtttgattgacagatgggtcccacagatatgttttttaattctaatgccacgtaagcgccacgtggaatgaaaatcgggttagcaccgccacgtcagcaaaaccaccctacaaaaccgctagaggagttaaattgcactggtttcaataatttggggagtcatcctacccggtatggcagttaagggtcacgaattagattcggtgaataatttagggagtctaagtggactttttccttttagatgacggcccatattttattttagaagatgggccatgttggttaaatactgggaataagtccactttgattcccttgtctagtggttgatctaattcatatccctgaaccacgatatgagatatctcgatctcctaactattaaaattgttgccatttgatttctttaatagatttggaggatggttttgttgacatgaccattacatggtagtgttgacctggttttcgccctatgttgttttgatgtggtgcttatgtggcattaggattaaaaactatatgtgggacccatttgtcattcacataaaaaaaatatggacccaccgacattgggggtgcccacatgccatcctctctctccttcctttcttcctcctccatctctctcccttctctctctttctctttctctcccttttctcttcgtctgctaggggcgggcgctcgagggccggaacagtggcggtcgagagtgcgggagctagagcggcggcggcggtcataagggcggagccagagtggcggcggcgggcgggaggacgggcactagagtggcgatggcggtgggtgggcgagggcccgagcggtggcaaaggcaacgggcgggcggctaggcggagggtgctcacgatctaggtgccaccgcctctcccctcaccgtttgcccccctccccctatccctagcaatagcttcgaacggcggaggagaaggcgtcaacggatcctaggatggtggaggaggaggaggcagtggtggtagaggagctagcttgatgacgtggagggtgctcgcgagctcagcgacattgcatccggtgctcctctgtggctccctctcgtgaggctggcctcctccctcttcgctatggcggccaccatcctactgctctatctccgctctgcatccgctcgcatgccaacatcgtccaccgcctttgttcccacgcccagcttcggtatcatcaccgccgctccaatgctcgcccacctgcccactgccaccactctgcccccactccgctggttgttgctccaacccccgttgctcacatacggccgaaggggaagagaaaggggagagaaagaaagagggaagggagagagggtggaggaagaagggaagaagaaagagaggatgatatatgggtcccacgtgtccgtgggtcacacaatattcttttttaatgacaaatgggtctcacattttttttatttctaataccacataagtgccgcgtcaatgctacgttagacgaagactaggccaacaccgccatgtaggggccacgttagcaaaaccgcccttcaaaaccgtcgagagggagttaaattgcatcgattttaataattgtgggtttagatatccggtatcgtggtttaagaatacgaattaattcagcaactagttaagggagtcaaagtgaacttattccttaatactgtactgtacatgtgctcatgcgaagcccatctcggtgtgcccaagttaccgtcagcctttttcctacaagaagttagcccaagttccatcccgaaacagtgctgtgtatataccgccggttcattggtcgcgacacgagagaacgcaatcgctaccgcgaccacgtccacgaccatgatctttcctgcccaccctgcacctttaccatctcggcgttttgccggtgttgctctcggccgacgccctctcggtctcgggggcccgcctcaccgtacggtcgccaatcgccacgcccacgccctcacccgacgggccacgactccacgagggaacacggcccacgagccaccgaggcgaacgtgcgcgcacgcgcaggcgcggcaggttcgcgttgggtgtgtttcccgttgaaataatgcttcggtcctccactcctccggcacggccaactcgtgacagcaacgccggcccagccgaccgggaggatgcgaatgcttggcgcgtcgcggcggtgcggcgggccacggggacaagccacacgagggccggtcgaaatcgcggcgccatttcagcatgatgaacaggagctcgacaattgctggcgccgatccggatgatcctactgcatgccgtctcactcccatccatccatatccattctctactagcgcagattgtggctgacgaatccactccctttggtacctcgccatggcccgctagctatataatctgcccaaactaagtaattcccaacacaatcttctacgacgccggctcgcccctcgcccctcgcttgaacgcttagagatacagtttttgccgcgctagttgatccctcctgcattcgcaccatggtggaggctgcctcggctgcgccggcgacggtggtcgttccgctgacgcagacgctctgcgcgaatgcgcctgcgacgagcgtcaccgtcgtttcgaagcagaccgttcggcccgacggcgcgtcggcggttggagacgtcaagctctcggtctccgacatgccgatgctgtcgtgccactacatccagaaggggctcttcttcccgccccctggcgtgccgatcgcctccctcgtgtcgtcgctcgtgtgcgcgctctcccgggcgctcgcggtgttccctgccctcgccggccggctcgtcacgctggatgatggccgcatcgtcatccggtgcgacggcgtggccgttgagttctaccacgcggtcgcgcccgctctgtcgctgggagacttcctcgtgcccaacgccgacgtgccgaccaggctgacgaaggatttgttccccatggaccgcaccgtgagctacgacggccaccgccgtccgctcacctcgttccagctcaccgtgctcggcgatggagctgtcttcgtcggcttcgtcgctaaccacgccgtcgtggacggcacctccttctggcacttctttaacacgtgggcaggtctctgccgcggcacgccggtccagccgccggacttgcgccggaacttctttggcgactccacggccgtcatccgcttccccggtggcgcgggtcctgccgtcaccttcgacgccgacgcgcccctccgcgagcgagtcctccatttcagcgccgccgccattcgcgagctgaaggccaaggccaaccagtggaaaagatccgacaaatttgccgaggctaacgggaagcatgtggatgaaacgaaggctcatggcggttacagagagatctcgtcgttccaatcgctgtgcgcgcatatctggagggcggtgacgcgatcccggcggctgctggcggccgacgcgaccacgacgttccgcatggcggtgaactgccggcaccgcctgcgcccggcgatctccccgctctacttcggcaacgccatccagagcgtagccacaaccgcgacggtggccgagctggcgtccaacgacctgcggtgggcggcggccaggctgaacgcgaccgtggtggcgcacgaggacggcgccatccgccgggccgcggcggagtgggaggccgcgccgcggtgcttcccgctgggcaaccccgacggcgcggcgctcacgatggggagctcgccccggttccctatgtacgacggcaacgacttcgggtggggcagggcgatcgccgtgcggagcgggcgcgccaacaagttcgacggcaagatgtcggcgttcccgagccaggctggggacggcagcgtcgacgtcgagttttgcctcgcgcccgacaccatggcccgcctgctcggtgaccacgagttcttgcagtacgtgtcgcgtgcaccgtgacgcacgtattctggtgtggtgcagtgagcgaggggacgatcacgagatgcgagttccccacatgacatgattatctctctggtggtgatgcagattgcagtagccgctggacacatacgttgctgtgctggattggtgtatgcttgcaaaaatatctaagctatatatccgagtatccgttactcttctggtattccatccattaagcggttggccaagtttgaacagccgcacagagagttgcttttaggatcaagtggagtcgtgctctgttccttcctccctgttagaagtacttgtcttgtgagttcgatggataattatttgagtacaaatttcacacactatatatgcttcaattaacctattacaaagatttagcatcaatttttttacgaaactatttaagacattgtatagcaaagctacaactctagaagtcactttaattcataccattggcaaatgactttcataaaatttaaattcgagtaaattgcactttgcaccgggtagattgatattgttttcactttgcaccaggttttgcatatactttcacttcgcgccggggatgacgaattaactttcacatcacaccatctttcatgtttggattcaaaccagatgcacatccaagtagtctccgattgtccatgttagctcacacagaaggtcagagcttactgttcttgcgcagttgccagaagaagatcacaataggggatcttgtcattagacacagcaggagtaaagagatgtcagctgagcttttgcgagcacgtattctggggttagattttactgtatgttggagagctatggtacgcaagccggccgccggccggcggcggttcggtaggcatgctgaaattgacgcccgtgatcggtgagtacccacgaaatcgcggaattgctctgcgtgtacgtgagcacctcgcaatatccatggtccccgctgcccgtggactcagctggtgcatgtgtgcatctcacgccatcccgtgtgattcagtcgatcggccagcgtgggtcaagggcgcgagccaacatggacaacagatgacagtttggatgacgccttgtgcatcggctttgagtccaaacatggaaggtggtgtgatgtgaaagtaaatttgtcatccccggtgcaaagtgaaagtatatgccaaaaccggtgcttgtcttttattccggcatgtttgtggctatgtgaggaaatggatgttgataagttgggttgttagctttaggttgatttggttcttagccaggtatttttgcaggtgtcgtttatcaatcgttaatttttgggagccttttcaacctagcctccaaagacttctaacccgctatctagttgaagcaaacctctggactgagagctttcaacgctctgatcgaattgttgtttcaacttgatcagaaatcttttcccgcctttttcattcacatcctatgtaaaggctctaatgctgtcgggccaaacctttatactccctataatatgacttattttcaatggaaaattcaggtggaaaagttctcctctcc

SEQ ID NO: 5543 - DNA, 2016 bp, Triticum aestivum
cctagatccgccactggagctgactttcgcgccggcggttcttctgtagtttctgtcaagatggggttgtcttcggccgctgagatcgacggggcgcagctgtgcatcttcgacctgaggagagggcagcaggaggggcaggagctcgacaagatcctcttcttccacccggctgactgccccatcctgctccagctctccgtcattggcctctgcgaaggaatcatcactttcacaagaatattttctccagaagatgactgtgaggtgatagaatctgataaacactgccacgttttttaccaagctgagccagatatttggatggttctggtggtgcagaaaattaaggacaatgaatcaactttgcgctttggtgcattgcaaggaatactaaaagaatctcattcacttttcgcaatgtttcatggaccaattcgaactttacttgacagacaaccaagtgctgaatttgcccgtggtcacctccatacatttgtcacagattatttgagcgattttagtgttggcaaaaagctacaattgccaacctaccgtgatagcctaacggagcggggaacagtccaaatgctaacagtctcacgagaagtggcacttgaagttcagtcactcaccacagttcttgggtcatgtcttcgaaacgtaatctgccaatcaattgtattatttgaggacctcttggtgtctacaacacttcccctggatgatacgttaaacctatacacttatgcaatcctgcggttgactcctagtgctttatcttccaacgggaattcatggtcctatttgcggaaagggggttatgttaatgctgacaccactttaagttcggcaaatggagcagctgcagcagaaaggtacaatagtcgatctcgtgacacttctcctggtggacaaaatcagatgcaccataatttcaggcctcttcagcgtgagaaattgtccaagggaaaagatggttttgttgctgctgactttgtaactacagaaattcgtggtgctgtaccgttgaatccaatactgtggttccatcaggcagaggagcgcatgtatttatgtgtttatcagcataagaaccttactatcttgctagtgattccagcttcctcactgataaatggagaagagggtattgctcatgtgaagaggcatcttcttgaaaatgcctcacagaacattgtcactgttgaacaaaaattatcacgaggatggggaggagaaaatgcctatcatgtcggtggataccgttatatactctctgatccaaacagaaaagtatcaagagcctccccacctgggaaagtcatcaccctgtcaaaggattctctacttgccctcaacaggctaagaggagaaatagatctagagaagtcaagagctaagaggagtgaccctacccatgacaaggattatgaagtatgcatcagagcgaaaaataatgcatggattattgctaaaatttctcgaggaaaagaactctatatggctatagagaagggcggcgaaacacttctctatgcatctacagctgttgagaaatttagcaacaggtactgcgagggagcattctctgcggactaaaagcaccagcaccagcatgattcccacgatccagtccagcactgcacatggttgtcaactggatcactccctaatgtgtgtaattgatgtcgatctcactcatgcaataactggatccataccagttgtacagctgccctttggaataaaattatgcagagcaggaaccagcatgttctgcctctaggttctgcggccttatgggatacagtacttaggaacattctcatttctatctgatgttaaaaaaagaagatcatttcgatctgtaaatgccgacggaggactgctaactcgtatatgtgttacgggccagttctcttgcgcttgtagatggcttaccttggaaattaagcctccttcagaaaaagaaaacttggaaattaaggccaagcttgaaagaacttgtctttt

SEQ ID NO: 5544 - DNA, 1973 bp, Secale cereale
aggctgtttcaaagtcctagatccgccactggagcggactgtcgcgccggcggttcttcggtactctctgtcaagatggggttgtcttcggccgctgagatcgacggggcgcagctgtgcatcttcgacctgaggagagggcagcaggaggggcaggagctcgacaagatcctcttcttccacccggctgactgccccatcctgctccagctctccgtcattggcctctgcgaaggaatcatcactttcacaagaatattttctccagaagatgactgtgaggtgatagaatctgataaacattgccacgttttttaccaagctgagccagatatttggatggttctggtggttcagaaaattaaggacaatgaatcaactttgcgctttggtgcattgcaaggaatactaaaagaatcccattcgcttttcacaatgtttcatggaccaattcgaactttacttgacagacaaccaagtgctgaatttgcccgcagtcacctccacacatttgtcacagattatttgagcgattttagtgttggcaaaaaactacaattgccaacctaccgtgatagcctaacggagcggggaacagtccaaatgctaacagtctcacgagaagtggcacttgaagttcagtcactcaccacagttcttgggtcatgtcttcaaaacgtaatctgccaatcaattgtattatttgaggacctcttggtgtctacgacacttcccctggatgatacattaaacctatacacttatgcaatcctgcggttgactcctagtgctttatcttccaacgggaattcatggtcctatttgcggaaaggggggtatgacaccactttaagttcggcaaatggagcagctgcagcagaaaggtacaatagtcgatctcgtgacacttctcctggtggacaaaatcagatgcaccataatttcaggcctcttcagcgtgagaaattgtccaagggaaaagatggttttgttgctgctgactttgcaactacagaaattcgtggtgctgtaccgttgaatccaatactgtggttccatcaggcagaggagcgcatgtatttatgtgtttatcagcataagaaccttactatcttgctagtgattccagcttcctcactgataaatggagaagagggtattgctcatgtgaagaggcatcttcttgaaaatgcctcacagaatattgtcactgttgaacaaaaattatcacgaggatggggaggagaaaacgcctatcatgtcggtggataccgttatatactctctgatccaaacagaaaagtatcaagagcctccccacctgggaaagtcatcaccctgtcaaaggattctctacttgccctcaacaggctaagaggagaaatagatctagagaagtcaagagctaagaggagtgaccctacccatgacaaggattatgaagtatgcatcagagcgaaaaataatgcatggatcattgctaaaatttctcgaggaaaagaactctatatggctatagagaagggcggcgaaacacttctctatgcatctacagctgttgagaaatttagcaacaggtactgcgagggagcattctctacagactaaaagcaccagcagcagcatgattcccacgatccagtccagcactgcacatggttgtggactggatcactccctaatgtgtgtaattgatgtcgagctcactcatgaaataactggattcataccagttgtacagctgccatttggaataaaattatgcagagcaggaaccagcatgttctgcctttaggttctgcggccttatgggatacagtagttgggaacattctcatttctatccgatgttaaaagaaaaaggctcatttcgatctgtaaatgccgacggaggactgctaactcgtatatgtattacgggccagttcttttgcgcttgtagatgtcttagcttggaaactaagcttccttca

SEQ ID NO: 5545 - DNA, 1908 bp, Triticum aestivum
gcagctgtgcatcttcgacctgaggagagggcagcaggaggggcaggagctcgacaagatcctcttcttccacccggctgactgccccatcctgctccagctctccgtcattggcctctgcgaaggaatcatcactttcacaagaatattttctccagaagatgactgtgaggtgatagaatctgataaacactgccatgttttttaccaagctgagccagatatttggatggttctggtggtgcagaaaattaaggacaatgaatcaactttgcgctttggtgcattgcaaggaatactaaaagaatctcattcacttttcgcaatgtttcatggaccaattcgaactttacttgacagacaaccaagtgctgaatttgcccgcggtcacctccacacatttatcacagattatttgagcgattttagtgttggcaaaaagctacaattgccaacctaccgtgatagcctaacggagcggggaacagtccaaatgctaacagtctcacgagaagtggcacttgaagttcagtcactcaccacagttcttgggtcatgtcttcgaaacgtaatctgccaatcaattgtattatttgaggacctcttggtgtctaccacacttcccatggatgatacattgaacctatacacttacgcaatcctgcggttgactcctagtgctttatcttccaacgggaattcatggtcctatttgcggaaagggggttatgttaatgctgacaccactttaagttcggcaaatggagcagctgcagcagaaaggtacaatagtcgatctcgtgacacttctcctggtggacaaaatcagatgcaccataatttcaggcctcttcagcgtgagaaattgtccaagggaaaagatggttttgttgctgctgactttgtaactacagaaattcgtggtgctgtaccattgaatccaatactgtggttccatcaggcagaggagcgcatgtatttatgtgtttatcagcataagaaccttactatcttgctagtgattccagcttcctcactgataaatggagaagagggtattgctcatgtgaagaggcatcttcttgaaaatgcctcacagaacattgtcactgttgaacaaaaattatcacgaggatggggaggagaaaatgcctatcatgtcggtggataccgttatatactctctgatccaaacagaaaagtatcaagagcctccccacctgggaaagtcatcaccctgtcaaaggattctctacttgccctcaacaggctaagaggagaaatagatctagagaagtcaagagctaagaggagtgaccctacccatgacaaggattatgaagtatgcatcagagcaaaaaataatgcatggattattgctaaaatttcccgaggaaaagaactctatatggctatagagaagggtggcgaaacacttctctatgcatctacagctgttgagaaatttagcaacaggtactgcgagggagcattctctacagactaaaaccaccagcaccggcaccagcatgattcccacgatccagtccagcactgcacatggttgtcgactggatcactccctaatgtgtgtaattgatgtcgatctcactcatgcaataactggattcatgtcggttgtacagctgccatttggaataaaataatgcagaggaggaaccagcatgttctgccttcaggttctgcggccttttggggtacggtacggtacttgggaacattctcatttctatctgatgttaaaaaagagagaccatttcgatctgtaaatgctgacggaggactgctaactcgtactatatgtattacgggccagttcttttggggcttgtactagatggcttaacttggaaattaagtctccttcagaaaaagaaaagaaaactt

SEQ ID NO: 5546 - DNA, 2180 bp, Festuca arundinacea
ggcacgaggctgggcgcgagttagctggatctctctctcccacgacgaagcgtccaacgaagttagctccggctgcgcgattccacctctaggtctcctccaaggggttcgcttggagctgcccgtcgcggccggtggttcctcggcaatttcggtcaagatggggttgtcttcggccgccgcgatcgacggggcgcagctgtgcgtcttcgacctcaggagggggcagcaggaggggcaggagctcgacaagatcctcttcttccaccccgccgactgccccatcctgctccagctctccgtcattggcctctgcgaagggatcatcactttcacaagaatattttctcctgaagatgactgtgaggtgatagaatcagatagacactcccacgtgttttaccaagctgagccagatatttggatggttctggtggtagagaaaactaaggacagcgaatcaactttacgtttcggtgcattgcaaggaatacttaaagaatcacactcacttttcacaatgtttcatggaccaatccgagctttacttgacagacaaccaagtgctgaacttgcccgcggtcacctcaacacatttgttacagattatttaagcgattttattgttggcaaaaagctacaattgcctacctaccgtgatagcctaacggagcggggaacagtccaaatgttaacagtctcacgagaagtggcacttgaagttcagtcactcaccgcagttcttgggtcatgtcttggaaacgtaatctgccaatcaatcggattgtttgaggacctttgggtatctacaacacttcccccggatgatacattaaacctatacacttatgctatcctgaggttgactcctcgtgctttatactctaatgcaaattcgtggtcctatctgcggaaaggggcttatgttaatgctggccccgcttcaagttcgtcaaatggagcagctgcagcagaaaggtatcatagtcgatctcgtgacacttctcctggtggacaaaatcagatgcatcataatttcaggcctctccagcgtgagaaattgtccaaggggaaggatggttttgttgctgccgactttgcaactacagaagttcgtgctgctgtaccattgactccgatattgtggttccagcaggcagaggagcgcatgtatctgtgcgtttatcagcacaagaaccttactatcttactgctgattccagcttcctctgtaataaatggagaagagggcattgctcacgtcaagaagcatcttctggaaaatgcatcacagaacattgtcactgttgaacaaaaactaacacggggatggggaggagaaaatgcctatcatgtcgctggatatcgttacctacttgttgatccagacagaaaagtgtcaagagcctccccacctgggaaagtcaccaccttgtcaaaggattctcttcttgccctgaataggctaagagaagaaatagatttagagaagtcaagagctaagaggagtgaccctacccatgacaaggattatgaagtatgcatcagagcgaaaaataatgcatgggttattgctaaaattactcgaggaagagaactctacatggctttagagaagggcggtgaaacacttctttatgcatctacagctgttgagaaatttagcaacaggtactgtgagggggcattctctacagactgaaagcaccggcatgagatgcttcccctttagattcacaaaaaaagaagacgacatgcttcctcttcccactatccagcacatggtttttcactggatcactcatgctgtaatgactggatctaatgccatgactatactcataccagttgtacagctgcctgttgttgcctgccatgcgagattagaggcttctttagagaataatgcaaagcaggaacggcatgtttctttaaggttttgcagcctactggaatacataagaccgaccatatcgtttctttttctaaatgctaacgctgcactgctgactcacatagttgccttgcatgtatcacattgcatatccgtgatcggttcattggtgtgttattttgagttgctcaatattgtacccagttcgctatacagcatgtttgaaattagaaatggaaaagaggctacaaatttaaacaagagattaaaaaaaaaaaaaaaaaaa

SEQ ID NO: 5547 - DNA, 2233 bp, Brachypodium distachyon
ttggcactggagtttggagtttggtagcagcagacgagagcctggttggtagcacaggaaatcttctgagatctctatacagacacctcgctccgtgcatcgtcttcctcatcgcgcgagcgccgccacccatcccgctgccgagcgccccagccccttcctcctcgcacgagcgtctccaccgcaggttgatctcccctttgattctctcactcccgaccatttctcctcccatcaccctacgaacggattccgccctttagctccccgtttcataatcttccccaattcgtaaccgaggcaaaattcaaggtagggcggaccttgccctactgggtcctccgcccgtggtctcagatggggttatcctcgaccgacggcgcgcagctgtgcgtcttcgacctcaggagggggcagcaggaggggcaggagctcgacaagatcctcttcttccaccccaccgactgccccatcctcctccagctctccgtcattggcctctgtgaggggatcatcactttcacaagaatattttcccctgaagatgattgtgaggtgatagaatcagatagacattcccatgttttttaccaagctgagacagatatttggatggttctggtggtggagaagaccaaggatagtgaatcaaccttgcgttgtgctgcattgcaaggaatacttaaagaatctcattcacttttcacaatgtttcatggcccaatccgatctttacttgacagaaaaccaagtgctgaacttgcccgcggtcacctccacacatttatcacagattatttaagcgatttcactgttggcaaaaagctacaattgccaacctaccgtgacagcctaaaggagcggggaacagtccaaatgctaacagtctcacgagaagtggcacttgaagttcagtcactcgccacagttcttggatcgtgtcttggaaatgttgcctgccaatcaattgtattattcgaggatctcttggtatctacgacactttccccggatgatacactaaacctatatacgtatgctatcctgcggttgactcctcgtgctttatccaatgcaaactcatggtcttatttgcggaaaggggtttatgttaatgctggctccacctcaagttcgtcgaatggagcagctacagcagaaaggcctctccagcgtgagaaattgtctaagggaaaggatggttttgttgctgctgagtttgcaactacagaagttcgtggtgctgtacctttgactccgatactgtggttccagcaggcagaggagcgcatgtatctatgtgtttatcagcacaagagcctcaccatcttattgctgattccagcttcctcgctaataaacggagaagagggtattgctcatgtgaagaggcatcttcttgaaaatgcatcagagaacattgtcatggttgaacaaaaactagcacgaggatggggaggagaaaatgcctatcatgttggtggatatcgttacttactcgtggatccagacagaaaaatatcaagagcctccccgcctgggaaagtcaccaccctgtcaaaggattctctacttgccctcaataggctgagagaagaaatggatttagagaagtcaagagctaagaggagtgaccctacccgggacaaagactttgaagtatgcatcagagcgaaaaacaatgcatgggttattgctaaaattactcgaggaagagaactctatatggctttagagaagggtggggaaacacttctttatgcgtctacagctgtcgagaaatttagcaacaggtactgtgaaggagcattctcgacagactaaaagcaccaccacgagatgtcgcctcttctccattgtacaacaaatggggtcggactggatggttcctttaaggtgtaatgaaagtgggtctctcgtcatgactggattcatactaggtgtactaaagtctatgcgtgaaaagagacttccgataataatatagagcagaccagcatggcttgccttacagtcttgcggccttccaggacacattctcgtttctatgctgacgatggacttgctgacgagggtagttaacttgcggatgtattatgtttcatagccgttgtcagtttgtgtgttattttgagttgctcaatgtttactaaacagtttaccagttttttatactgcctatttgagaatatgaatggaaaagaggcttgaaagttgaaacttccacaaaaga

SEQ ID NO: 5548 - DNA, 2258 bp, Brachypodium distachyon
ttggcactggagtttggagtttggtagcagcagacgagagcctggttggtagcacaggaaatcttctgagatctctatacagacacctcgctccgtgcatcgtcttcctcatcgcgcgagcgccgccacccatcccgctgccgagcgccccagccccttcctcctcgcacgagcgtctccaccgcaggttgatctcccctttgattctctcactcccgaccatttctcctcccatcaccctacgaacggattccgccctttagctccccgtttcataatcttccccaattcgtaaccgaggcaaaattcaaggtagggcggaccttgccctactgggtcctccgcccgtggtctcagatggggttatcctcgaccgacggcgcgcagctgtgcgtcttcgacctcaggagggggcagcaggaggggcaggagctcgacaagatcctcttcttccaccccaccgactgccccatcctcctccagctctccgtcattggcctctgtgaggggatcatcactttcacaagaatattttcccctgaagatgattgtgaggtgatagaatcagatagacattcccatgttttttaccaagctgagacagatatttggatggttctggtggtggagaagaccaaggatagtgaatcaaccttgcgttgtgctgcattgcaaggaatacttaaagaatctcattcacttttcacaatgtttcatggcccaatccgatctttacttgacagaaaaccaagtgctgaacttgcccgcggtcacctccacacatttatcacagattatttaagcgatttcactgttggcaaaaagctacaattgccaacctaccgtgacagcctaaaggagcggggaacagtccaaatgctaacagtctcacgagaagtggcacttgaagttcagtcactcgccacagttcttggatcgtgtcttggaaatgttgcctgccaatcaattgtattattcgaggatctcttggtatctacgacactttccccggatgatacactaaacctatatacgtatgctatcctgcggttgactcctcgtgctttatccaatgcaaactcatggtcttatttgcggaaaggggtttatgttaatgctggctccacctcaagttcgtcgaatggagcagctacagcagaaaggcctctccagcgtgagaaattgtctaagggaaaggatggttttgttgctgctgagtttgcaactacagaagttcgtggtgctgtacctttgactccgatactgtggttccagcaggcagaggagcgcatgtatctatgtgtttatcagcacaagagcctcaccatcttattgctgattccagcttcctcgctaataaacggagaagagggtattgctcatgtgaagaggcatcttcttgaaaatgcatcagagaacattgtcatggttgaacaaaaactagcacgaggatggggaggagaaaatgcctatcatgttggtggatatcgttacttactcgtggatccagacagaaaaatatcaagagcctccccgcctgggaaagtcaccaccctgtcaaaggattctctacttgccctcaataggctgagagaagaaatggatttagagaagtcaagagctaagaggagtgaccctacccgggacaaagactttgaagtatgcatcagagcgaaaaacaatgcatgggttattgctaaaattactcgaggaagagaactctatatggctttagagaagggtggggaaacacttctttatgcgtctacagctgtcgagaaatttagcaacaggtactgtgaaggagcattctcgacagactaaaagcaccaccacgagatgtcgcctcttctccattgtacaacaaatggggtcggactggatggttcctttaaggtgtaatgaaagtgggtctctcgtcatgactggattcatactaggtgtactaaagtctatgcgtgaaaagagacttccgataataatatagagcagaccagcatggcttgccttacagtcttgcggccttccaggacacattctcgtttctatgctgacgatggacttgctgacgagggtagttaacttgcggatgtattatgtttcatagccgttgtcagtttgtgtgttattttgagttgctcaatgtttactaaacagtttaccagttttttatactgcctatttgagaatatgaatggaaaagaggcttgaaagttgaaacttccacaaaagagattgaggcgactaaaaaagagggg

SEQ ID NO: 5549 - DNA, 2144 bp, Triticum aestivum
aggcgtgttctaaagcctacgatccgccactcggagctgactttcgtcgccggcggttcgttctgtagtttctgtcaagatgggttggtcttcggccgctgagatcgacggggcggcagctgtgtatcttcgacctgaggagagggcagcaggaggggcaggagctcgacaagatcctcttcttccacccggctgactgccccatcctgctccagctctccgtcattggcctctgcgaaggaatcatcacattcacaagaatattttctccagaagatgactgtgaggtgatagaatctgataaacactgccatgttttttaccaagctgagccagatatttggatggttctggtggtgcagaaaattaaggacaatgaatcaactttgcgctttggtgcattgcaaggaatactaaaagaatctcattcgcttttcacaatgtttcatggaccaattcgaactttacttgacagacaaccaagtgctgaatttgcccgcggtcacctccacacatttgtcacagattatttgagcgattttagtgttggcaaaaagctacaattgccaacctaccgtgatagcctaacggagcggggaacagtccaaatgctaactgtctcacgagaagtggcacttgaagttcagtcactcaccacagttcttgggtcatgccttcgaaacgtaatctgccaatcaattgtattatttgaggacctcttggtgtctacgacacttcccctggatgatacattaaacctatacacttatgcaatcctgcggttgactcctagtgctttatcttccaacgggaattcatggtcctatttgcggaaagggggttatgttaatgctgacaccactttaagttcggcaaatggagcagctgcagcagaaaggtacaatagtcgatctcgtgacacttctcctggtggacaaaatcagatgcaccataatttcaggcctcttcagcgtgagaaattgtccaagggaaaagatggttttgttgctgctgactttgtaactacagaaattcgtggtgctgtaccgctgaatccaatactgtggttccatcaggcagaggagcgcatgtatttatgtgtttatcagcataagaaccttactatcttgctagtgattccagcttcctcactgataaatggagaagagggtattgctcatgtgaagaggcatcttcttgaaaatgcctcacagaacattgtcactgttgaacaaaaattatcacgaggatggggaggagaaaatgcctatcatgtcggtggataccgttatatactctctgatccaaacagaaaagtatcaagagcctccccacctgggaaagtcatcaccttgtcaaaggattctcttcttgccctcaacaggctaagaggagaaatagatctagagaagtcaagagctaagaggagtgaccctacccacgacaaggattatgaagtatgcatcagagcgaaaaataatgcatggattattgctaaaatttctcgaggaaaagaactctatatggctatagagaagggcggcgaaacacttctctatgcatctacagctgttgagaaatttagcaacaggtactgtgagggggcattctctacagactaaaagcaccagcaccagcaccagcatgtttcccaggatccagtccagcactgcacatggttgtcgactggatcactccctaatgtgtgtaattgatgtcgatctcatgcaataactggattcataccagttgtacagctgccatttggaataaaattatgcggagcaggaaccagcatgttctgccctaggttctgcggccttatgggatacagtacttaggaacattctcgtttctatctcatgttaaaaaaggaagatcatttcaatctgtaaatgccgacggaggaccgctaactcgtactccgttggagtacatgtattacgggccagttctcttgcgctcgtagatggcttaccctggaaattaagcctccttcagaaaaagaaaacttggaaattaaggccaagcttgaaagaacttgtctttttagggtaaaagaaataacttatttttggggttgggattaacgtacgacacacttcagtggaaagaagctagtggcggttaaagctgatttttaa

SEQ ID NO: 5550 - DNA, 2222 bp, Setaria italica
cccgcctccccttcctttctctcccccgaccgccgtgaccgccgcctcacgccagcccccaaccaccctatcggccacgcccgccgcccgcccgccgtcgcggcccctagctccccggatctccctcccatcctcccccggcgacgaacccacccccgcaattggatcagctcggggccgcgcggtcgcccccatctctcctcgcgcccctcgcttgcggccgcgcctcccccatcccgcgggtgatccccccaccggcggctcgcggttccggggatggggctctcgacggcggccgcgggcgacggggcgcagctctgcgtcttcgacctccgcaggggccagcaggagggccaggagctcgacaagatcctcttcttccaccccgccgactgccccatcctgctccagctctccgtcatcgggctctgcgaggggatcgtcactttcacgagaatattttctcctgtagaggattgtgaagttatagaatctgagaagcactcccacattttttatcaagcggaacctgatatttggatggttctggttgtggaaaaaaccaaggacaatgaattgacctggcgttgtggtgcactgcaagggatacttaaagaggcccattcactcttcgcaatgttccatggaccaatccgaactttacttgacagacaacccagtgctgaacttgctcgtggtcacctccgcacatttctcacagattatttgagtgattttcatgctggtaaaaagctgcaattcccaacctaccgtgattgcctaaaggagaggggaacggtccaaatgctcacagtatcaagagaagtagcacttgaagttcagtcactcaccacagttcttggatcatgtcttggaaacaccacctgccaatcgctcgtactatttgaagacctcttggtgtctacaacactgcccccggatgatactttaaacctatatacttatgctgtcctgaggttaactcctcgcgctttatcttccaatgcaagctcttggtcctatttgcggaaaggaacttctgttaatgcaggcccaacttcaagttcatcaaatggaacaactgcaggagaaaggcctctcctgcgtgagaaattgtcaaagggaaaggacggttttgttgctgctgattttgcaactacagaagttcgtggtgctgtacccttgactccaatactctggttccagcaggcagaggagcgcatgtacctatgcatttaccagcacaagagtctcactatccttttgctgattcctgcttcctcactaataaacggagaagagggcattgcacatgtgaagaagcagatgcttgaaaatgcatcacagaagattgtcactgttgaacagaaattgacacgaggatggggaggagaaaatgcttatcatgttgctggatatcgttacttgctggttgatccagacagaagaatatcaagagcatccccacctgggaaagtcaccaccctggcaaaggattcgctacttgccctcaataggctaagacaagaagtagatttagagaagtcaagatacaagagaagtgacccttgtcatgataatgattttgaagtatgcatcagaacaaaaagcaatgcatgggtgattgctaaaattactcgagggagggagctttacatggctttagagaaaggtggtgaaacacttctatatgcttccacagctgtagagaagtttagcaacaggtactgcgagggagctttctctacggactgaaagcaccagcatgagatgcccctctttatacaattctcagtcttcagctggatcgatggctttgttgtagcgaacttggaccactatttgcaaggggaataagggattcatattcacatcagttgtacagctgctctgttatcatgtgctatgtgcccaaaaaaatatagcctagtctgggaataatgcagagcagggtagagtttgttctcttacggcctcatgtccttccgcaacgcatagcattgtgcctgttttagttttcttgtaaacgctggcggtggacctggtgactgaaagagctcagcttaggatttgatccggtgattctgtattttggtactgttgccatggtttgacttttgatgtcaatctcccgagatataagtgagaatgctgagaacgacatgttgaaagaggctacttcatagtcattgagttgtcacagcggttaaaatcacatggat

SEQ ID NO: 5551 - DNA, 2217 bp, Setaria italica
cccgcctccccttcctttctctcccccgaccgccgtgaccgccgcctcacgccagcccccaaccaccctatcggccacgcccgccgcccgcccgccgtcgcggcccctagctccccggatctccctcccatcctcccccggcgacgaacccacccccgcaattggatcagctcggggccgcgcggtcgcccccatctctcctcgcgcccctcgcttgcggccgcgcctcccccatcccgcgggtgatccccccaccggcggctcgcggttccggggatggggctctcgacggcggccgcgggcgacggggcgcagctctgcgtcttcgacctccgcaggggccagcaggagggccaggagctcgacaagatcctcttcttccaccccgccgactgccccatcctgctccagctctccgtcatcgggctctgcgaggggatcgtcactttcacgagaatattttctcctgtagaggattgtgaagttatagaatctgagaagcactcccacattttttatcaagcggaacctgatatttggatggttctggttgtggaaaaaaccaaggacaatgaattgacctggcgttgtggtgcactgcaagggatacttaaagaggcccattcactcttcgcaatgttccatggaccaatccgaactttacttgacagacaacccagtgctgaacttgctcgtggtcacctccgcacatttctcacagattatttgagtgattttcatgctggtaaaaagctgcaattcccaacctaccgtgattgcctaaaggagaggggaacggtccaaatgctcacagtatcaagagaagtagcacttgaagttcagtcactcaccacagttcttggatcatgtcttggaaacaccacctgccaatcgctcgtactatttgaagacctcttggtgtctacaacactgcccccggatgatactttaaacctatatacttatgctgtcctgaggttaactcctcgcgctctatcttccaatgcaagctcttggtcctatttgcggaaaggaacttctgttaatgcaggcccaacttcaagttcatcaaatggaacaactgcaggagaaaggcctctcctgcgtgagaaattgtcaaagggaaaggacggttttgttgctgctgattttgcaactacagaagttcgtggtgctgtacccttgactccaatactctggttccagcaggcagaggagcgcatgtacctatgcatttaccagcacaagagtctcactatccttttgctgattcctgcttcctcactaataaacggagaagagggcattgcacatgtgaagaagcagatgcttgaaaatgcatcacagaagattgtcactgttgaacagaaattgacacgaggatggggaggagaaaatgcttatcatgttgctggatatcgttacttgctggttgatccagacagaagaatatcaagagcatccccacctgggaaagtcaccaccctggcaaaggattcgctacttgccctcaataggctaagacaagaagtagatttagagaagtcaagatacaagagaagtgacccttgtcatgataatgattttgaagtatgcatcagaacaaaaagcaatgcatgggtgattgctaaaattactcgagggagggagctttacatggctttagagaaaggtggtgaaacacttctatatgcttccacagctgtagagaagtttagcaacaggtactgcgagggagctttctctacggactgaaagcaccagcatgagatgcccctctttatacaattctcagtcttcagctggatcgatggctttgttgtagcgaacttggatcactatttgcaaggggaataagggattcatattcacatcagttgtacagctgctctgttatcatgtgctatgtgcccaaaaaaatatagcctagtctgggaataatgcagagcagggtagagtttgttctcttacggcctcatgtccttccgcaacgcatagcattgtgcctgttttagttttcttgtaaacgctggcggtggacctggtgactgaaagagctcagcttaggatttgatccggtgattctgtattttggtactgttgccatggtttgacttttgatgtcaatctcccgagatataagtgagaatgctgagaacgacatgttgaaagaggctacttcatagtcattgagttgtcacagcggttaaaatcaca

SEQ ID NO: 5552 - DNA, 1624 bp, Echinochloa colona
ggccgccgcgggcgacggggcgcagctgtgcgtgttcgacctgcggagggggcagcaggaggggcaggagctcgacaagatcctcttcttccaccccgccgactgccccatcctgctccagctctccgtcatcgggctctgcgaggggatcgtcactttcacaagaatattttctcctgaagaggattgtgaagttatagaatctgataaacactcccatgttttttatcaagcggaacctgatatttggatggttctggttgtgggaaaaaacaaggacaatgaatcaacctggcgttgtggtgcgctgcaagggatacttaaagaggcacattcactctttgcaatgttccatggaccaatccgaatgttacttgacagacaacccagtgccgagcttgctcgtggtcacctccgcacatttctcacagattatttgagtgattttcatgttggtaaaaagttgcaattcccaacctaccgtgacagcctaaaggagaggggaacagtccaaatgctcacagtatcacgagaagtagcacttgaagttcagtcactcgccacagttcttggatcatgtcttggaaatgtcacctgccaatcgctcatattatttgaagacctcttggtttctacaacactgcccccggatgatactttaaacctatatacttatgctgtcctgaggttaactcctcgtgctttatcttccaatgcaagctcttggtcctatttgcggaaaggaacttctattactgcaggcccaacttcaagttcatcgaatggaacaactgcaggagaaaggcctctcctgcgtgagaaattgtcaaagggaaaggacggttttgttgctgctgatttcacagctacagacgttcgtggtgctgtacccttgactccaatactctggttccagcaggcagaggagcgcatgtacctatgcatttatcagcacaagagtctcactgtccttttgctgattcctgcttcctcactaataaatggagaagagggtatcactcatgtgaagaagcaaatgcttgaaaatgcatctcagaaggttgtcactgtcgaacagaaattgtcacggggatggggaggagaaaatgcttatcatgttggtggatatcgttacttgctggttgatccagacagaagagtatcaagagcctccccacctgggaaagtcaccaccctggcaaaggattcactacttgccctcaataggctaagacaagaagtggatttagagaagtcaaggtacaagagaagtgacccttgtcatgataaggattttgaattatgcatcagaacgaaaaacaatgcatgggtgattgctaaaattactcgaggaagagagctttacatggctttagagaagggtggtgaaacacttctatatgcatccacagctgtagagaagttcagcaacaggtactgcgagggagcattctctacggactgaaagcaccagcatgagatgccccttttccatacacactagttccttatacaactcagctttcagctggatcggtggcttcattgtagcaaactcggatctctatttgcaaagggaataagggattcatatcagttgtacagctgctctgttatcatgtgc

SEQ ID NO: 5553 - DNA, 1931 bp, Echinochloa colona
cggcggccgccgcgggcgacggggcgcagctgtgcgtgttcgacctgcggagggggcagcaggaggggcaggagctcgacaagatcctcttcttccaccccgccgactgccccatcctgctccagctctccgtcatcgggctctgcgaggggatcgtcactttcacaagaatattttctcctgaagaggattgtgaagttatagaatctgagaaacactcccatgttttttatcaagcggaacctgatatttggatggttctggttgtgggaaaaaacaaggacaatgaatcaacctggcgttgtggtgcgctgcaagggatacttaaagaggcacattcactctttgcaatgttccatggaccaatccgaatgttacttgacagacaacccagtgccgagcttgctcgtggtcacctccgcacatttctcacagattatttgagtgattttcatgttggtaaaaagttacaattcccaacctaccgtgacagcctaaaggagaggggaacagtccaaatgctcacagtatcacgagaagtagcacttgaagttcagtcactcgccacagttcttggatcatgtcttggaaatgtcacctgccaatcgctcgtattatttgaagacctcttggtttctacaacactgcccccggatgatactttaaacctatatacttacgctgtcctgaggttaactcctcgtgctttatcttccaatgcaagctcttggtcctatttgcggaaaggaacttctgttaattcaggcccaacttcaagttcatcgaatggaacaactgcaggagaaaggcctctcctgcgtgagaaattgtcaaagggaaaggacggttttgttgctgctgatttcacagctacagacgttcgtggtgctgtacccttgactccaatactctggttccagcaggcagaggagcgcatgtacctatgcatttatcagcacaagagtctcactgtccttttactgattcctgcttcctcactaataaatggagaagagggtatcactcatgtgaagaagcaaatgcttgaaaatgcatctcagaaggttatcactgtcgaacagaaagtgtcacggggatggggaggagaaaatgcttatcatgttggtggatatcgttacttgctggttgatccagacagaagagtatcaagagcctccccacctgggaaagtcaccaccctggcaaaggattcactacttgccctcaataggctaagacaagaagtggatttagagaagtcaaggtacaagagaagtgacccttgtcatgataaggattttgaattatgcatcagaacgaaaaacaatgcatgggtgattgctaaaattactcgaggaagagagctttacatggctttagagaagggtggtgaaacacttctatatgcatccacagctgtagagaagttcagcaacaggtactgcgagggagcattctctacggactgaaagcaccagcatgagatgccccttttccatacacactagttccttatacaactcagctttcagctggatcggtggctttgttgtagcaaactcagatctctatttgcaaacggaataagggattcatatcaattgtacagctgctctgttaccatgtgctatatgtggcccggaaaacatagcttagtcagggaataatgcagagcagggtagagtttgttgttctcttacggcctcatgtcgtccttccgtggcacataacattttgcgcgttttaagcttcttgtaaacgctggcgatggacctggtgactgaaagagtttagcttaggatttgatttggtgattctgtattttgttgtgtcctggattgagctttgagttatatcccctgagagtagtggggctactgagaaagacgtggaaagaggctactgagttgtcacaacggttaaattcatac

SEQ ID NO: 5554 - DNA, 2328 bp, Sorghum bicolor
cgcacagcgtctcgccgcgccgcacgcctgcgtcggtcgccgaccccagccagccaccggtccacgcccgcctccccctctctccaccccgtccggtcacccgctgccgcgggccctagtccgccggatctccctccccggcgacccgtccccgcgccggaccagtccgggccgcgtggtcgccccacccgcctcgggttcactcgctcgcggttgcgtgtcccgcggggggtgacccctcggcagctcccggtttcgaatggggctctcgtcggccgccgcgggcgacgggacgcagctctgtgtcttcgacctccggagggggcagcaggagggccaggagctcgacaagatcctcttcttccaccccgccgactgccccatcctgctccagctctccgtcatcggcctctgcgaggggatcgtcactttcacgagaatattttccccggaagaggattgtgaggttatagaatcagagaaacactcccatgttttttaccaagccgaaacagatatttggatggttctggttgtggaaaaaaacaaggaaaatgaattggcttggcgttgtaatgcactccatggtattcttaaagaggctcattctctctttgcaatgtttcatggaccaatccgaactttgcttgacagacagcccagtgctgaacttgctcgtggtcacctccgcacatttatcacagattatttgagcgattttaatgttggtaagaagttacaatttccaacctaccgtgacagcctaaaggagaggggaacagtccaaatgcttacagtatcacgagaagtggcacttgacgttcagtcactcaccacagtacttggatcatgtcttggaaatgtcacctgccaatcactcgtactatttgaagacctcttggtgtcaacgacactgcccccggatgatactttaaacctatatacatatgctgtcctgaggttaactccacgtgctttatatgccaatgcaagttcttggtcctatttgcgaaaaggaacttctgttagtgctggtccaacatcaagttcatcaaatggaacaactgcaggagaaaggcctctcctgcgtgacaatttgtcgaagggaaaggacggctttgttgctgctgatttcgcagctacagaagctcgtggtgctgtacccttgactccaatactatggttccagcaggcagaggaacgtatgtacctatgcatttatcagcacaagagtctcactatcctactgctggttcctgcttcctcactgataaatggggaagagggcattgctcatgtgaagaagcagatgcttgaaaatgcatcacagaagattgtcactgttgagcagaaattgacacggggatggggaggagaaaatgcttatcacgttagtggatatcgttatttgctcgttgatccggagagaagaatatcaagagcctccccacctgggaaagtcaccaccctggcaaaggattctctacttgccctcaatatgctaagacaagaagtagatctagagaagtctagatacaagagaggtgacccttgtcatgacaaggattttgaagcatgtatcagaacaaaaaataatgcatgggttattgctaaaattagtcgaggaagggagctttacatggctttagagaagggtggtgagacacttctttatgcatccacagctgtagagaaattcagcaacaggtactgtgagggagcattctctacagattagaagcaccagcgcaagatcttaacttttccatgcattacctcctatgtacatcctggttcttcagctggatcgttcccctcattgttgcgagacccggatttctctttgcaaagggaataagaaattcgtatcggttgtacagctgctctgctataatgtgctatgtgcaaaagaatagcctgattcgggaataatgcagagcaggatagagttcgttctcttattacggcctcatgtccttccgcaacgcagagcattgtgcatgtttacattttattgtaccagctggcaatggacctgttgactgaaaaaaaaactcagcttaggatctgatttggtattctgtattttggtgatctcgtatcatatggttgagttgacgagttctatcttcggagaggagagactagagcggctacggagaaagagatagaacgaagttgtagtaattgtgttgttatacaacggtagtaaggtttaaatgctatagttgtagtaattgtgttgtactccatttcagattatatgttgttttgacttttctaggcataacaagctatgcccctagtagatattaagtggtaatgaag

SEQ ID NO: 5555 - DNA, 2027 bp, Oryza sativa
cgcgccgccccgtcgccggccgcaaccaccaccaccactcgccgtcgcctccgccccccgcacgcgctcctcccctcccctcccctcccctcccctctccccggccgcgccgctcgccggatctctcccctcctcccttccaggaaccccagccaagcaggtagcgtgtgacgggggaagggggggatggggctctcgtcggcggcggcgggggaggggccgcagctgtgcgtgttcgacctgaggcgggggcagcaggaggggcaggagctcgacaagatcctcttcttccaccccaccgactgccccatcctcctccagctctccgtcatcggcctctgcgaggggatcatcaccttcgctagaatattttctcctgatgatgattgtgaggtgatagaatcagagaaacactcccatgttttttaccaagctgaagcagatatatggatggttctggtagtggagaaaaacaaggacattgagtcaacttggcggtgtggtgcattgcaaggaattcttaaagaggttcactcgcttttcacaatgttccacggaccaattcgaactttacttgacaggcaacccagtgcagaacttgcccgtggtcaccttcgcacatttttcacagattatttaagtgattttaatgctggtaaaaagatacaattgccaaccttccgtgattgcctaaaggagcgaggaactgtccaaatgctaacaatctcacgagaagtggcacttgaagttcagtcactcaccacagttcttgggtcatgtcttggaaatgtcatgtgccaatcacttgtattatttgaagatctcttggtgtccacaacacttccaccggatgatacactaaacctatatacttatgctatcttgaggttaactcctcgtgctttattgtccaatgcaacttcctggtcctatctgcggaaaggaacttcggttcatgctggccccacttctagttcatcaaatggaacagcttcagtagaaaggcctctccagcgtgagaaactatacaaaggaaaggatggttttgttgccgctggttccactacttcagaagttcgtggtgctgtggcttgggttcccatactgtggttccagcaggcagaagaccgcatgcatctctgtgtttatcagcacaagaacataaccattctgctactgattccagcttcatctctaataaatggagatgatggcattgctcatgtgaagagacatcttcttgaaaatgcatcacagaacattgtgactctggagctgaaattatcacgaggatggggaggagaaaatgcttatcatgttggtggatatcgctacttacttgttgatccagatagaaaagtatcaagagcctccccacctgggaaagtcaccaccctctcaaaggattctctactttccttgaatagactaagagaagaaatagatttggagaagtcaagggccaagaggtctgactcttgtcatgacaaggattttgaagtatgcatcagagccaaaaataatgcatgggtcattgctaaagttacccgaggaagagaactttatatggcgttagagaaggctggtgaaacacttctttatgcatctactgccatcgagaagtttagcaacaggtactgtgaaggagcattctctacagactagaacaccgaaatgacaacgattgttttatccaaaccactcacctatccagcttcgtcatttaggctgtgcggctcgctccctcatggtgtcgtgaatatggatcttgttattttgaagagattcgtacatgttgtacagctgccatgttgttgcctttctatgcatacaaaacaaatagcttcgtcagagaacaatacagcgcaggaaacagtcagtttcccctgccctgcgctccgacgtccttccagttccagattcgaccatcttaatttgtttgttgtatattctgacgatggacctgctgacttatgtagtagttcattcgattgcttcgatatctatgtttcaattcagtttgttgt

SEQ ID NO: 5556 - DNA, 554 bp, Vigna unguiculata
gaacttcattcacgcattcaacatcaacatgatctgatagatcgtgtttcatctcacgtttccatatcagggaaatgggtttgtggactttacttgaggggtttttacttcttgcaaatgcaatggcaattttaaatgagggtcgttttcttgcacctagaggatggggtttcgcagatttctcagttggaaggactaagtcgttcaaaggccagcttataggtctcatttatgcaactcagtaccttagagttcccctcatacttctcaactccatttgcatcattctcaaattggtgtctggatgatacttcacaaggttacgagtttttgttagatgatttcacgaaggtctttaagatagcaggcttaccaaattcttgtatagaaatatcaactaaagtatgtctcctatttgtttgatattatttattaccaccaaataacgttctttaatgtattaacttagttaggctaaaatgtgggacattatgattttaaattcagtgttgtattcagtttattgagtattgattatcaaaaaaaaaaaaaaa

SEQ ID NO: 5557 - DNA, 696 bp, Arachis hypogaea
aagtagcatttgacaaaaacggtgcgctttggtgagactctattctttcgtctctgctctgtagtactgatacgccgttcccaatttccgtttcgcgccgccacacccttcatccaccgctccattctcgcttcttctgcgatcagtgcagggaaatgggtttgtggacattacttgaggggttcctgcttcttgcaaatgcactagcgatactaaatgaggaccgatttctggcacctagaggatggggcttatctgatttttcaagtggcaggacaaaatctttcaaaggccagctcataggtcttatttacgcaactcagtacctaagagttcctctcatacttctcaactccatctgcatcattttgaaatttgtttctggataatgcctagcaaggttcgggttaccactagatgatttcaagaagttgctcctgcgtagaacaattaatttgacaaattctattttagagagagcctccattacaagtgtttgtcttagtttgggatattggtcaattgattgttatttattgccctaaaatcatgtttaccattgtgacatcaatagtaagaaatgaaaatcattgtgacattagttgggtgggtgttgtattcaatttctgaagaatcaattatcatctgccaattttccttatgtaaactcttgatctatttttttaatagaattta

SEQ ID NO: 5558 - DNA, 644 bp, Cajanus cajan
cagaaaaacggtgcgtttcaataggttgggttctccttcgtcacacattgttcagagattcagcgtcagcatgatctgattgaatttcatctccaccgttccgttatcagggagatgggtctgtggactttacttgaggggtttctgctgcttgcaaatgcgcttgcaatattaaatgaggaccgctttcttgcacctagaggatggggtttctcagatttctcaggtggaaggactaagtcattcaaaggccagcttataggtctcatttatgcaactcagtacctcagagttcctctcatacttctcaattccatctgcattattgtgaagttggtgtctggatgatgcctcacaagatgtctagttcttaaaaattgaacgttctcgagtttctgtcagatgatttcacgaagatcttttagatagcaggtttgccaaattctattgtagaaatatcaattgaagtatttctcctgttttttgtgatattttttattaccacaaaatagtgttctttacaatagtaacatacttatactgaaagaaagaacattgtggttttaaattcagtgctgtattcaatttattaagtattcattatcatttctctttttatttttaattgattctagctttctttg

SEQ ID NO: 5559 - DNA, 1312 bp, Glycine max
agtaaactcttggcttcattcaaagaaacaagaaaaacggtgcgtttttgtcaggttggttttctccttcctcgctcgcacttcttcgttcagcatcagcatgatctgattgtgtttcgtctcatcccaccgttccgttttcagatttttacaaatcttcttttcaaaactaactcatttctatcttaactttgttccacttttattgaaaaaaaaaaaagatcatcatactttttcctcgttgcttttttttttttttatgaagatctaggattccgcatcattctcaatccttagttttgtggcattggctgaatgttgtgattttgttatttgaacacgattcctttatttttttgtctgtcacgtcgtaaaatgtttgcacctgtttctgttaattttttttaatttgaaatatggtttttgaatttttagtaggtgcagtgcactcatatttctttaaatttaattagaaaaagtaatttaattagcgtatatgagtgaatttgaggtgttccaagccaacaactgattgcaaaattgtaacttgtgagtgagatgttgttatgaaccaccaaccttcagttcatgaaaagtgatgaatcatgaaactctttgataataagctctcttttaagctccctgaagatggaagcatactcatttgccctgtaactgtcaatgactaaggtgattgtttcctattggattagttatgtgatggccacagggttggatttctttgcaatgcagggaaatgggtctttggactttacttgaggggtttcttcttcttgcaaatgcgctagcaatattaaatgaggaccgctttcttgcacctagaggatggggcttccaagatttctcaggtggaaggactaagtcgttcaaaggccagcttataggcctcatttatgcaactcagtacctcagagttcctctcatacttctcaattccatctgcatttttctgaagttggtgtctggctgatgcttgacaagatgtttacttcttaagtattgcatgttcaggagtttttgtcagatgatttcacgaaggtctttaagatagtaggtttgccaaattccactggagacatatcaattgaaatatttgtcctgttttttgtgactttatttattgccacaaaatagtgttcttctttacaatagtaacataggaagggcatcatgattttcaattcagagttgtattcaatttattgagtatcaattatcatttctcatttttttttgttctacttgattctagctttgcttgaccgaattgatgctgatagagtaactcccg

SEQ ID NO: 5560 - DNA, 717 bp, Glycine max
taagtaataacttcgattctgttctctaattattgggcttacggcgggtccaacataaatataggatccttctaaactcttggattccttcaaagaaacacaaaaacggtgcgtttcgatcaggttggttttctccttcctcgctcgcacttcttcgttcagcatcagcatgatctgattgtgtttcgtctcaccccaccgttccgttttcagggaaatgggtctgtggactttacttgaggggtttcttcttcttgcaaatgcgctagcgatattaaatgaggaccgctttcttgcacctagaggatggggcttccaagatttctctggtggaaggactaagtcgttcaaaggccagcttataggcctcatttatgcaactcagtacctcagagttcctctcatacttctcaattccatctgcatttttgtgaagttggtgtccggatgatgcttgacaaggtgtttctgtcagatgattgcacaaaggtcttcaagacagtagggttgccaaattccactgtagaaatatcaattgaagtaattgtcttgttttttgtgatattgttcattgccacacaatagtgttctcaatagtaacatagactgaaatgaagggcattatgattttaaattcagttttttattcaatttattgagtatggattggcatttctcatttttttctaattgattctatagcttattttgcttgac

SEQ ID NO: 5561 - DNA, 2553 bp, Lupinus angustifolius
agagtacatgggtgagattggggtttttcatttgcactgtgaaacgcatttgcgcgataatcaggttaccttcatctattccattctgaatcattctcaatccttccttttttgttatgaatcttaatatcttatagttcagctttacgttttttttattttatcagaattcaattcacattgttgcagtacaagtacttttttttgtagatgatagaatgtcgagttgaaaatttttatttaagaaattttgattgttgcctggacatataggaaatgtttgttagttgggttctggaggagaagaataagatagtagaagtttcaaaactatcgtgtttcatgtctctcaagccttctctccactctaaaacttaactcacagaaataaacccttaggttctgattgtgtgttgagttatggaggtgaaggaaaagggaaatgaaggcttcagagtcattttacaagtatatttcatgttctcatatcttttcattcatttccctcccaaactcaaatcgcaaacaaatccttagaagtataaaatatgcagtaagtgtaggttttgaaatgggaggggtgcaaggtgtaattgagatatgtgacatcccgggaatgcgaatataattaataatcacactgaccatccctgagagaggtgagtgtgtatgttgctctatatgatcttgtgatacaatgattctccaagtgattgtaaatgagattttaattttcaacaacctggtaattgatgcatcctatttgccttttgttatctactggatcagttctgtcttagcataggattggatttcattgcattgcagggaaatgggtttgtggacattaatagagggcttcttacttcttgcaaatgctctcgcaatactaaatgaggaccgctttcttgcaccgagaggatggggcttctcagatttttcgggtggaaggacgaagtcattcaaaggccagcttataggtctcatatatgcaactcagtacatgagagttcctctcatccttctaaactcaatctgcattattataaagttagtgtctggatgatgtagcaaggtatgatctcaatgcatatgtctctgattcaaacatttgttaattttgtatgtgagttaagttttctttaatttggttagaacaacaactatgtcctgtgtggaagtgccttgagtttttctaaatgttttgttgctgaaataaaatacatgaaaaagaaattatatgctgacaggaaaaaaaagtgtatttttattacagtgatgtttgaggcattctgactgatattattctagaatcataatatagcatattctgtgtattatcttcatacatgttgtacaggtgccaaatttagttcatgacttactgagtttagttctcaattttagtcattggtaattttatactgctcaactcttattgttaatcatcagtatgaaataactgttagaaacttagaatttgttttgttttggatctgactgaattctcctagcatggatagttttaaactgcaaagtcaagctagtgtagtcagcaaccttttcatctacctaagtatctttatctatgttctttcttcatctcatgaacttcatatatattatagtaagactcgggtgggaacaattgttattgtgagaaatgagaacaaataatatagatcattagatcttgtttgaaagtttaagattaaaggaagtgagcttataaccaataaataacttttaatcttaaccatctttgtatgattgtgaaaagcccagatttattttttgccccaaaaccatgttcactttgggactcaagagttagatgttgtattccatttttatgcgttaactatcctatcacttttctttactgtaagttctcattttacaacactgtctttaactatattaacagatcaagtatgatcgttgttttttcttgtttttaaaaatactataagattacaatcttaccatctcaacttttattgaaaattccacaaacctattgttttattaatgaacaaatgacaaatcaaagggaaaaaataaacattgcataaaaatataaggtgctttataaaaatgactcaataaagtttctaaaatgtgatttataattaggaccagaacaattgcttcttgcttacttcattgttggtgcttgaattttactctctgggtctcgggctgtattgttgttgggaagtaaggatcatattgcttatttaattgatttgggaatagtttaattagctattgagttactcatctcattatcaattggttttgagatgaaaccttgatcaattcaataattagcgctaaattttattgtttacttctactactactacaacgattcaacatttttgagcaagagttcaaggagtttcatgaaagaaatactcgagctagtttatttactcatcatttgatgagctaaaaatgatctaaaatttcataaactttattctgttttcaacaaactctctttacaaaagtcttgcctacttaacaaactacaggaatgcaatgttc

SEQ ID NO: 5562 - DNA, 611 bp, Lupinus angustifolius
gagtttgttcgattcgggatctcgtgttgttcatttgcactgtgaaacgcatcagcttgatcgtcgtccctccacgtcatcgtccaccgtaatcagtgcaggaaaatggggttgtggacattattagaggggttcttgcttcttgcaaatgcactagcaatactaaatgaggaccgctttcttgcacccagaggatggggcttctcggatttttcaagtggaaggactaagtcattcaaaggccaacttataggtctcatttatgcaactcaatacatgagagttcctctcatcattctcaactccatctgcattattgtaaagttggtgtctggatgatgtagatctcaatggaccatgccagtattaaatgcaaaaacaagactagcagcggatccaattgttgaaaatactttacttgtatcatcatcccctggcatgctgtaatctctagctggtgatcgtattcctgttcatgtgttggtagttagtgcacatccacgttggaagtcggggtgagagatgtaagaatcggatgaatttggattaagatattaatgattgaacgaaaaaaaaaacaattcagtaagcatacttaaaattattcaatt

SEQ ID NO: 5563 - DNA, 1216 bp, Glycyrrhiza uralensis
atctttcgtcttcgctgattcaaccgtccacgtcgtcaccggcacggcggcaccggcaaagccatccatcgttccgttcttgctccctctgtaatcactaattagggaaatgggtttgtggacattactcgaggggctcctacttcttgcaaatgcactagcaatactaaatgaggaccgctttcttgcacctagaggatggggtttatcagatttttcaggcggcacaacaaagtctttcaaaggacagcttataggtctcatatacgcaactcagtacctaagagttcctctcatacttcttaactccatcttcattattgtaaagttggtttctgggtgatgcctagcaaggttctggggttctacatcagatgatttcattttgtttttaggtcagaaattttgagaaattctattgaagaaatattcatttaaagtacctgttctgggatactgatccattgatgttattgtcataaaatcagaatcaaaaccttcatttcgctgccggggttattttacggttgtgcttttctggttatgatattagctccccgtcggcgtcaaccactgagccgaagctcttccacagctctcggcttccctcgcctcagatatgtaaggtatcgccgattaaggtagccaaaaaaaaacgccgtcggaaataaatcctgaaattccaactttgccccctgtacatatttgccttttcattttccctttttttttctattcctgggcgattataatctgataagggcagttccatgccaagccccaagagtcaccggaggggaaggttggccgagagatcttcgtcttatcaaggcctcaacgccatgtgcgccggtcaactacgccgtccgagtaccgttcccgacctcttgtcttaccggaacaacgccggagcggcgccggagggacttccgagacagcctccgaagctgctgctgaaggtgacggtgctcggaagcctcggtcccgtgcaggttctgttgaggccggaattgaccgtcggcgatctggttgaggcggcggtgcggcagtacctcaaggaaggtcgccgtccaatcttgccgtcgaacgttgcctccgatttcgaccttcactattcccagtttagcctagaaagtttgcatagagaggagaagctgatagaacttggttctagaaacttctttctgtgcctgaaaaagactgcccctgccactga

SEQ ID NO: 5564 - DNA, 673 bp, Vitis vinifera
ccacactcggatctccttccaattccagacgttcctacattcatttcccacgaatttctgaggatatgggtttgtggactctactggagggctgtctgctcattgcaaatgcattggcaatattaaatgaagaccgattcctggcacctagagggtggagtttctcagaattctcagggggcagaacaaagtcatttaaggggcagcttataggtctcatatacgcaacccagtacttacgagttcctctgatactactgaactccatttgcatcatcataaagttggtgtctgggtgatgttgttgcagatcagaagcagttggttcagaacattgggggattcctttgccagaaatgccttctacagtaggcagccattataagtttgttttcatagctgtaacaacttatttggggtgtgaactttgttgatttggttgttagtttttgtgccattgagacaacttttgcaccctatgaattgcaagtgagtttgttgaggtatcactattctgcttcttgcctcaatttgtccacatttattcatccattggttcatctactttgttgaggtatgaagccttatgtattggccttttgtattgttaatttcacttttgtacctaactgtgattaaaaatttagatatagcattatcatggtattgatta

SEQ ID NO: 5565 - DNA, 903 bp, Cajanus cajan
acgtaagatattgtttaatatatagggtcgatttaggaaacaggaaagcaatcaaaaggaaacggtgcgctttggcaaggttggattctgtcttcttatttcaatcgccgtttgctgtcttctctgattccaccgtccacgtcgactccgccaccgccgtataccgtcgtgatcttactcttactcctccctcagggaaatgggtttgtggaccttacttgaggggttcctgcttcttgcaaatgcactagcaatactaaatgaggaccgttttcttgctccaagaggatggggcttatcagatttttcagctggccggacaaaatctttcaaaggccagcttataggtctcatttatgcaactcagtacctaagatttcctcttatacttctcaatactatctgcattatcgtgaagttagtttctggatgatgctgggcaaggttcaaagggagtatctatgatctacccaagcattttgtctccaatgtccttttgcttatgcagatcgcagaatgtggtttttattttcttattaagaagctgcggggtataatggatgtatcatgacatgcaacatgctctgtttcttaataatgtcaggttcaggatttatcatcagattatttcaagttgttcttaggttggaaaatttgataaaagttagataccaaacaaatgacaaaattcgattgtagaaatatacattaaaagtatcttttttgggatattaatccattgatgttatttattatcgtaaaatcatgtttgccttcatgacataactagtcagtaaatgagatcattgtggttgtgatattagttggacgggttttgtattcatttttgaagaattaatgatagctgttaattttccttgtgtaaattctcagattgttttt

SEQ ID NO: 5566 - DNA, 741 bp, Cicer arietinum
ccgcaaagcatttgataaaacggtgcgttttggcaactattggtttcatcttagttctgctctagattagcattgccatcggtcgcgttccctgattccccgtccacgtccacgtcgacaccggcatcggcaccggaaaactatcaaccgttccgttcttgtcctctccgtaataatcagggaaatgggtttgtggacattacttgagggtttcctgcttcttgcaaatgctctagctatactaaacgaggaccgctttcttgtgcctagaggatggggcttatcagatttttccggaggcaggacaaaatctttcaaaggccagattataggtctcatttatgcaactcagtacctaagagttcctctcatacttcttaattccgtcttcattattgtaaagttggtttctgggtgatgcttggcaaggatcatgcatgtgcggtttaaggaattcacaagatgtttagcactattccagtctcttcctggttgcaggtgctgaagttttacatcccatgatttcaagttgtttttagataggaatatttgagaaattctattgtaattgtaagaatatacatcaaaaacatctcttttgagatcttgatccattgataatattaggcacaaaattatgcttgctaccacgacatatgtagtcagaaatggagattattattgcgactttagctgggtgggtgcagtattcattttataagaattaattaaatgggccaa

SEQ ID NO: 5567 - DNA, 594 bp, Castanea mollissima
ctgctccaggctccgatttcggttcctttccccattaccaaacctttcagagatcaggttccaacgaccaggaaaatgggtttgtggacattattggagggatttctacttcttgcaaatgcattggcaatattaaatgaggaccgcttcttggcacctagaggatggagcttctcagaattctcagggggcaggtcgaaatcatttaaggggcagcttattggccttatttatgcaacccagtacttaagagtacctctcatactgttaaattccatctttgttgttgtaaagttggtatccggataataccacgtaagtttctgaatgattgcagatatcataaagatacaccagattgcggggactacacaaaaagaaagtttttctgagaggctgaagaattttgttctgtgtgcttcattttcttttagggtggttgtggggaaggattagtcattttaaggctgtttttatgcggtaactgttgccaacgtataaacttcaaatgccgcactttctcttaagtctcttttgtggtaatataattccctatgaacaactcaataatttactttcaaaccatatgttgac

SEQ ID NO: 5568 - DNA, 446 bp, Castanea mollissima
ctgctccaggctccgatttcggttcctttccccattaccaaacctttcagagatcaggttccaacgaccaggaaaatgggtttgtggacattattggagggatttctacttcttgcaaatgcattggcaatattaaatgaggaccgcttcttggcacctagaggatggagcttctcagaattctcagggggcaggtcgaaatcatttaaggggcagcttattggccttatttatgcaacccagtacttaagagtacctctcatactgttaaattccatctttgttgttgtaaagttggtatccggataataccacgtaagtttctgaatgattgcagatatcataaagatacaccagattgcggggactacacaaaaagaaagttttcttgagaggctgaagaaattttgtttctgtgtgcttcatttcttttagggtggttgtgg

SEQ ID NO: 5569 - DNA, 676 bp, Vigna unguiculata
gatacacagtagatggagttcagcaaggttgggttcttctctatagtggtgtgcatttattgttttctctgatttcaccgttcacctccacctcgccgccgccattaacactttccttcgtgctcctctctcaggtaaatgggtctgtggacattacttgaggggttccttcttcttgcaaatgcactagcaattctgaatgaggaccgatttcttgcacctagaggatggggcttatcagacttttcggccggccagacaaagtctttcaaaggccaggttttaggtctcatttatgcaacacagtacctaagatttcctcttatacttctgaactctatctgcattatcgtgaagttagtttctggatgacgccagcaaggttcaagagttatcatcagattatttcaaaatgttcttaggtaggaaaattggacaatgattatctacccaaaaaaggtcaaattctattgtagaaatatacattaaaagtgttctttttaggatatttgttgtcgtaaaatcaagtttgcaatagtgacatacgaatcagaaaatgagttcattgtgcgggtgttgtattcaatttttaagaattggttaccctctgcaagttttccttgtataaattcagattgattttaactgcttcttgtttgataaaaaaaaaaaaaaa

SEQ ID NO: 5570 - DNA, 720 bp, Ricinus communis
caaacccgcctactattgtggcaagaacgtgccttttcaatccttacagtttgctttaaagaaaggcttcaaatttcagattccaaatttaccattcttaccattcgattcagttgttcaaaagcttcttcgattcaaatattaccaacttcgcattgcatatattttagctgttcgggaccatgggtttgtggacattactggagggctttcttcttcttgcaaatgcactagcaatattaaatgaagaccggttccttgcacccagaggatggagcttctctgagttttcaggaggtcggacaaagtctttcaaggggcagcttatagggctaatatatgcaacccagtacatgagagttcctctcatgatactcaatgctatttgcattgttgtaaagctagtgtctggatgattccacgaaggttgcaggattatatggttgcactggataaataggagtctgcggatttgggaagggcagaaatatgttgaaaattaaagaaaaaacttcaaacattattttgtatggttagtggttttaaggttgtatccctagctttagaaaattatagctctgcggaagcgaattttgtagatttggggaaaatttcttaacctgatgcttgtaatcttctgtcagaagttttggaaattgacctattatatgacgttttattcctagatcattccactattaattgaagcaatgagaatat

SEQ ID NO: 5571 - DNA, 1466 bp, Trifolium pratense
gtttgaaccccggttgcagtccttttaactactccaactcgttgaacccttagctttaactagttgagctaccctaccccattttagaaggattattaactcgatgttgtatagcgctgctcgctagggttttagataaggagaacaacaactaaacaacaaaaatagttatagttcaagtagctaggtttcactttcactaggcatattgggctagaagtgcagtggtttgttatcactctactgttgggccaatcgccaatgagaatccctcatgtggtgcctttcttgtctaggaccaacaagaattgggcattctcccaggccccatcagttgactctcaacttggaggccagcatttgcagcctggcccaacccagtggaatctgaaccatgttccaccaccttaaataggaagttgctacttgtcggttaaattcatggtaatgattaattgcaatgatgatataaccattggccttttaaagctgaaatagacaagtaaattgaattaaggagtgtccccccccccccccccccctactctttgttgcccatgcatagtttttcaatgattcataaagcatcgagtagtcctttattctaacatatgatatcttccattcttctgtaagtcattactatacgctgatttatacttttatagataatcaagatatagtatttgattttttaagaagttattgaggtggttcctgaggagaagcttaaggggtgatctgtgctagactttctagagaaagctttatatgatttgtcttaatcatttgttaatttgtattagtcatttgttgttattctctgcttctgttaaaaggttaacagtcatttgttatgacttgaagtaattcgtcagttgagttggatttgttttacaatgcagggaaatgggtttgtggacattacttgagggctttctgcttcttgcaaatgctctagcaatattaaatgaggaccgctttcttgtccctaaaggatggggcttatcagatttttcaggaggcaggacaaagtctttcaaaggccagattataggtctcatttacgcaactcagtacctaagagtccctctcatactttttaactccgtcttcattattgtaaagttggtttctgggtgatgtctagcaaggtgctggagttttacatcgcatgatttcaagtttatttaggtaggaaaatttgagaaattctattgtaagaatacacgttgaaagtatctcttttgggattttaatccattgatattattagtcacagaatcacgcttgctacaatgacatatgtagtgagaaatggagatcattattattgactttagctgggtgggtgctgtattcattttctaagaattaattaaaataggccaatttccttgtattatcttcaccctgttttcaattgcttgttgtttgattggtgatgtgttccgaactgattcggc

SEQ ID NO: 5572 - DNA, 630 bp, Fagus grandifolia
atttgccacgttctactccattctcgtttcagtgaagcctctactccagactccgatttcgatctcttttcaaatatcagcttcttctatcaggaaaatgggtttgtggactttattggagggatgtctacttcttgcaaatgcattggcaatattaaatgaggaccgcttcctggcacctagaggatggagcttctcagaattctcagggggcaagacaaaatcatttaaggggcagcttataggtctcatttatgcaacccagtacttaagagtacctatcatactgctaaactccatctgcgttgttgtaaagttggtatctggatgataccatgtgagatatcataaaggttcacaccagattgatgggactcacgaaaagaatattttttctgaaaggctggagaatttagttctctgtttgtcttcattttctattttctctttcttttttcttattcttcgtttttaggggggggggggggtatcggagaacgcttcaatggaatgatcctttatgtgattagtctattttaaggtttttgtctttcattgactatatctagagtggggtaatgtagtacactgctatttattgaattgttactggtctggttcgcgtagtgt

SEQ ID NO: 5573 - DNA, 781 bp, Ricinus communis
attgtcttatttttccctttttgtgcgttaaattgaatgatccggatccggatgcggaccaaactcggatattcataatcaaacccgcctactattgtggcaagaacgtgccttttcaatccttacagtttgctttaaagaaaggcttcaaatttcagattccaaatttaccattcttaccattcgattcagttgttcaaaagcttcttcgattcaaatattaccaacttcgcattgcatatattttagctgttcgggaccatgggtttgtggacattactggagggctttcttcttcttgcaaatgcactagcaatattaaatgaagaccggttccttgcacccagaggatggagcttctctgagttttcaggaggtcggacaaagtctttcaaggggcagcttatagggctaatatatgcaacccagtacatgagagttcctctcatgatactcaatgctatttgcattgttgtaaagctagtgtctggatgattccacgaaggttgcaggattatatggttgcactggataaataggagtctgcggatttgggaagggcagaaatatgttgaaaattaaagaaaaaacttcaaacattattttgtatggttagtggttttaaggttgtatccctagctttagaaaattatagctctgcggaagcgaattttgtagatttggggaaaatttcttaacctgatgcttgtaatcttctgtcagaagttttggaaattgacctattatatgacgttttattcctagatcattccactattaa

SEQ ID NO: 5574 - DNA, 1017 bp, Cucumis sativus
attacccacggtttatgctctctctccgtcgccgtcgtacacctacacccacccagcctcttacttactctcagtcgccaccccccttggtcgccggagtcgatagatcggctctcgctctcgatcgctcaccatctgcctctctggttatccatcaccgtgcggcactccatctttttattgccggaatttgtggagctaaaaatatcacattcattccttcttcgactgttttttttccttcctcccaggctaactgaaaagttatttgaggaccaaaaaacagcaaagagcagacaagaacgtgttctgtacaaagtagtctctagagtttctgtttcgaattcgagcagctgaggtaaatgggtctgtggacactactcgagggttgtctgcttcttgctaatgcgctggcaattctcaatgaagatcgctttctcgctccgcgaggattgaacttctctgaattctcaggaggcagaacaaagtcattcaaagggcagcttattggccttatctacgcaacacaatatttaagagttcctctcataatgctaaatgcaatctgtatctttgtaaagttagtatctggatgatgagccaactgacgtgagatgtcaacttcaactctggaaagatatttgactatctaccatattattatgttctttgttgtaatgtaacaatggactgcttttaacttctgggtttgtgggaacacaccatgttgcagtttgcaccatagccaaattctttttgggacatgtcaaggtagaacaaagaggaattctgctattttttttttccttttagaaatgagatatcattaacttgggttcatattggtcttgcatcaagattaaaccgtttttttttatggaaactttgatggaaataggtatttttggcatggtttcttatatactcttcatactttttgttcttatagttataattttaaagagaactacttgttctttttgtaaggtaatattaaaagaaatgtagtccatctac

SEQ ID NO: 5575 - DNA, 559 bp, Cucurbita pepo
aatcatctgatttttaagatttgaataaagaaaaagaaagcattttgtgatgcaattgtaacaggttgtgcgggtcattctcgggttcactctgcgatctgtagcggcttcacaaccggccatttccaactcctccgctctctccgatcaggttctttgcaacacagataataaatgggattgtggacacttctagaaggctgcctgctactcgccaatgctctagcgatcctaaacgaagatcggtttcttgctcctagaggatggagcttctcagacttctcaggcggcagaaccaagtcattcagggggcagcttatagggcttatctatgcaacacaatatttaagagttcctctcatgatgctcaatgtcatctgcatctttgtcaaattggtatcaggatgataactaccgttaaaggcaggtttgcacttccttccattttgagaaagttatttccggtgtattgttcttgatttagtatggcctttgttggtttgatgtaacaaacaattggctgctatgagataactataacatctgagagttagaaaca

SEQ ID NO: 5576 - DNA, 785 bp, Medicago truncatula
ctggaaaactctctcattctcaaacaaaccctagccgccgcctcctccctccttcagtgtgtctccggcggtcgttacattgctccaccatcttcatttttgaaaatccatcaccataaaaagagtcccctccatcttctctacaaaacccatttaaaaatatcaggaacggacaaccttcgccggtgaccaccacgccggagcttgcaaccaccgcgccggggaaatgggtttgtggacattacttgaaggccttttgcttcttgcaaacgcactagcgatactaaatgaagaccgctttcttgtccctaaaggatggggcttatcagatttttcaggaggcaggacaaaatctttcaaaggccagattataggtctcatttacgcaactcagtacctaagagttcctctcatactttttaactccatctttattattgtaaagctggtttctgggtgatgtctagcaaggtgctggagtttcttaatggctgcaggtgctggagtttacatcacatgattttaagttgtttttaggtaggaaaatctgagaaattctattgtaagaatatacatttaaagtatctctattgatttttgatccattgatattattagtcacaaaatcacgtttgctacatgtagccaaaaaaggagaatcgaagatcattattgtgactttagcttgatgggtgctgtattaattttctaagaattaattagaatgggccaatttccttgtattatcttcagcttcttttcaattgcttattgtttgattggcg

SEQ ID NO: 5577 - DNA, 857 bp, Quercus alba
gagagtctgtggtttgtctttgcccggttgagttaaagaagttgaaccccggttgttaagtatgttttaacattataaatgacgtggcacgtttttgagcgttgataattttcaaagaaatcttgtccgtgtactggacccggatccagatcccttaaaagtttacgttgcacaaaagagacgccacgttctgctctccattctcgtttcggtgaagcctctgctccaggctccgatttcgattcctttccccattaccaaaccttttcagagatcaggttccaaccaccaggaaaatgggtttgtggacattgttggagggatttctacttcttgcaaatgcattggcaatattaaatgaggaccgcttcttggcacctagagggtggagcttctcagaattctcagggggcaagtcgaaatcatttaaggggcagcttatcggccttatttatgcaacccagtacttaagagtacctctcatactgttaaactccatctttgttgttgtaaagttggtatccggatgataccatgtaagtttctgaatgattgcagatatcataaagataaaccagattgcgggaactacacaaaaagaaaatttttctgaaaggctgaagaattttgttctgtgtgcgcttcattttcttttggggtggttgggaggaaggattagtaattttaaggttgtttttatgctttaataacaaatctaggtggggggaatgaggacattttgaatttaattgaatgttactgtttgatttttgtattttattgaaatagcttttgcaagtgatcattcaaagtaacatatagttagaccgtatgcggggtaactgttgccaacgtat

SEQ ID NO: 5578 - DNA, 946 bp, Carica papaya
caatccaaggaagctcgtcatcactgtgaattccggttgaataatcgtcggtaaatgagatctcagtcctttttctacctcttccctcctcttttgcttgctctgttattctccatctaggattcaaaccctcatttttacacctccaatccctcaccaaaccctttttattttctctccaacgccagagcttcttcacattttctgatttccgcaacacccacttccccgcttcttactccaaggtgtaaagctcggatcagcccgcttctaatttcgttcaccaaagctttcctggttttcgttcataagcacgttcgaaatcaggtagattccagttctatcagccctaccaccagctacaaacgtcgatccgtttaccttctccagctgtcagtcgtaataggaaatgggtttgtggacattattggaaggctgtctgcttcttgcaaatgcattggcaatattaaatgaagaccgctttcttgcacctagaggatggagtttctctgaattttctgctgggcagacgaagtcatttaaggggcagcttattggtctcatttatgctactcagtacttgagagttcctctaatactactcaacttgatttgcatccttgtgaaattggtatctggatgatgccagttgaaccagaaaaaaggagagggatgtttttagagtggcagattcatacacgtaaaggaaacttttggttcagagatattgttcaaaattgtcctgttttaacgatgaggcatttgtaaggtaaggttgtatccgaagctttcagcatgttcaagatgtgagaatgagaatattgtgagttcagcaaattctatgactgtcactgagaatttgtttcattccccagtaagtgaaatcacactaccaatttcagtttgtgctcaacaaatttaaagtctcatttatttattttcttct

SEQ ID NO: 5579 - DNA, 586 bp, Rhizophora mangle
gctcttttttctttttctgtttctttcttctctctctacgtttattatcaattattaccgtgggaatcgccctgcggaagcctgttctggcaactttgctttgcaggtagaggaaatgggtctttggacattattggaaggttttctgcttctcgcaaatgcacttgcaatactaaatgaagatcgttttcttgcacccagaggatggagcttcagtgaattctctgggggtcggacaaagtcctttaaagggcagcttataggtctcatttatgcaacccagtacatgagagttcctcttatgatactcaatgccatctgcattgttgtcaagctggtatctggatgagccactgaggactccttcctgcattgaatgttgaggagttcctcctgcatcagatgtttagtagcctctaaaggagcttgtaagataagaataatgaagcacgtattggccacatctcttggaaggcaatagtaaccataccaagctttgcctcactgtccaaggctttaaatcttttgcatgcagctgtgtagaaatggtttagtatttggggagatgaactgtaattcatcatag

SEQ ID NO: 5580 - DNA, 1078 bp, Glycine max
aatgtggtcagaaaaacggtgcgctctagcaagtttgtggctttgtcttatcattggttaccatttgttgtcatctctgattccaccgtccacgtcatcaccgccaccgccaccgccaccgccatctactgattcgttttttgctccttcctcaggttacctccttcaccttctccattcctccatatttttttaatctttcttcttttcgtgttcaatcgaaggtggtcctctagttcgttccgctttaaaatttacatttttttttgtcacattcacttttggttgttggatttgttggcagatctagaattctgtatttgttaaacttggtcttgtgtgtctgttatttgatctgagttcctttgttattccgaattctgatccatgccttaaaatcatttgtgcctgccaattgtttcaatgtgtttgaactttgaagtgtgtactttgcacaacaataattgacacccagataaaaaaaaaggggcaaagccgtaaaagataactactatcattgaattagaaactcttcaattgagagaaaatgggattgtggaccttacttgaggggttcctgcttcttgcaaacgcactagcaatactaaatgaggaccgctttctcacacctagaggatggggcttatcagatttttcagctggccagacaaaatcttttaaaggccagcttataggtctcatttatgcaactcagtacctaagatttcctcttatacttctcaactctgtcttcattatcgtgaagttagtttctggatgatgcctgaaaaggttccaagagttatcatcaggttatttcaatttgttttaaggtaggaaaatttgacagtagttatctaccaaaaaaatgatcaaagtattgtagaaatattcattaaaagtatcttttttgagatattgaatcattgtcctaaaatcatgtttgccattgtgacataactagtcagaaaatgagattcattgtgattgtgatattagttgtgcgggtgttgtattcattttttaagaattaattacgtctgctgatgttcctattgtagattctcattttgttttt

SEQ ID NO: 5581 - DNA, 581 bp, Citrullus lanatus
atgatcaaaacacagcagagagcagacaagaacatttccagtacaaaggaatccctagagtcaaaaccctctgaagtgtgtttcaagtagccgaggtaaatgggtctgtggacactactagagggttgtctgcttcttgctaacgcgctggcaattctgaatgaagatcgctttcttgctcctcgaggattgaacttctctgaattctcaggaggcagaacaaagtccttcaaggggcagcttattggccttatctacgcaacacaatatttaagagttcctctcataatgctaaatgcaatctgtatctttgtaaagttagtatctggatgatgagctctgctgaggtgatgaactctggaaaaatatatctaccatatcattcttgttttctctattgtaatgtaacgatggctgctttaacttcggaatttgtggggaacgcatgttgcaccaatagccaaattcttttgggacatgtcaaggtaggacagaagatatggctactctttaattttcttttttgatgtgagatatggttagcttggtttcatattggttttgcatcaagattacactat

SEQ ID NO: 5582 - DNA, 802 bp, Trifolium pratense
gtatcattcttctctttggtgcaagcaaaacaatcgataaaacgcagcgttttggcccaattcgtttgatcttagcatcgtgattgatcgtccctcttccctaattcaccgcgtcgacaccgtcaccggcaaagctattcaccgttccgttcttgctccttctgtaatcagggaaatgggtttgtggacattacttgagggactcctgcttctggcaaatgctctagcaatattaaatgaggaccgctttcttgtccctaaaggatggggcttatcagatttttcaggaggcaggacaaagtctttcaaaggccagattataggtctcatttacgcaactcagtacctacgagtccctcttatactttttaactccgtcttcattattgtaaagttggtttctgggtgatgtctagcaaggtgctggaggtttacatcgcatgatttcaagtttatttaggtaggaaaatttgagaaattctattgtaagaatacccgttaaaaagtacctcttttgggattttaatccattgatattattagtcacaaaatcacgcttgctacaatgtcaatatgtagtgagaaatggagatcattattattgattttagctgggtgggtactgtattcattttctaagatttaattaaaataggccaatttgcttgtattatcttttacttgttttcaattgcttattgtttgattggtgatgtgttccgaactgattcggctcgaggaactatgaaattatttgatctataaccatataaatgggcttataagaaagtccataattcat

SEQ ID NO: 5583 - DNA, 728 bp, Vicia sativa
gtttgatctcgttcctctgaattcttcaccactgaaattcctggggaatgggattgtggacattactcgaggggttactgcttcttgcaaatgcgctagcaatactaaacgaggatcgctttcttgtccctaaaggatggggtatgtcagattttgcaggaggcaggacaaaatctttcaaaggccagattataggtctcatttatgcgactcagtacctaagacttcctctcatactttttaactccatcttcattattgtaaagtttgtttctgggtgatgcttagcaaggtgagatgtcagtacttatagatatgttggacttgcattcttttaattttgagtgtgtagacggtagatagtaataataacagttatagaaaagatttgctgttgttggagtaccttgagtcactaatgaatgaaatgtatgcaaaaattgcatgtcggttactattaaaacctatgttgtcaataacacgctacgctagcctataatagaatagcgtagtggtggtagggtttggcatgacgctgttggtctgcaaggcactgtcaacaatagaggcaatagtggccacttattgcggccccagaccgctatcactgctgttattgcgttgtgtctgttattagaattttggggataaatttctcaaattctttttttttaaactgttgtctatttttaaggataaaattttcaatctgaacccttaagagtaat

SEQ ID NO: 5584 - DNA, 608 bp, Phaseolus vulgaris
tctttacattgcaggtaaatgggtttgtggacattacgggcggggttcctgcttcttgcaaatgcactagcaatactaaatgaggaccgctttcttgcacctagaggatggggcttatcagatttttcagctggccagacaaaatctttcaaaggccaggttttaggtcttatttatgcaacacagtacctaagatttcctcttatacttctgaactctatctgcattatcgtgaagttagtttctggatgatgctagcaaggttcaggagttaacatcagattatttgaaaatgttcttagatcggaaaattggaaattggttatctacccaaaagaatgtcaaaattctattgtagaaatatacattaaaagtgtcttttttaggatatttgttgccgtaaaatccaatttgccgtagtgacataacgaatcagaaaatgagttcatcgtggttttgatattgggcgggtgttgtattcattttttaagaattggttactctctgcaaatcttcattgtataaattcagattgtttttaactgcttcttgcttgataggtgatatgtgttcgaatatgtgattctcaacttgatggcttctattaa

SEQ ID NO: 5585 - DNA, 337 bp, Chelidonium majus
cacgtccacactcccttacaggaaatgggtttgtggacattgttggaaggctttttgcttcttgcaaacgcgttagctatactgaatgaggatcgtttccttgctcctagagggtggagcttcgcagatgtctcaggaggcaggacaaagtcgttgaaggggcaacttatagggctcatctatgcaacccagtacttgagacttccccttatagttctcaataccatcacaatagttgtaaagcttgtatctgggtgaaactggtcagagtaagacgtgtatgaaatacagtggtctggtgtaaccttttgtcagaacatggattactaactcttgc

SEQ ID NO: 5586 - DNA, 814 bp, Eucalyptus grandis
ggggctcaattaagattttgaaaatgatgagatctagccacagtacttcatcgcccgaatcctgaaggaaccgaaaggcgaaacagcgaaaaacgcttccttcgcggtggccgagattttgtagagcggcggccggtgattctccagtgggtgattgacggcgtcaggtggtggttcggcggtcgtcctcttccggcgagagggtgggcgttaaggccggtcacagcgagagaaaaagcagtccgggaatgggtttgtggacattacttgaaggccttttgcttcttgccaatgctcttgcaatattgaatgaggaccgtttcttagctcccaggggctggggcttccaagaatttccaggcgggaaagcgaaatcattaaaaggacaggttataggtctcatttatgcaacacagtacttaagggttccccttattatcttaaacagcatttgtataatcataaagctggtctctggctagtatcttgtggtaaccgtaccctatgagaagcttaattggtatgtccttcctcacatatgttgtgcctgtaacatctatttttcctctctttttttgaatttgcactgtgaagaacagagttttagagaagattgggctatgttttttatctctagggggtgatgatggtgaatagtacagttcattagtcatttacaacggaagaatgtgctcatttgacgatgttgatgcttattgcttttcatttgattgtattgaacttgtgaaggaatgcattttttgaggtaaaaaaattttgccaatagttttgactccctcttatgtggactggt

SEQ ID NO: 5587 - DNA, 537 bp, Linum usitatissimum
ttgctgctccttgggttctcagttttccgttccggactttcctctgccaatcaacgccgggcgaagcttcgcagggaaatggggttgtggaccttgctagagggatttctgcttcttgctaatgcactagccatattaaacgaagaccgtttccttgcacctagagggtggagcttctccgaattctctggagaacgaacaaaatctttcaaggcgcagatcattggtcttatttacgccactcagtacatgagagttcccctcatcatactcaactcgatatgcattgttgtaaagcttgtgtctgggtgatgcttccaaggattgtgatgttgcatcaagactagtagggagtttgcaacacgaacaagatttcgctatgaggggctgaagctcatggtttgcaaggttggttatagtgtgtcccttgtagattagtgctcttagaacagtttgcctagcctttagaacaatcaattagttgtggaaattatgatgtaatggagtttcacgttctatagtttaaatgcagctttc

SEQ ID NO: 5588 - DNA, 699 bp, Linum usitatissimum
gacagcgatccgatctgagacagtttgctgctccttcgattctcagttctccgttccggactttcctctgccaatcaactccaggcgaagcttcgcagggaaatggggttgtggacgttgctagagggatttctgcttcttgctaatgcactagccatattaaacgaagaccgtttccttgcacctagagggtggagcttctccgaattctctggagaacgaacaaaatctttcaaggcgcagatcattggtcttatttacgccactcagtacatgagagttcccctcatcatactcaactcgatatgcattgttgtaaagcttgtgtctgggtgatgccactaaggattgtgatgttgcatcaagactagtagggagtttgcaacacgaacaagatttcgctacgaggggctgaagctcatggtttgcaaggttggttatagtgtcccttgtagattagtgctcttagaacagtttgcctagccttgagaacaatcaattggttgtggaaattatgatgtgatggagtttcacgttctatagtttaaatgcagcatttgaaatgttaatcttcttccagacatacattttgtcatgagtgacctgaatacgcctcagatcgattcagatgataagttcagatatcttgttcgatcaactgtttccaatggctgactattatatcattcccacatcccg

SEQ ID NO: 5589 - DNA, 1017 bp, Cucumis melo
atttacgattacccacgatttatgtcctctcttggtcgccgtcgtccacctacacccatccagcctcttacttactcccagtcgctacccccctttggtcgctggagtcgatagatcggctgtctctctcgatcgctcaccatctgcctctctggtcgtccatcaccgtgcggcactccatctttttcttgccggaatttgtggagctaaaaatatcacactcattccttcttcgactgttttttaccatcctcccagcctaactgaaaagttatttgaggaccaaaaaacagcaaagagcacacaagaacgtgttctgtacaaagtagtctctagagttcctgtttcgtatccaagcagctgaggtaaatgggtctgtggacactactagagggttgtctgcttcttgctaatgcactggcaattcttaatgaagatcgctttctcgctccgcgaggattgaacttctctgaattctcaggaggcagaacaaagtcattcaaagggcagcttattggccttatctacgccacacaatatttaagagttcctctcataatgctaaatgcaatctgtatctttgtaaagttaatatctggatgatgagccccaaccgatatgagatgtcaacttcaactctggaaagatatgactatctaccatattattatgttctctgttgtaatgtaacaatggactgcttttaacttctggatttgtgggaacacgcatattgcaccaatagccaaattcttttcgggacatgtcaaggtagaacagagtggaattttgctatttttttttttccttttagaaacgagatatcgttaacttggtttcgtattggtcttgcatcaagattacgccatttctttttcatggaaacttttatggcaataggtatttttggtggtttcttatctcttcatattttttgttcttataactataatgttaaaagagaactacttgttctttctgtaaggtaaaattttaaaagaaatgtagtccatctac

SEQ ID NO: 5590 - DNA, 1338 bp, Populus trichocarpa
ctcttgtataatttttgcctaaccaaacgtgcccttgatacaatcaatctaaattctcacagttgcttgacaagaagaggcttcttgctttagttcaaagctctgatttgggttcgcattcgcataacttgctcagcgattcaaagcatcaaagaggaagcagctttgccttcacaggaaatgggtttgtggactttattggagggctttctgcttcttgcaaatgcatttgcaatattaaatgaagatcggtttcttgcacctagaggatggagcttctctgaattctctgtaggacgaacaaagtctttgaaaggccagcttatcggtctcatttatgcgacccaatatatgagagttccacttataatactcaattccatttgcatctttgtaaagctggtgtctggatgatgatgctaagcaatcatggagtttggctaataggattgtaaacaacatttctttttagaaaggcagaggaggcatacgattcaggaaatccaagacatgattgatttatttggaatatcctttctcaaaaactagtgtttttaaggttacatatgttgcgggaaaaaaaaacgatgagatgtggggtgaaaatggtgtggatttagggccattttataattggtgtttgtattgtttgacaagtttcaaaagtaactaacgttctatgacatttagtgttttgttgtcaacctaattattcttcatgatttgatgcagtaataatgtttttccttcatttctcgatagattctgaatgttaatgcgaggaacacccttactggagtggatgtattttacgctcgttatgcatttgaagttgcggtcttgtgtgtgaaaaccaattgtgacttcactgtttggttcttatgggaacatttggtgttcatttcatcagtgtggtgaggggcttcatgtgattcttctacatgcaggcagatgttgaaataggatacctggggtgctggtccctttttcagttaatgctgtgatattgatgcgcaaaatctgatgtttgcccaaaattttttataaatcagaggaatgaaagcgcactcctttcacttctcctttttaaccaacaacctatcaagattccactctccattataggattctacaacctccatacgggttgtgctgtgatggagagcacaagtttagaagtttttatactatattcaacgaggtactatttcaagaagtgtacgtgtcgaatgtagctgtttctgccatcatttttatgttggcatctatttatctatttttgcagactcgatctggatgtcaagtaatcgggataatgaattctgcatataatcacac

SEQ ID NO: 5591 - DNA, 378 bp, Rosa hybrid cultivar
cgtctttcgtccttctttgaagcttttcgcatcttcgaagtctctctctttctctgagatcaggagctaccatcaggtaaatgggtttgtggacgctacttgaaggcttcctgcttcttgcaaatgctctagcaatattaaatgaggaccggttccttgcgcctaggggatggagcttctcagaattctctgtgggcaggacaaagtcattgaagggacagattataggtctcatttatgcaacacagtacctgagagttcctctcgtgctactcaattccatctgcattgttgtaaaattgatatctggatgatgccaaatgaggttttgtgcagattcatcaaatttctatgggagtctgccaagtgccacttcca

SEQ ID NO: 5592 - DNA, 1603 bp, Glycine max
taaaaaaaaaaacacgcaaagcaattgaaagaaaaacggtgcgctttggcaaatttggggttttgtcttctcattggttaccttttgttgtcttctctgattccaccgtccacggcgccaccgccaccgccatctacttttcgtttttgctcctttcttaggttacctccttcaccttctccattcctccatattgttttttatattctactgtgcttcagttttctgaccgtattcaatcgaaggtggtcctttagtttgttccgctttaaaaatcactttgatcatatgcacttttggttgttggatttgttggcagatctagggttctgttctttgttaagatcagtcttgcgtctgttatttgatctgagttcctttgttattgtgaattctgatccatgccttaaaatcacttgtgcctgccaattgtttcaatgtgtttgaagtgtgtactttgcacaacaattattgacacccagataaaaaaaagggacagagccgcaaaagataactactatcattgaattcgaaattcttcaattgagactgcatcaatgatcattggccattttaatagagacaagtcaatggaggaactactgggaaatgggattgtggaccttacttgaggggttcctgcttcttgcaaacgcactagcaatactaaacgaggaccgctttctcacacctagaggatggggcttatcagatttctcagctggacagacaaaatctttcaaaggccagcttataggtctcatttatgcaactcagtacctaagatttcctcttttacttctcaactctgtcttcattatcgtgaagttagtttctggatgatgcctgacaaggttccaggagttatcatcagattatttcaatttgttcttaggtaggaaaatttgacagtagtaatctacaaaaaagttgatcaaagtctattattgtagaaatatacattaaaagtatcttttttgagatattgatccattgatgttatttattgtcttcttaaaatcatgtttgccatcgtgacataggtgatgtctagggtgagagaccaggataggtctccctccgactgtgagaaagtagtagatttttaccgttggatctatttattttttaaatggatggtttagacttttttcctttttctttttttttttactcatttctttgtctttcctagtttactcctttgtttgccacacacaattcaccctaatcagaccgtgacttctcactccaaaaccccccattctccccaacctcaacactcgccggcgccgcagcctcctcctgaaaccgaccaccgccgcgacgtgtccatctcccctctctccgacctccttgaaaccaacgtcgagaggaaaagaccgagagagaacgtggacaggggtagatagggaaatacaaagaaaaaaagactcaaccgttgatttaaaaaactaatagatccaatggtaaatttttagtttcccactgtgggagacctatgtaactctcacattagccttcccctcgagacataactagtcagaaaattatatgattcatttttttaagaattaattacgtctgctaatgttcctggtgc

SEQ ID NO: 5593 - DNA, 679 bp, Trigonella foenum-graecum
ttaacaaaaaagaaaaacgaacccacagagcaattcacatttgacacaacgctgcgttttgaaacgattcgttttcttctactccccgattaacattgcaattgtccgtccacttccctgattcaccgtccacatcatacacctgctccggcaccggcgaatccatccaccgttccattctatctccctctattatcagggaaatgggtttgtggacattacttgagggctttctgcttcttgcaaatgctctagcaatactaaatgaggatcgctttcttgtccctaaaggatggggcttatcagatttttcaggaggcacgaaaaaatctttcaaaggccagattataggtctcatttacgcaactcagtacctaagagttcctctcatactttttaactccatctttattattgtaaaattggtttctgggtgatgtctagcaaggagctggagttttaaatcgcatgatttcaaatttatttaggtaggaacatttgagaaattctattgtaagaatatatattgaaagtatctcttttgatattattagtcccaaaattatgcttgctaccgtgacatatgtagtgagaattggaaatcattattattgtgactttagctgagttgcagcagtattcattttctacgaattaattaaaatgggtcttattcctt

SEQ ID NO: 5594 - DNA, 696 bp, Citrus clementina
attgatctctctgaaatctgaatcttcttcggtgtaacttgtgaggcagagtttgggaattttggaaaagaaggtatctagacatcaagtctctgatacaaataaataaggaaatgggtttatggacgctgctggaaggttttctgcttcttgcaaatgcattagcaataataaatgaagatcgtttccttgcacctaggggatggagcttctcagaattttctgtggggcggacaaagtcattaaaggggcagatcattggtctcatttatgcaacccagtacatgagagttcctcttatactactcaatgccatatgcattgttgtgaaattggtatctgggtgatgctttaccgggtttcttataattgaattaccaaatctagagtctcccagaagtgcttttgcaaaacggaagaagcattcctttaagaaaattctagtaattcttttagtctaggtgttgtcttgtataatgagcccctgcgggggttgtattttagactttactgacattgttttggtgtgagaacaataatctgaaattggtagtgttcatttctattttttgtttcgaaaatagcttttgcttctgattattcacgattacggggctgtttgcctgtacatcaactttgatagctcttagcaatgctaaaagttttgtgctatgaactcgacgccacaacattcat

SEQ ID NO: 5595 - DNA, 1367 bp, Lupinus angustifolius
attgggttttaaaatgttaatttataaaacggatttaatgtgaatcttgtaaacttttattatttatccttcgctgtcttctcattcaaccgtccacgtcgacaccaccaccgtcaccggcaacgccttctaccgttacgtttccgccacctttgaattcagggaaatgggtttgtggacattagttgaggggttcctgctgcttgcaaattcactggcaatactaaatgatgaccgctttcttgcacctagaggatggggcttatcagatttttccggcaacaggacaaaaactttcaagggccaggttttaggtctcatatatgcgattcagtacctaagagttcctcttataattctcaactccatctgcattattttaaagttggtttctggataaagcctagcaaggttctagagttctcatcaggtgattcaagaagatgttcttaccttggagagtttgaccaagttctattgtagaaatattcattaaacgttttctctttttgagatattgatatttaagtatctgtcgtaaattcatagggtgaggggattatacaaaaaaattcccaatttgtttttctattgcttcttacatgattgctgacatgtgtcccaacgatgctggtagagtgtaacttctacaaactgatatgatttattgcagctggagtgaatagtttaactcagcgcttgtcaatgagagttttctaaaacaaattagaggattttattttcctctaacaattttattgttttaattttgaactaaagttgatttctagattatctccattcatttagtcacatctctatccttgttctctaactccatgtggtttgttttctattatctttttataatgtttagccctgagaaaggaaactgcacacagatcttcttgggaacctaattttacaattcccatgattttatttgtgcatatagcaaagtcacaagcctctctgcttgagctttcttctttatccatgaagatgtgttccaatgttattggcttataaagtttatcttccttttcaaaagtagatgtaattgattttctaagcaatctatcatcctataaaccctcttattgttttacacttgtacgttaaagcctttttgaaaatataaatttcatatgcggatgattttaggaagttatcattttttgaacttaagttgcttttgtagattgtcagtttattgaaataatgtttcccatatactttgttttttgtgtagaaaatataggtaagagaataggaagaaaatctggagataagataagcaatatgtaagtagagaatgtagagatgtgatatgggataacggagaaatagaataaaaaaatgaagtt

SEQ ID NO: 5596 - DNA, 690 bp, Momordica charantia
gggactgttaataattcaattatttctttcgatctcgctctctttttttcgatctctttcagtctctccattgagcggatgacaacacttgctgtacaaggaatccctatagttgatatcctttgaagctgtgtttcgagtaaatttgggctcgggtaaatgggtttgtggacgctattagagggttgtctgcttcttgcgaatgcactagtaatactaaatgaagatcgttttcttgctcctcgtggattgagcttctccgagttctcaggaggtagaacaaagtcattcaaggggcagcttataggctttatctacgcaacacaatatttgagggttcctctcataatgctcaatgcaatctgtatctttgtaaagttggtatctggatgatgacaatgggttgcagaggtgacatgtcgacttcaattatgagaaaggttatctaccagattgttcttgatttctctgttgtaatgtaacagtgggctgctctaacttctgaatttgttagaaacaaatgttgcaccgtttacaaattcttttgggagattcattgtcaaggtaggaggaaaggaaaggagatatgtcggcttaatagggatccttggcatggtttgataaatacttattatatttaggcttattcgttctgtacgattttttatagttaatattgaaagaaccgtt

SEQ ID NO: 5597 - DNA, 696 bp, Citrus sinensis
attgatctctctgaaatctgaatcttcttcggtgtaacttgtgaggcagagtttgggaattttggaaaagaaggtatctagacatcaagtctctgatacaaataaataaggaaatgggtttatggacgctgctggaaggttttctgcttcttgcaaatgcattagcaataataaatgaagatcgtttccttgcacctaggggatggagcttctcagaattttctgtggggcggacaaagtcattaaaggggcagatcattggtctcatttatgcaacccagtacatgagagttcctcttatactactcaatgccatatgcattgttgtgaaattggtatctgggtgatgctttaccgggtttcttataattgaattaccaaatctagagtctcccagaagtgcttttgcaaaacggaagaagcattcctttaagaaaattctagtaattcttttagtctaggtgttgtcttgtataatgagcccctgcgggggttgtattttagactttactgacattgttttggtgtgagaacgataatctgaaattggtagtgttcatttctattttttgtttcgaaaatagcttttgcttctgattattcacgattacggggctgtttgcctgtacatcaactttgatatctcttagcaatgctaaaagttttgtgctatgaactcgacgccacaacattcat

SEQ ID NO: 5598 - DNA, 323 bp, Arachis hypogaea
tgtgtccgtgtgtaacccctttccctccagtgtccactcctcgcgaagctacccgccgttccggtaccagtgtagggagatgggtttgtggacactactagaggggttcttgctccttgcaaatgcactggcaataataaatgaggaccggtttcttgcaccgagagggtggggcttctcagatttctcagttaggaggacaaagtccttgaaaggccagattataggtctcattcatgcaagtcagtacttgagagttcctctcatacttctcaacaccatcttcattattgtaaagtttctgtctggatgatgatgatgat

SEQ ID NO: 5599 - DNA, 651 bp, Populus trichocarpa
caaaattgcttgacaagacaagaggcctcaacctcaacgctctaatttgggctaagcaattcaagtatcgaagaagcagctttgccttttcaggaaatgggtttgtggacgttattggagggatttctgctccttgcaaatgcatttgcaatattaaacgaagatcgttttcttgcacctagaggatggagcttctctgaattctctgtaggtcgaacaaagtctttgaaagggcagcttataggtctcatttatgcgacccaatatatgagagttccacttgtaatactcaattccatttgcatctttgtaaagctggtgtctggatgatgccgctgaggagcattcatggagtttggctaataggattgtaaacaatattttattttagaaaggctgaggaggcatgtgactcagaaaatccaagacacgcttgatttggaatatcctttctcacaattagtgattttaaggttatttctgttgcttaaaaaaacacgacgagatgtgggatgaaaatggcgtggattttgctcaattttataatctgtgtttgtattgttcgacaagtttcaaaagtaactaaccttcttatggcactattaatgttttgctatcaacctaattattcttcatgatttgatttagtaa

SEQ ID NO: 5600 - DNA, 530 bp, Papaver somniferum
ctctgctctatcttcttctctccgtctcgcttacagaagtatgggtttgtggactctattggaaggctttttgcttcttgcgaatgcattagcaatattgaatgaggatcgtttccttgctcctagaggatggagcttcgcagaagtctctggtggcaggacaaagtcgttgaaggggcaacttatagggctcatttatgcgactcagtatctgagattaccacttatagttctcaacgcgatcactatagttgtaaagcttgtatctgggtgatataggtcggaggaagacatgtatgaaatacaatgtggtctggtgaatgggtttgtcaacacttgttactaacattttcttaggaactggatttggtgtgtttagttgatcagagttcaaaaagtagatcagcagagaagtgtaatttctctaattatctttttcccgtaaattggcaaccgcatatgttatgactgagtttggatacaaaatatatgaattcatattttttaaatgcatcagtatattacttttt

SEQ ID NO: 5601 - DNA, 732 bp, Fragaria vesca
tttcccctgcaacacaaataaaaggaagaattggaaacaaaggaaattacaagcaaggactcttcgtctttgaaagcctttcacatcttcaagtctctctctctttctcagagatcaggagccacagttaggtaaatgggtttgtggacgctacttgaaggcttcttgcttcttgcaaatgctctagcaatattaaatgaggaccgcttccttgcgcctaggggttggagcttctcagaattctctgtgggcaggacaaagtcattgaagggacaaattataggcctcatttatgcaacacagtatctgagagttcctctggtgctactcaattctatcttcattgttgtaaaattgatatctggatgatgccaaagaggttttgtgcagattcatcgaattacgatcgggagtctgccaattgccacttgcatcttctgtttccgggagagctgcagcgttaagctgttagatagtgtttgcgttcttgaagtagatctttcacctcggtgttcggaacctgtttgactttagatagtaattgtttggaaatatctgtctcaaatcatgataaagttgtcttcttgattggttttatatgactatgcaatccttattcttgtgaatgaagaactatgttcattggcaggctccggcctctgaaaatcagcaccaataagaacttgtgatctctgataacattagtaagaactaagtactgtttacccaaaa

SEQ ID NO: 5602 - DNA, 559 bp, Valeriana officinalis
caaaagcgatcggaatctccaatcatctcacaccgtttccgctcatcgcccggcggaaaaaatgggtttatggacacttttggagggttgtttgcttcttgcaaatgctctagctatattaaatgaggacagatttcttgtaccaagaggatggagttttcaagaattctcaggtgtaagaagaaattcattcaaaggacagctgatcggtttgatttatgctactcaatatttgagagttcttctgatacttcttaactccatttgcatcgttgttaaacttgtctccggctaatttatcttcttctacatggcctgatcatggtgatgaatgagaaaccacaaatggtctattttggaagagaacaagcgtgtggaataagtagaagaaacatgttgttataagatactttcttgatattatgattattagctgtcgacttggttgtttttagagttctagattttcatgttccatatttatcaaaatagtgttctattcttgattttctacgatcatatataattgttatgtttgctgcgcagtctgcaggatcta

SEQ ID NO: 5603 - DNA, 3477 bp, Cocos nucifera
tgttgacaaggtgttcaggatttggatctactcccgcccggtgatttctttgccgaaaaggagcaacgccgtaaagggtcagaattctcttcgtgaagcaacattctccacgatgcattctcaaatcccagccacacacgcagcaggacggctgaagcccacccacagacagattaagcagccgtggttttctccttgatatatcatcacccacaccctcgtccttctcccatccctaatccaagacgagatgggtctggtctttggaaagatcaccgtggagacgcccaagcacgaagtcctccactcctgtcctgactatgagatcaggaggtactccccctccgtggtcgccgaggtcacctacgacccttcgcagctccgaggtgaccgcgacggtggcttcatgatcctcgcccagtacatcggcgccctcggccagccgcagaacgccaagcccgagaagatcgccatgaccgcgcccgtcatcaccaaatctccctcccagtccgagaagatcgccatgaccgcccccgtcatcacgaccggtgataacaaagcgacgacgatgcagttcgtgctgccggccaagtacaagacagtggaagaggcaccgaagccgttggatgagagggtggtgataaaggcggagggggggaggaagtatggggtagcgaggtttagtggggtggcgacggataaggtggtggaggagagggtggagaagctcaggaggagcctggagagagatgggtacaaggtggtgggggactttcttctggcaaggtataacccaccatggacgttgcctcctctcaggaccaacgaagtaatgcttcctattgaatgaatcgcgtctgccttcgtggatgttggtccggtctagttgcatccgtatttgtgattacagacgcatggtttggcgtcatagtttacatcgaggacttagcctcgcgtttgttttggggttctaatttatgtgctgcaattacaaatgaagaggttttagattaagtatttcaatggagtttattatgcctgaggaaattaatgcaagagtaagaagagaagctaatcaattttcttgtaacgcacaaacaaaacctgagctcgaggaccacaaatacaccgctgttttcagctaaaggcccgtttggaagccctgctaaaccattccaggaatacgtcgcatccatgtcaacggacggaaagacgataacgccgtaagagaaagaggacagaaaagaatttagctatttaggaagacctccgaacattcaaccggctacgaaaatctccgacaatcaagaaggaacaataccatctccaatttcgaggatcgtctgatctgcaaccattcttcatctcgcgaaattctattcccctgtttccaccacctgcttgggaaacttatccatgcagaatttacctccacatccaaacaggctccaaaattcagtcacacgcgagatcatttccccactataattaactcgctttccagaaagcattacttcttttgaaagaaaacaataaaatacattcaactaaatttttccgttataaactatttctgtaagcacaggcacaagcatgatttcatgaacttattaatttggttcatgacactgccgaaactaaacaaacactccaataacttatcaccatcgagaaagatgaacctagctttccctcatctgcttgcagtggttgatgacctacaggactctggaaggagattagatggcaatccacaacttgtttttaactgcttctcatatacttctcacccccaatcaaccagaattatcaaggtaaaaacattgacaatacatggagataagcggttcccctgctaggtgcaggaatgtttgattaaactacagttaaaggaagttcaaacaaacaaaatttcggaacaattcatcaagtacatgccagactcagcctgaaaccaacttcacaagaattatgataacatttagaattataagtggaactctcaagtactgtgttgcatagataagccctatgagctgccccttcaatgactttgctcgaccagttcccgaaacttcagagaaactccatcctctaggagcaagaaatctgtcctcgttcaatattgccaatgcatttgcaagaagcaaaaaaccctcgagcaatgtccacaagcccattttcgcccaatgtggtcctgcaaatcctttcgatcttgtccctgcttggatcttgctcgatttatgcaagaggcaaaaaatcacagataaacacaaacagcgtgataattttaaattgaatacaacttcccatagaacgaacgaagaaggaaagcagcagacctggaactcccttcgtggaacgtgttgcgaagctttacttcaagccgcggtgttatcttggatgctgaggagatgcgaaaggcgaatttctccgattttgggttcgaccacgtcgacgtagaccggtcgggctgcagacaatggacccggttcgaaatgctgcagtccgcgcctacgcggtcagagtaaggtgaagttacctgccggttctacaactttcgtgccggcccttctggatctcgttgaagagcctagagtaggccagaaggtggtagaatttctccagaaacggatcggttgtcgactcttggaaggaatccccgacctccacacctccataaatacgctcttcatcccagccggaggcaacgatttcagcaattaaaagccttctttctgcacaattcgatcgatctcttccctaaagctgacctgcattctcctgtaatcaaagatgtcgctcatccctcgcggctggggttttggatccagcatcttcgaccccatctccttcgatcgctgggatccttttgagggcttccccttcaacagctccctctcctcctttcctcgtccttcctttccaggcaagtcgtccgccttcgccaacgcccgcatcgactggaaggagaccccggaggcccacgtcttcaagaccgacctccccggcctcaaggaggaggtgaaggttgaggtggaggagggcaacgtccttcggatcagcggcgagcggagccgggagcagaaggagaagaccgacacctggcaccgcgtcgagaggagcagcggcaagttcttgaggcggttccggctgccggaaaacgcgaaggtggaccaggtgaaggcggccatggagaacggagtgctcacggtaactgttcctaaggaggaggtcaagaagcccgaggtgaaatccattgagatctccggctgagggtcctttccttttagagggtagggtaaaggtctagtgcagtcgtttgttgttattagcgtgttacgcggtctttcatctcagcaccaatgtccgcctgctgtgtcatctcatcgtggtcaggggttttgtctttctggagtatcagtatgtaagttttgaatggaaataaatgatgctgtcttgttttactgtttttaa

SEQ ID NO: 5604 - DNA, 640 bp, Cucurbita pepo
aatgttttgcgctgtcttcgatttgcctttgttcgccgttcaatctcactctcgccttcccgtcgttcgatctccttatctctttgcttgtgctcgtcttcccgccttctgatctccctctctgacgactttaagataataacgtcatcagtacaaaggagtccctagattcagaaccctctgaagtgtgtttccagtaagttagagctcaggaaaatgggtctgtggacgctactagagggttttctgcttcttgccaacgcgctagcaattctaaatgaagatcgctttcttgctcgtcgaggattgagcttctctgaattctcaggaggcagaacaaaatcgttgaagggacagcttattggccttgtctacgcaacacaatatttaagagttcctctcataatgctcaatgcactgtgtatctttgtaaagttggtatctggatgatgagatgccaacttcaactctgtgaaagtttacatctatcacattattcttgatttctctgttgtaatgtaacaatgggctgctttaacttctgaatttgttgcaacatatgttgcaccattagcgaacacttctgggacttgtcaaggtaggagggaagtgacaatttttccctctcttgttgaagtaa

SEQ ID NO: 5605 - DNA, 1114 bp, Cocos nucifera
cttttcccttttcttttttcgggaaaaagcgctgggctttagaaattagcttgattaaataactcggctttcgttccgagcacgctcccccgatccttatacggaaaaagtgaaccggcggagccgaagcaacggcctggtgaatctctggtagtggccgcgctgcctctcttctcgacttctcaagagggatgggattgtggacattgcttgagggttttctacttcttgcaaatgcattagccatattgaatgaagatcgatttcttgctcctagaggatggagtttctctgaagtttcaggaaatggcaggtcaaaatcattgaaggggcagctcatagggcttatctatgccacccagtacctcagagtgccactgatagttctcaatgctatcatcatggtagtgaagttggtttcaggataacttttaggcggttgtgaatgggactaaaagaaggggaaatcttggaagtagcagatgcaagtgaagaagggaagaacaaaggactttttgactcaggtttacttgggtttaacttatactaaaagtatgttttcaatttgcattgcttatcattgtgctgatcttgataatggaccaacatgtttggagtttgtctatggaacttctacagcatatttcagatttttagatttggatgaatgagattttgctcctctctctgtctctttaaagtttgctattggtgttctcaaagagatgactacaaggttccttaaccatgtgccctttgtccctttgtgaatctaacctctgtgctatttttggtccatgtggatttagatgaagaaaaacgtatcaggacacacaggcttaagctctcatgcagttcaagtgtctcgagaaaatggtgcgatttatatcattgaatccctatttcatccatcttcggtctcagcattgccattgcttcctctagcctttgtgttggatatgtttcagaatgatatgtgggaactccagtgacaaaggactgaagacccattccaccatctaagcagatacattggcttcatgactatggccttggattagccgtggatatggaggagcttattgtaagctactatttatatttgagttgcctc

SEQ ID NO: 5606 - DNA, 593 bp, Elaeis guineensis
gaagggccggtaggaaagatgtagaatcgtccggtaactacaccttactctgaccgcgtaggcgcggactgcagcatttcgaaccgggtccactttctgcagaccgaacggtctatgtcaacgtggtcgagcccaaaaaatcggagaaattcgtctttcgcctttcctctacatccaagataacaccgcgactagaagaaaagcttcgcaacacgattccctaaagagagatccaggaccacattgtgcaaaaatgggcttgtggacattgcttgagggttttttgcttcttgcaaatgcattggcaatattgaacgaggacagatttcttggtcctagaggatggagtttctctgaagtttcgggaactggtcgagcaaaatcattgaaggggcagctcatagggcttatctatgcaacacagtacttgagagttccacttataattctaaatgttatcacaattcttgtgaagttggtttcaggctgagtctggcatgtaattgatgaattgttctgaaattttgtttgtttaaacttgctttaactgtagttgaattaaacattcctgcacagtgcaggggagccgctta

SEQ ID NO: 5607 - DNA, 589 bp, Elaeis guineensis
tgaagcagcgggagacgaagtaacgcccaggtgaatctctggtcgcggccgcgctacctctcctctctacttctctaaaggaatgggattgtggacattgcttgagggttttctacttcttgcaaatgctttagccatattgaatgaggatcgatttcttgctcctaggagatggagtttctctgaagtttcaggaaacggcaggtcaaaatcattgaaggggcagctcatagggcttatctatgccacccaatacctcagagtgccactgatagttctcaatgctatcatcatagtagtgaagttggtttcaggctaacttttaagcggttgtgaatgggactaaaaaaaggggaaatcttggaagtaacagatgcgagtgaagaagggaagaaacataggattttttgtctcaggtttacttgggtttaacttctactaaatgtatgttttcaatttgcatggcttatcattgtgctgatcttgagaatgaaccaacatgtttggagtttgtctacggtacttctacagcatatttcagatcattagatttggatgaatgagattttgctccaaaaaaaaaaaaaaa

SEQ ID NO: 5608 - DNA, 794 bp, Phalaenopsis aphrodite
cttcccatctctctcaagctttcgtgttcgggctgttcgtccgcctctcgctcttccaagccttccctttctcctctcaaaatcacgaaaagctttcaccccgattgagagagcttagggttgccttttgtgtttgttctctaatctctacttctatttatcttcgagccggcgcctgctcgcctgctcggtatcattgcttggttgctcattttctgctggaatgggcttgtggaccttgctggaaggattcctgcttcttgcaaatgcattggctatcttaaatgaggacagatttctgggtccaagaggatggagtttctcagaggtttcggcaggtggccgaacaaaatctctcaaggggcaactcatagggcttatatatgcaactcaatacttgagagttcctcttatcatcttgaacttaatcatcgtggttgtgaagttagtttcaggatgagatgtgaggtaatttgtgagttctatgccatttagggttgttcatactatgtggtcatcaaaatgatccaaaatgctttatattttgttttttttttgaagttatttatcctttttagaagcccttaatgaaagtgcaaagtgcctgctcttacatgtgcgtatattaggcacatatcttgtttgttaacatgttctcagtttacaaaaaatatttcggttgcttccacagctttatttgtttctttaactagttcttattgtgcatgcaagaaaggtctgctaaaattgatatttatatgtttatttcattacattttacatttccttatcct

SEQ ID NO: 5609 - DNA, 2407 bp, Malus domestica
atgtcgaaatccactagtgatcacaactcatgcgctaggtcgaggcggcggcatttcgaggcaacggaggggcaaccgggttcctccaccaagttcgatgacgccaatgctcatgccgtgtttttccgccgcagggtgcgaaagttgtccgatttctcgagctggcggttgtgcaaatggacttcaatggttttgatgggtttggcctttctgtcaatgttggccaagtttgccttgctgaacacgtttccagagttgaaggtgatggagaaaataagtttgattcgaccttcactgatcgaagggacgacgacattgaaacagaacatggtcagattaggtgacagggtaaatgtggctaaaatgctcataagttcaagaaattgtgatcccatcttttatttgatttctgctagtcagacccttgatatttggacgccatcagagagttataactactaccaatgcataaatcgagcgaagaaggaattttgtacgtcccgaaagctttcttccccaacaatgaatgaaacagccacaaatggctacatccttgttcgttccaatggcggattgaatcaaatgaagctcgggataagtgatatggttgccatagcaaaacttatgaatgccactcttgttctaccttctttagatcacatatccttttggaccgacccaagtgactttaaagacattttcaattggaagaacttcatggaagttttgagagatgatatcatgatcgtagagtctctcccgtcggagtttgcaaacatgaaaccccgccataaggctccagtatcttggtcaggggccagttactataaacaacagatggcgacattattgaagaagcacaaggttgtcaaatttaccttcacagattccagacttgctaataatgttgatagctcgatccagagactccgttgccgcgccttttataaggcactgcgcttcgcagttgaaatcgaagagcttgcaatgaatttgatttacagattaaagaacaatggtgggaaatacattgctctccatctaaggtatgaaaaggacatgctttctttcacaggctgcagtcacaatctcactagagaagaagatttagaactcgaaatgataagggagaagacgccacattggaagcacaaaaaaatcaatggtacagtgcagagacaccaagggcaatgtcccatgaccccaagagagattgctgttttccttgaggcaatagggtttccttcggatacaaaaatttacatagctgcaggtgaagtctacgggcaagacgggctaacgtcactgcaagccaagtatccaaatctatttttccactcaaatttagcatccgaagaggagttgcaaccttacaaggataagctcaaccagcttgccgcattagattatattatagcagttgagagtgatgttttcatctactcctatgatggaaacatggccaaagcagtcaaaggccacagaagatttgaaggttttaggaaaacaatcagccccgacaaacaaagatttgttagattgatcgataagttagacaagggtatgataacttggaaaacattctcgtcccgagttaagaggttacacaaaaatcggatgggagcaccatatccaagagtgcccagaattttgcctagactggaggagaacttttatgcgaatccatatccaggttgcatttgtgaaaggaccaatgagccagcttcatcaccagcagggagatgcccaaatgagatgatccagcaagaaagcaaaagggcacgttctactttgttcctggagtcttcgttgttggaagccttcggctttagcattttccacctccaagtctcttcctctcctgagatcaggtcctcgcattcaggtaaatgggtctgggtacactacttgaaggctttctgcttcttgcaaatgcagtggcgattttaaatgaggaccgcttccttgcgcctaggggatggagcctctcagaattctcagggggcaggacaaaatcagtcaagggacagattataggtctcatctacgcaacacaatacttgagagttcctcttgtgctactcaatactgtctgcatcgttctaaaattgatatctggatgattccaaatgaggttatttgttcagaagattcgtcgaattgatattaggaatcggccaaaatggatctctcgtttctcggaaggctgaagcattaggttgatggatattgtttgaatgctgtatttttgaagtagttcttgttcctcattgttcagaagctgtttggctttagatattaattgggtggtcaggccatctcaaggtaaaattcatttttacggtgtaatttcctcgaaggtattaacttttccaacattttaacgccaaattcggtccccgtaatt

SEQ ID NO: 5610 - DNA, 617 bp, Daucus carota
ctctttgttcgcaaaaatcccaatcggagcgctccttttttcaaagctttgcttccattcatccttaagggggttcatatctttgcaaggtgatgggtttgtggacactgctagaaggctgtttgcttcttgcaaatgcactggcaatattgaatgaagaccgctttcttgcacctagaggttggagcttccaggaattttcaggggtcaagagaaattcatttaaaggacagctaattggtctcatatacgcaacccaatacttgagagttctactaattatgctcaactccctttgcattgttgtgaagctagtttctggatgatcatcctggcgttccttgatgatactttaggaagcaccagaacatacttgtccgcacagcaggatgttatagaagattacgtttggttatcattgtaagattatcatcaggttcccaagctgtaggaatgtgaaaatgtcatgaatacagagattgcttgtgtgttgttgaaccaaccttatttagagttccatttgatttaggttgctgcagcttatttttgagatgtatggtatgcaatgagccctcttagattggggcttcatgtactcggaaaacatataatcattt

SEQ ID NO: 5611 - DNA, 677 bp, Daucus carota
gttcgcaaaaatcacaatcggagcgctccctttttgtgttgtaccaagctttgcttcgattcatccttaagggggttcatatctttgctaggtgatgggtttgtggacactgctagaaggctgtctgcttcttgcaaatgcactggcaatattgaatgaagaccgctttcttgcacctagagggtggagcttccaggaattttcaggggtcaagagaaattcatttaaaggacagctaattggtctcatatacgcaacccaatacttgagagttctactaattatgctcaactccctttgcattgttgtgaagctagtttctggatgatcatcctggcgttccttgatgtttgactctttataccaggagtctgcaaaaaaagatacttttgaaagcaccagaacatacttgtccgcacagcaggatgttatagaagattacgtttggttatcattgtaagattatcatcaggttcccaagctgtaggaatgtgaaaatgtcatgaatacagagattgcttgtgtgttgttgaaccaaccttatttagagttccatttgatttaggttgctgcagcttatttttgagatgtatggtatgcaatgagccctcttagattggggcttcatgtactcagaaaacatataatcatttgtttgatgtcaattaagaaatgtg

SEQ ID NO: 5612 - DNA, 680 bp, Manihot esculenta
acactctcggaatctcagatttggttcttgttcatcgctcccagtggtttccgttacagaaacgcttctgcgattcaagtagcagcagttttgcaggtttattgtagtcgagcgcctgaacatgggtttgtggactttactggagggcactcttcttcttgcaaatggcctagcaattttaaatgaagaccggttccttgcacccagaggttggagcttctcagagttctcagtaggtggaacaaagtctttcaaagggcaacttatggggcttatttatgcaacccagtacatgagagttcctcttattatactgaatgccatttgcattgttgtaaagctagtgtctggatgatgccaactaaggattcatttagttgcttctgactgacaggagttcgcaaaaagaagatttttttttggagtggcggaaacatatagaaaattcaagactgcacttgaaattgtcttttgtgtggtcagtgggtttaaggttgtatccttagctttaaaacacaatcagttgtgcagatgagaatattttgtgtgagagaaaaactttataacacggtgtttttattcttttagaagttttagatgtcgacattatttgtgaaatttttgttggctcgttaaccaaatttttttgcctgcatgcaatggaaacatattttttgttg

SEQ ID NO: 5613 - DNA, 712 bp, Euonymus alatus
gcccaaggaaagttcctttgagcttcttgccttcttcaacagttcaacctgttattttgcccaattctcttcgtgaaagagcgacaccagagcatatcttcaccttacgtgtctcctctctcccttcctgtcactcgcgatctagtgagaaaaactggaaaacctgccagggtttcgacttttgcgtttcttgaaatatagcttgattgtcagttcgattatttgcagttttcttaagatccgttttactggtgagataggatatgggtttgtggacactacttgaaggattcctgctccttgcaaatgcatttgctgtattaaatgaagacagattccttgctccaaaagggtggagtttccaggaattctcaggaggcaagacaaaatcattaaaggggcagcttataggtctcatatatgcaacccagtatctgagagttcctcttataatcttaaattgcatattcatagttgtaaagcttgtttctgggtgaggattccctcgttagttagcaatatattatgcacatctgattgcccccaattgtttggatttggtagtctataaactggttggatcaaagactgagattgtgaggtttctaatgaggttttatggattactttagtgagaattatcagtttgtattttgcatctatattgctggactagggtgtttttgcaaatttgtcttatcaaagcttgtgg

SEQ ID NO: 5614 - DNA, 495 bp, Fagopyrum esculentum
cccatcaatcgatctctatttgcggctggtcctctcgtctcccccgatcagtttctctcgatttccggcaatgggtttgtggactctcctggagggcatgttgcttcttgctaatgcatttgcaattctaaacgaggaccgtttcctagcacctaaaggatggagctttcaggacttctctgtaggccggaccaagacgataaagggccaaattataggtctaatctacgcagttcagtacatgagagttcctctgattcttctcaacagcatcactatcattgtcaagttagtgtctggataacactttcatcatgaactgttcttcctcagtatggtttcttttgacaacttggtatctttcttttaaatttccaatctcatggcaatatataccttgggaggtgtgatatgatgtttaaaacttgggagttcagaaagtatcaaaatagatgattctttgtaacttaggatgttttttgagcttaatttttt

SEQ ID NO: 5615 - DNA, 509 bp, Fagopyrum esculentum
acccatcaatcgatctctacttgcgactggtcctctcgtctcccccgatcagtttctctcgatttccggcaatgggtttgtggactctcctggagggcatgttgctacttgctaatgcatttgcaattctaaacgaggaccgtttcctagctcctaaaggatggagctttcaggacttctctgtaggccggaccaagacgataaagggccaaattataggtctaatctacgcagttcagtacatgagagttcctctgattcttctcaacagcatcaccatcattgtcaagttagtgtctggataacactttcatcatgaactgttcttcctcagtatggtttcttttgacaacttggtatctttcttttaaatttccaatctcatggcaatatatacctcccaagtatgatatgatgtttaaaacttgggagttcagaaagtgtcaaaatagatgattctttgtaacttaggatgtttttgtagcttaattttgtgtggaattgctagt

SEQ ID NO: 5616 - DNA, 1265 bp, Petroselinum crispum
aaatctgtgtgatccaagaatccaagccagccagagggattgttaaggccacccataggaagctttctcaggatatgggtttgtggacgctgctggagggttgtctgcttcttgcaaatgcactagcaatattaaatgaggaccgctttttaatacctagagggtggagcttccaagaattttcaggtgtaagaagaaattcattcaagggtcagcttattggtcttatatatgcaacccagtacttgagagttcttcttataatactcaactctctttgcattgttgtgaagctagtttctggatgatgtgttttggagcgagtccttttgctaggacttttttcacctgtgtaagatatgtttgtggaagtaatatgtacttgagagttcttcttagtattatttgttattgcagtttaaaacaaaaatatactgacggaagatattcttgcatatgaacaaactatcatagtttccacctttttattccagtgtaagccatttgtgtgttgctcgaacaaaggtaacattttcaatatctctgtttatcaaggcctttcggttctgtacgcttgagacttctaggtcaattcctatgcagcaagtagaatgctttgcggttattgggaaactggtataatcattcatgtttctcaaattaaaatactatatctggaatcttctatgatttacataggtatatgtggactaatctgcacccaccaaagattaatattaccattcttagtttgtgaaaaatagagaacacaagttaaatttgtaaaaactgttgtttcaatatctgttttctttcagtgtgatgctggctaatacggtatattgttgaagtgtattttgtgtagttcgttctcagggaaggactaaatcaatcaagtatatgatctcttaatgtttagaagtgtggaaaaataatgaggtgttttgttaactaactaaacttaactaaggagcaaataaaacaaagattaatcgatatggaaaaaacaacctgagaactagggttcttcaattggttcaatgaatgctttgcgttttgcgatatctacttctcgtcctttgctaaaaacaattcttctaaagtttatgttgttctttcccaagatacaagatagtgcctgcaactatatcccaaaagccactcccatgatcaattgaaatacaattataaactattaagacctaagaattataagtttaatagctcgcatattaatcttttaattaaataactgaactatgtct

SEQ ID NO: 5617 - DNA, 545 bp, Petroselinum crispum
ggaggggggaataagtaatttaagagactaataaacttggcggcctggttaagaaatcttttagggcaatgctagcttagttgtttcttccaagaatttaggcaacctactacttttaaaaatataataagaaccgttgtacacgtgctgcagttatattcaagcaaaaactagtttaccattttttaattatgcaggtgatgggtttatggacactgttggaaggctgtctgcttcttgcaaatgcactagcaatattgaatgaggatcgctttcttgcacccagagggtggagctttcaggaattttcgggggtcaagagaaattcatttaaaggacagctgattggtctgatttatgcaacccaatacctgagagttctactaattatgttgaactccctttgcattgttgtgaagctagtttctggatgattttctttccgtccttaatgttggcttagttacaaggagtctctgaaagacaatattctaaaagcactagaacatacaagctgggataacagggtggtgttgaagtttaca

SEQ ID NO: 5618 - DNA, 1211 bp, Solanum tuberosum
aatcaagtctattcatatttcactgagagtttccgcctgctgccgccggttgacgcctgccaccagccgccgatcgttcgtcttcctcgtcgtcagggcatgggtttgtggacattgctcgaggggtgcctgcttcttgcaaatgcacttgcaatattgaacgaagaccgtttccttgctccgagaggatggagcttccaggaatattcaggggtccggagaaattcattcaagggccagctacttggtcttatttatgcaactcaatatctgagagttcttctcatactcctcaatacactctgtattgttgtaaagtttgtatctggatgatgattcttgggtgaggtatgcatgtttaacttggttgctatattttgagtttgaggtgtatttggtcaattatttcttgttacgaattaacagaagggctaccagaacattctggggagaatccaggaaattgtttttttcattacaaaagctatgtgtggatttggtgtgatgcttaacttttgaaataatgttgggatcctagaaataaggtatcctgaactagctaatatcttttatgcttcatgtctctgacaatgtccatggtatcatatagtgggttggacagtttcaatctgcagtatcaggaggttagattgtacattttttgtacttctctcatttccttaggttggggtggggggtagttgttcagcacaaagtagtcggtgcgtgacctgttttccaaactacagtttcctcaagcaatataatgttcaataatgcattcagaaggaccagaacacatttttcgttttcttacatgcaatgacatttgtttcacttacaatgagattgagtaataaagtagttacaacttacaatcaaataggatcagccattatttttaatgcattgcatatttattaatagcagtataaaattgattttttcatttaaagttagaccaatttatttgttgatattacagacacgaaagttcatagatggatggatgaagaaggttccttgaggaaaagccgcaagtctagtcacattttgtttgaaaccctgatacaaaatgatttttttttattagttttagattaagaattgtttttcagtttttgtgaacaactgttgtaaaataggtcatcagttcaactacctatgcatagtagtttttgcagttttttgaatacatgtggaatactgtc

SEQ ID NO: 5619 - DNA, 623 bp, Prunus mume
aaaaagaaagcagaaaaaagaagggcacgttctacttgttcctgtactcttcgttttagccatttacacctccaatccaagtctgtctctctgagatcaggtgctagcatcaggtaaatgggtttgatgacactacttgaaggctttctgcttcttgcaaatgcactagcaatattaaatgaggaccgcttccttgcgcctagaggatggagcctcgcagaattctcagtgggcaggacaaagtcagtcaagggacagattataggtctcatttacgcaacacagtacttgagagttcctctcgtactactcaataccgtctgcattgttctaaaattgatatctgggtgatgaaaaattagattgttctgaagattcatcaaagtgatatgggaaatctgccaaatggatctctggtttcttggaaggctgaagcattaggttgattgatattgtttgattgttgtaattttgaaatagctcttgcacctcactgttcggaaactctttgccaacatatcaattgtgcattttaacatcaccctctctgtcgctcatccttccttgcctttcacttttctatctgttagcaattaaaattcctttaaaatttattcaaggat

SEQ ID NO: 5620 - DNA, 254 bp, Prunus persica
ttcaggtaaatgggtttgatgacactacttgaaggctttctgcttcttgcaaatgcactagcaatattaaatgaggaccgcttccttgcgcctagaggatggagcctcgcagaattctcagtgggcaggacaaagtcagtcaagggacagattataggtctcatttacgcaacacagtacttgagagttcctctcgtactactcaataccgtctgcattgttctaaaattgatatctgggtgatgcaaaattag

SEQ ID NO: 5621 - DNA, 689 bp, Solanum phureja
agaaagattaatacaaataaagtgagatatgagaagttgagaacggattcttgtgaatggagttactaataatatcaacataattcagggcatgggtttgtggacattgctcgaggggtgcctgcttcttgcaaatgcacttgcaatattgaacgaagaccgtttccttgctccgagaggatggagcttccaggaatattcaggggtccggagaaattcattcaagggccagctacttggtcttatttatgcaactcaatatctgagagttcttctcatactcctcaatacactctgtattgttgtaaagtttgtatctggatgatgattcttgggtgagacacgaaagttcatagatggatggatgaagaagcttccttgaggaaaagccgcaagtctagtcacattttgttcgaaaccctgatacaaactgatcttcttctattagttctagattaagaattgtttttcagtcttcgtgaacaactgttgtaaaataggtcatcagttcaactacctatgcatagtagtttctgcagttttttgaatacatgtggaatactgtccatctcttcttagcatttgcttatcaggatgttgttttaatgtgaaaccaattcttgtgatgaaagggagtcttgtagttaggattctaatgatgatgagtaaagcccctgtctttgacttta

SEQ ID NO: 5622 - DNA, 791 bp, Solanum lycopersicum
tgacgcagacggtaaatatgaaacttagccctttgcctttgcctttgcctctgcctctttagtgaaagtatacgtattgttcagattgcagatctgggttccaaatcaagtctattcatatttcactgagagtttccgtctgctgccgccggttgacgcctgccacctgccgccgatcgttcgtcttcctcgtcgtcagggcatgggtttgtggacattgctcgagggctgcctgcttcttgcaaatgcacttgcaatattgaacgaagaccgtttccttgctccgagaggatggagcttccaggaatattcaggggtccggagaaattcattcaagggccagctacttggtcttatttatgcaactcaatatctgagagttcttctcatactcctcaacacactctgtattgttgtaaagtttgtatctggatgatgattcttgggtgagacacgaaagttcatagatggatggatgtagaagcttccttgaggaaaagctgcaagtctagtcacattttgttcgaaaccctgatacaagctgatcttcttctataagttttagattaagaattgtttttcggtcttcatgaacaactgttgtaaaataggtcatcagttcaactacctatgcatagtagttttgactttctgcagttttttgagtacatgtggaatactgtccatctcttcttagcatttgcttatcaggatgttgttttaatgtgaaccaattcttgtgatgaaagggagtcttgtagttaagattgtaatgataatgagtaaagccc

SEQ ID NO: 5623 - DNA, 900 bp, Gossypium raimondii
acgaacaatccagataaatcccttcccttcccacccaaactatatatatttcactacacatctcattgtatatcacagcattgataaacaaagatcatcaaatcaaaatcatcctcaaactgttcaacaatttcgtctcccattaccaaatttccccattaaaaccaaaaatgagaatcccaaatctcaccaaagcctttattttgttaatggcaataactctgatgtcaacccaagccaacggcctaatcccttacagtagatccttatgggacgtgatgcttgctgaagacccattcaaaatcctggaacaaaccccagtgaccgtccccaaaggatcagaacccgtcgctttagctcgagctgactggaaagaaaccccacggtaccatgccattaccctggacatcccagggatgaaaaaagaggatttgaagatcgaggttgaagagaacagagtgttaaggatcagtggtgaaaggaaagaagaagcagaaattgaaggagagaaatggcatagagctgaaaggacgaatgggaagttttggaggcagttcaggttgcctgcgaatgtggatatggatcgcatcaaagctcatatggaagatggggttttgaggatcagtgtgcctaaaattgtagatgagaataagaagcaggctaaggtgattgacattgttcagtcgggtggtactggtgaagatatcaaggcaacctcccagggtcatcattagatatttgattgatctaccaggtttttgatggattgatttcgggttttcatcgtttcgcctacttatgtaataataagttgatgtttatgtgtttggttgaagtatgatgaaatggtgatgcttaatttcaatattatcaatatattagtatttccttttcagataa

SEQ ID NO: 5624 - DNA, 1878 bp, Gossypium hirsutum
gagcaaaccaagaaaaggctgcaaattcagcttctcaatatctgcttttgatcaatcgaaatggcttcacaagtttctcaaatgccttcttcatcacccctttcttccaataaggatgaaatccgtcccaaagccgattttcagcctagcatttggggagatttcttcctcaattgtcccgacaagaatattgatgctggaactgaaaaacgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccaccaaccatttaagccttgcagtatcatctttggaccatcctttgtccgaagaggtttctcatgctttgaaacaatcaattcgaagaggcttgccaagggttgaggcaaggcactatctttcagtataccaagatattgagtcccacaataaggctttgttggagtttgctaagatcgacttcaacatgttacaatttttgcataggaaagagctaagcgagatttgtaggtggtggaaagatttagactttcaaagaaagttgccatatgcaagagatagagtggttgaaggctatttttggatctcaggagtgtactttgagccccaatattcacttggtagaaagatgttgacaaaagtgatagcaatggcatctattgtagatgatacatatgactcatatgcaacatatgaagagctcattccatatacaaatgcaattgagaggtgggatatcaaatgcatagatgaacttcctgaatacatgaagccgagctacaaggcactattagatgtttatgaagaaatggaacaactggtggctgagcatgggagacaatatcgtgtcgaatatgcgaaaaatgcgatgatacgacttgctcaatcttatcttgtggaggccagatggactcttcaaaactacaaaccatcattcgaggagtttaaggctaatgcattgccaacttgtggttatgccatgcttgctattacatctttcgtcggcatgggagatatcgtaacaccagagacctttaaatgggcagccaatgaccctaagatcattcaagcttccacaattatttgtaggtttatggatgatgttgcggaacacaagtttaagcataggagagaagacgattgctcagcaatagagtgttacatggaagaatatggcgtatcagcacaagaggcatacgatgtattcaacaagcatgttgagagtgcctggaaggatgtgaatcaagagtttctgaaaccaacagaaatgccaacagaagttttaaatcgtagcctaaaccttgcaagggtgatggatgtactttacagggaaggagatggatatacatatgttggaaaagcggctaagggtggaatcacttcattgcttattgaaccaattgcactttgaaatttatattaaattttcctcttcaagcatcttccttaagaaatagttattaagttctaattaataatgttgtataatattcatatatattatcaaagaaagtccgaatcgattgtctttgtactcattaccttctattaattcaataaagtt

SEQ ID NO: 5625 - DNA, 1923 bp, Gossypium raimondii
atcctcacacaaattctgtgccaaatttcaagagcaaaccaaaaaaaggctgcaaattaagcttttttgatcaatcgaaatggcttcacaagtttctcagatgccttcttcatcacccctttcttccaataaggatgaaatccgtcccaaagccgattttcagcctagcatttggggagatttcttcctcaattgtcccgacaagaatattgatgctggaactgaaaaacgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccaccaaccatttaagccttgcagtagcatctttggaccatcctttgtccgaagaggtttctcatgctttgaaacaatcaattcgaagaggcttgccaagggttgaggcaaggcactatctttcagtataccaagatattgagtcccataataaggctttgttggagtttgctaagatcgacttcaacatcttacaatttttgcataggaaagagctaagcgagatttgcaggtggtggaaagatttagactttcaaagaaagttgccatatgcaagagatagagtggttgaaggctatttttggatctcaggagtgtactttgagccccaatattcacttggtagaaagatgttgacaaaagtgatagcaatggcatctattgtagatgatacatatgactcatatgcaacatatgaagagctcattccatatacaaatgcaattgagaggtgggatatcaaatgcatagatgaacttcctgaatacatgaagccgagctacaaggcactattagatgtttatgaagaaatggaacaactggtggctgagcatgggagacaatatcgtgttgaatatgcgaaaaatgcgatgatacgacttgctcaatcttatcttgtggaggccagatggactcttcaaaactacaaaccatcattcgaggagtttaaggctaatgcattgccaacttgtggttatgccatgcttgctattacatctttcgtcggcatgggagatatcgtaacaccagagacctttaaatgggcagccaatgaccctaagataattcaagcttccacaattatttgtaggtttatggatgatgttgcggaacacaagtttaagcataggagagaagacgattgctcagcaatagagtgttacatggaagaatatggcgtatcagcacaagaggcatacgatgtattcaacaagcatgttgagagtgcctggaaggatgtgaatcaagagtttctgaaaccaacagaaatgccaacagaagttttaaatcgtagcctaaaccttgcaagggtgatggatgtactttacagggaaggagatggatatacatatgttggaaaagcggctaagggtggaatcacttcattgcttattgaaccaattgcactttgaaatttatattaaattttcctcttcaagcatcttccttaagaaatagttattaagttctaattaataatgttgtataatattcatatatattatcaaagaaagtccgaatcgattgtctttgtactcattaccttctattaattcaataaagttcttttcaagctttccattatgaaaaa

SEQ ID NO: 5626 - DNA, 1923 bp, Gossypium raimondii
acacaaattctgtgccaaatttcaagagcaaaccagaaaaaggctgcaaattcagcttttcaatatctgcttttgatcaatcgaaatggcttcacaagtttctcaaatgccttcttcatcacccctttcttccaataaggatgaaatccgtcccaaagccgattttcagcctagcatttggggagatctcttcctcaattgtcccgacaagaatattgatgctggaactgaaaaacgccaccaacaattgaaagaagaagtgaggaagatgattgtggcaccaatggctaatgcaacccaaaagttagccttcattgattcagtgcaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgagcaagggaatttcaaatcaaccgtgacaagcgatgttcgaggattgttggaactttaccaagcttcttatttgagggttcatggggaagatatattggatgaagcaatttctttcaccaccaaccatttaagccttgcagtagcatctttggaccatcctttatccgaagaggtttctcatgctttgaaacaatcaattcgaagaggcttgccaagggttgaggcaaggcactatctttcagtataccaagatattgagtcccataataaggctttgttggagtttgctaagatcgatttcaacatgttacaatttttgcataggaaagagctaagcgagatttgtaggtggtggaaggatttagactttcaaagaaagttgccatatgcaagagatagagtggttgaaggctatttttggatctcgggagtgtactttgagccccaatattcacttggtagaaagatgttgacaaaagtgatagcaatggcatctatagtagatgatacatatgactcatatgcaacatatgaagagctcattccatatacaaatgcaattgagaggtgggatatcaaatgcatagatgaacttcctgaatacatgaagccgagctacaaggcactattagatgtttacgaagaaatggaacaactggtggctgagcatgggagacaatatcgtgtcgaatatgcaaaaaatgcgatgatacgacttgctcaatcttaccttgtggaggccagatggactcttcaaaactacaaaccatcattcgaggagtttaaggctaatgcattgccaacttgtggttatgccatgcttgctattacatctttcgtcggcatgggagatatcgtaacaccagagacctttaaatgggcagccaatgatcctaagatcattcaagcttccacaattatttgtaggtttatggatgatgttgctgaacacaagttcaagcataggagagaagacgattgctcagcaatcgagtgttacatggaagaatatggcgtaacagcacaagaggcatatgatgtattcaccaagcatgttgagagtgcttggaaggatgtaaatcaagagcttttgaaaccaacagaaatgccaacagaggttttgaaccgtagcctaaaccttgcaagggtgatggatgtactttacagggaaggcgatggctatacatatgttggaaaagcggctaagggtggaatcacttcattgctcattgaaccaattgcactttgaaattatgttaatttttcctctccaagcttgtttcctaagaaatagttattaagttctaattaataatgttttataatattcatatattataaaagaaagtccaaatctattgtctttgtacttattgccttatattaattcaataaagttctttccaaacttttcattgtgaa

SEQ ID NO: 5627 - DNA, 1871 bp, Gossypium hirsutum
cagaaaaaggctgcaaattcagcttttcaatatctgcttttgatcaatcgaaatggcttcacaagtttctcaaatgccttcttcatcacccctttcttccaataaggatgaaatccgtcccaaagccgattttcagcctagcatttggggagatctcttcctcaattgtcccgacaagaatattgatgctggaactgaaaaacgccaccaacaattgaaagaagaagtgaggaagatgattgtggcaccaatggctaatgcaacccaaaagttagccttcattgattcagtgcaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgagcaagggaatttcaaatcaaccgtgacaagcgatgttcgaggattgttggaactttaccaagcttcttatttgagggttcatggggaagatatattggatgaagcaatttctttcaccaccaaccatttaagccttgcagtagcatctttggaccatcctttatccgaagaggtttctcatgctttgaaacaatcaattcgaagaggcttgccaagggttgaggcaaggcactatctttcagtataccaagatattgagtcccataataaggctttgttggagtttgctaagatcgatttcaacatgttacaatttttgcataggaaagagctaagcgagatttgtaggtggtggaaggatttagactttcaaagaaagttgccatatgcaagagatagagtggttgaaggttatttttggatctcaggagtatactttgagccccaatattcacttggtagaaagatgttgacaaaagtgatagcaatggcatctattgtagatgatacatatgactcatatgcaacatatgatgagctcattccctatacaaatgcaattgagaggtgggatatcaaatgcatagaccaacttccagaatacatgaaaccgagctacaaagcactattagatgtttacgaagaaatggaacaactggtggctgagcatggaagacaatatcgtgtcgaatatgcaaaaaatgcgatgatacgacttgctcaatcttaccttgtggaggccagatggactcttcaaaactacaaaccatcattcgaggagtttaaggctaatgcattgccaacttgtggttatgccatgcttgctattacatctttcgtcggcatgggagatatcgtaacaccagagacctttaaatgggcagccaatgatcctaagatcattcaagcttccacaattatttgtaggtttatggatgatgttgctgaacacaagttcaagcataggagagaagacgattgctcagcaatcgagtgttacatggaagaatatggcgtaacagcacaagaggcatatgatgtattcaccaagcatgttgagagtgcttggaaggatgtaaatcaagagcttttgaaaccaacagaaatgccaaccgaggttttgaaccgtagcctaaaccttgcaagggtgatggatgtactttacagggaaggcgatggctatacatatgttggaaaagcggctaagggtggaatcacttcattgctcattgaaccaattgcactttgaaattatgttaatttttcctctccaagcttgtttcctaagaaatagttattaagttctaattaataatgttttataatattcatatattataaaagaaagtccaaatctattatctttgtacttattgccttatattaattcaataaagttcttt

SEQ ID NO: 5628 - DNA, 1848 bp, Gossypium hirsutum
gcttttgatcaatcgaaatggcttcacaagtttctcaaatgccttcttcatcacccctttcttccaataaggatgaaatccgtcccaaagccgattttcagcctagcatttggggagatttcttcctcaattgtcccgacaagaatattgatgctggaactgaaaaacgccaccaacaattgaaagaagaagtgaggaagatgattgtggcaccgatggctaattcgacccaaaagttagccttcattgattcactccaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgcattcaacaagtttaacgacgagcaagggaatttcaagtcatctgtgacaaacgatgttcaaggattgttggaactttacgaagcctcctatttgagggttcatggggaagatatattggatgaagcaatatctttcaccaccaaccatttaagccttgcagtagcatctttggaccatcctttgtccgaagaggtttctcatgctttgaaacaatcaattcgaagaggcttgccaagggttgaggcaaggcactatctttcagtataccaagatattgagtcccataataaggctttgttggagtttgctaagatcgacttcaacatgttacaatttttgcataggaaagagctaagtgagatttgtaggtggtggaaggatttagactttcaaagaaagttgccatatgcaagagatagagtggttgaaggctatttttggatctcgggagtgtactttgagccccaatattcacttggtagaaagatgttgacaaaagtgatagcaatggcatctattgtagatgatacatatgactcatatgcaacatatgaagagctcattccctatacaaatgcaattgagaggtgggatatcaaatgcatagatgaacttccagaatacatgaaaccaagctacaaggcactgttagatgtttatgaagaaatgaaacaactggtggctgagcatgggagacaatatcgtgttgaatatgcgaaaaatgcgatgatacgacttgctcagtcttaccttgtggaagccagatggactcttcaaaactacaaaccatcattcgaggagtttaaggcaaatgcattgccaacttgtggttatgccatgcttgctattacatctttcgtcggcatgggagatatcgtaacactagaaacctttaaatgggcagccaatgatcctaagatcattcaagcttccacaattatttgtaggtttatggatgatgttgctgaacacaagttcaagcataggagagaagacgattgctcagcaatcgagtgttacatggaagaatatggcgtaacagcacaagaggcatatgatgtattcaacaagcatgttgagagtgcttggaaggatttaaatcaagagtttttgaaaccaacagaaatgccaacagaggttttgaatcgtagcctaaaccttgcaagggtgatggatgtgctttacagggaaggcgatggctatacatatgttggaaaagcggcaaagggtggaatcacttcattgctcattgaaccaattgcactttgaaattatgttaatttttcctctccaagcttgtttcttaagaaatagttattaagttctaattaataatgttttataatattcatatattataaaagaaagtccaaatcgattgtctttgtacttattgccttatattaattcaataaggttctttccaaaaaaaaaa

SEQ ID NO: 5629 - DNA, 2005 bp, Gossypium hirsutum
caccaatcttattgtataattgtttccttgcatataggttgtcttttttgacttaaactcaccagtatattttacctataaatacatgcaacaattgcactcttatcctcacagattctgtgccaaatttcaagagcaaaccaaaaaaggcagcaaattaagcttttcaatatttgcttttaatcaatcgaaatggcttcacaagtttctcaaatgccttcttcatcacccctttcttccaataaggatgaaatgcgtcccaaagccgattttcagcctagcatttggggagatttcttcctcaattgtcccgacaagaatattgatgctgaaactcaaaaacgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatcccttcgattccgactactccgagagcatggattcaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccagcaaccatttaagccttgcagtagcatctttggaccatcctttatccgaagaggtttctcatgctttgaaacaatcaattcgaagaggcttgccaagggttgaggcaagacactatctttcagtataccaagatattgagtcccataataaggttttgttggagtttgctaagatcgatttcaacatggtacaacttttgcatagaaaagagctaagtgagatttctaggtggtggaaggatttagactttcaaagaaagttgccatacgcaagagatagagtggttgaaggctatttttggatctcaggagtgtactttgagccccaatattctcttggtagaaagatgttgacaaaagtgatagcaatggcatctattgtagatgatacatatgactcatatgcaacatatgaagagctcattccctatacaaatgcaattgagaggtgggatatcaaatgcatagatgaacttcctgaatacatgaagccgagctacaaggcactattagatgtttatgaagaaatggaacaactggtggctgagcatgggagacaatatcgtgtcgaatatgcgaaaaatgcgatgatacgacttgctcaatcttatcttgtggaggccagatggactcttcaaaactacaagccatcattcgaggagtttaaggctaatgcattgccaacttgtggttatgccatgcttgctattacatctttcgttggcatgggagatattgtaacaccagaaacctttaaatgggcagccaatgaccctaagataattcaagcttccacaattatttgtaggtttatggatgatgttgctgaacacaagttcaaacataggagagaagacgattgctcagcaattgagtgttacatggaagaatatggtgtaacagcacaagaggcatatgatgtattcaacaagcatgttgagagtgcttggaaggatgtgaatcaagagtttctgaaaccaacagaaatgccaacagaagttttgaatcgtagcttaaaccttgcaagggtgatggatgtactctacagagaaggtgatggctacacatatgttggaaaagcggctaagggtggaatcacttcattactcattgaaccaattgcactttgaaatcgtattaaattttcctcttctgttccttaaggaatagttattaagttataattaataatgttttataatatatatattataaaagaaattctaaatcaactgtctttgtattcatttccttgtattgatctaataaagttctttt

SEQ ID NO: 5630 - DNA, 1787 bp, Gossypium hirsutum
ggactagcaaattcagctttcatatctgctttgtatcaatcgaaatggcttcacaagttctcaaatgccttcttcatcaccccttcttccaataaggatgaaatccgtcccaaagccgattttcagcctagcatttggggagatctcttcctcaattgtcccgacaagaatattgatgctggaactgaaaaaacgccaccaacaattgaaagaagaagtgaggaagatgattgtggcaccaatggctaatgcaacccaaaagttagccttcattgattcagtgcaaagactgggtgtgagttaccatttcaccaaggagatcgaagatgaactagagaatatctaccataacaacaatgatgccgagaacgacctctacgctacatctcttcgattccgactactccgagagcatggattcaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccagcaaccatttaagccttgcagtggcatcttggaccatcctttatccgaagaggtttctcatgctttgaaacaatcaattcgaagaggcttgccaagggttgaggcaaggcattatctttcagtataccaagatattgagtcccacaataaggctttgttggagtttgctaagatcgacttcaacatgttacaatttttgcataggaaagagctaagtgagatttgtaggtggtggaaggatttagactttcaaagaaagttgccatatgcaagagatagagttgttgaaggttatttttggatctctggagtgtactttgagccccaatattcacttggtagaaagatgttgacaaaagtgatagcaatggcatccattgtagatgatacatatgactcatatgcaacatatgaagagctcattccctatacaaatgcaattgagaggtgggatatcaaatgtatagatgaacttcctgaatacatgaaaccaagctacaaggcactattagatgtttatgaagaaatggtacaattggtggctgagcatgggagacaatatcgtgtcgagtatgcgaagaatgcgatgatacgacttgctcaatcttatcttgtggaggccaaatggactcttcaaaactataaaccatcattcgaggagtttaaggctaatgcattgccaacttgtggttatgccatgcttgctattacatctttcgtcggcatgggagatatcgtaacaccagagacctttaaatgggcagctagtgaccctaagatcattcaagcgtccacaattatttgtaggtttatggatgatgttgctgaacacaagttcaagcataggagagaagacgattgctcagcaatcgagtgttacatggaagaatatggtgtaacagcacaagaggcatatgatgtattcaacaagcatgttgagagcgcgtggaaggatgtaaatcaagagtttttgaaaccaacagaaatgccaacagaggttttgaatcgtagcctaaaccttgcaagggtgatggatgtgctttacagagaaggagatggctatacatatgttggaaaagcggccaagggtggaattacttcattgctgattgagccaatcgcagtttgaaattatattaaaatttcctcttcaagctttttccttaaggaatagttattacgtttaattaataatgttttataatattc

SEQ ID NO: 5631 - DNA, 1917 bp, Gossypium hirsutum
aacacaaattctgtgccaaatttcaagagcaaaccaaaaaaaggctgcaaattcagcttttcaatatctgcttttgatcaatcgaaatggcttcacaagtttctcaaatgccttcttcatcacccctttcttccaataaggatgaaatccgtcccaaagccgattttcagcctagcatttggggagatttcttcctcaattgtcccgacaagaatattgatgctggaactgaaaaacgccaccaacaattgaaagaagaagtgaggaagatgattgtggcaccgatggctaattcgacccaaaagttagccttcattgattcactccaaagactgggtgtgagttaccatttcaccaaggagatcgaagatgaactagagaatatctaccataacaacaatgatgccgagaacgacctctacactacatctcttcgattccgactactccgagagcatggatacaatgtttcatgcgacgtattcaacaagtttaaagacgagcaagggaatttcaagtcatccgtgacaagcgatgttcgaggattgttggaactttaccaagcttcctatttgagggttcatggggaagatatattggatgaagcaatttctttcaccaccaaccatttaagccttgcagtagcatctttggaccatcctttatccgaagaggtttctcatgctttaaaacaatcaattcgaagaggcttgtcaagggttgaggcaaggcactatctttcagtataccaagatattgagtcccatataaggcttgttgagtttgctaagatcgacttcaacatgttacaatttttgcataggaaagagctaagcgagatttgtaggtggtggaaagatttagactttcaaagaaagttgccatatgcaagagatagagtggttgaaggctacttttggatctcaggagtgtactttgagccccaatattcacttggtagaaagatgttgacaaaagtgatagcaatggcatctattgtagatgatacatatgactcatatgcaacatatgaagagctcattccatatacaaatgcaattgagaggtgggatatcaaatgcatagatgaacttcctgaatacatgaagccgagctacaaggcactattagatgtttatgaagaaatggaacaactggtggctgagcatgggagacaatatcgtgtcgaatatgcgaaaaatgcgatgatacgacttgctcaatcttatcttgtggaggccagatggactcttcaaaactacaaaccatcattcgaagaagttaaggctaatgcattgccaacttgtggttatgccatgcttgctattacatctttcgttggcatgggagatattgtaacaccagaaacctttaaatgggcagccaatgaccctaagatcattcaagcttccacaattatttgtaggtttatggatgatgttgctgaacacaagttcaaacataggagagaagacgattgctcagcaattgagtgttacatggaagaatatggtgtaacagcacaagaggcatatgatgtattcaacaagcatgttgagagtgcttggaaggatgtgaatcaagagtttctgaaaccaacagaaatgccaacagaagttttgaatcgtagcttaaaccttgcaagggtgatggatgtactctatagagaaggtgatggctacacatatgttggaaaagcggctaagggtggaatcacttcattactcattgaaccaattgcacttagaaatcgtattaaattttcctcttctgttccttaaggaatagttattaagttataattaataatgttttataatatatatattataaaagaaattctaaatcaactgtctttgtattcatttccttgtattgatctaataaagttcttttcaagctttcatttgtgaaaaa

SEQ ID NO: 5632 - DNA, 1930 bp, Gossypium raimondii
aagttacgttgcttagtccttgttccaacctataaattcatgtaacagctgcactcttatcctcacagattttgtgccaagtttctcaaattaagtttttgaatatttgcttttgatcaatcgaaatggcttcacaagtttctcaaatgccttcttcatcacccctttcttcccataaggatgaaatgcgtcccaaagccgattttccgcctagcatttggcgagatttcttccacaactgtcccgacaagaatattgatgctgaaactgaaaaacgccaccaacaattgaaagaagaagtgaggaagatgattgtggcaccaatggctaattcaacccaaaagttaaccttcattgattcagttcaaagactgggtgtgagttaccatttcaccaaggagatcgaagatgaactagtgaacatctaccataacaacaatgatgccgagaacgacctctacactacatctcttagattccgaatactccgagagcatggattccatgtttcatgcagcgcattcaacaagtttaacgacgagcaagggaatttcaagtcatctgtgacaaacgatgttcgaggattgttggaactttacgaggcctcctatttgagggttcatggggaagatatattggatgaagcaatttctttctccgccaaccatttaagccttgcggtggcatctttggactatcctttgtccgaacaggtttctcatgctttgaaacaatcaattcgaagaggcttgccaagggttgaggcaaggcactatctttcggtataccaagatattgagtcccataataaggctttgttggagtttgctaagatcgatttcaacatgttacaacttttgcataggaaagagctaagtgagatttgtaggtggtggaaggatctagactttcaaagaaagttgccatatacaagagatagagtggttgaatgctatttttggatcttgggagtgtactttgagccccaatattcacttggtagaaagatgatgacaaaagtgataataatgacatctgttatagatgatacatatgactcatatgcaacatatgatgagctcattccctatacaagtgctattgagaggtgggaaattaaatgcatagaccaacttccagaatatatgaaactgagctacaaggcactattagatgtttatgaagaaatgaaacaactagtggttgagcacgggagacaatatcgtgtcgaatatgcgaaaaatgcaatgatacgactttctcaatcctactttgtggaggccaaatggactcttcaaaactacaaaccatcattcgaggaatttaagattaatgcattgtcatcttctggttatgccatgcttgctattacatctttcgtcggtatgggagatatcgtaacaccagagacctttaaatgggcagccaatgaacctaagatcattcaagcttccacaattatttgtaggtttacggatgatattgctgaacacaagttcgagcataggagagaagacgattggtcagtaatcgactattacatgaaagaatataacgtaacagcacaagaggcatacgatgtattcaacaaatatattgagagtgcttggaaagatacgaatcaagagcttctgaaaccaacagaaatgccaacagaggttatgaatcgtagcctaaacctttcaagggtaatggatgtggtttacaaggaaggagatggctatacatatgttagaaaagcgatgaaagatgtaatcacttcattgttgattgagccagtcacactttgaaatgatattaagcttgttgtttaagggatggatattaagttaaagacagtacaaatcgattgtctttctacttattgccttaataattcaataaagttcttttcaagcttttggttgtgaaaattttgctattttatata

SEQ ID NO: 5633 - DNA, 1913 bp, Gossypium raimondii
aaacaagttacgttgcttagtccttgttccaacctataaatacacgtaacagctgcactcttatcctcacagattttgtgccaagtttctcaaattaagcttttgaatatttgcttttgatcaatcgaaatggcttcacaagtttctcaaatgccttcttcatcacccctttcttccaataaggatgaaatgcgtcccaaagccgattatccgcctagcatttggggagatttcttccacaactgtcccgacaagaatattgatgctgaaactgaaaaacgccaccaacaattgaaagaagaagtgaggaagatgattgtggcaccaatggctaattcaacccaaaagttaaccttcattgattcagttcaaagactgggtgtgagttaccatttcacgaaggagatcgaagatgaactagagaacatctaccacaacgacaatgatgccgagaacgacctctacactacatctcttagattccgaatactccgagagcatggattcaatgtttcatgcaacgcattcaacaagtttaaggacgagcaagggaatttcaagtcatctgtgacaaacgatgttcgaggattgttggaactttacgaggcctcctatttgagggttcatggggaagatatattggatgaagcaatttctttctccgccaaccatttaatccttgcggtggcatctttggactatcctttgtccgaacaggtttctcatgctttgaaacaatcaattcgaagaggcttgccaagggttgaggcaaggcactatctttcagtataccaagatattgagtcccataataaggctttgttggagtttgctaagatcgatttcaacatgttacaactgttgcatagggaagagctaagtgagatttgtaggtggcggaatgatttagactttcaaacaaaattgccatatacaaaagatagagtggttgaatgctatttttggatcttgggagtgtactttgagcctcaatattcacttggtagaaagatgatgacaaaagtgataataatgacatctgttatagatgatacatatgactcatatgcaacatatgatgagctcattccctatacaagtgctattgagaggtgggaaattaaatgcatagaccaacttccagaatatatgaaactgagctacaaggcactattagatatttatgaagaaatgaaacaactagtggctgagcacgggagacaatatcgtgtcgaatatgcgaaaaatgcaatgatacaacttcttcaattctactttatggaggccaaatgggctcttcaaaactacaaaccatcgttcgaagaatttaaggctaatgcagtgtcatctagtggttatgccatgcttgctatcacatctttcgtcggtatgggagatatgataacaccagagacctttaaatgggcagccagtgaacctaagatcattcaagcttccacaattatttgtaggtttatggatgatattgctgaacacaagttcaagcataggagagaagacgattggtcagtaatcgactattacatgaaagaatataacgtaacagcacaggagacatacgatgtattcaacaaatatattgagagtgcttggaaagatatgaatcaagagcttctgaaaccaacagaaatgccaacagaggttatgaatcgtagcctaaacctttcaagggtaatggatgtgctttacaaggaaggagatggctatacatatgttggaaaagcgatcaaagatgcaatcacttcattgttgattgagcccatcacactttgaaattatattaagcttgttgtttaagggatggatatttagttaaagaaagtacaaatcgattgtctttctacttatcgccttaataattcaataaagttcttttcaagcttttggttgtg

SEQ ID NO: 5634 - DNA, 1743 bp, Gossypium raimondii
gttgacaatgataacgacatcaaagtcacctacaatttgtatgaaccatgccacttaggctgttaacttgttatcctcatccagttctagcaaccggccattagctactgccagaaaatccaagcatcaatcttgcaaagcaaagcgtttgctaatggagggtctgatgcaggtgccttatgatgttacggtcaggttcatgttgacttccttggagcgcaatttgttgcctgatgctattataaggaggttgactcggcttctcctggctagtcgtcttcgttctggttataaaccctccactgaactccaactctctgatctccttcagtttgctcattccctaaaggagatgcctatagctatcaagacagacaagcctaaaactcaacattacgaactgccaacctctttcttcaagttggttcttgggaagaacttcaaatacagttgctgttacttttctgatgagtcgaaaactttggaggatgctgaggaagcaatgttggaactgtactgtgagagatcgcaattaaaagatggccaaacggttcttgatgtggggtgtggatggggttcactttctctatacattgcccgtaagtaccccaattgcagggttacagggatttgcaattccaccactcagaaagcttttatagaggagcaataccaggatcggcaattgcaaaatgtggagatcattgttgcggacataagcacatttgaaatggaggcatcatacgacaggatatattcgattgaaatgtttgagcatatgaagaactatcacgatcttctcaagaagatatcaaagtggatgaaagaggatagtcttctttttgttcattatttctgccataaagcatttgcttaccactttgaggacataaatgaagatgactggataaccaggtacttctttacaggaggtacaatgccttcagctaatctgcttctatatttccaggatgatgtttctgttgtcaaccattggcttgtgaatgggaaacattatgcaaaaactagtgaagagtggctgaagaggatggaccgaagcttggcttccattaagccaataatggagtccacctatggcaaggatcaggctgtgaaatggacagtgtattggagaacattctttattgctgttgcggaactctttggatacaataatggagaagaatggatggttgcacttttcctattcaagaagaaataaagccgtcatcaatgctcatttccaccaataatcagctttgggcattaggggactaaaataagagcaactgtagaatcgctgaaaattttgcaactcgtactagtcacacacgtctagctacttgttccattggaaagacgaatgcattttgtactttggacgaaaccaaacaactgcatcaagaagcgtcaatgcagagaataaatcatagcaaaaaatttaaataattgatgaaagtataacttccgttagttacttcacctgtttagttttacactatgtagcaacattctcaactgggtttccactattatcttgaaaatggaaccaacaacgtcatcagcttccaaggagcctggctatgactgttctccatcatagacccagggtacttcatacagaagttgcaaggaaggctatcagggattaacaggctcaagttcatcagcaataacttgtctggttcccttctcatatctcagccactctaatgtagcttggatggccatacttgataggct

SEQ ID NO: 5635 - DNA, 1256 bp, Lotus japonicus
gaaccatttgctgtgattcaatggaagggataatgcagcgaccgtacgacgcgacggtgaagctgatgctagcttcaatggagcgcaacttgctccccgacgccgtcatcaggagactcacgcgcttgctgttggctgctcgcctacgcgccggttacaaaccttcctctgagattcagctctctgaccttgtttactttgtgcattctttgcaagatatgcctattgccatcagcactgatacggcaaaatctcaacattatgaattgccaacctctttcttcaagctggtgctcggaaagaatctcaaatacagttgttgttatttctcttctgcctcagagacgttggaagatgctgaagaagcaatgctgaaattgtactgcgagagatcaaacctgaaagatgggcatacagttcttgacgtaggatgtggttggggatcactggctttatacattgccaagaactacagcaattccagagttacaggaatctgcaattccgtaactcagaaagcttttatagaggagaagtgccaggatcttcagctgcaaaatttagagatcattgttgcagatattagcaccttcgaaatggaagcttcttatgacagaataatttccatagaaatgtttgagcatatgaagaactataaggatcttctcaagaagatatccaaatggatgaaagaggatagccttttgtttgttcatcatttctgccacaaggcatttgcctaccactttgaggatgaaagtgaagacgactggattacaagatatttctttacaggaggaaccatgcctgcagcaaatctacttctttatttccaagatgatgtctctgtcgtcaaccattggctagtaaatgggaaacactacgcacagaccagtgaagaatggctcaagagaatggacaagaacatgagttctatcaagccaataatggaatcaacatacggcaaggattcagctatcaagtggactgtctattggagaacattcttcatagctgtagcagaactttttggatacaataatggcgatgaatggatggttgcacactttcttttcaaaaagaaataaataacataagccgaaaacaaatgaaatcttatttcaatttgagaatggaggtgttgcgcaaaaaactgctcaaagaggttacatactaaaaaatattgttgtattttattgattaactttatcttatcgggttgtgtctattttattcaatcttttgatttcgcccgt

SEQ ID NO: 5636 - DNA, 1348 bp, Vitis vinifera
aaaaccacacggcatcctctcatctctagtctccccgcctctcgcctcctgtcttcatcttcttactcttcttcaatctgagagtgagagagtgagagatggagggaatgatgcaggtgccttacgacgccactgtaaggctcatgctggcttcgctggaacgcaacctcttgcccgacgcactcgtcaggagactcacgcggcttctcttggccagtcggcttcgctccggatacaagccttcggcggagctccagctctcctctctcctccacttcgcccactctttagaagaaatgcctatagccatcaagaccgaagatccaaaatctcagcattatgaactcccaacctctttctttaagctagtacttggaaagaatctcaaatacagttgttgctacttccctgataaatcaagcaccttagaggatgctgagaatgccatgttggagatgtactgtaagagggcacaggtagaggatggccacactgttctcgatattggatgtggctggggatcattatccttgtacattgcacagaagtataccaactgcaggatcactgggatttgcaattcaaagacccagaaagcatacattgaggagcagtgccaggagcttcagctgcaaaatgtggagatcattgttgcagatattagcacattggaaatggaggcaacctatgaccgaatattttccattgaaatgtttgagcacatgaagaactacaaggatcttctcaagaagatatctgggtggatgaaacaggatagccttctttttgttcatcatttctgccacaaagcattcgcatatcactttgaggacaaaagcgatgatgactggattacccggtacttcttcagcgggggcaccatgcccgctgcaaatctgcttctttatttccaggaagatgtttctgttgttgatcattggcttgttaatggaaagcattatgcacagacaagtgaagaatggcttaaaagaatggacaagaacttagcttctataaagccaataatggagtcaacttatggcaaggattcagctgtcaagtggaccgtctattggagaacattcttcatttctgttgcagaactctttgaatacaatgatggagaagaatggatggtcgcccttttcctattcaaaaagacttgaagtctctaaaagctgaacaaaatccaaaagtactcacagggaataaggctcaacaacattttgattctagggtggtcaataagctgtattattgaagaatttgcatacttgagatgaacaacagaacaagattggaactaccagcataatgtgttgcagaaataaaaaccaccacaacttcg

SEQ ID NO: 5637 - DNA, 1121 bp, Cucumis sativus
gcgtaatattcgggatcaagcttcacccacccagaaatggcgaagcttattcagatcccctacgacgctactgttcatcttgcattagcttctcttgaacggaatttgttgccggacgccatcataagaacgttcactcgtttgttactcgcttctcgtcttcgctccggttacaaaccttcctctcaacttcaactctccgaactcctccatttcgttcactctttaagggaaatgcccatagcaattaagactgataagccaaaagctcaacactacgaagtaccgacttccttcttcaagttggttttggggaagaatctcaagtacagttgttgctatttcaatgacaaatcaagtactttagaggatgctgaggatgccatgctacaaatgtattgtgaaaggtcacagttgaaggatggtcacactgttcttgatgttggatgtggctgggggtcgctctcattgtacattgcccaaaagtataagaattgcacggtaacaggaatttgcaattcaatcacgcagaaagcttacatcgaggatcggtgccaggatctccaactgcataatgtcaacatcatagttgcagacataagcacatatgaaatggaagctgaatatgacagaatattttctattgaaatgtttgagcatatgaagaactacaaggatcttctcaagaaaatatcaggttggatgaaacaggatagcctcctatttgttcattatttttgccacaaggtgtttgcctatcactttgaggatgtaaatgacgatgattggattactagatacttctttgaaggtggtacaatgctttcctcaaatctacttctctatttccaggatgacgtttcaattgtagaccattggcttgtgaatggcaagcactattctcaaacaagtgaagagtggctcaaaagaatggacgagaacatagcttcaataaaaccaatcatggcaactacttatgggaaggattcggctgtgaagtggactgtttattggagaacattctttattgcagtggctgagttatttggttacaacaatggtgaagaatggatggttagccatttcctgttcaagaagaagtgatgcaaagcaacaaagct

SEQ ID NO: 5638 - DNA, 1523 bp, Cucumis melo
gtacgggtagtggcgccgacgggatgagggagaagaagacgctatttttgtcaggccacgccacgtggccgagctcggagataaaacggtggcttaaaatggagagaccaaagagtggaggttagcgtaatatttgggatcaagcttcacccacgcagaaatggcgaagcttattcagatgccctacgacgtttctgttcgtcttgcattagcttctcttgaacggaatttgttgccggacgccgtcgtaagaacgttcacccgcttgttactcgcttctcgtcttcgctccggttacaaaccttcctctcaacttcaactctccgaactcctccatttcgttcactctttaggggaaatgcccatagcaattaagactgataagccaaaagctcaacactacgaagtaccgacctccttcttcaagttggttttggggaagaatctcaagtacagttgttgctatttcaatgacaaatcaagtactttagaggatgctgaggatgcaatgctacaaatgtattgtgaaaggtcacagttgaaggatggtcacactgttcttgatgttggatgtggctgggggtcgctctcattgtacattgcccaaaagtataagaattgcacagtaacaggaatttgcaattctatcacgcagaaagcttacatcgaggatcggtgccaggatctccaactgcataatgtcaacatcatagttgcagacataagcacatatgaaatggaagctgaatatgacagaatattttctattgaaatgtttgagcatatgaagaactacaaggatcttctcaagaaaatatcaggttggatgaaacaggatagcctcctatttgttcattacttttgccacaaggtgtttgcctatcactttgaggatgtaaatgaagatgattggattactagatacttctttgaaggtggtacaatgccttcctcaaatctacttctctatttccaggaggaggtttcaattgtagaccattggcttgtgaatggcaagcactattctcaaacaagtgaagagtggctgaaaagaatggacaagaacatagcttcaataaaaccaatcatggcaactacttatgggaaggattcggctgtgaagtggactgtttattggagaacattctttattgcagtgtctgagttatttggttacaacaatggtgaagaatggatggttagccatttccttttcaagaagaaatgaatcaaacaacaaagctcctgtggtttaagagttcatagaacaaggtgcgatttttatgagcttgaatgagtgagtttcttcctttgatctattgatttggtgaagccatatgatccaacatgtcctgtttattgcaatatttgtactgttagtcagattaattggcatcgcgatgtgtcccttaaagaccattttgcaaaactttttagcctgtcatggatattattagaggaaattagaatgccaattcgggtaataaaaaaaaaaaaaaaactagagacacgacaacaaggga

SEQ ID NO: 5639 - DNA, 1899 bp, Gossypium raimondii
ggtaatggtatggtttacggttggatgatggtagatattgggaaggttcggagattgatgtcatatagggcgtgagtgttacgtacataatccagctgcatcccaaaacatccatgataaggtatatcagtttaaggtcactttcactcttaaggtattggtattaattaactttgttctccttaggctggagcagggaataagttcatgtggtgtcacactgtcccttgatgtggcatattttagcatttaagctaatttgtctctactctatacctctcttatccatctgcagcctcagcctcagcctcccaaatgacaccaaagtgaatcaaccctcaatatcaagcccctcaaatcttctcaatttgaagcacatcatagaactgctcccccttggttccactcttctgttactgttgaagggtcatgttgaataagctagccttgccagaatccagcactttcccaggaaagccaatgccacccacagctgaatgctggtttgatgatgcatgcatccttgacatggactactttgtgaagaccatctcaggcataaaggccaagggtgttcgtcccgacttagtaggctcaatcattgcacattatgcatcgaaatggctacctgatctatccggcaatgacaccgaaaagggtcctatgagcctccaagagtcatcgccggagagtgtcacagtttcatggatgaaaaagaggttctttgttgaaaccttggtgggaatcttgccacctgagagagattccatcccctgcaacttcctcctacgccttctccggacggccaacatggttggggtggagccttcctacagagcagagctggagaaaagaatttcgtggcagcttgaccaagcatcactgaaagagctcatgattccatcgtttagtcacacttgtggcactctgctagacgttgagcttgttataaggctggttaagagatttgctagccttgatgaaggcactagaagcggcattgcggtggttaaagtagctaagcttgtggatagctacttggcagaagcagctttggataccaatctgagtttggaggactttattgcacttggtgctgctcttcctagccatgcccgagccatggatgatggcctctaccgtgccattgacacttatctcaaagcacatccaggtgtttcaaagcaagataggaaggttctatgcagattgatagacagtcgaaaactgtcaccagaagcatccctacacgctgcacaaaacgaacgtttgccagttcgggcggtgattcaagtgttgttctgcgagcaaagcaagctcaaccgacatgttgattggagtgggtcgttcaacggaacccggagtcctaacccggcaggactggaagccccggttcggtgcatgtcgaaacgtgaaatgaacgctcaacaaatggagataaagaagctgaaggaagaactgctgagggtccaaagccaatgcgtagcgatgcaaatgcaaatggagaaactagtggataagaagaaagggtttttcaggtggaagaagctggggataatgccgtcgctgaagagcagcgtgagtgtatttgagaagattgaagaagaaagagaggctaactttgggaggcaaacccccattgatatcaaacagaagcctgttcgtcctcccaagtggagaaaatccatgtcttgacttcattatgcaggggttcctaattaatttgctgctaaatttaatgttttatatatatatatgttccttttcctatgttccatgtcgcgataataatgtaacaataataagattcgtattaaataaatgtagtttttctttttgtagattataataacagagaaaatttgaacaataaacgcgactagcataactcgaactcaa

SEQ ID NO: 5640 - DNA, 1817 bp, Theobroma cacao
cttgtcttcactctctgcctctcttatccatcttcatcttcacctctcggcctcccaacgccaggaaaattaaatcctcaatctcaaatcccaatttatcactttttctcatcagctaaataatctgttatccccaaaaaaaccaatgttatcttctcaaaccaaacaaatatttcaagggtgttttagtcagtttcccttgcaaatcctattctcggccatgtagcttaggacctattactccccacgtttgcttttatctcatacaggtaaatctgacatgaaattcttctcaaattacaacactgcataacctgcttcccctctatttttctcttctgttactgttacgccatgatgaagaagctagccttgcaagaatccatcactttcccaacccaatccgcgcctgactgctggtttgacgatgcatgtatcctggatatggactactttgtcaagaccatatcaggcattaaggccaagggggtccgtcctgacttgatcggttcaatcatagcgcattatgcatcaaaatggctccctgacttatccagcaataacaccgaaaagggtcttacgaatttcgaagaatcatccccagagagtgtcacagcttcctggatgaaaaaaagattctttgttgaaaccttagtggggatcttgcctcccgagagagactccgtcccatgcaactttctcttacgccttctccggacagccaacatggtcggcgtagaaccttcctacagagctgagctggagaaacggatttcatggcagctcgaccaagcttcactgaaagagctgatgattccatcgtttagtcacacttgcggcactctgttagatgtggagcttgttataaggctggtgaagagatttgctagcctggatgaaggggctagaagtggtgctgctttggttaaagcagctaagcttgtggattgctacttagcagaagcagccctggataccaatttgagtttggatgagtttattgcacttggtggagctcttcctagccatgctcgtgccatggatgatggcctgtaccgtgccattgacacttatcttaaagcacatcctggtgtcccaaagcaagataggaaggttctttgcagattgatagacagtcgaaaactctcaccagaagcatccctccacgctgctcaaaacgaacgtttacctgttcgagccgtaattcaagtgctattctcggaacaaacaaagctcagtcgacatatagattggagtgggtcgtttagtggaacaaggagtccaaacccggggctggaagcccctgctcggtgcctgtcgaaacgtgaaatgaacgctcagcaaatggagataaagaagctgaaagaggacttgctgaaggtccaaagccaatgcattgccatgcaaatgcaaatggagaaaatgttggataagaagaaggggtttttcaggtggaggaagcttgggctgaagccttcgtttaagagtagcgtgagtgtttttgagaagattgaagaaggagaaggagaaggagaggttgctttcgggctgcaaacgccaatggatatgaaagcaaagcttgttcgaggtaggactcctcccaagtggagaaaatccatgccttgaaaagtgaaggactcccaaaaataaatttgatgtttgtttattattaattctaagctagggaataatgtacgggctgaataatatgtatttgcattataatgtatttccagttgaattcaaataagaggctaccctcagggatattaacattacatcaccatgatcagtcttaaatgtagtttgctagtttc

SEQ ID NO: 5641 - DNA, 1143 bp, Gossypium raimondii
caacaagacaagaaaacattaaattttttttatactaaacgaggaaatggggaacagcataggaggaagaaacaaggcaaaggtaatgaaaatcgatggtgaaaccatcaaattaaagacaccaattcgagtttgggatgttctaaaagattatccaacaggccatgttttattagattcacaaaccgtgaagcattatgggatccgtgctaagccattagagccacaagagagcttgaaacccaagaaaatctacttcttggtggagctgccgaagcttgccgatgatgaagttcataaggcgccgaggagggtgcggtcaggagggattcatatgagtgctaaagataggttagagtgtttgatgttgtcgagaaggacggtgtcggacctttctatggttcgaccgtcgtcgacgagcatggtgcccgatggggttcgactaggtggtggtggtacttccggtggggggatgatgactgtgaaaatgaggttgcctaagtctcaaatggctaagttgatggaagagagcaaagatggtgttgaggtggctgagaagatccttgatctttataccggaaatggtggtagtggcggtgatgatgccggtaatcgaatccaccgtgaagcaccgtggaagcctggccttggtaccgttggagaaaactttaagcccaaacgtgagaagagagtgagctttattccacaagaagaaggtgaaatccatttagcaaatcaattgtagcagccaaatttggagtcagcatcaaaatccagcaattcagccccaatactagttttctttctaaataacttattatttatgacttctttttcttttttatataatcacatgtattttcatatgttttacggttcaagtctagttctattcggtgaggtgacattcaggtaaagccctcccaacaataccgactatagtgttcgaacttgatctaaatacctagagaagaagtctactttcacttcttccaaatggttggtacgatagatagttgaatatggattgtaaatactgaaatttcaaactagatttattgaatatcatatcttaaaggtggctgtatgattttttttgggttaaagtttggtattaatctttatattatgcgtaagttgtgg

SEQ ID NO: 5642 - DNA, 1089 bp, Gossypium hirsutum
ggggaacaaagaccaagaaaacattaatttttttctatactaaacgaggaaatggggaacagcataggaggaagaaacaaggcaaaggtaatgaaaatcgatggtgaaaccatcaaattaaagacaccaattcgagtttgggatgttctaaaagattatccaacaggccatgttttattagattcacaaaccgtgaagcattatgggatccgtgctaagccattagagccacaagagagcttgaaacccaagaaaatctacttcttggtggagctgccgaagcttgccgatgatgaagttcataaggcgccgaggagggtgcggtcaggggggattcatatgagtgctaaagataggttagagtgtttgatgttgtcgagaaggacggtgtcggacctttctatggttcgaccgtcgtcgacgagcatggtgcccgatggggttcgactaggtggtggtggtggtacttccggtggggggatgatgactgtgaaaatgaggttgcctaagtctcaaatggctaagttggtggaagagagcaaagatggtgttgaggtggctgagaagatccttgatctttatatcggaaatggtggtagtggcggtgatgatgccggtaaccgaatccaccgtgaagcaccgtggaagcctggccttggtaccgttggagaaaactttaagcccaaacgtgagaagagagtgagttttattccacaagaagaagttgaaatccatttagcaaatcaattgtagcagccaaatttggagtccgcatcaaaatccagcaattcagccccaatactagttttctttctaaataatttattatttatgatttctttttcttttttatataatcacatatattttcatctgttttacggtttaaatccagttctattcggtgaggtggcattcaggtaaagccctcctaacaatatcaactatagtgttcgcacttgatctagatacctagagaaaaaatttaatttttcttccaagtggttggtaagatagatagttaaatatggattgtaaatactgaaatttcaagctagatttattgaatatcatatcttaaaggtggct

SEQ ID NO: 5643 - DNA, 997 bp, Gossypium hirsutum
tggtgaaaccatcaaattaaagacaccaattcgggtttgggatgttctaaaagattatccaacaggtcatgttttattagattcacaaactgtgaagcattatgggatccgtgctaagccattagagccacaagagagcttgaaacccaagaaaatatacttcttggtggagctgccgaagcttgccgatgatgaagttcataaggcgccgaggagggtgcggtcaggggggattcatatgagtgctaaagataggttagagtgtttgatgttgtcgagaaggacggtgtcggacctttctatggttcgaccgtcgtcgacgagcatggtgtccgatggggttcgactaggtggtggtggtggtggtacttccggtggggggatgatgactgtgaaaatgaggttgcctaagtctcaaatggctaagttggtggaagagagcaaagatggtgttgaggtggctgagaagatccttgatctttatatcggaaatggtggtagtggcggtgatgatgccggtaaccgaatccaccgtgaagcaccgtggaagcctggccttggtaccgctggagaaaactttaagcccaaacgtgagaagagagtgagttttattccacaagaagaaggtgaaatccatttagcaaatcaattgtagcagccgaatttggagtccgcatcaaaatccagcaattcagccccaatactagttttctttctaaataatttattatttatgatttctttttcttttttatataatcacatatattttcatatgttttacggtttaagtccagttctattcggtgaggtggcattcaggtaaagccctcccaacaatatcaattatagtgttcgcacttgatctatatacgtagagaaaaaatttaaattttcttccaagtggttggtaagatagatagttaaatatggattgtaaatactgaaatttcaagttagatttatttgatatcatatcttagaggtggctgtatga

SEQ ID NO: 5644 - DNA, 2039 bp, Pennisetum glaucum
ccactcatcaccctccttcctctcctcctcaactccgatcgactcccctctccaccccaccttcgccgcgagccttgccacgctagttcccacgcaccatgagcgccgcccagcatgcagaccccgccaccacagcctcctccactcccaccgccgcgagcaaccccacggtaatcaagaacgcccggcaccgcccgagcgcgctcaagctctcctaccacctggccatctccaacctcccgtacctcctcctcgcccccttcgccgccgccctcctccaccgcctctcgcgccactcccccgcggacctcgccgccgcggcccactccgcggtcacctccaaccccaccctcaccaccgcgctcctctccctcgccgccatcctcaccaccgtctacctcgcgcgccgcccgcgcgccgtctacctcctcgacttcgcctgctacaagcccgggcccgagcacgtggtcacccgggagacgttcatgcggcagtcggaggcggcgggggtgttcacggacgacaacctggggttccagcggaagatcctggagcggtcgggtctcggccaggggacatacttcccgcgcgccgtgctcaactcgccgcccaacccgtgcatggcggaggcgcgcgccgaggccgaggctgtcatgttcggcgccatcgaccaggtcctcgccaagacgggcgtccgggcgcgcgacatcggggtcgtcgtcgtcaactgcagcctcttcaacccgacgccgtcgctgtccgccatgatcgtcaaccattacaagctccgtgggaacgtcgccagctacaaccttggtggtatggggtgcagcgccgggctcatctccatcgacctcgccaagcagctgctccaggtgcaccggaacacgtacgcgctggtggtgagcatggagaacatcacgctcaactggtactggggcaacaaccgctccatgctcatgtccaactgcctgttccgtatgggcggcgccgccgtgctcctcacgaaccgcggcggcgcggaccgtcgccgcgccaagtaccagctcgtccacaccgtccgcacccaccacggcgccgacgaccgcgcctaccggtgcgtgttccaggaggaggacgagacgggccgcgtcggcgtcgcgctctccaaggacctcatggccgtcgccggcgaggcgctcaagaccaacatcacgacactggggcccctcgtgctccccatgtcggagcagatcctgttcctggcctccctcgtcgggcgcaaggtgttcgggctccggtcgctcaagccctacatcccggacttcaagatggcgttcgagcacttctgcatccacgccgggggccgggcggtgctcgacaccatcgagaagaacctcgacctcagcgcgtggcacatggagccgtcccggatgacgctgtaccggtgggggaacaccagcagcagctcgctgtggtacgagctcgcgtacacggaggcgcaggggagggtccggcgcgggcaccacgcgtggcagatcgcgttcgggtcggggttcaagtgcaacagcgccgtgtggagggcgctccggtcggtgaacccggcggaggagaccaacccgtggatggacgagatcgacaggttccccgtggatgttccaaaggtctccaaggtttccagcggctgaaagcctgaaatgatctttatgccctgttcgtccttctggtgattggaaccatcgcctggcattttccatgggatttcatcattcggggaagtttgtgactgtttggattcaggaattagtggggatttgtcataggtcaccacattaggtggtacaaagggtgatcaacttctgactatgagcttgggttatatgtaaatttagttggtctgtatggcactagtttatacagtttcattgttcttaattctgacaactcttaccatgtctaggacgctcatgttgagttgagcatttcaggtcgtccacctaaacggcaaaaagaaaaaaggatgagatcaatttcatggtcaattccaccttcgcatggag

SEQ ID NO: 5645 - DNA, 1985 bp, Sorghum bicolor
ccaccacaccttccaaactcgcacgctccttcccccctacccggccaatcaatctcctccctccctctccggccacgcgcaccacgagtacgccatgagcgccgcccatcagccagaacccacggctcccgccgccgccgcctcctgcggcggcggcggcgacagcacgatcaagaacgcgcggcaccggacgagcaccctgaagcagtgctaccacctcgccatctccaacgcgctgtacctcctcctcgccccagccgtcgcctacgcctcccaccgcttctcccaccacaccgcatccgacgtcacctccgccgccgcgttcgcgtccaacccgccgttcgccgtctccctcctggtgctctccgcggtgctcgccacggcgtacctgatgcgccgcccgcgcgccgtctacctgctcgacttcgcgtgctacaagcccggcgccggccacgtggtgacgcgggagacgttcatgcggcagtcggaggcggcgggggtgttcacccccgacaacctggcgttccagcggaagatcctggagcggtcggggctcgggcaggggaccttcttccccgccgccgtcctcaactcgccgcccaacccgtgcatggcggaggcgcgcgccgaggccgaggccgtcatgttcggcgccatcgaccaggtgctggcaaagaccggcgtccgcgctagggatatcggggtggtggtggtgaactgcagcctgttcaacccgacgccgtcgctctccgccatgatcgtcaaccactacaagctccgtgggaacgtcgccagctataaccttggcggcatggggtgtagcgccggcctcatctccatcgacctcgccaagcagctgctccaggtgcaccggaacacgtacgcgctggtggtgagcatggagaacatcacgctgaactggtactggggcaacaaccgttccatgctcatgtccaactgcctcttccggatgggcggcgccgccgtcctcctcaccaaccggggctccgaccgccaccggtccaagtaccacctcctccacaccgtccgcacccaccacggcgccgacgaccgcgcgtaccggtgcgtgttccaggaggaggacgagacggggcgcgtcggcgtggcgctctccaaggacctcatggccgtcgccggcgaggcgctcaagaccaacatcacgacgctggggcccctggcgctgcccatgtcggagcagatcctgttcctggcctccctcgtggcgcgcaaggtgttcggcgtccgtggcctccggccgtacatcccggacttcaagatggcgttcgagcacttctgcatccacgccggcgggagggcggtgctcgacaccatcgagaagaacctcgagctcagcccctggcacatggagccgtcgaggatgacgctctaccggtgggggaacacgtcgagcagctcgctctggtacgagctcgcatacacggaggcgcagggccgggtccggcgaggtcaccgcgcgtggcagatcgcgttcgggtccgggttcaagtgtaatagcgctgtgtggcgggcgctgaggacgattgatccgaagaaggagagcgccgtcgggaacccatgggtggaggagatccataggttccccgtcgaggtgcccaaggtggagagcgtcatcgtgtcctgaggatgaagacgactctggttctctggtcggaggacgacgaactacaagattgctgctactactacgactgcagtagttctctcttttttttccagttcttcttcgttctgaaaattctttgttaaatatataagtattatgtcgacaaaagtgtctgctgatggagtgtgatgatacagggaagctctgtaattgtaaaaataccttacatacaacaagtgtgatgattggatgagatgtactgtagtctgtagctcacatgtgattttttttgacagaacctgacatgtgattttgagcttcgaaatgatccaatgaggcc

SEQ ID NO: 5646 - DNA, 1911 bp, Secale cereale
tcagcgctatatatcgcttccgatccgatccgatcccaccctcccactcatcccggacaaacacttcccaaccccgaccaaccgcagccaaccacgcacgcgagccggcccacggcgctacgtacgcacgccaccatgagcgccgccgcccaggaacccacggccggcggcggcggcggcaagcgtccgggaccttgccgcccgggatacctcaagctcggctaccacatcgcggtgtccaacgcggtctacgtgctgctcaccccgttcgccgcggcgctggcgctccgcgcgtcccgcctcgccccgtccgacctggcggcggcgcgcgcctacctcctcgccaacctccagctcgccgtctccctcgcgtccgtcgccgcggcgctcgcgacggtctacctggcgcggcggccgcgcgcggtgtacctgctggacttcgcgtgctacaagcccgggcccgaccacgtggtcacccgggagaccttcatgaggcagtccagcagggccggggtgttcaccgacgacaacctggcgttccagcggaagatcctggagcggtcggggctcgggcaggggacctacttcccggcggcggtgctcaactcgccccctaacccgtgcatggcggaggcgcggcgggaggcggaggctgtcatgttcggcgccgtcgacggcctgctcgccaagacgggggtgcgggccagggacatcggcgtcgtggtcgtcaactgcagcctcttcaacccgacgccgtcgctctccgccatggtcgtcaaccactacaagctccgcggcaacgtcgccagctacaacctcggcggcatgggatgcagcgccgggcgtcatctccatcgacctggccaagcagctgctccaggtccaccggaactcgtacgcgctggtggtgagcatggagaacatcacgctgaattggtactggggcaatgaccgctccatgctcatgtccaactgcctcttccgcatgggcggcgcggcgatcctcctcagcaaccgcgccgccgacaagcggcgctcaaagtaccagctggtgcacacggtgcggacgcaccacggcgccgacgaccgcgcctaccgctgcgtgttccaggaggaggacaaggccggccgggtcggcgtcgcgctctccaaggacctcatggccgtcgccggcgaggccctcaagaccaacatcaccacgctcggccccctcgttctccccatgtccgagcagatccttttcctcgcctccctcgtcggcaacaagatcttcggcctcaggatgaagccctacattccggacttcaagatggccttcgagcacttctgcatccacgccggcggcagggcggtgctggacaccatcgagaagaacctggagctcagtgactggcacatggagccttcgaggatgacgctgaaccggtgggggaacacgtccagcagctcgctctggtacgagcttgcctacacggaggccaagggacgcgtccggcgcggccaccgtgcgtggcagatcgccttcgggtcagggttcaagtgcaacagcgcggtgtggcgcgcgctcaaggacattcacccgtcaaaggaagccggcagcaacccgtggattgaggagatccaccggttcccggtcgaggtgcccaaggtggagagcgtcgtttcatcgccatgatacactcgtcaaggtcgagtacccatggttttatagaaaagaatctttcattccaagttgaaaggtatctgttgaattatttgtatcgttgtgatgtagcatcaagttaattgatggtttgagctagctgaattgatatggaacttcaattcgtgtatttttgtttggtttggctgggtgccgcagtttgttagaatataattgtgcttaaatatggaattccaaggatcacatga

SEQ ID NO: 5647 - DNA, 1877 bp, Panicum virgatum
ggcggcggtggcggcgccgttccgggcgagggacgttctgccgctgctgccgcggcgcctggcgtggcagctcatgggcgcgacggcccacagcgccgtggacctgctgccgtccttcgtcggcgccgtcgcgccggcgggccccggcggcctggcgcggcgcgtgcttcgcggagaacgaggctgtcctcagcctcacccccgccgccggcggccgcagcgggaccgccggggcactcagcggcaacaccagctccagctcaagcctcggcggcgccgtcctccgcctcaagactgcttcgcctgagagctggacatgcatggatctgtatgtgtttgcaactccatacaggatagcctgggattactatatgagatcaaatgaaaaccacacctttgagattaaggcgtgggaggaagcagcagaactggaatatgtaaagcagcatggcattgctgtctttctcatgccatctgggatgcttggaacactgttatccttgatcgatgtcatacctctgttttcaaacactggttggggtcaggatgctaacttggcatttctgaagaagcatatgggaacttcatttcagaaacgttctcagccctggtctgcaaatataagaaaagaagatgtacattccggtgactttttggccctttcaaaaatccgaggacgatggggtggatttcagacattggagaaatgggtgaccggagcatttgctgggcacaccgcagttttcttgaaagatgagaatggcactctctgggttgcagaatcaggctatgagaacaaaaagggtgatgaaatcattagtatgactccatgggatgaatggtggggaatggcactaaaagacgattcaaatcctcagatagcacttcttccgttgcatcctgatgtacgagccagattcaatgaaagtgctgcatgggattttgcacgaagcatgtatggaaaaccctacggatatcataatatgatatttagttggattgacacaatgtcagacaattatccacctcctcttgatgctaacctggtaatggctattatgtcaatgtggaccagattgcaaccacattacgcttctaacatgtggaatgaagcccttaataaacgacttgggactgagaaattggaccttcacgggatcatcactgagaccgaaagacgtggcctgtctttcaaccagctgctcaccattcctgagcgagacgattgggagtacagcgacggcaaatccacgacgtgcgtcgccttcatcctctcgatgtacaaggcggccggcgtgttcgctcctttcacggagtcgatccaggtgacagagttcactatccgggacgcgtacatgctgaagatcttcgaggacaaccagacgcggctgccggggtggtgcaacgcggcggcggacgggctccccttttgccagatcctgggggagtacaagatggacctgccggagtacaacacgatcgagccctacgccaacatgaacgagaactgcccgtcggcgccgcccgcctacagccgcccggcgcgctgctgatcgatgaccgccgccgggcggccgtgcgtggctgccgggtaaccgtgtgcaagtgtaaatagaccacgcgcgcaggcacgcacgctgcttgtgtttacagcgccgtggtctcgctctcgccgatacatgtccttctccttcacgtagcagctaccgcaaagcttctttatggaagtcataagtattatgtcctggatcatttgaacaagaaacggaaacatcttggagcatgaatttgcaatgtactcattgggcaaaaaaaaaaccattacgatattatagaagactataaataattgtatattttttttatcgttttcgact

SEQ ID NO: 5648 - DNA, 1947 bp, Brachypodium distachyon
ggggagctctctagtcacgggcgggcacaaagataagtacccggtgcacaggccggcaggcctcgcgatggcggcttcggtgcccaggccgcggcggcgcctccccgtgcctatcctccttctccacgtcctggctctgtgtccgccgcgatgcggggccgccgggctgagttgggcgccgttccggaccgggggcctgctgccccgggggctcgcgtggccgctcgcgaacaccgtccacagcgccatcgacctcctcccgacattcgtcgccttcgcggcgcccggtggccgcgcggccgcctggcgcggcgcgtgcttcgaggagaacgaggccgtcctcagcctcacgcctgggccggccggacgcaacggcacgggtgccggtgccggccttggcggtgccgtcctacaactcaagactgcttcagctcagagctggacatgcatggatctgtatgtattcgcaacgccttacaggataggatgggattactatactagagcacatcaacacacctttgagatcaaatcgtgggaagaagccggagaaatggaatatgtaaagcagcatggaatcgccatctttctcatgccgtctggaatgcttggtacattgttatctctgatcgatgtcatacctctgttttcgaacactatttggggacaggatgccaacttggccttccttcagaagcacatgggagcttcatttgagaagcgttctcagccttggtctgccaatataaggaaagaggatgtacactctggtgattttctggctctttcaaagattcgaggacgatggggtgggtttcagacattagagaaatgggtgactggtgcgtttgctggccataccgcggtttgcttgaaagatgagaacggcactctctgggttgcagaatcaggctatgaaaacaagaagggtgaagaagtcattgctgtagttccatgggatgaatggtggggaatggcactcaaagatgactcaaatcctcaggtagcatttctgccattgcaccctgacgtgcgagccaggttcaatgaaagtgcagcatgggaattcgcccaaagcatgtatggaaagccctatggatatcataatatgatatttagttggattgatacaatgtcagaaaattatccaccacctcttgatgctaacctgataatggctgtcatgtcaatgtggaccagattacaaccacaatatgcttctaacatgtggaatgaagcccttaacaaacggcttggcacggagaaactggacctccatgggatcatcagcgagaccgagaaacggggcatgtctttcaaccagctgctcaccgtaccggagcaagacgagtgggaatacagcgatggcaagtcgacgacttgcgtcgccttcatcctctcgatgtacaaggcggccggggtattcgctcccttcacggagtcgatccaggtcactgagttcaccattcgggacgcgtatatgctgaggatcttcgaggacaacgcgacgaggctgccgggctggtgcaacggcgaggcggacgggctccccttctgccagatccttggggagtacaagatggagctcccggagtacaacacgatcgagccctacgccaacatgaacgagaactgcccgtcctcgccgcccacctacaagaggccggtgcgctgttgatgatgatcctccattcggcgtcgacggatcgatgctcacatggtatagatccgtgtcacacgatctgtctgcaactctacgtgcaattaactaggagcgttcatgttgctgtaaaaaaaaaactaggagcgttctgtaatattaatagacacactatgcattttactttacccgaattctaatttcggccgttgaaaaaaaatcagcgcctgccactctgaaataaaaatgtctgtaattcttgaactagttcgattcagaactgttct

SEQ ID NO: 5649 - DNA, 2178 bp, Brachypodium distachyon
gccagggatcactttggcgggacctgagcgcgcacacacgctggcggcgccattcgtcttgacgcggcctgacggcctcccgatctcaactcgcgaggcacaaagccaaagccaagcaagcaaacaaaccactcgctcagccgaaaactcggcagcaaaacgcagaagaggcgccaaccaaattgcctcacggtcaggggagctctctagtcacgggcgggcacaaagataagtacccggtgcacaggccggcaggcctcgcgatggcggcttcggtgcccaggccgcggcggcgcctccccgtgcctatcctccttctccacgtcctggctctgtgtccgccgcgatgcggggccgccgggctgagttgggcgccgttccggaccgggggcctgctgccccgggggctcgcgtggccgctcgcgaacaccgtccacagcgccatcgacctcctcccgacattcgtcgccttcgcggcgcccggtggccgcgcggccgcctggcgcggcgcgtgcttcgaggagaacgaggccgtcctcagcctcacgcctgggccggccggacgcaacggcacgggtgccggtgccggccttggcggtgccgtcctacaactcaagactgcttcagctcagagctggacatgcatggatctgtatgtattcgcaacgccttacaggataggatgggattactatactagagcacatcaacacacctttgagatcaaatcgtgggaagaagccggagaaatggaatatgtaaagcagcatggaatcgccatctttctcatgccgtctggaatgcttggtacattgttatctctgatcgatgtcatacctctgttttcgaacactatttggggacaggatgccaacttggccttccttcagaagcacatgggagcttcatttgagaagcgttctcagccttggtctgccaatataaggaaagaggatgtacactctggtgattttctggctctttcaaagattcgaggacgatggggtgggtttcagacattagagaaatgggtgactggtgcgtttgctggccataccgcggtttgcttgaaagatgagaacggcactctctgggttgcagaatcaggctatgaaaacaagaagggtgaagaagtcattgctgtagttccatgggatgaatggtggggaatggcactcaaagatgactcaaatcctcaggtagcatttctgccattgcaccctgacgtgcgagccaggttcaatgaaagtgcagcatgggaattcgccctaagcatgtatggaaagccctatggatatcataatatgatatttagttggattgatacaatgtcagaaaattatccaccacctcttgatgctaacctgataatggctgtcatgtcaatgtggaccagattacaaccacaatatgcttctaacatgtggaatgaagcccttaacaaacggcttggcacggagaaactggacctccatgggatcatcagcgagaccgagaaacggggcatgtctttcaaccagctgctcaccgtaccggagcaagacgagtgggaatacagcgatggcaagtcgacgacttgcgtcgccttcatcctctcgatgtacaaggcggccggggtattcgctcccttcacggagtcgatccaggtcactgagttcaccattcgggacgcgtatatgctgaggatcttcgaggacaacgcgacgaggctgccgggctggtgcaacggcgaggcggacgggctccccttctgccagatccttggggagtacaagatggagctcccggagtacaacacgatcgagccctacgccaacatgaacgagaactgcccgtcctcgccgcccacctacaagaggccggtgcgctgttgatgatgatcctccattcggcgtcgacggatcgatgctcacatggtatagatccgtgtcacacgatctgtctgcaactctacgtgcaattaactaggagcgttcatgttgctgtaaaaaaaaaactaggagcgtcctgtaatattaatagacacactatgcattttactttacccgaattctaatttcggccgttgaaaaaaaatcagcgcctgccactctgaaataaaaatgtctgtaattcttgaactagttcgattcagaactgttctgagatctcaacatatttaggataattgataaactt

SEQ ID NO: 5650 - DNA, 2039 bp, Hordeum vulgare
cggcctcccgatatgaattcacgaggcacgaggccgagcaagcaagcaagcaaacaaaccactgagccgaaaaccgggcagagcagcgaatgccctgacgctcacggagctctggtcacgggcgcatagataagtggtgccgcagcgcggccgccgcggccccgcggacgatggcggcgtcggcgcccaggccgcggcagcgacgcctcgccgtcgccgtgcccatcctcctcgccctactccaccttttcctgtctccgccgcgatgccatgccgcggcaaggggcctcctgccgcgccggctggcgtggtcgctcatgggcagcaccatacacagcgccgtcgacctcctcccgaccttcgtcgccttcgcggcgcccggcggccccgcggccgcctggcgcggcgcgtgcttcgcggagaacgaggcggtcctcagcctcacgcccggcccccgtggaagcaacagcacggctgccggcctcggcggcgccgtcctacgcctcaagaccgcttcggctcagagctggacatgcatggacctgtacgtattcgcaacaccgtacaggatagggtgggattactataccagagcacatcaacacaccttcgagatcaaatcatgggaagaagcaggagaaatggaatatgtgaagctccatggggttgccattttcctcatgccatctggaatgctcgggacattgttatctctgatcgatgtgattccgctgttttcaaacaccatttggggacaggacgccaacttggcatttcttcacaagcacatgggggcttcatttgagaagcgttctcagccttgggctgccaacatacgtaaagaggatgtgcactctggtgatttcttggctctttccaagattcgagggcgatggggtgggtttcagacattggagaaatgggtgactggtgcgtttgctgggcataccgcggtctgcttgaaagatgagaacggcactctctgggttgcagaatcaggttatgaaaataagaagggtgaagaagtcattgctatagttccttgggatgaatggtggggagtggcactcaaagatgactcgaatccacaggtagcattgctgcccttgcaccctgacgtgagggcaagattcaatgaaagtgctgcatgggaattcgcccgaagcatgtatggaaaaccctatggctatcataatatgatatttagttggattgatacaatgtcggaaaattatcctccacctctcgatgctaacctggtaatggcggctatgtcgatgtggaccagattacaaccacactatgcctccaacatgtggaacgaggctcttaacaagcgactcgggaccgagcaactcgacctgcatggcatcatcagcgagacggagcgacggggcatgtctttcaaccagctgctgaccataccggagcaggacgagtgggagtacagcgacggcaagtcgacgacctgcgtcgccttcatcctcgccatgtacaaggcggccggggtgttcgctcccttcacggagtccatccaggtcacggagttcaccatccgggacgcgtacatgctgaggatcttcgaggacaaccggacgaggctgccggggtggtgcaacggcgacgcggaccggctccccttctgccaggtcctcggggagtacaagatggagctcccggagtacaacaccatccagccatacgccaacatgaacgagaactgcccctcgtcgccgcccacctacgacaggccgctgcgatgttgatcatggttccatcattccaccgtcccataatattagagtttttttcagggagtaggacataaatagaccacgtacgtttttactcctacatcgtacgttctcatccagcatcatgtaaagagtacagtagtagtaacatgttacacacctgccctaattgttatgtttttttaatacttcctccgtttctaaaaatactttctctgaataaatatacatctagcttttgttttaagtcaaagttctaaaacttttgaccaactttataaagaa

SEQ ID NO: 5651 - DNA, 1855 bp, Triticum aestivum
cgggcgcgtagataggtggtgccgcagcgcggccaccgcggcacgcgggcgatggcggcgtcggcgcccaagccgcggcagcgacgcctcgccgtgcccatcctcctcgccgtcctccaccttttcctggccccgccgcgatgccatgccgcggcaagcgaccttctgccgcgccggctagcgtggtcgctcatgggcgacaccatacacagcgccgttgacctcctcccgaccttcgtcgccttcgcggcgcccggcggccccgcggccgcctggcgcggcgcgtgcttcgcggagaacgaggcggttctgagcctcacgcccggtcctcgtggaagcaacggcacggccgccggccttggcggcgccgtcctacgcctcaagactgcttcggctcagagctggacatgcatggacctgttgtatttgccacaccgtacaggatagggtgggattactacaccagagcacatcaacacaccttcgagatcaaatcatgggaagaagcaggagaaatggaatatgtgaagctgcatggggtcgccatttttctcatgccatccggaatgctcgggacactgttatctctgatcgatgtgattccgctgttttcgaacaccatttggggacaggacgccaacttggcatttcttcagaagcacatgggggcttcatttgagaagcgttctcagccttgggctgccaacatacgtaaagaggatgtgaactctggtgatttcttggctctctccaagattcgagggcgatggggtgggtttcagacattggagaaatgggtgactggtgcgtttgctgggcataccgcagtttgcctgaaagatgagaacggcactctctgggttgcagaatcaggttacgaaaataaaaagggtgaagaagtcattgcttagttccatgggatgaatggtggggagtggcactcaaagatgactcaaatccacaggtagcattgctgcctttgcaccctgtcgtgagggccagattcaatgaaagtgctgcatgggaattcgcccgaagcatgtatggaaaaccctatggctatcataatatgatatttagttggattgatacaatgtcggaaaattatcctccaccactcgatgctaacctggtaatggctgctatgtcgatgtggaccagattacaaccacactatgcttccaacatgtggaacgaggctcttaataagcgacttgggaccgagcaacttgacctccatggcatcatcagcgagacggagcgacggggcatgtctttcaaccagctgctgaccataccggagcaggacgagtgggagtacagcgacggcaagtcaacgacctgcgtcgccttcatcctggcaatgttaaggcggccggggtgttcgctcccttcacggagtccatccaggtcacggagttcaccatccgggacgcgtacatgctgaggatcttcgaggacaaccggacgaagctgccggggtggtgcaacggcgacgcggacgggctccccttctgccagatcctcggggagtacaagatggagctcccggagtacaacaccatccagccgtacgccaacatgaacgagaactgcccctcctcgccgcccgcctacgacaggccgctgcgctgttgatcatggatcgatcattcttccgtcgaaaggaaagatgattttacattattgtgccctgtgcaatcaaataggacgtacgctttactccgcatcgtacgctctcatcgagcaacatgtaaagaagtactagtactgtaatatgttacacacctgccctaattgtgatggttttctttataatctttaacacggatggtagttaaaaaaaaaaaaaaaa

SEQ ID NO: 5652 - DNA, 2033 bp, Oryza sativa
aaacacaacaaaacccacactgtcaagcgtcaaccagccacccgcctcgcggagtcacgggctcgagctccaccaccaaagctcgagctctcgcgcccgcgtgccgtgcgccaatggcgccgcccccgccgcggcgccccgtcgtgcagaggagcctgatctccctcctccttctcccggtggtcctcctcgcgctcccgacggcggcggcggcgggggcggggtgggcgccgttcagggcgagggacctgctcccgctgctgccgcgcgggctggcgtggccggccgtgggctccgtccacagcgccgtcgacctcctcccacggttcgtcgcccacgtcgcgccggaggcctcctccgcggtcgcctggcgcgccacgtgcttcgcggacaacgaggccgtcctcaccctcacccattcctcctccgccgccgccgccggccgcaacgccaccaccgccggcgctgctgcccttggcggcgccctcctccgcctcaagactgcttcagctcagagctggacatgcatggatctgtatgtgtttgcaacgccgtacaggataggatgggattactacattacagcacaggagcacacctttgagatcaaggcatgggaggaaccaggagaaatggaatatgtgaagcagcatggcattgccatatttctcatgccatctggaatgctggggacgttgttgtctctgattgatgtcatacctctgttctcaaacactatttgggggcaggatgccaacttggcctttcttcagaagcacatgggagcttcgtttgagaagcgtacccaaccttggtctgctaacatcagaaaagaggacgtacattctggtgactttttggctctttcgaagattcgagggcgatggggtggatttcagacattggagaaatgggtgactggtgcatttgctggtcacactgctgtttgcttgaaagatgagaacggcactctctgggttgcagaatcaggctatgaaaacaaaaagggtgaagaggtcattgctatagttccatgggatgaatggtggggaatggcacttaaagatgactcaaatcctcaggtagcatttctgccattgcaccctgatgttcgggccaggttcaatgaaactgctgcatgggaatttgcacgaagcatgtatggcaaaccctatggatatcataacatgatatttagttggattgatacgatgtcagacaattatccaccaccactggatgctaacctggtaatggctgttatgtcaatgtggaccagattacaaccactttatgcttctaacatgtggaatgaggcccttaataaacgacttgggactgagaaattggaccttcatgggatcatcaccgagaccggaaaacggggcatgtctttcaaccagttgctcactatacccgagcaggacgactgggaatacagcgatggcaaatcaaccacttgcgtcgccttcattctctcaatgtacaagaaggccggggtctttgctcctttcacggaatcgatccaggtcacagaattcacgattcgagacgcgtatatgctcaagatcttcgaggacaaccagacgaggctgccaagctggtgcaacagcggggcggacaggctcccgttctgccagatcctgggcgagtacaagatggagctgccggagtacaacacgatcgagccgtacgccaacatgaacgagaactgcccctcctcgccgcccacctacaccaggccgctgggatgctagctgagctgaccaccaacatatgccagttgttcagactctagaagatatatacagatcgtgtttcagatggaattgttctgatcgatctagctaggccggagtgtccgtgtaaataaaccgatttttatcgtgctcagatggtagtgctgatgtgaatgttgattttcctgtggtaaactacaggggtgtgctacggaattcgatgaaatatgaacaggatgtcgattacttgcaaaagttgcaatcctagcttgagtgaccaaattatttgccacc

SEQ ID NO: 5653 - DNA, 1857 bp, Gossypium hirsutum
aaagaaaccctaaacactgcttagtctccctcatcgttccattagtcgtctccaaacggcggcatcttcatcttactattcggcctccctatttcagattctttaagttgaacatatggctggaggggagaagaaaaagtctggcggtggagggaaaaagaaggaagtgaagaaggagactggtttgggtctttcctttaccaaggatgagaattttggggaatggtactctgaggttgttgtcaatggtgaaatgattgagtactatgacatctctggatgttatattcttaggccatgggcaatgtcaatatgggagaacatgcaaacgttctttgatgcggaaatcaagaaaatgaaagtcaagaactgctatttccctctttttgtatctccaggtgttttgcaaaaggagaaggatcatatagagggttttgctcccgaggttgcttgggtgacaaaatctggtgagtctgatttggaggtgccaattgccatccgcccaactagtgagacagttatgtatccctactattctaagtggataagaggacaccgtgacttacctttgaagcttaaccagtggtgcaatgttgttcgatgggagtttagcaatcccacaccatttatcaggagtcgtgaatttctatggcaggaagggcatactgccttcgcaaccaaggaagaggcagacactgaggttcttcaaatattggagctataccgacgtatatatgaagaattcttggcaattcctgttacgaaaggcaggaagagtgaactggagaagtttgctggtggactttacacaaccagcgttgaggcatttattccaaacactggccgtggtattcaaggtgcaacctcccattgtttgggccaaaacttcgcaaaaatgtttgagataaactttgaaaatgaaaagggggaaaagtctatggtctggcagaattcctgggcatatagcactcgaacgattggggtaatggtgatggttcatggggataacaaaggcttagtgctgcctccaaaagtagcagctttgcaagttattgtgattcctgtgccctacaaagatgcagatactcaaggtatctttgatgcctgtgctgccactgtggcaatcctctctgatgctggtattcgtgctgaagctgatcttagagagaactactcacctggttggaagtactcaaactgggaaatgaaaggtgttccactaaggattgaaataggacctcgagacttggcaaataatcaggtgcgtgcagttcgccgtgacaatggagaaaagactgatatctctagagtctttttggttgaacaagtaaaaggaatgttggaaaagattcaacagaacctatttgatgtggcaaaacaaaaaagagatgcctgcattgaagttgtaaaaacttgggatgagtttataaaagctctcgggcaaaagaaactgatcttagctccttggtgtaatgaggaggaggtggagaaagatgttaaagctcgaacaaagggtgagatgggagcagctaagtctctatgtaccccatttgaacagcctgaacttccagaaggtactaaatgctttgcttctgggaagcctgcaacaaagtggacctattggggcagaagttactaggtttattcactttttaaaaccatctccttttcatggttctttgcctgatgtcaacggttctggtcattggggccattgtaaacggggaaattttcaatttaaaattgttatatgaaactgatgagaagattcagtttttaatcatgttaaaacttctgtggtttttctttttcctttttggcagaattttgctttgctataatagatatactgtgttt

SEQ ID NO: 5654 - DNA, 2195 bp, Papaver somniferum
tagtcctaaatccttaatcaaatcaactccaacacatcattcacaaaccccttgttgttcatctgccaatactcagtatgctcttcaattgcgtacgaactcaaattcataatgctaactctatgattctataccaaatcaacttcacaacttcaatttaaccaaaacccaaccctaggatttccggtctttgtcttccattatcatctctctttgctgtcttcattggttctgcaataacggcactaatttccggaactgaattcaccaaacatcaactctttccaactaacaacacagtactaccgctgtctgtcatgaaggatgtcaatatttatgttgatgcgatggaggatctcaatatttgcgttaatcggatggaggatgtcaaagtgactaataaaaaggagaagagaacacctaaagtcaaagcccctaatactactggtggtggcagtggaagcggcgttggaaaaaaagaggttaaaaaagagactggtctgggtttatctaataagaaagatgaaaattttggggattggtattctgaggttgttgtcagtggtgaaatgatcgaatactatgatatatctgggtgttatatcatcaggccatggtccatggctatttgggaaattatgcaaaaatttttcgatgctgaaattaagaaaatgaaaattgagaattgctatttcccattgtttgtgtcttcaactgtgttacaaaaggagaaagatcacattgagggatttgctccagaggttgcatgggttacgaagtctggagatacagagttagaggttcctattgcaatccgtcctaccagtgaaacagccatgtatccttattttcgaaaatggattagaggacatcgtgacttgcccttgaggcttaaccagtggtgcaatgttgttcgttgggagttcagcaatcctactcccttcatcaggagtcgtgagtttctttggcaagaagggcatacggcttttgcaacaaaggatgaagcagataaagaggttcttgaagttttggagctgtatcgaaggatttatgaagagttcttggcaatcccagtggtaaaggggaagaaaagtgagaatgaaaagtttgctggaggtttatatacaaccagtgttgaggcttttgttccaaatactggtcgaggagtgcaaggtgcaacctcacactgtcttggtcaaaattttgcaaaaatgttcgagatcaactttgagaacgagaagggagaaaaggggatggtgtggcaaaattcttgggcatacagcactcgaacaattggagtgatggtgatggttcatggagatgacaagggcttagtattgccacctaaagttgcatccgttcaagtcatagtgattcctgtgccttacaaagatgctgacattcaagccatctgggatgcttgttccgaaactgcagaagagttgaataaagctggttttcgtgctgagacagatctaagagacaactactcacctggttggaagtattcacactgggaattgaaaggagttcccttgaggattgagataggtccaaaggatatggccaaaaaccaggtacgtgttgttcgccgagacaatggagcaaaagaggatatatcaagaatcaccttggttgataagattaaagacgtactagacaatgtccaacaaagcctattcgatgctgcaaagcaaaaacgcgatgcttgtgttgtggtagctaagacatgggaagagttcaccaaggccctaaatgagaagaggatgatcttagctccttggtgcaatgaggaggaagttgagagagatgttaaagcacgtaccaagggtgatatgggagcatgcaagactctttgcaccccttttgatcagcctgagctcccagaggggacgttgtgctttgcctctggaaaacccgctaaaaagtggacttactggggcagaagctactagttcaactggtgttacttgaaagcaggtgaaagggtttctttgcaacagtaaagagttggaaactaattgtgagatttttgaagttgatattctcttttatctttattcttggaattttctgatttgaatttcatcttgaatttttctgatgctggaattaaagaatttgaatttcatgattctattcttcggatctttaggacattttagattgatttagattcttcttgtctttagggc

SEQ ID NO: 5655 - DNA, 1811 bp, Chrysanthemum coronarium
gaaaagaaaagaaatggctggtggtggtggtaaaggtaaaggaggagataagccaactaaatcagctaagggaaggaagaaggagactggtttaggtcttaccaatactaaggacggtaactttggcgagtggtattctgaggttgttacaaatggcgaaatgatagaatactatgaaatatctggctgttacatccttcgtccatggacaatggccatttgggagacgatgcagaacttctttgatccagaaattaagaagatgaatattaaaacatgttacttcccactttttgtgtctaatacggttttacaaaaggagaaggatcacatcgagggttttgcccctgaggttgcgtgggtcacgagatcaggtagctccgatttggaagttcctattgctattcgcccaacaagtgagactgtcatgtatccctatttttctaagtggatcaggggacaccgtgacttgcccttaagactaaatcaatggtgcaatgttgttcgctgggagttcagtaatccaaccccctttatcaggagtcgtgagtttctttggcaagagggacacactgcctttgcaaccaaggaggaggctgacactgaggttctggaaatacttgaactgtatagacgtctttatgaggattacttggccgtccctgttgtgaaagggaaaaagagtgagctggagaagtttgctggtgggctatataccactagtgtggaggcctttattccaaacactggtcgtggtgtacaaggtgcaacttcacattgcttaggccagaattttgctaaaatgtttgagattaacttcgaagacgaaaagggagaaaaggctatggtgtggcagaactcatgggcttacagcaccagaacaattggtgtgatggttatggtccatggtgatgataaaggcctggtgctgcctcctaaagtttcacaagtacaagttattgtgattcatgtgcctttcaaagacgcagatacaaaagaattaaagaaagcttgtttggaaactgtgaaaactttaaagggtttagatattcgtgtcgaggcagacctcagagagaattattcgcctggttggaagtattctcattgggaattgaagggcgttcccttgaggattgaaataggaccaaaagatctagctaataaccaggtccgtgctgtttgtcgtgacaatggatcaaaggttgatcttcctatggcagatttgggtgagaaagttaaggttatgttggatgatattcagcaacgcatgtttgatattgctaaacaaaaacgagatgcatgtattcaagttgccaaaacttgggatgagttcattgaagcactaggccaaaagaaaatgatcttggctccatggtgtaatgaagaggaagtcgagaaggatgtgaaagccaagacaaaaggggaggttggagctgctaagacactatgttctccatttgaccagcctgaactgcctcaaggaacgttatgctttgcatcgggaaaacctgctaagatatggacgtactggggacgaagctattagccacactaccgtcgggttgatttggttgtttaccatttactgtacttattattagaggtaggcaaacctttttctttccaaaaccggttcggttagaaccgggttttggttagatttcggtttttaacgggataaccggtgaaaacttagttttggttattatcgaaacgaccttagtcggcacgcctcttgtacgcatgcgatttgatttgtacattgcgtctccatgcatgtttgtgaaatgccaagaatcgaccaaggccgg

SEQ ID NO: 5656 - DNA, 1633 bp, Gossypium hirsutum
aaggctaaagaaaatctttcaaccatggtgggtctcggcgataacaacaatcccagttgccaaaacaacatcagcagcaaagcaaaagacaagaagaagaacaagaagaagaagcgtgggggaagcaagagaaggatgacggctgagcaaacatcggctttcaaatcggtgaccgaatgggtttatttagacaggcaccagaaccccaattcttcttcgacggcgggtttatcgtcgtgggtggtggatgattttggtgtgcaaaagagtttggggagagggacggagaaaatggtgtttgaattgcattcccattcgaaacacagtgatgggttcttgtctccttctaagctcgttgagagagctcatggcaatggggtgaaagttcttgctctgacagatcatgatacaatgtctggaatcaccgaagctgtagaagctgctcgcagattcggtatcaagataatccccggtgttgagatcagcaccatattctctccaagaaatcctgaaatggaggaaccagtgcacatccttgcatattacagcagctgtgggcccacgaggtacgaggagctggataaattattggctaacataagggagggacgttacgtacgtgctaaggacatggttttgaaactcaataaactcaagctacctcttaagtgggagcatgttacaaagattgcaggcaagggagtggctcctgggagattgcatgtggctcgagctatggttgaagcaggttatgtggagaatctaaagcaagcttttgcaagatatttatatgatggaggacctgcttattccacaggaagcgagcctcttgcagaagaagcagtgcagctgatatgtgaaaccgggggtttagcagttctcgctcatccttgggcactaaaaaacccgattcctatcataagacggttaaaagatgcaggccttcacggaatggaggtttatagaagtgatggaagactggcagcatacaatgacttagcggatacgtacaaccttctgaagcttggagggtcagattatcatgggagaggtggccatggtgagtccgaactaggaagcgtgaaccttccagtggtggttctgcacgactttcttaaggtagctcgacctatctggtgcagtgccattaaggacattctagagggttatgcaaaggaaccctctgatacaaacttcgccaagatagccagatttacaaggatgggcagtttcaagggaagtactcccttgagttgtggcaaggacttgattgatcgttgtttagcatcgtggttgactgccgaagaacagcagaatgatgaattcgaggccattaggttgaagctttcccatgctacgatcaacctcagtggagttcaagttcctatagagaccaaatagtacttgattggagggaaaaaaaagagattaggtaccatttgattcttgccattgttgcaaagataaagagcgagtggcatattcctttggttttgttaaaatctgaactagaactaatcatatttggtgattcaacccgtgtgtatttttggttttattgcctaattataaaccatgtaccatctatatcttgccttattttttgttctaatgctttgctctctagaagttc

SEQ ID NO: 5657 - DNA, 1395 bp, Gossypium raimondii
gcagtttttcttcaagcgttttataaattacatacaaaacatacatgtcatgcaagggcgtgatgaccaaccagttttagatacttgccatatccatattcacataagatagccccaaaccgcattgaaccccgcccccctctcctcccacattttcagattcttctctttatatataccatgacgtctcgtagtcatccatatatgttttaaagttgaaaatcttgatcttcttttcactctcttctgtcctcctccttgtttcattcattgctttacagcagataaccatggtgtctcacctagtcagaactatccgaaatgtagttgggatcacagggaacgttatctctctcttcctcttcttgtctcctgtgccaacttttgttcggatttggaagaaagggtcagtggaacagtactccccagtcccgtacctggcaactttaatcaattgcatggtttgggtcatttatggcctgcctatggttcatcccgacagcaccctggttatcaccatcaatggtgcagggaccgccattgagctcgtctatttaaccctcttcttgatcttttgccatgacaagaaaaagagactcaaagtgctgctgatcgcgttggtcgaggtagttttcatggcccttgtcgctgctctggttctcacattagctcacaccactgaacgccggtccatggtcgtcggaattatcgcaattttgttcaatatcatgatgtatgcttcgcctttatccgtcatgaaactggtgatctcaacaaaaagcgtagagtatatgcccttttttctctccctggcttcctttgccaatggtgttgcatggactacatacgctttcctcccttttgacccattcattgctgttccaaatggattgggcacattgtttagcttagcgcagctgttgttgtacgccacatactatgagtccacaaagagaataatagcagcaaggaaagagacgaagatggaagtgaacctatctgaggtggtcgttaatggcaaccatgatcccaagaagaccaccagagcaacttaagaaacccattgagacatttttttgggggttatgatcattgtcttgacacagacatggtgctaaacaaagcagctcttgttaccaaatactttgccttatcaagccatgttttattattattattgtctccttttttatttcttttgttaatgtacgggctataaagaggttttagtttcataatcatgtggcccatcttaaataacccaatgccaagggttctctcaaaaaacatgtttcttataacttgaaaaagctcttgcaaccaaagatctttaggttcggttgacatacagtatgaatcaattgaactaaattttatagtatatttctttctttt

SEQ ID NO: 5658 - DNA, 887 bp, Gossypium hirsutum
aatcttgatcttcttttcactctcttctgtcctcctccttgtttcattcattgctttacagcagataaccatggtgtctcacctagtcagcactatccgaaatgtagttgggatcacagggaacgttatctctctcttcctcttcttgtctcctgtgccaacttttgttcggatttggaagaaagggtcagtggaacagtactccccagtcccgtacctggcaactttaatcaattgcatggtttgggtcatttatggcctgcctatggttcatcccgacagcaccctggttatcaccatcaatggtgcagggaccgccattgagctcgtctatttaaccctcttcttgatcttttgccatgacaagaaaaagagactcaaagtgctgctgatcgcgttggtcgaggtagttttcatggcccttgtcgctgctctggttctcacattagctcacaccactgaacgccggtccatggtcgtcggaattatcgcaattttgttcaatatcatgatgtatgcttcgcctttatccgtcatgaaactggtgatctcaacaaaaagcgtagagtatatgcccttttttctctccctggcttcctttgccaatggtgttgcatggactacatacgctttcctcccttttgacccattcattgctgttccaaatggattgggcacattgtttagcttagcgcagctgttgttgtacgccacatactatgagtccacaaagagaataatagcagcaaggaaagagacgaagatggaagtgaacctatctgaggtggtcgttaatggcaaccatgttcccaagaagaccaccagagcaacttaagaaacccattgagacattttttttggggttaatgatcattgtcttgacacag

SEQ ID NO: 5659 - DNA, 1101 bp, Gossypium hirsutum
cgtgtgccggagtgattaagcaaggctccgtcgatcaatccgacggtaatttccttgatgatgaccagattgctgcaactcacagtcatggtttctcacctggtcaacactatacgaaatgtagtagggatcacagggaacgttatcgcactcttcctgttcttgtctccagtgccaacttttattcgaatttggaagaaaggatcagtggagcagttctccccagtaccatacctagcaaccttaatcaattgcattgtttgggtcatttacggcctgccaatggtgcatcccaacagcatccttgttataaccatcaatgctgcagggaccgccatcgaggtcgtcttcctcaccctcttcctcatcttctgtcatgacaagaaaaagcgactcaaagtgctacttatcatcatggtcgagctcattttcatggccgctctcgccactctgatcctcactgtccttcacaccactcaacgccgatccataatcgttggaattatagcaattttgttcaatgtcatgatgtatgctgcgcctttatccgtcatgaaactggtgattacgacgaaaagtgtggagtatatgccatttttcctctcactggcttcctttgccaacggtgttgcttggactacttatgctttcctcccttttgaccccttcattgctgttccaaatggagtgggcacaatatttagtttagcccagctattgttatacgccacatattacaagtccacaaagagaataatagcagcaaggaaagaggcgaagatggagatgcatctctcgttgtcggaggtggcagtcgccaacggcgatgttgatcccaagaagaccgctggagcaacaccttaaccttgagagacccaaacaatgcatccatttccaatatatataattatatccagctatatctatttaactatctatgtctgtattatttataaatatagactaattagtgggtgcgagtttgttttagttatcaacatatatccctttcaacttctcaatccatgtttgacgttttataaaaatgtatgggctattgagaacaaagttgtcttcagttaatggatttattatgttgaa

SEQ ID NO: 5660 - DNA, 1202 bp, Gossypium raimondii
agaattttgatgatttcgcattcatgaggcaacttataccagccccaacaccctcgatctttgtgtatatatactctcccaaagtcatacacattttattctaacgtaggttacattctctctccactctttttctctgcaactcacagtcatggtttctcacctggtcaacactatacgaaatgtagtagggatcacagggaacgttatcgcactcttcctgttcttgtctccagtgccaacttttattcgaatttggaagaaaggatcagtggagcagttctccccagtaccatacctagcaaccttaatcaattgcattgtttgggtcatttatggcctgccaatggtgcatcccaacagcatccttgttataaccatcaatgctgcagggaccgccatcgaggtcgtcttcctcaccctcttcctcatcttctgtcatgacaagaaaaagcgactcaaagtgctacttatcatcatggtcgagctcattttcatggccgctctcgccactctgatcctcactgtccttcacaccactcaacgccgatccataatcgttggaattatagcaattttgttcaatgtcatgatgtatgctgcgcctttatccgtcatgaaactggtgattacgacgaaaagtgtggagtatatgccatttttcctctcattggcttcctttgccaacggtgttgcttggactacttatgctttcctcccttttgaccccttcattgctgttccaaatggagtgggcacaatatttagtttagcgcagctattgttatacgccacatattacaagtccacaaagagaataatagcagcaaggaaagaggcgaagatggagatgcatctctcgttgtcggaggtgaccgtcgccaacggcgatgttgatcccaagaagaccgctggagcaacaccttaaccttgagagacccaaacaatgcatccatttccaatatatataattatatccaactatatctatctatctatatatgtctgtattatttataaatatagactaattagtgggtgcgagtttgttttagttatcacatatatccctttcgacttctcaatccatgtttgactttttataaaaatgtatgggctattgagaacaaagttgtcttcagttaatggattgattatgttgaagaaagatatacaccctcatctgcatctgtgcctgtcaa

SEQ ID NO: 5661 - DNA, 1124 bp, Theobroma cacao
atccatatccattctatgttgaaaatcttcagataaacgatcccttttgctctctctctctttctctctccctttgtaccctttctctctctaattttctgcaattgtctcgttaaaattcattcctctacagcttacagccatggtctctcacctagtcaacactatccgaaatgtagttgggatcacagggaacgtcatctcactcttcctgttcttgtctccagtgccaacttttgttcgaatatggaagaaagggtcagtggagcagttctcgccaaccccctacctagcaaccttaatcaattgcatggtttgggtcatttatggactcccgatggtgcaccccaacagcaccctggttatgaccatcaatggcacagggaccgccattgagttcgcgtatatatccctctttttgatcttctgtcctgacaagaaaaagggacttaaagtgctactaattgtgcttgttgagctaattttcattgcccttgtcaccaccctggttcttaccctagttcacaccactgaacgccgctccatggtcgttggaatcatagcagtcttgttcaatatcacgatgtatgcttcgcctttatcagtcatgagactggtgatctcgacgaaaagtgtggagtatatgccatttttcctctccctggcttcctttggcaatggtgttatctggactacttacgctttccttccttttgaccctttcatagctgttccaaatggactgggcacgttgtttagtttagcccaacttttgttgtatgccatatattacaagtccaccaagagaatcatagcaacaaggaaagagaccaagatggagcttaacctgtccgaggtggtcgtcgtcagtggagatatcgatcacaaaaagaccggcggagtcccttagagacccatctccgatataaacataccccaacaatatatctatatatatatatatatataaagagagagagtttgtttttgtcatgagcatccccatagaaatggtgcgatcagtcatgtttagtttcttgaaaatcgttgtgtagcccaactcgtataacccaagggggtttttctccaatccaagtaataagaggttgcttcagagtttaaac

SEQ ID NO: 5662 - DNA, 1962 bp, Setaria italica
ccactgcagatgggtcccacgacaactcggttgaggttggcccgaggaagtggggcccgcaacctcagcacgcgcaaatactcgctttcccaagcaagcgagcagctttccgcactgcccggtgcccagagtccacactcccagtcccgtccccgcgccgcgccggcgagcaaaccaatccagcaatgccggcggccgatccccccgccgccgcggacgcggcgtccgacgaaggcgcgcctcaccacgcacccccgccgcggccgcggccgccgcctccaccccgacccctctccctcgcctccgccctccccttctggttctacctcgccgccgcggtctccctcctcgcgatcctcctcccccgcatctccccttcctcctccgctcccgctcctctcccgcctctcctccgcggacacctcgcctccggtagcgtcctcaagctcgatcccgcccccggcctcttcgctgtaacctcccgccccgccgccgccgctgccggcggcggctcccccgcgcaccgcgtcctcatcctcccgggcctcgccgcgggatccttctccttccgccgcgtcctctcgtcgctctcctctcgcggcgtcctcgccgcggcgctcgacctccccggccagggcctctccccggtgccgccctccgcggccgcgcccgcgcggaccagcgctctccgggagatcatggaccgcggcatcttccatgccttcgagcacctcgtccagaccggcgaggtcccgtaccaggaagaaacggccgccccgctggcgcagtccccgcacgcgcccgccgaggcggccgcggccgtcgcccgcgccgtggaggcgctcggggtggcccccgtccacctcgtgctccacgattcgtccctcgcggccggggcagcattcgcgtcggccaacccgggcgccgtccggagcgtgacgctgatcgacgccaccgcatccgtgccagcgtttccggccgcggtgttcgacgtgcccgtgctggggaggctggtgctgcgagtgccggcgctgttccgtgggctggtgcggctgtgctgcgtgcgggggatgggggccgaggaggtggaggcgcaccgggagacgatgcggggggaggggaggacacatgaggtgattgaagcttggaaggcgatgaatcacagctttcagttgggtgaatggaggggttcttcagacgaggtgaggaggctgccgatgatggtgctgtggtcaggtacttggtcagatatgtggattgatgagggtaagaaggtggctgctgcattgccggatgccagatttgtctaccattccggtggccgatggcctcaggaggatgcctccgaggaaatttcgcggctgatagcagagtttgtgacctcttcagaagaagcatcagatgatcgcatcgagtagcctgttgtatgtcatcctatgagttcacggccatggataaggatcaagatcctggatttgaaaatgccagagccatatgtatgcacacgtcttggacaagttggtagctttagctcctgctgctagcatgaaacacttacccaagtggggacatcatgttcatgtaccatatcttttttgaaggatagtttaacaaatgtgcccatagagctcttgtgttgatcctgaagttgatgcagtgacgagaattgttagttaagactatttttttagaagggtttctgttgtggcatctgtactgagttctgacttacattggtgtatttctcctttgttgctaaattggtattgccttgctgtcctgcatgaattgtaaaacgatgtggtaccaaactcatgctagtgtttgtatttttctttttatcaagcctatgctagtattgttttcatttaagcaatactttgaaggcattatattctgtgcaattgcttcgtgaggtgcattcattcatgcaacaattgtttcctatgaaattcccgtcag

SEQ ID NO: 5663 - DNA, 860 bp, Saccharum officinarum
ctccaactccaacctacccagctgcggccagccacctccccgtcgctctcacgctcttcgtgcccgccgcctcccctcttcgtgcctgtctgacgaacatggcctccatcgccggatcttccgcgctctccttcgccaggcccgtcaaggcaatcaacacaaactctctagctttctccacggtgaggaagggaaatgcattcctccgcctgcaaccaatgactatgagatctgtttcctgcgctgccaagaaggatacagtggacaaggtttgtgaaattgtgaagaagcagcttgctcttcctgaccacactgaagtttgtggtgaatccaaattctctgaacttggtgcggattcactggacacggttgagattgtgatgggccttgaggagcacttcgatatcagcgtggaggagtccagcgcccagacgatcgcaacagttgaagacgctgctgacctcatcgacaagcttgttgctgggaaggcataggtctgtatctcctctatcattgtcctaccactctctgtctctcccttgatctaggtttctatggtctgaagacttggtgattttctccgcacttatgttgctatgcccgtgttgtaataatacgagatgttttattaagcggttgaacattacggtggtgtaatctgttactgctaaggtgcatttttgtatgaattgtttctcccccaaaaaaaaaaaaaaaaaggcggcccgttttaagatccaagctacgtacgctgcatgcgagtcatagcttttttatgggcacctaaatcaattcattggccgggttaacacgcgtgactggaaaaccctgcggtaccacttaatgcctgagaaatccct

SEQ ID NO: 5664 - DNA, 684 bp, Zea mays
aactccaacctacccagcctcggccagccacctccccgtcgctctcacgctcttcgtgcccgccgcctcccctcttcccctccacctcactcctcccgtctgacgcacatggcctccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgaccacactgaagtttgtggtgaatcgaaattctctgaacttggtgcggattcgctggacacggttgagattgtgatgggccttgaggagcacttcgacattagcgtggaggagtccagcgcgcagacaattgccaccgttgaagacgccgctgacctcattgacaagcttgttgctgtgaaggcataggccgcatctcttctatcattgtcttaccactctaggtttctatggtctgaagacttgtgattttctccgcactgctgttgctattcccgtgtcgtaataatacgagatgttttaagcggctgaacacacggtggtgtaatctgttactggtaaggtgcattgttgtatgaattgtttctc

SEQ ID NO: 5665 - DNA, 709 bp, Sorghum bicolor
ctccaactccaacctacccagcagcggccaggccagccacctccccccgtcgctctcacgctcttcgtgcccgccgcctcctcccctctccgtgcccgtctgaccaacatggcctccatcgccggatcttccgccctctccttcgccaggcccgtcaaggcaatcaacacgaattctctagctttctccccagtgaagaagggtaacacattcctccgcctgcaaccagtgcctatgagatctgtttcctgcgctgccaagaaggatacagtggacaaggtttgtgaaattgtaaagaagcagcttgctcttcctgacaacactgatgtttgtggtgaatccaaattctctgaacttggcgcggattcactggacacggttgagattgtgatgggcctcgaggagcacttcgacattagcgtggaggagtccagcgcgcagacaatcgcaaccgttgaagatgcggctgacctcatcgacaagcttgttgctgggaaggcatagatctgtatctcctaccattgtcctaccactctatgtctctccatttgatctaggtttctgtggtctgaagacttggtgattttctccgcactgctgttgttatgcccgtgtggtaataatacgagatgttttattaagcggttgaacattacggtggtgtaatctgttactgctaaggtgcattgttgtatgaattgtttctccc

SEQ ID NO: 5666 - DNA, 838 bp, Echinochloa colona
agcagcagcagcagcctgccagccatcaagcccagccaccaccgcccacttccccgtcgctctcacgcgcttcgtgctcgccgcctccccgttcccacccccatggcctccatcgccggatccgctctctccttcgccaggcccgtcaaggccgtcaacacgagctcgatctctttctctgctccgaggaagggtaatgcattcctccgcctgcagtcggtgcccaagagatttgctgtttgctgtgctgccaagaaggatacagtggacaaggtttgtgaaattgtgaagaagcagcttgctgttccagatggcactgaagtttgtggtgcctctaagttctctgatcttggtgcggattcacttgatacggttgagattgtgatgggcctcgaggaggagttcaagatcagcgtggaggaatcaagcgcacaatcgattgcgacagttgaggacgccgccgagctcattgacaagcttgtcgcagcgaaaccgactgaaagccagtgatgtcgaggggcttgctgctgccctgcccactctccccctatctaggtttttatggtcggaaggcttgatgattttctgcgcattgttgtctattgtcgtaataatactgagattttaagctgttgaacattaggatggggtgtgtatgctgtcagttcaatgttgtatgaatgatttcctgggagcatgtgttcgctgtggagctgcgtcggaagtttatagtaattggcaatgctgaataggagtttcctgtgtgttcatgctccctgtgatcagattcattattttgaccatcgtgaccaactgaagccaaatcggaagagcacac

SEQ ID NO: 5667 - DNA, 3661 bp, Zea mays
cgcactttgcacgtgacacggagtatgatagtaacaaagatgagtgactgtgtaatgtgactgtgtgtgtgagaacaaaaccctagaagaggacccaaagccctcgggcaaatctgggccgtctacccccaaaatccaacggcgcacctcgctccgcccgttgtacttaatcgagccgcaaccggcctctgactgatttcctctccggtctattctctactcttcttccccagtcctccctactcagtacttacctcagcacgccactgctcgaaggcggagcgcctccaaaatccatcccaatcccaaatcctctgaattcggacgccgctcgccccacgcagatggatgcccgcccctcgattcgcccgcgctgagcatccgaacccggttcccgccgcctcggctcattccggcgctgaaagattcagctccgcgcttccggccgccggagctcggtaatggcggggttctagcgcggcggacttaaagatctagcctcctcttttcctttccattttctctctttcgctgctaccccctcacacccccacggcgatggtcacggagatggcggcgcgcggcggcgaggcggcggcgtttggcgcggagaccgaccgcggcgacttcgaggtgtttcgcagtggctccgcgccgcccactgtcgagggagccctgggcgccgccggggccgacggcggccttctcgtggacgacgacctccgcgccgacccggcgtaccagagctactactactccagtgcgcacctcaacccgcgcctcccaccgccgctcctgtccaaggaggactggcggtcctcgcaccaccgcctccgctccgcgggcttcggcgggatcggggacggcaggaggcagcagcagcaggcgtcggctgccgaggggactgtcggcctgcccgggatcgatcttggtcgccagaggagcttctccaccatctttcaggaagactcgtaccagcgtgatatggataggcatactgccagccacaatagtaatgacttactaggttcttctggaatacagtatggtctaaatcgtggatctggaactattggaggcctgcactctagcaatagtctacggagcttggatgaaattcagaacaatgatctgccatcaaacacatttgcttctattttagggtcatctctttctaggagtgcatctccagaccctgaacttgtgaggagggcccctagtccatccctgcctccaattggtgtgaaagttggtaacactgataagaagatcaatggtggttccacttctttccgtcgtagctcatccgcaatcggagaatctgatgatttggtggctgctttatctgggatgaacttatcatctagggcaatgagtgggcaaactatggaccagtctcagctctatcaggatgtcgataatgtccagaagttcctttttgatcgacagggtgaccaaacaactggaaatcagcagcactatatgagacgtcctgaacaaggacaatctaagttacccgatggatattctgccaatttggccaattcatctacaatgagaaaccagattaatgctggcagtttcacatcttttgacagtttgtctcttggatctgggtttgcttcccctaggattggttctagatcccctggagggactgtatcttctcgacaaaatttagctggtatgtctaacatgctaaactataatggaattggaagtccaactgcctcaccttctcttcagacttctattgatccggcatatatccagtaccttgctcagcttgcagctacctgtgatgatcctctaatggacaggggccatctaggaaattcttacatggacttacttggtactcataaagctaacattggccctttactccagtctcaaaaacaatatggttactatggcaatcttggatttaaccttggttatcctggaagtccattggcgagtcctgttcttccctcttcacctattgcgccaggcagtccacttaggcatggtgagcgcaacatgcgctttccatcaggcatgagaaacttcggtaattcctttggttcatggaattcaggcatgggtggaaagatggatgccaatttgatgccctcacttctggaggaattcaagagcaacaaaagtaaatcatatgagctctccgaaatagctggccatgttgttgagtttagtgccgatcaatatgggagccggtttatacaacagaagctagaaacagccagtactgaagaaaaggacatggttttttcagaaatcatgcctcaagctctcacattgatgactgatgtatttggaaattatgttgtccaaaagttttttgagcatggaagcactgcccagataaaggaattggccggtcagcttattggacgtgtccttgctcttagtcttcagatgtatgggtgccgggttatacagaaggctatagaagttgttgatttggagctgcagactaaaatggttgcggagctggagggccatgtcatgcgctgtgtgcgtgatcaaaatgggaaccatgttatacagaaatgtatagagtgcattcctcagcatgctattgagtttattatctcgacattctatggccaagttgtaatgctatccactcatccatatggttgtcgagttattcagagggttctagagcattgtgatgatcctaaaacacagcaaataatgatggatgagattctccagtctgtttgcttgctggctcaggaccagtatggcaactatgttgttcagtacttctgcctgtccaatctagccatgtgccatgctgccatgtggaacatgaagcaacaagagaggcaaggcgttgatgcctgacagcctagcctgctaatgctaatggcctggtgtaaagcaggagagtttaggatctgtgtggataagcaaaccggagttcaaaggaaaagcgggtgctgggaattcaccaggcgtggcacgacggtgttgtggtggtcggcagcagtcctcggtttggttgcttggcgctccagtgtggcagcgcctgccacctggtcaccctgttggctaggaatgggtcagagattcgcggacaggagtgctatgtctttgttacaaaggaattgttgggctgggcttagggtattaaggtataccaccatctctgggtggcctactggggtctgcacctcatcataggacatactctcattttcccaccttacaggaccactgtgaaacatggttctcaattgcatattactatattagagcttgcagtctctccctgaagcgactatcaaatatgttatatgtcttagtatgattttgaggtgcaagtatgcaacctttactcaagtatggcttgatattgccaaactgacagtgcttctgtaatttagctgctagtcaattcatgtaaactacaatactgcacatgttacttgtcactatttgtctacaaacacttgaacgcttacattgagcacaaattgagttttttgaactcagtattgagtattgacatttcattgcccagttgcccttaagtggtttccatttatgttttctctagtaaatatgtagacgtgtagtttatttgattgattgctgtggtaatgtggtgctactaattattactcaccacaggatatcagtaaataatgtt

SEQ ID NO: 5668 - DNA, 2785 bp, Cicer arietinum
aaaagtttttcgaccgttagagaactaaccgttacactttacaccattacagaacgacactcccatcttcctctgatccttgtcaagcctctcttaccacttgacttccctccagtcatttctactaccaacgcaaattgcgctctctatcaatcttcactcttgtttattaattaataataataataatccccaatttcacaaaaccctaatctgaactgcaaaatggcggtggcagatggaaccggcggtgggaccattatcattgacgagacttacgaattctctgcaccgcgatttttcgatttcactaaaggggaatctgatgatgaaattcgtagggctgagctctggtttcacactgctctctcctatgctccttctccattcatgcctaaaatcaaggctggtagatccattactgttggtaccttgtgtgattttagtgaagctgacgatatgcctaagacgtcagcaaatgtggaagagagtagtgttctcgaatcaaaaacacaacctcagagcatggctagcaaaataaaggaagaggatgaagacaataaagaaaacctaacaactccttcgcacgtgatttctaccaataagaaagacgatgcaccatgctgcgaggtcaaagaagaaagtaattcaactacttctgttgaggattctgttggtaagaaagagagtgatcataaaggggatagcttaaaagtattaccatctgttgaagtaggaaaagatgcttgcacaccaaatccagcattgaggaaaaatgtcacttcctcttccactatttccaagaagctacagaactctaagaaggtaaccacgaataccaaaactcggttgcagtcagcagccaaaaagagcactgcagggactccccacttggcccaagagaatcaagctattaagaagcaaaaattggaaggaggacaaagtagacagattctgaatgtcaaacctcaaacttaccctcataataagtcaaaactgggttactcttcaagtaccagcaaaacgctcaaagaggacagaaagacttacgtccgtgaaacaccaaaaacacctgcatctgcgccatttgtatcaatggcagaaatgatgaaaagattccagtcaagtacaagagacctgccaatgcacactctttcccatataaaaccaaaactcacattgaccaggcctaaggaacctgaatttgagacaactcagcgggttcgcccagctagagtgaaaagtgctgctgagcttgaggaagaaatgatggctaaaatgccaaaatttaaggctcgaccactgaataagaagattatgcaaactccaactttgcctcccttgccaagaagtgcacctcaaccaccagaatttaaggaatttcatctggaaacactggctagggctcatcaaaatacagattcagcttcaagagcttcaacagaggtgtcccataaggagaattcatcgaaagtacattatagtgagcctaaaactccagtactccaaacattactaagggcccgcccaacaactgttaaaagctcattagaaatagaggaagaggaacttgaaaagatccctaaattcaaggcaagacctctaaataagaagatctttgaaagtaaaggggatattggaatttcttgccatacgaagaaacatgttactgaacctcaagaatttcactttgcaacaaatgaaagatttccaccacctgctgccgtggctgatttgtttgacaagctttctttgaagtctgaacctgctcgtaatcacaacacaatcccaagaactacaactccaaatccattccatcttcacaccgaggaaagaggtgctgagaaagagaaaaaactgctcatggatattttgcagaaacaatttgaggaggaagtagcaagggttccgaaggctaatccatacccttataccactgactaccctgtgatcccaccaaagccagagcccaagcactgcactaaaccagagccatttcaattggagagcctagtgagacatgaggaggaaatgcagagggaacaagaagaaagacttcgaatggaaagagaggaagcaaaaatgagaaaatttaaggcacaaccaatcataaaagaggacccaatcccagtcccagagaaggtccgcaaacctcttacacaagttcaagaattcgatttacatttgaatattcgagctgtggatagagcacaatttgatgggaggattaaggagaaagaaatgatgtacaaacgatacagagaggagagtgaagcagcacgaatgatagaagaagagaaggcagtgaaacaaatgagaaggacaatggttcctcatgctagaccagttccaaattttgataatccattttgtccccaaaagtcttctaaaacaacaaaacccaagtcaccaaatttgcgtgtattccaaagaaaggaaagacggaagatattcaatggaccagcattctcaagtcctgctactaacatgagataaaagatattcaatggaccagcattctcaagtcctgctactaacatgagagataactgatgtatcaaacttgtggactgtgtttggtgttcaagaactcttgaatccttgacaccttgtgtttgtacttttttaaaactcaattttttatgtatatttttctataacttcagctattggcatctgtataaatgaatgatttgtgagaactatatccacattaataatccaagaaaatgaaaactgaggtaacgaattcattgaggaatatcccaagaaaccgagttagcca

SEQ ID NO: 5669 - DNA, 1787 bp, Solanum phureja
cacggggatctcgcagttaatagtaaggcacacacttctcttcgtctccacagtccacccactgatcagctcccggagattaacgaaatcggaaaaccaatccaactattttttgattaccgatcaaaaaaatgtctcagagccttaatccgaatccaacttacgacgtgataatcttaggcgcttcaggttttactgggaagtacgtcattagagaagctctcaaattcctcaatgttccctcttcccccttgaagaatttagccattgctggccgtaacacttcaaagctttcccaggctcttcaatgggcttcccgtccaaacccacctcccgaaatccccattctcactgccaataccactgacccatcttccctccgtgaccttgcttcacagactaagatcattcttaactgtgtcggaccgtttcgtctttatggtgagcctgttgttgaggcctgtgctgattctggatgcgattacttggatatttctggggagcctgagtttatggagaggatagagatgaagtaccatgataaggctgtggaaaatggatccttagttgtttcggcatgtgggtttgattctattcctgctgaattgggcttgatgttcaattcgagacagtggctgccgccggctgttcctaacagtgttgaggcctaccttagtctagaatcggacaagagaattgttggaaatttggggacgtatgagtcagcggtgcttggtgtggctaatgtggacaaattacaggagctgcggcggagcagaccaaagaggcctcgtcctgtgattcctggtcctcctcctcctaaaggtccgttgatggaccacctaaaggaagttggtgtttgggctgtaaagttaccatcagcagatgcaattgtagtccgaagaacactttcatgtttggctgaaaatcctcatggtttacctggtgttaatgaaagcactgaacaagttgagaggagggagacattttggtcaagcataaagccagctcactttggtgtgaagatagcttcaaaatctccgttaggaattgttcgtttcattatagtcgggctgttcattggtctctttggtaaaactggtttatggaggtggctgctattgaaattcccttcattgttcagtcttggatggttcaggaaaaaaggtccaactgaagatgaagtggcaagtgctacctttaagatgtggtttgtcggacatgggtttagcgatggcagtcttgcatcacaaggaaacatgaaacctgatacagagataattacaagagtaatgggacctgaggttggttatttaacaactccaatcattcttgtccagtgtgctctcattttgctcaaggaacgaaacaatcttccaaaaggaggtgttttcccacctggggttgtgtttggcccaaccgacctccaaaacaggcttcaacacaatggaatatcttttgatgttatttcaaagaagacaatctaactaaatggtagtgttcccttctattcacatgggaaaatttgaacttcctctaaagggagaatgatactagttacttatgctttcattacgtttttctgaatgtttatatgcttgcttaataccttaaggtgcttcctcgacatttgtctttccgtatttagactactggataagctctactttgtttatcaatttgttaggtctgttaactcctgtggatctccgatgtcaggagcttccactttacacctgtaaacttgctataattgactgcatttgattcttattgtgctttaactt

SEQ ID NO: 5670 - DNA, 1724 bp, Nicotiana benthamiana
cacgacattttcgcagttagaggcacgcatttctagtccctctctgttcgtctcaaaagtgcactctctttccctgtgatctcttcactgattagcaacccaaagacgaaaacgaatcatactatccaattagtatttgatttcagatcgaaaaatgtctcaaaatctcaatacaaacccgacttacgacgtgataatcttaggagcttcaggttttacaggaaaatacgtcattagagaagctctcaaattcctcaacgttccctcttccccattgaaaagcttagctatagcaggccggaacagttccaaactttcccatgcactccaatgggcctcccgttcaaatccacaaccccaaattcccatcctcaccgccgacacaaccgacccatcttctctccgccacctcgcttctcaggctaagctcatcttcaattgtgtcggcccgtttcgtctttacggtgagcccgttgttaaggcctgtgctgattcgggttgtgattacttggatatttgtggagagcccgagtttatggagaggatggaaatgaagtaccatgataaggctttggaaacgggctccttaattgtttcggcctgtggttttgattctattcctgctgaattaggttggatgttcaattcgagacaatggctaccgccggcaatttgcaatcggattgagggctacattagtctagaatcggacaagagaattgttggaaacctagggacgtatgagtcagcggtgcttagtgtggctaatgcggacaagttacaggaactaaggcgctccagacctaagaggcctcgtcctgttatttcaggtcctcccccttctaaaggtccaatggtgcaccaccttaaggaaattgggctttgggctgtaaagttaccatcagcagatgcaactatagtgcggagaacacttttgtgtctggctgaagctcctcgtggtttacctggtgttagtgaaagcattgaacagattgagaggagggaggcattttggtctagcataaagccagctcatttcggtatgaagatagcttcgaaatctttgttaggtgttgttcgtttcattatagttggctggttcctcggtcactttggtcaaactagtataggcaggtggctgctcttgaatttcccttcagtgttcagtcttggatatttcaggaaaaaaggtccaactgaagatgaagtagcaagtgcaaactttaagatgtggtttgttggacaagggtatagtgatagcaaacttgcatcacaaggaaacaagaaacccgatacggagataattacaagagtaatgggacctgagattggttatatgacgactccaatcattctagtccagtgtgcccttgttttgctcaaggaacgagacaatcttccaaagggaggtgttttccctcctgggattgtgttcggcccgacagacctccaagacaggcttccgcagaatggaatatcttttgatgttatttcgaagaaaactataaactaaatggtagttctatgcagttttagtcatatggaaaattcgaatttatgccacagtagtaatgattctattaaatccttctactttctttgcgtgttcttctgactgtattttcttaatttatagagtctttctggttctttctttatagagtctaactatttttacaaccatacataaaaggttgttgtagagaacttctaatttgtcttaa

SEQ ID NO: 5671 - DNA, 1503 bp, Solanum phureja
atatatataacatagggatatgtgaagaacagtagtactaaatcctgtaattcttaaaccctttcatataataccctcttaccttattctttcttctcctcagcttcttcttcactctgcaaatatggtgctcaaagtttcagttttgcttcttttttcatttctcttcactgcctctgctgttcgctcagctcctcctcttgaaggattacttccaaatggtaattttgaagagctaccaaagccaaaagacctcaagaagaaaacagtgcttcaaggtaaatatgcgttgcccaaatgggagattaatggcttagtggagtacatttctggcgggccacagcctggtgggatgtacttcgcagttgcccacggtgtccacgctgtgaggcttgggaatgaggcttcaatttctcagacaattccagtcaagaaaggctctttgtatgcactcacatttggggcatcaagaacttgtgctcaagaagaggtgttgagggtgtcagtgcctcctcaaacaggagaccttcctttgcagaccctttatagcagcaatggtggtgatacttatgcttggggtttctatgccacctctaatgttgttaaagttacctttcataatcctggagttcaagaggatcctgcttgtggtccactcttggatgccgttgctatcaaagaactttttccacctcgccctacaagagtgaacttggttaaaaatgctggttttgaagaaggacctcacctcttgataaactcttcacatggagttctcctccctcccaagcaggaagatttgacatccccacttccaggatggatcattgagtcactcaaagcagtgaaattcttggattcagctcatttcaatgtcccgtttggccaagctgcagtggaacttcttgcagggagagaaagtgctctcgcccaaatcattaggacagtccctaagaaggtctacgccttcacattcagtgttggtgatgcaaagaacggttgtcatggtgatatgatggttgaagcatttgctgctaaagaaacgttcaaagttcccttcaaatcacaaggcaaaggcagcttcaaaactgttagtttcaagttcacagctattgcagacaggaccagaattactttctacagctctttttaccacacaaagatcaatgactacggcgctctttgtggccctgttgttgatgaagttaaggtgacccctgttgcttagggtctctaaaagtactccaaaaaaagtgtttctcatagagtttttgcaatggtcatatcatactccccacttatcaataggaccattttgaggcaattcctgtattttacctatgtaattgcttaatgctgctgtaagagttgtgtactatttgtttacaaaggaagtctgaaactggtagagcttcctctccattaaaagttgtattacatttcaaagatttcatgttatctgaaggatgaaatatagtagtatttagattaccaatctcattt

SEQ ID NO: 5672 - DNA, 1557 bp, Solanum lycopersicum
gtactaaaaaatttcattgatttaaaaacgaaaataacagtaattatgatattggttggaatatttcacgtttaatcaaaagtcgtggatttgatccttgaatatgaagaaaattaatttgagaacgtcattcttgaatagattatgcagtgcacacttcttcttcactctgcaaatatggtgttcaaagtttcagttttgcttcttttctcatttctcttcacagcctctgctgttcgcccagctcctcctcttgaaggattacttccaaatggtaattttgaagagctaccaaaggcaaaagacctcaacaagaaaacagtgcttcaaggtaaatatgctttgcccaaatgggagattaatggcttagtggagtatatttctggcgggcctcagcccggtgggatgtacttcgcagtcgcccacggtgtccacgctgtgaggcttgggaatgaggcttcaatttctcagacaattccagtcaagaaaggctctttgtatgcacttacttttggggcatcaagaacttgtgctcaagaagaggtgttgagggtgtcagtgcctcctcaaacaggagaccttcctttgcagaccctttatagcagcaatggtggtgatacttatgcttggggtttctacgccacctctaatgttgttaaaattacctttcataatcctggagttcaagaggatcctgcttgtggtccactcttggatgctgttgctatcaaagaactttttccacctcgccctacaagagtgaacttggttaaaaatgctggttttgaagaaggacctcacctcttgataaactcttcacatggagttctcctccctcccaagcaggaagatttgacatccccacttccaggatggatcattgagtcactcaaagcagtgaaattcttggattcagctcatttcaatgtcccgtttggccaagctgcagtggaacttcttgcagggagagaaagtgctctcgcccaaatcattaggacggtccctaagaaggtctacgccttcacattctctgttggtgatgcaaagaacggttgtcatggtgatatgatggttgaagcatttgctgctaaagaaacgttcaaagttcccttcaaatcacaaggcaaaggcagcttcaaaactgttagtttcaagttcacagctattgcagacagaaccagaattactttctacagttctttttaccacacaaagatcaatgactatggcgctctttgtggccctgttgttgatgaagttaaggtgacccctgttgcttaggctctctagaagtactccacataaaaaagcgtttatcatcgagtttttgcaatggtcttatcatactccccacttatcaataggaccattttgaggcaattcctgtattttacctatgtaattgcttaatgctgctgtaagagttgtgtactatttgtttacaaaggaagtctgaaactagtagaacttcctctccattacaaagttgtattacatttcaaagatttcatgttatcttaaggatgaaatataatagtatttagattatcaatctca

SEQ ID NO: 5673 - DNA, 1583 bp, Capsicum annuum
gtgaagtttccttattcttaaacccttttatataccctcctcttccttcaccttctttcttattacatacatacatacatacatacatctacttttgtctgcaaatatggtggtgaaagtttcagttttgcttcttttctcattgctcttcactgcttctgctcttcgcccagctcctactcttgaaggattacttccaaatggtaattttgaagagccaccaaagccaaaagacatcaagaaaaaaacagtgctccaaggcaaatattctttgcccaaatgggagatcagtggcttagtggagtacatatctggcgggccacagcccggtgggatgtacttcccggtcgcccacggcgtccacgcggtgaggcttgggaatgaggcttcagtttctcagacaattccagtcaagaaagggtctttgtatgcactcacatttggggcatcaagaacctgtgcacaagatgaggtcttgagggtgtcagtgcctcctcaaacaggagatcttcctttgcagaccctttatagcaccaatggcggtgatacttatgcttggggtttctatgccacctctaatttagttaaagttacctttcataatcctggagttcaagaggatccagcttgtggtccgctcttggatgctgttgctatcaaagaacttttccctcctcgcccgacaagagtgaacttggttaaaaatcctggttttgaagaaggacctcatctcttgataaactcttcacatggagttctcctccctcccaaacaggaagatttgacatccccacttccaggatggattattgagtcactcaaagcagtgaaattcttggattcagctcatttcaatgtcccatttggccgagctgctgttgaacttcttgcagggagagaaagcgcccttgcccaaatcattaggacggtccctaagaaggtctatgccttcacattcactattggtgatgctaagaacggttgccatggcgatatgatggtggaagcatttgctgctcaagaaacattcaaagttcccttcaaatcacaaggaaaaggcagcttcaaaactgttagtttcaagttcacagccattgcagacaggaccagaatcactttctacagctctttttaccacacaaagatcaatgactacggcgctctttgtggtcctgttgtggatgaagttaaggtgacccctgttgcttaggctctccagaagtactctaaaaaagcttttgtcatagagttttttgcaatggtcataatcatactccacttatcaattataggaccattttgaggcaattgctgtattttacctatgtgattgcttaattctgttgtaagagttgtgtactatttgtttacaaagtgttattatgaaggtcctaataacacaggagggtgaattgggtaatgcttgattttcgctcgagtgatggaccgagttacttagcttgaagtggaatatgaatgcagtaaagtgagaacatatagttttttcttgtctgagttgtgtaatttgtttacaaaagtgtacaactggcagaacttccttaccattactatgtgcactttga

SEQ ID NO: 5674 - DNA, 1419 bp, Nicotiana benthamiana
acttctttctgcaaatatggtggtgaaggtttcaatcttgcttcttttctcattactcttcactgtctctgccgttcgcccagctcctcctcttgaaggactacttccaaatgggaattttgaagagcaaccaaagccaaaagacctcaagaaaaaaacagtactcgtaggcaaatatgctttgcccaaatgggaaatcaacggcttggtagagtacatctctggcgggccacagcctggcgggatgtacttcccagtcgcccacggcgtccatgccgtgaggctagggaatgatgcctcaatttctcaaacaattccagtaaagaaaggctctttgtatgcactcacatttggggcatcaagaacctgtgctcaagatgaggtcttgagggtgtcggcacctcctcaaaccggggaccttccattgcagaccctttatagcagcaatggcggtgatacctatgcttggggtttctatgctacttctaatttagttaaagttacctttcataatcctggggttcaagaggatccagcttgtggtccactcttggatgctgttgctatcaaagaactcttcactgatttgaatttggttaaaaatcctggttttgaagaaggaccagacctcttgataaactcttcgcacggagttcttctccctcccaaacaggaagatttgacatccccacttccaggctggatcattgagtcactcaaagcagtgaaattcttggattcagctcatttcaatgtcccatttggccgagctgcagttgaactactagcagggagagaaagtgccattgcccaaatcattaggacagtccctaagaaggtgtatgcctttgcattcactgttggtgatgcaaagaacggttgccatggcgatatgatggttgaagcattcgctgctaaagaaacattcaaagttcccttcaagtcacaaggaaaaggcagctttaagactgttagtttcaagttcacagctattgcagacaggacaagaattactttctacagctcttattaccatacaaagatcaatgactatggatctctttgtggtcctgttgtggatgaagttaaggttatccctgttgcttagaagcacactcagagctgttgtaatggtcaatagagtttttttggcaatgttcttttcatacttttcaagctacactcagagctgttgtaatggtcgatagaggcaattactgtattttacctatgtgattgcttaaaactatgaattagatgcccgctgtgagaattgtgtactactttcaaggaagtgggatctagttgaacttcctctcctttactatgtgcactttgatcttgattcttagatagtcaagatgtaatatataaaattgtactagtatatttcaaacttttcatgtttcttgaaggatg

SEQ ID NO: 5675 - DNA, 1317 bp, Sesamum indicum
ctctgtcgctagctgtgtgtgtagtggaagaagaatggaagtgaagaagaagatatgtttgttggtgtactgtgtgtggtttgtgtacgcagtctctggtgttgcaccaccgccggctcctttggaagggctcctccccaacggcaactttgaagaaaagccaaagcccacagacctcaagaaaacagtgctccagggcaaacgcgcgctgcccaaatgggagatcgacggcctagtggagtacatctccggcggcccacagcccggcgggatgtacttcgccgtggcgcacggcgtccacgccgtccgcctcggcaacgaggcctccgtctcccaaacaatcccagtcaagaacggctcactctacgctctcacgtttggcgcatcaagaacctgcgcgcaggacgaggtgctgcgggtgtcagtgccgccgcagacaggggacctccctctgcagaccctttacagcagcaatggcggcgacacctacgcttggggatttagggctaattccgactccgtgaaggtgatttttcacaatcccggcaggcaggaggatcctgcttgcgggcctttgcttgatgctgttgccattaaggaactcttcccacctaggcccactagagtgaacctggtgaagaacaatggttttgaggagggtccccatctcctgatcaactcatctcacggagtcctcctccctcccaaacaagaagacctgacctccccgctccccggctggatcatcgaatcactcaaggccgtcaagttcatagactccgccaatttcaacgtcccgtttgggaaagctgcagtggagctgcttgcaggaagagagagcgccatcgcccaagtcatcagaaccgtccccaacaaagcctacaacctcacctttgtagttggagatgccaagaacgactgccacggctcgatgatgatagaagcgtttgctgctaaatcggtaatgaaagctcccttcaaatccgaagggaaggggaagttctcgacctacagtttcaaattcacagccacgttgtacaggaccaggttaacgttcttcagctcgttctatcatactaaggttcatgactatggcgctctgtgcggtccggttctcgacgaagtccgagttttccctgctaaggcttagttttatcggtattgatgaagtgccggagttactatgtgtaatggagatagaacaatgactgttcagctttatgtggaggctgatcaattcatcaggcatggtctgcagtatgtaattgcatcaaaacttaggttatcagtgagttcttggttgctttgagttgattt

SEQ ID NO: 5676 - DNA, 2041 bp, Mimulus guttatus
aagataaagccctaatgttattattaaaacaatataaactgtgtttttttgagacaaacagacaaattatcaccatgttgcatctgccccttaaaaggtgtacttgttcccatgctctctctctctctctctcacacacacacacacacacagacagactctattatgtataaataaatgcacaacacagatgccctaataccatcctttaccttagaccattctctctctctctctctctctctctctctctctctgctgattctgttgtgcaaaaatgaaaatgaagatctctttcatgctttctctgtgctttctctacactgtgtctgctcttgcaccaccacctccttttgaagggcttctcccaaatgggaatttcgaagagaaaccgagccctaaagacatcaagaaaacagtgctccaaggcaaacacgccctccccaaatgggaaatcaacggcttcgttgagtacatctccggtggtccccagccaggcggcatgtactttgccgtggcacacggggtccacgcagttcgcctcggaaacgaggcctcgatttcccaaaccatccccgtgaaaaacggctctttgtatgcactcacattcggtgcatcgagaacttgtgcacaggatgaggttttgagggtttctgtgcctcctcaaacaggggacctccctttggctacactttatagcagcaatggtggcgacacttacgcttggggatttagggctaattcgaattacgtgaaggtgatttttcataacacgggaatgcaggaagatcctgcttgtgggcccctcttggatgccgttgccattaaagaactcttccctcctaagccaagcagagtgaacctagtcaagaacgaaggatttgaagaaggccctcatctactaatgaactcgtctcatggagttctcctcccaccaaaacaagaagacctaacttcaccactccctggttggattatcgaatcattgaaagccgtaaaatttatcgacgcaaaacatttcaacgtacctttcggaaaatctgctgtcgaacttgttgcgggaagagagagtgcaattgcgcaaatcatcagaacagtcccaaacaaagtctacaatctctcgtttgttgttggtgatgctaaaaacggctgtcacggatcgatgcttgtggaggctttcgctgctaaaacgacagcgaaagcaccgttcaaatctgaaggcaaagggaagttttcgacttacagttttcagttcacggcggtttcggacaggaccaggttgactttcttcagctccttttatcatacgaggatcgatgactttggctctctctgtggccctgttcttgatgaagtccgtgtttttcctgctgcgaagatgtaataatagtagcaatatatctgcattatcgagatatttgaggcgtgcaattctaatatatatgtaatagatgagatgcagtaatgggaattctgcctcttctcgaggctaatcaaaggataaggcgttactttagcaaatatgtgatttgcatgagctgattttcaactgcttgtaatacaagttattgtttcggaataatttgatcaatcaaatataaatacaatgcaagaaaaaacagaagaagaacagtaatacataaatcgaatatgattcatgccaagaatcgaatatgattaatgccaagaattgtaaagacacattggctaatacgaagctcaacatagacaaactgatcaatagataaaaatactgtctttatatcagtctcccctctttcaaatatgtaagaacatatatactaagcagaatctcttgcctctggcttctacaaccatatcaggggaataaaattgttgcaaagaattgcattttttttctatgaagcgaatgtcttcatttgcccacgtctaaaacgccgacgagacatttctccaacatgaattctgcattaacccaagcatggtatttatctgaatcaagaatcaggattcgcaatagtatcggatatcatactaattttattcggtagaaattgat

SEQ ID NO: 5677 - DNA, 2523 bp, Mimulus guttatus
gaataatataattctccatctttctgtgagacctgaaattccagctactacagaatcatcttcaacaagaaggcgaaatttgtagattgaattttgttttttgctccctcttggaatctgattttgggatataatggctggtgaggatgatttcaccttttgtccggttcccccgccagtagacgatactcagaaagttgccgaggatgtaagcgggattcgtatagatgatgtaaatgaaaatgcttccgataagattagtgacaagaaaaatggtactaatatatggaaagttagtggtacctctcagaagcaagaaacagttggctctttgtcttttactgttactgatgcatcgtctagcggaggaatcgatcaacagccccaaaaaacagcagaagtgggtcccgcaagttcagctaaggcttcaccgcctgtaaagaagtctacggctcgtgcgaaggttccttttgagaaggggtatagtcaggtggactggcttaagcttacaagaacgcaccctgatttggcaggattgaagggacagtcaaataagagacttatatcattgagcgaagtcaaacaaaatcagtctgaagactccatgtggactgttctaaaaggccgtgtctataatattgccccatatatgaagtttcatcctggaggtgttgatatgctgatgaaggcagttggaaaagattgcacgtctttattcaataaataccatgcttgggttaatgcagaattcatgttggagaaatgtctagtcggcgttttagacgtgggcaaatgaagatattcgcttcgtagaaaaaagattcaattcttttgcgacaattatattcccctcatatcattgtagaggccaggggcaagagattcagcttagtatatatgttcttacatatttgagaggggagactgatataaagactgtatttttatcaattgatcagtttgtcaatgttgagcattggagaacaggattatggctttacaattcttggcattaatcatattttcgatttatatattactgttcttcttctgtttttcttgcgttgtatttatattcgactgatcaaattattccgaaacattaacttgtattacaagcagttgaaaatcagctcatgcaaattacatatttgcaaaagtaatgccttatcctttgattagcttcgagaagaggctaatcatctattacatatatcttagaattgttcgtctcaaatatctcgataatgcaaatatatattactattattattacatcttcgctgcaggaaaaacacggacttcatcaagaacagggccacagagagagccaaagtcatcgatcctcgtatgataaaacgagctgaagaaagtcaacctggtcctgtccgaaacagccgtgaactgaaagttgtaagtcgaaaacttccctttgccttcagatttaaactgtgctttcgatgtagttttagcagcgaaagcctccacaagcatcgatccatgacagccgtttttagcatcaccaacaacaaacgagagattgtagactttgtttgggactgttctgatgatttgcgcaattgcgctctctcttcccgcaacaagttcgactgcagattttccgaaaggtacgttgaaatgttttgagtcgataaatttcacagcttttaatgattcgataatccaaccagggagtggtgaagttaggtcttcttgttttggtgggaggagaactccgtgagacgagttcattagtagatgagggccttcttcaaatccttcgttcttgactaggttcactctacttggcttaggagggaagagttctttaatggcaacggcatccaagaggggcccacaagcaggatcttcctgcataccagtgttatgaaaaatcaccttcacgtaattcgaattagccctaaatccccaagcataagtgtcgccaccgttgctactataaagtgtagccaaagggaggtcccctgtttgaggaggcacagaaaccctcaaaacctcatcctgtgcacaagttctcgatgcaccgaatgtgagtgcgtacaaagagccgtttttcacggggatggtttgggaaatcgaggcctcgtttccgaggcgaactgcgtggaccccgtgtgccacggcgaagtacatgccacctggctggggcccaccggagatgtactcaacgaagccgttgatttcccatttggggagggagtgtttgccttggagcactgttttcttgatgtctttagggctcggtttctcttcgaaattcccattcggggagaagcccttcaaaaggaggtggtggtgcaagagcagacacagtgtagagaaagcacagagaaagcatgaaagagatcttcattttcatttttgcacaacagaatcagcacacagagagagagagagggagagagaatggtctaaggtaaaggatggtattagggcatctgcattgtgcatttatttatacaccatagagtctgtgtgcgtgtgtgtgtgtgtgtgtgagag

SEQ ID NO: 5678 - DNA, 1135 bp, Manihot esculenta
ggcttcattttcctttgaaaatggcaatgggtgtcttcccgttgcttgctttcttcttgctcttcaatggctctgctttggctgctaactacatggaagggttcctcaaaaatggaaactttgagcagaaaccaaaacccagtgacctaaacaagacagtactcaaaggaaaatatgcattacctggctggatcaccaatggcttagtggaatacatctctgctggcccacagcctggtgggatgtattttgctgtggctcatggtgtacatgctgtgagacttggcaatgaggcttcaatttctcaaacaattcctgtaaaaccaggctctttatatgctctcacatttggtgcttcaagaacttgtgcccaagatgaggttttgagagtctctgtgcctcctttgtctggcgacctgcctctgcagacactttatagcagtaatggtggtgacacttatgcttggggatttagagccaaatctaatgttgctactgtgacttttcacaaccctggtgtccaagaagaccctgcttgtggaccactcattgatgctgttgctattaaggagttgtttcctccaaggcccacaagagataatttggttaagaatcctggatttgaagagggtcctcatcgcttactcaactcttccaatggtgtcctccttcctccaaaacaagaagatctcacatccccacttcccggttggatcattgaatcacttaaagctgtgaagttcattgattcaaagcacttcaatgttccatttggattggcagcagttgagcttcttgcaggaagagaaagtgccattgcccagatcctcagaacaatccccaacaaaatctataatctcacattcactgttggagatgcaaagaatggctgccatggatcaatgatggttgaagcatttgctgataaagaaacctttaaggttccatttgagtcccaaggaaagggtatctccaagactgtgagcttcaagttcaaagctatttcagcaagaacaagaattacattctacagttcattttaccacactagagttgatgattttggatccctttgtggtcctgttcttgatcaagttagggtttttcctgttgcttagattattgattatatcaa

SEQ ID NO: 5679 - DNA, 1322 bp, Mimulus guttatus
accatcctttaccttagaccattctctctccctctctctctctctgtgtgctgattctgttgtgcaaaaatgaaaatgaagatctctttcatgctttctctgtgctttctctacactgtgtctgctcttgcaccaccacctccttttgaagggcttctcccgaatgggaatttcgaagagaaaccgagccctaaagacatcaagaaaacagtgctccaaggcaaacactccctccccaaatgggaaatcaacggcttcgttgagtacatctccggtgggccccagccaggtggcatgtacttcgccgtggcacacggggtccacgcagttcgcctcggaaacgaggcctcgatttcccaaaccatccccgtgaaaaacggctctttgtacgcactcacattcggtgcatcgagaacttgtgcacaggatgaggttttgagggtttctgtgcctcctcaaacaggggacctccctttggctacactttatagtagcaacggtggcgacacttatgcttggggatttagggctaattcgaattacgtgaaggtgatttttcataacactggtatgcaggaagatcctgcttgtgggcccctcttggatgccgttgccattaaagaactcttccctcctaagccaagtagagtgaacctagtcaagaacgaaggatttgaagaaggccctcatctactaatgaactcgtctcacggagttctcctcccaccaaaacaagaagacctaacttcaccactccctggttggattatcgaatcattaaaagctgtgaaatttatcgactcaaaacatttcaacgtacctttcggaaaatctgcagtcgaacttgttgcgggaagagagagcgcaattgcgcaaatcatcagaacagtcccaaacaaagtctacaatctctcgtttgttgttggtgatgctaaaaacggctgtcatggatcgatgcttgtggaggctttcgctgctaaaactacatcgaaagcacagtttaaatctgaaggcaaagggaagttttcgacttacaactttcagttcacggctgtttcggacaggaccaggttgactttcttcagctcgttttatcatacgaggatcgatgactttggctctctctgtggccctgttcttgatgaagtccgtgtttttcctgcagcgaagatgtaataataatagtaatatatatttgcattatcgagatatttgagacgaacaattctaagatatatgtaatagatgattagcctcttctcgaagctaatcaaaggataaggcattacttttgcaaatatgtaatttgcatgagctgattt

SEQ ID NO: 5680 - DNA, 2343 bp, Hordeum vulgare
ggagaccattcgcacaccggcggttgccaatacgattccactacaggtctcctcctccggtcctctccgcggtaaacctcggcgcccccaacgaggccacccgcttcatggccgagctgagcagagctcgcatgatcccgcgagagccccaccactgagggagcgagcgatgtccgttgccccgtcggcgcgcagcggctgcggtgccgccaaggccgcgcggcgccaccaggcggggcgcgctggcggagggaggcgccgcgccgccgtggtcctccttctcctcgcgctggcatacgcgacggggctgctcatgttcgtcttaggaggcgggggttctgtcgacatcggcggccgcgcgggcgttacggtggcatcgttgcggcggcccgccccgtccccaccgccgccggggtcggtttaccgcagccacatcgtgtttaagcggctatggccggacatacgcgatgacgccgcgtccgcttcgactgccacctccgcttctgcctccacctcctctccgtggcgtcgcagcatgttaatgacatcacgttatccaaattctggagagctatggatgccatgcgtcaagaggacgctgattccatcagatgtgccgccttcaaatgggtatctcatagttgaagcaaatggtggtctgaatcaacagcgtctttctatctgcgatgcagttgctgtggccagcttgcttaatgcaactcttgtgatcccaatatttcatctgaatagcgtttggcgtgatcctagcaaatttagtgatatttttgacgaagatcgttttatcgggacgctcagacaacatgtaagagttgtgaaggaactcccaaaagatgttgtgctgcgtttcaatcataatataagcagcataccaaatatgcgaactaaagcttactcatccccagatcattatgtccagaaggttctcccgaaactactggagttaggggttgtgcgcatagccccgttctcgaatagattggctcagtcagttccatcgaatatccaggccttgaggtgtttggtaaactaccaggctctgcggtttgccgaaccaataagagttcttgcagacgatatggttgtccgaatgatgaaaaagagttctttggctggtgggagatatgtctcggtgcatctccgtttcgaagaggatatggtagctttttcgtgctgtacatatgatggtggccgcaaggagaaaattgaaatggaaaatgcccgtgaaaggagctggagagggaagtttcaccgacctggtcgagttatcaaccccgaggcaaacagaagagatgggaaatgtccacttactcctctagaggttggtatgatgctgcgaggcatgggatttgacaatacaaccttcctctacgttgcctctggtaaaatatacaatgctgcaaaatacatggctccccttcgccagatgttccctcttttacagaccaaggacactcttgcattgcctgaagagcttgctgagtttgaggggtattcttctcggttagcagcattagattacactgtctgtgttcagagcgaagtgtttgtgacgacccaaggggggaacttccctcactttttgatgggacacaggcgttacctgttaggagggaatgcaaagacaataaaacccgacaaacggaagctggtcttatcttttgacgaccccaatatcagatggagtcgattcaagcaccacatgcaggaaattctgcacaatagtgacataaggggcattgctttcaggaaacctaatgattccatatacaccttcccaatgcctgattgcatgtgccaacaagatggaacatgatctaggttttagcatacataactgagggatgcatatcctctgcctttgtgcaacaaaggcaccaaaggcacgggcatcgttgactgcatgaacaggatttgacggtcatgatcaaaactggagtgaagtcgagcatttggagctcctcaggagattctgaaaccctctggcattgctcaaaccgtttgattcagggtagaatggtcaaaagatgcctaatgacaatgcatttcagagggtcagaaattgagaggatgtgagggattttgtaaagttggtaatctgtaggtagtccaccatatagcaatctccatttgttcgctctgtctataggttgtaaagagaaaagaactacgagattggcttgtagatatgactatgagtacaacctgagtgcctcaatgtatattcgaaaaacaaagggctaagaaccacaaggaaaggaatttttcagtatatcatcactcatcagcgtttgttcttgcatttcatctcgcccttcacaattc

SEQ ID NO: 5681 - DNA, 2225 bp, Secale cereale
gcccccaccgaggccacccgctccatcgccgagctgaacagagctcgcatgatcccgcgagagccccgctactgagggagcgagcgatgtccgtcgccccgtcggcacgcggcggctgcggtgtcgccaaggccgcgcggcgccaccaggcggggcgcgctggcggagggaggcgccgcaccgccgtggtcctcctcctcctcgcgctggcatacgcggcggggctgctcatgttcgtcttaggaggcggaggttctgtcgacggcggcggccacgcgggcgtgacggtggcatcgttacggcggcggcgcgcgcccgcgccgtcccaaccgccgccggggtcggtttaccgcagccacatcgtgtttaagcggctatggccggacatacgcgacgacgccgcgtccgcttcgaccgccacctccgcttccgtctccacctcctctccatggcgtcgcagcatgttaatgacatcacgttatccaaattctggagagctatggatgccatgcgtcaagaggaggctgattccatcagatgtgccgccttcaaatgggtatctcatagttgaagcaaatggtggtctgaatcaacagcgtctttctatctgcgatgcagttgctgtggccagtttgcttaatgcaactcttgtgatcccaatattacatttgaatagtgtttggcgtgatcctagcaaatttagtgatatttttgacgaagatcgttttatcgggacactcaggcaacatgtaagagttgtgaaggaactcccaaaagatgttctgctgcgtttcaatcataatataagcagcataccaaatatgcgaactaaagcttactcatccccagatcattatgttcagaaggtgcttccgaagttactggagttaggggttgtgcgcatcgccccattctcgaatagattggctcactcagttccatcgaatatccaggccttgaggtgtttggtaaactaccaggctctgcggtttgccgaaccaataagagttcttgcagacgatatggttgtccgaatgatgaaaaagagttctttggctggtgggaaatatgtctcggtgcatctccgtttcgaagaggatatggtagctttttcatgctgtacatatgatggtggccggaaggagagaatggaaatggaaaatgcccgtgaaaggagctggagagggaagtttcaccgacctggtcgagttatcaatcccgaggcaaacagaagggatgggaaatgtccacttactcctctagaggttggtatgatgctgcgaggcatgggatttgataatacaaccttcctctacgttgcctctgataaaatatacaatgctgcaaaatacatggctccccttcgtcagatgttccctcttttacagaccaaggacactcttgcattgcctgaagagcttgctgagtttgaggggtactcttctcggttagcagcattagattacactgtctgtgttcagagtgaagtgtttgtgacgactcaaggggggaacttccctcactttttgatgggacacaggcgttacctgttaggagggaatgcaaagacaataaaacccgacaaacggaagctggtcttatcttttgacgacccaaatatcagatggagtcgtttcaagcaacacatgctggaaatactgcaccatagtgacataaggggcattgcattcaggaaacctaatgattccatatacaccttcccaatacctgattgtatgtgccagcaagatggaatatgatctaggccttagcatacataaccgagggatgcacaaaggcaccaaaggcacggcatcgttgactacatgatcaggatttgacgatcatgatcataactggagttaaatcgagcatttggagcctctcaggagattcttaaaccctctgtcatgcctcaaaccgttcgattctggatagaatggtcaaaaggtgcctaatgacaatgaattccggaggatcagaaattgagaggatgcgagggattttgtaaagttggtaatatgtaggtagtccaccatatagcaatctccatttgttcaatctgtctgtaggctgtaaagagaaaagagctacgagattgggttgtagatatgagcacaacctgagtgcctccatatatattcgaaaaacaagggctagcaacaacaaagaaaggattttttcagtatatcatcactcatcagtgtctgttcttgcaaattttt

SEQ ID NO: 5682 - DNA, 2575 bp, Brachypodium distachyon
cattccctcaccgggcggttacccaacaaacaccttccactgcaggtctcccgtttccacctcgtctcctctgcgcgtttaaaactccgcaccggcgacctcctcgagctgagcggagctcgcgtcgcatggtcctgccacggccccgccactgacgtacggggcgggcgagagagatgtccgtggcggcgtcggcgcgcggaggcggcgggggagccgcgaaggccgcgcgtggggggcgattctcggcggggcgcggcgtctgggggaggcggcgcgccgcggtggtccttttcctcgcgctggcgtacgcggcagcgcttctcgtgttcgtgttcggcggcggcggcggaggaggttctgctggaggcggcgcggggttgacggtggcgtcgctgcggaggcggcggcatggcgagcccgcgccctcgacgccgccgcctcccgggtcggtgtaccggagccacatcgtgttcgaccggctgttgccggagatacgcgacgacgccgcgccctccgcctccgtttcaaccccatcgtcctggcgtcgcagcatgttaatgacatcacatcatcaaaactctggggaggtatggatgccttgtgtcaacaggaggctgattcgatcagagttgccgccttcaaatgggtatctcatagttgaagcaaatggcggtttgaatcaacagcgtctttctatctgcgatgcggtcgctgtcgccagcttgcttaatgctactcttgtgatcccaatatttcatttgaatagtgtttggcgtgatcctagcaaatttagtgatatttttgacgaaaatcgttttatcgagacagttggaaaacatgtaagagttgttaaggaactgccagaagatgttttgcttcgcttcaattacaatatcagcagcataccaaatatgagaaccaaagcctactcatctccacatcactatctgcacaaggtgcttccaaaattactggagttaggggccgtgcgcattgctccattctcgaatagattggctcagtcagttccatcaaatatccaggccttgaggtgtttggtgaactaccaggcactgagatttgccgagccagtaaggcttcttgcagaggatatggttgtccgaatgatgaaaaaaagttcttcgactggtggcaaatatgtctcggtgcatcttcgatttgaagaggatatggtagctttttcatgctgtacatatgatggtggctggaaggagaaaattgaaatggaaaatgctcgtgaaaggagctggagagggaaatttcaccgacctggtcgagttatcaatcctgaggcaaacagaagggatggaaaatgtccacttactcctctagaggttggtatgatgctgcgtggcatgggatttgaccattcaaccttcctctatgttgcttctggtaaaatatacaatgctgcaaaatacatggctccccttcgccagatgttccctcttttggagaccaaggaaagtcttgctttacccgaagaacttgctgagtttgaggggtactcatctcgactagcagcaatagattacactgtctgtgttcagagcgaggtgtttgtgacgactcaaggggggaatttccctcactttctgatggggcacaggcgctacctgtttggtgggaatgcaaagacaataaaacctgacaaacgaaagctggtcttatcttttgatgatccgaatatcagatggagtcaattcaaacgccacatgcaggagatattgcaccacagtgacataaagagcatcgctttcaggaaacctaacgattccatatacaccttcccaatgcctgattgcatgtgccaacaagatggaatataatctagcttagcatgcatacgtgagggatgcataccctctgcctttgtgcaacagaggaacgaaaagcactgcgtcgtggatagtactaacaggaattggcagctcatgatcaaagccggagataaaatcgagggcttggaatttctcgcaaggtactgaaaccctctcgcttgccttgagccgttcaatgctagagatggaatggccagaaacagcctgacggcaaggagttccatagaagtagaaatgcagaggatgtgaggtattctttaaaattagtaatctgtggatagtccaccatatagcaatttctattcgtcagttctgtatgtaggttgcaaagaggagagttgcaaaattgggttgtagatatgagcacaacctaactgcgtcggtatatatgtataaaaaagaatggctaacaaccaactgaaaggaattttcagggacggactgcctttcagtcgaccattttcttaatcccagtgcattatattttaaattgctggatcatttactgaaaaatgtattcaatgttgaattgttaccggagcaatttcatttcttgcactacaactttcctgttgtttccacactactagtgttgaaatgttccttaagcactttcagtgtgttgtcatacatttctggtttactcgagtgcgaactttggctcatcgtgagaaacacgatgattcaaatgaaacatgatttgaatgcgt

SEQ ID NO: 5683 - DNA, 2045 bp, Brachypodium distachyon
cattccctcaccgggcggttacccaacaaacaccttccactgcaggtctcccgtttccacctcgtctcctctgcgcgtttaaaactccgcaccggcgacctcctcgagctgagcggagctcgcgtcgcatggtcctgccacggccccgccactgacgtacggggcgggcgagagagatgtccgtggcggcgtcggcgcgcggaggcggcgggggagccgcgaaggccgcgcgtggggggcgattctcggcggggcgcggcgtctgggggaggcggcgcgccgcggtggtccttttcctcgcgctggcgtacgcggcagcgcttctcgtgttcgtgttcggcggcggcggcggaggaggttctgctggaggcggcgcggggttgacggtggcgtcgctgcggaggcggcggcatggcgagcccgcgccctcgacgccgccgcctcccgggtcggtgtaccggagccacatcgtgttcgaccggctgttgccggagatacgcgacgacgccgcgccctccgcctccgtttcaaccccatcgtcctggcgtcgcagcatgttaatgacatcacatcatcaaaactctggggaggtatggatgccttgtgtcaacaggaggctgattcgatcagagttgccgccttcaaatgggtatctcatagttgaagcaaatggcggtttgaatcaacagcgtctttctatctgcgatgcggtcgctgtcgccagcttgcttaatgctactcttgtgatcccaatatttcatttgaatagtgtttggcgtgatcctagcaaatttagtgatatttttgacgaaaatcgttttatcgagacagttggaaaacatgtaagagttgttaaggaactgccagaagatgttttgcttcgcttcaattacaatatcagcagcataccaaatatgagaaccaaagcctactcatctccacatcactatctgcacaaggtgcttccaaaattactggagttaggggccgtgcgcattgctccattctcgaatagattggctcagtcagttccatcaaatatccaggccttgaggtgtttggtgaactaccaggcactgagatttgccgagccagtaaggcttcttgcagaggatatggttgtccgaatgatgaaaaaaagttcttcgactggtggcaaatatgtctcggtgcatcttcgatttgaagaggatatggtagctttttcatgctgtacatatgatggtggctggaaggagaaaattgaaatggaaaatgctcgtgaaaggagctggagagggaaatttcaccgacctggtcgagttatcaatcctgaggcaaacagaagggatggaaaatgtccacttactcctctagaggttggtatgatgctgcgtggcatgggatttgaccattcaaccttcctctatgttgcttctggtaaaatatacaatgctgcaaaatacatggctccccttcgccagatgttccctcttttggagaccaaggaaagtcttgctttacccgaagaacttgctgagtttgaggggtactcatctcgactagcagcaatagattacactgtctgtgttcagagcgaggtgtttgtgacgactcaaggggggaatttccctcactttctgatggggcacaggcgctacctgtttggtgggaatgcaaagacaataaaacctgacaaacgaaagctggtcttatcttttgatgatccgaatatcagatggagtcaattcaaacgccacatgcaggagatattgcaccacagtgacataaagagcatcgctttcaggaaacctaacgattccatatacaccttcccaatgcctgattgcatgtgccaacaagatggaatataatctagcttagcatgcatacgtgagggatgcataccctctgcctttgtgcaacagaggaacgaaaagcactgcgtcgtggatagtactaacaggaattggcagctcatgatcaaagccggagataaaatcgagggcttggaatttctcgcaagtctcgcggaccttgcaactcagtctccatccgacaaagtt

SEQ ID NO: 5684 - DNA, 3646 bp, Brachypodium distachyon
gcctgtcagagagagagagaggggggtgtttgccacgtcaaaaggcagcattagcattacgcatccgtggtgaggagataatcagataaagcagtagccgcagcagtccacaaagttccaagcgagcgaggaacccggcttgactgccgtcccgtttcccatcactccctcttctaaaactccttccatcaccacccccattcccttgcccgcaatcaattcctcccctgccttttcccttcccatccttgcttgcaacaacagattaccagaagagagctggagcggcggctctagagagcagtagacgcaaccatggcgacgctggaggacctcggggtgtcggccttcatcaacatcgtgggcgccttcgtcttcctcctcctcttcgccttcctccgcatccagcccatcaacgaccgcgtctacttccccaagctctacctcgcccgcaagcgcacccacgaccagcgcggcgtccgcggcgtcatcaacctcaacctctgcacctacctcaggttcctcagctgggtccccggcgcgctccgcatgaaccagacggagctcatacaccacgccgggctcgactccgccgtctacctgcgaatctacaccctcggtctcaagatatttttgcccattatggttgttgccttgctggttcttattccagtcaatgtcgctggcggcacattactaaacataagaaaagaagttgtgtttagtgacattgataagctatccatatcaaatgttagcccgggatccaacaggttctttattcatctcttaatggcatatgtgttcacattttggacgtgctttatgctgtacaaagagtacagtaatgtggcattcatgaggttgcatttcctggcttctcagaagcgttgtgctgatcagttcactgtgattgttagaaatataccgcgtgtttcaagccattcaacatctgaaacagtggatgagtttttccgtaggaaccatccagaccactatcttggtcagcaggctgtttacaatgcaaaccggtacgctaaactcgtgaagagaaaggagaggcttcaaaactggttagattactaccagctgaagtttgaaaggcatcctgaaaaaagaccaactggaaggacaggatgctttggtttctgtggtcgcaaagtggatcaaatcgactactaccgggctagaatcagcgaacttgataagaggatggcatctgaacgtcagagagttctgaatgatccaaaagctgttatgcctgtttcttttgtgacatttgactcgagatggggtgctgcagtatgtgcacagacacagcagtcaaagaatcccacccaatggctaactgattgggctcctgaaccgcgtgatgtttattggcagaatcttgccattccatttttctctctgagtatccgcaagtttctgatatcaattgctgtttttgctttggtattcttctacatgatacctattgcatttgtgcaatcccttgccaatcttgagggtatcgaaaaagttgcgcctttcgtgaggccagtaattgaagtaaaagtggtgaagtccttcctacaggggttccttcctggtctgactttgaagctctttctctatatcctcccgacggttcttatgattatgtcaaaagttgaaggttatgtctctttatcgtcactggaaagaagaactgcttcaaaatattattacttcatgctggtgaacgtatttcttggaagcataattgctggcacagcttttgaacagctatattctttttttcacgatcctccttcacaaattccgaggaccattggagtagctgtaccaatgaaagctacatttttcatgacatacattatggtcgatggctgggccggcatcgcaaatgagattcttcgagtgaaaccactgatcatataccatctgaagaacatgtttattgtgaaaacagagagggacagggagagggccatggatcctggcagcattggacttggagaaaatcttccatccctgcagctatactttctccttgggctcgtatacgcggtggtcacccctattctccttcctttcataatcgtattcttcgcctttgctttccttgtctacaggcaccagatcatcaatgtgtacaatcaggagtacgagagcgctgctgcattttggcctcaggtccattcgcgcatcatagcgagcttgctgatctctcaggtaactctgtttggactgctgagcacgatgaaagccgcctactctactccgttgctcatcttcctgccactgctgacgatatggttccacaagtactgcaaaagccggtttgaacctgctttcaggaagtatcctctagaggaagcaatggaaaaggacagactggagcatgcatcggagccaagcctgaacctcaagacctacttggcaaatgcttacctgcacccaatcttccatatgtttgagcaagaggatcagaaagaggagactacagtagaggtgagaattgacaaagcacagcagcaacagcaacatcatgtgagaagctcacactcacagtatcatgaagaggagagcagcattacggagacacattataaccatcaggaggaaaggaccagccaggtccagtatcagtaccattatcagcaccaccatgaggaaaacatggggagccaacagtcaccaccgcacttcgtctaacaccatgaagttgagccttgatgctgcaaactaattttccagcccctaacttgattttccttttcttttttagcttgtgcttttgtgaatgtttaattgcagccctgtagtccagatagtgctgatgattgacgtacagccaatatatagtgtgatggtaaattgataatctcatgccccgagtttttgatgcaaaaggagaaaatatcttgtgcttattttttgaaaggggatcttgtgtttttcctagcaacgagcgagagttctgccttttccattaaaaaaaaagttgcactttatttttccactttctgctttagtctcgagtgattgcgatagatgtggttgggcacttcaaatgaaatgttttttacaggtgcttcaaatgacatgttgtttctttgtactccgcaatactaatctttccaaaaactcgaatgcttatttgcttgccatctatgtcacgatttgatgacaagtggccattgtctatttttctccacaatttgtttgatcgtgtgaggattcggttctggctagaaaatgccgtgctaagctgccgctgtcagctctatgtctgctttttttttacggatttgctagggaacagtcgtctgagaaatcaaatttctcggtcgacggcggaaactgatatacgatttgtagttaataactgaatgaaacatggatatgtatatggcctggtggtttgtggatggtcgctctgttttggaggtcgcaggttcgaatgccttcccgttcaactttttgtttccttttcctatttttgtcttcaattttttatttctcttaatattttgttttaaattttatatatgtacactaacgtaaaatagcagtataagataatttgtatatttgttttaattttttgtgctctgatttttttggatgagtcgcatattccgaaaaccataacggcaga

SEQ ID NO: 5685 - DNA, 3303 bp, Brachypodium distachyon
gcctgtcagagagagagagaggggggtgtttgccacgtcaaaaggcagcattagcattacgcatccgtggtgaggagataatcagataaagcagtagccgcagcagtccacaaagttccaagcgagcgaggaacccggcttgactgccgtcccgtttcccatcactccctcttctaaaactccttccatcaccacccccattcccttgcccgcaatcaattcctcccctgccttttcccttcccatccttgcttgcaacaacagattaccagaagagagctggagcggcggctctagagagcagtagacgcaaccatggcgacgctggaggacctcggggtgtcggccttcatcaacatcgtgggcgccttcgtcttcctcctcctcttcgccttcctccgcatccagcccatcaacgaccgcgtctacttccccaagctctacctcgcccgcaagcgcacccacgaccagcgcggcgtccgcggcgtcatcaacctcaacctctgcacctacctcaggttcctcagctgggtccccggcgcgctccgcatgaaccagacggagctcatacaccacgccgggctcgactccgccgtctacctgcgaatctacaccctcggtctcaagatatttttgcccattatggttgttgccttgctggttcttattccagtcaatgtcgctggcggcacattactaaacataagaaaagaagttgtgtttagtgacattgataagctatccatatcaaatgttagcccgggatccaacaggttctttattcatctcttaatggcatatgtgttcacattttggacgtgctttatgctgtacaaagagtacagtaatgtggcattcatgaggttgcatttcctggcttctcagaagcgttgtgctgatcagttcactgtgattgttagaaatataccgcgtgtttcaagccattcaacatctgaaacagtggatgagtttttccgtaggaaccatccagaccactatcttggtcagcaggctgtttacaatgcaaaccggtacgctaaactcgtgaagagaaaggagaggcttcaaaactggttagattactaccagctgaagtttgaaaggcatcctgaaaaaagaccaactggaaggacaggatgctttggtttctgtggtcgcaaagtggatcaaatcgactactaccgggctagaatcagcgaacttgataagaggatggcatctgaacgtcagagagttctgaatgatccaaaagctgttatgcctgtttcttttgtgacatttgactcgagatggggtgctgcagtatgtgcacagacacagcagtcaaagaatcccacccaatggctaactgattgggctcctgaaccgcgtgatgtttattggcagaatcttgccattccatttttctctctgagtatccgcaagtttctgatatcaattgctgtttttgctttggtattcttctacatgatacctattgcatttgtgcaatcccttgccaatcttgagggtatcgaaaaagttgcgcctttcgtgaggccagtaattgaagtaaaagtggtgaagtccttcctacaggggttccttcctggtctgactttgaagctctttctctatatcctcccgacggttcttatgattatgtcaaaagttgaaggttatgtctctttatcgtcactggaaagaagaactgcttcaaaatattattacttcatgctggtgaacgtatttcttggaagcataattgctggcacagcttttgaacagctatattctttttttcacgatcctccttcacaaattccgaggaccattggagtagctgtaccaatgaaagctacatttttcatgacatacattatggtcgatggctgggccggcatcgcaaatgagattcttcgagtgaaaccactgatcatataccatctgaagaacatgtttattgtgaaaacagagagggacagggagagggccatggatcctggcagcattggacttggagaaaatcttccatccctgcagctatactttctccttgggctcgtatacgcggtggtcacccctattctccttcctttcataatcgtattcttcgcctttgctttccttgtctacaggcaccagatcatcaatgtgtacaatcaggagtacgagagcgctgctgcattttggcctcaggtccattcgcgcatcatagcgagcttgctgatctctcaggtaactctgtttggactgctgagcacgatgaaagccgcctactctactccgttgctcatcttcctgccactgctgacgatatggttccacaagtactgcaaaagccggtttgaacctgctttcaggaagtatcctctagaggaagcaatggaaaaggacagactggagcatgcatcggagccaagcctgaacctcaagacctacttggcaaatgcttacctgcacccaatcttccatatgtttgagcaagaggatcagaaagaggagactacagtagaggtgagaattgacaaagcacagcagcaacagcaacatcatgtgagaagctcacactcacagtatcatgaagaggagagcagcattacggagacacattataaccatcaggaggaaaggaccagccaggtccagtatcagtaccattatcagcaccaccatgaggaaaacatggggagccaacagtcaccaccgcacttcgtctaacaccatgaagttgagccttgatgctgcaaactaattttccagcccctaacttgattttccttttcttttttagcttgtgcttttgtgaatgtttaattgcagccctgtagtccagatagtgctgatgattgacgtacagccaatatatagtgtgatggtaaattgataatctcatgccccgagtttttgatgcaaaaggagaaaatatcttgtgcttattttttgaaaggggatcttgtgtttttcctagcaacgagcgagagttctgccttttccattaaaaaaaaagttgcactttatttttccactttctgctttagtctcgagtgattgcgatagatgtggttgggcacttcaaatgaaatgttttttacaggtgcttcaaatgacatgttgtttctttgtactccgcaatactaatctttccaaaaactcgaatgcttatttgcttgccatctatgtcacgatttgatgacaagtggccattgtctatttttctccacaatttgtttgatcgtgtgaggattcggttctggctagaaaatgccgtgctaagctgccgctgtcagctctatgtctgctttttttttacggatttgctag

SEQ ID NO: 5686 - DNA, 2742 bp, Triticum aestivum
ccatggcgacgctgcaggacctcggggtgtcggccttcatcaacatcctgggggccttcgtcttcctgctgctcttcgccgtgctccgcatccagcccatcaacgaccgcgtctacttccccaagctctacatcgccggcaagcgcgccgccgaccaccgcggcgcccgcagggccatcaacctcaacctctgcacctacttcaagttcctcagctgggtccccggcgcgctccgcatgacccagaccgagctcatacaccacgccggcctcgactccgccgtctacctccgaatctacaccctcggcctcaagatttttctgcccgtcatggttgtcgccttgctggttctcattccggtcaatgtctctggagggaccctactgaacctgagaaaagatgttatgttcagtgatattgataagctgtccatatcaaatgttagcccgggctccaacaggttctttattcatcttctaatggcgtatgtgttcacattttggacgtgctttatgctgtacaaagagtacagtaatgtggccttcatgagattgcatttcctagcttctcagaaacgttgtgctgatcagttcactgtgattgtcagaaacatacctcgtgtgtcaagccattcgacgtctgagacagttgacgagttcttccgcaggaaccatccagaccactatcttggtcagcaggctgtttacaatgcaaaccggtatgctaaacttgtaaagcaaaaggagagacttcaaaactggctggattactaccagctaaagtttgaaaggcatcctgagaaaagaccaactggaaggacaggatgctttggtttctgtggtagacaagtggatcaaatcgactactaccgggctagaattagcgaacttgataagaggattgcatcagagcgtcaaagagttttgaatgatccaaaagccattatgccagtttcttttgtgacatttgactcaagatggggtgctgctgtatgtgcacagacacaacagtcaaagaatcccacacaatggctgactaactgggctcctgaaccacgtgacgtttactggcagaatcttgctattccatttttctctctgagcatacgcaagtttctcatatcaatcgcggtctttgctttggtgttcttctacatgatacctattgcatttgtgcaatcacttgccaatctcgagggtattgaaagagtcgcgcctttcttgaggccagtaatagaagtaaaggtggtgaagtccttcctacagggtttcctacccggtctggctttgaagctctttctctatatcctccctacggttcttatgatcatgtcaaaagttgaaggctatgtctctttgtcatcgctggaaagaagaactgcttcgaaatattactacttcatgctggtgaatgtatttcttggaagcataattgctggcacagcttttgaacagctagactcttttttcacgatcctccttcacaaataccaaggaccattggagtggctgtaccaatgaaagcaacattcttcatgacatacataatggtcgatggctgggccggcatcgccaatgagattcttcgagtgaagccactggtcatataccatctgaagaacatgttcatcgtgaaaaccgagcgggacagggagagggcgatggatccacggagcatcgcgctcggagaaaaccttccatccctgcagctgtacttcctccttgggctcgtgtacgcggtggtcacccccattctccttcctttcataatcgtcttcttcgccttcgcctaccttgtctacaggcatcagatcatcaatgtgtacaaccaggagtatgagagcgcggcggcattctggcctcaggtccattcgcgcatcatagcgagcctgctcatctcccatgtgactctctttgggctgctgagcacgatgaaagccgcctactccaccccgctgctcatcttcctgccgttgctgacactatggttccacaagtactgcaagagtcggttcgagcccgctttccgcaagtatcctctagaggaagcgatggagaaggacgtgatggagcacgcgtcggagccgagcctgaacctcaagacctacctggcaaatgcttacctgcaccccatcttccatatgtttgagcaggaggatcagaaagaggaggccaccatagaggtgagaatcgacaaatcggagcagcagcagcagcatgtgagaagctcacactcacagtatgaggaggagacgagcgcacagacgcattaccaccatgaggagaggagcagcagccggtaccagtaccagtaccagcaccagtatcagtaccagcacgaggaaactcacatgaggagtgagcagtcgccgccacactttgtctaccaccatggagtcgagcactgatgctgcgaatttaccactccctaacttgaccttttgcctcgcaatttcgtgaaaatgattgcccgtctagtccagtccagatgatgctgatgtttgatgtacatgccaatatgtagtcgtgtgatgataatctcatgagttgattgattttccttctgtaaatggagaaatcaattaccttgagtactaatgcgaatcggcgttggatggcgatacttacggcaactcccattaatccgaaagaacctaagtacctaactgccaaacatcttttggaattagggcaactcaatgttgcacatcaaaccgcttaatgcatcttcatattattctcg

SEQ ID NO: 5687 - DNA, 3675 bp, Zea mays
tcttaaatatttgacgcggatagttttttgaataaaagatatcaaataggagggagtatatacatatataataaataaaaaatctactacggagtattattgatttaatatcacaattgtttattatttatttttggttaactctgagatgcttataatttggaagagagggagggagtagaaaactcttgcaaagaaacctgcaactctgcaagcaaccccacaaggcagccgttctccactctccatctcgaggatcaaaagttcaaaacaacagagaccgaaactcgccatccaccagacagaaaaagcttccagctcccctcgccgaaactcgccgccgtctcctcgccttctgcctcgccaccggtcccgtcgcggtttcacacgcatccgtcgtactggccttcttcttccctcgtcgttcaccagttctcgcgcgctcaaccatgtgccatgcctaactggcgcctcgtttatctcgccctgcagcggtggacggagcaggctaggttgccggctgcccccggtcgtccctccttcgccgtcgagctggaggacacgcgtagcaacgccgggttcttctgcggcgagctgtggtgtggcctcatggagcccaagggcgagttggctcagaagcgtatccttccttctcgtttcgctcacccgtacgctattgaagaagcaatcaacagcttggaaattgatgctagcacgaaggcaagcaatgtcaacttgcctgctaagaaagacgcaagttcttcagatgcagtatcttgcatttcctccggcgatgcagctagtactgccaaggaaagtgaaatgaaccgagaaacttcttttggggaccaagggatgtattactatgggtattattatcctggttcatacggaggatgggatgagaatggctactttgttggatataatggcgtagaggtgcacccagcagtggttcaaactgacaatggttcatatctgtgtcatcttccgggatatgaaaatggatatgcttcttatagtcaggttgttcctggaggcattgctagtgtggatggtcaatatgtcagcaaagaaccatattattccactgcacttccaattcaggatcctaggacacctggcatttttgctcagccaattgcttacagaactgaactagcatctgcatactcatgggacccttctttcgttcttctggatggggttcagggacatccagttggtgtgcatcaaacaaattatgctgcaagaccaaaatattcttttaataagcatgttattccttcttcgaaagccacccgcagtgcaaaatccgcagcagatactgtcaaaggctcatcatcagctctagaaactgtaacaaatgctgtcaatagcagcccaccatcaaagagtgcaaataagacacctggtgcttccataacaaaaggatatcttccatatagcaagtctgtgatgcacactaataaccaagaaaaaaacagtgtttatcaaagcaaaggcatcaatgtgaaagaaagtggcagaagctggaacagccgagagaagcttgggagaagtaagctaaatggacagggtgattctgaatctaatgagaacaaccataccgataacctgaaacatagtttgagccatcggtctgatgttgttggattgtcaagtgcaggggatgccaatgctagcataccttcacctgttgcaataagcaaaaatgcatgcaatctttcagatttcgttacaaagtatgaacaagctctattctttgtaattaagtcctacagtgaagatgatattcacaagagtgttaagtacaatgtctgggcaagtactcctaatggaaataaaaggcttgacaatgcctatagggttgcacaggaaaggatagcagaaaaaggaaccaaatgtcctgttttccttttcttctcagttaatgcaagtggtcagttctgtggcgtggctgagatggttggtccagtagatttcaacaggaacatgaacttctggcaacaggacaagtggaatggtttcttctcggtaaaatggcacattatcaaggatgttcccaatccacaatttcgccatataattttggagaataatgagaataaacctgtgacaaacagcagggacacacaagaggtcaatttttcacaaggtacagagatgttgaacattttcaagaacttcacatgtaaaacatcaatactggatgactttgacttctatgaaaatcggcagaaagtaatgcaggacagaagaggcaagctgcttactacatcgtttgatcacccattgccaaaagctgaaaaatctccagaaattaaaagccaaacacaattgataagtggcccagaagttggtagagccaagagtgatgaggggcagggcaacaatgttgggatggtacttgatacaaccaagaaaaatgaggagcagagcagcaatgttccagaaatactcgatgcagcctgtagtaacaaggagcaacccaacaaaattgcaatagaaggatgatgcctcggctagttggtctgggaaaacgagatagcctctggaactgacttcaacctgaaatgataagtttgatgtgtgcaatatcaagaaaccaccattggtcatgggttctcttccattatctcatggaagcggggaaagggaaaaaatgaagcaaaggagctgtcttcccacgagaattgttcgatgactgggaaaaaaggttctaggactcatttaggttgaggaccctagtgctaaggcattagagcgccctccatgtctattttttccccatcttggagggtcctttcttttgtcgtgttgtgtctttttttctcttctttttttctattatactgcggctgatgtccaaagaagccagtctgccttatgggtgggtgtgctttaagggaatgtttgttgctttgtgggttgtcctctaggatgtggtatgttttgtttgttttctttaatctgtgcacttgttctagagactgacatagaagaaaagagaaaaaaagattgtgagggattaggaattaattacagtaacattatcttatgtctctgtttcttccattatcaagaaaagggaacaaaaaggattttaaaagctgttgatgtgtacttcgccgataccatttgtcttgcagcctgctacgagccttccgttttcgcttggttctttccggctaaattggttgttcgattcagacatctgtggttggccttcgcggcgttttgatttcgacggactgtgaactcgcatccagtcctttcggaaggggacatgctatctgtttgctttctggtgctgcgtacagatagcgtgtgtataaaaggtcaactttatcgacgctaccgtattgccttgtgaattgtttgtgaagaattttgtgtatgaaccaaatatgcttagtttttgttcggttgtataaggatcaaaggggatcgaagaggattaaggctttgtttggttttaccgggattgaggtggaataaatccacctaaatttgattttaaataaggagctaatcttactcaatgccttcgcaaccgaataagccctaataaaaatcttttatgttccgtttggatgttgatattagaggatatggaattaagttcaatatcaaatcagatatattacggaaatgagaactctgtattgggag

SEQ ID NO: 5688 - DNA, 2832 bp, Setaria italica
aacacacgcagtcacgcacccagccgccgtctctcgcgaatcaaaagttcaaaaccgcagcccgaaaatcggctatccaccagaaaaagcctcccacccaattaacccccctcgccgagactcgccgccgcctcctctgtcctctcctcgcctcccgcctccggcctccgtcgccttcgcctacgccgcttcgtgcgccgcggcagccgccctcccctcctcctcgttggctgccggcctccgcgcggcggccggagcaggctagggtaccggcggcacccccccggctcccttctcggtcgagctggaggacacgcgtagcagccccgggttcttctgcggcgagctctggtgtggcctcatggagcccaagggcgagctgggccagaagcctattgaagaagcaatggacagcttgaagattgatgctagcacgaaggcaagcaatgtcaacttgcctgctaagaaagacgcaagttcttctgatgcagtatcttgcatttcctcgggcgacgcagctagtactgtgaaggaaagtgaaatgaaccaagaagcttctattggggaccaagggatgtattactacggatattactatcctggctcatatggaggatgggatgagaatggctactttgttggatataatggcctagagatgcacccagcagtggttcaaggtgataatggctcatatttgtgttatctcccggggtatgaaagtggatatgcttcgtatagtccggttgttcctggaggcattactagtgcagatggtcaatatgtcagcaaagagccatattactccactgcaattccaatgcaagatcctagcacacctggcatttttgctcaaccaattgcttatggacctgaactagtccctgcgtactcatgggacccttcttttgttcttctggatggggttcagggacatccagttggtgtgcatcaaacaaattatgctgcaagaccaaaatattcttctaataagcatggtgttccttcctccaaagctgcccgcagtgcaaaatctgctccagaaactatcaaaggatcatcatcagctctagaaactttaccaaatgctgctaatagcatcccattatcaaagggtgcaaataaggcatctggtgcttccacaacaaaaggatatcttccatctagcaagtttgtgacgcatagtaataaccaaggaaaaagcagtgtttatcaaaacaaaggcattaatgtgaaagaaaatggtagaagctggatcaacaatgagaagcttaagacgagaagtaagctaaatggacatggtgattctgacatatctaatgagaatagccacactgataactcaaaacacagtttaagccctcgaggtgatgttgttggattgtcaagtgctggagatgctaacgagaccatactttcacctgtcacgataagcaaaaatgcatataatcttccagattttgttacgaagtatgagcaagctctattctttgtaattaaatcttacagtgaagatgatattcacaagagtatcaagtacagtgtctgggcaagtactcctaatggaaataaaaggcttgacaatgcctatagacttgcacaggaaaggatggcagaaaaaggaaccaaatgtcctgttttccttttcttctctgttaatgcaagtggtcagttctgtggtgtggctgagatggttggtccagtagattttaacaggaacatgaacttctggcaacaggacaagtggaatggtttcttttcagtaaaatggcacattatcaaggacgtgcctaatccacaatttcgtcacataattttggagaataatgagaacaaacctgtgacaaatagcagggacacacaagaggtcaaatttccacaaggtacagagatgctgaacattttcaaaaacttctcatgtaaaacatcaatattggacgattttgacttctacgagaatcggcagaaagtaatgcaggacagaaggggaaaaccacttactacgtcatttgatcacccattgccgaaagctgagaaacctgcagaaattaaaaagcaaacacaattgataagtggcgcacagcttgatacaaccaagaaaagtgaggaacagagcaacaatgttgcagaagtacttgatgtcgcccaaagtaataaagagctacccagcaaggttgcaacagaaggacgatgactgttgggctacttgagctgggaaaaatgagatagcctctgaaatggacttcaacctgaaatgataagtttgatgtgcgtaatgttgagaaacaatcattcttcaaggttcttccattctcatgccagcggaaaaggaaaaaggtgaagccatgaacctgtcttcccacgagaaacattcagtgattcaatgactgggaaaaaggttctgggacacatttagattgaggcccttggcaccgaggcattagagtgccctccttgtctattttttcatctgggagggcattttattttcttctgttgcatcttttttcttcttttcctattaagctgctgagattttgccaagcaatttgtgctgtggtctaaagaaggcagtttgcctcgtggccgggtgtttcttagggtatgcttgttgatgtgtgggttgtcctctaggatgtggtatgtgttggatgttttttcttttagaatttgtgtccttgttctaaaaaactgacattgaagaaaagaaaaaaggggggaggcggtgagggattaggaattgctagaattacaataacttcatatcgtgttgctgtttcttccattatcaagaaaaggaacaaaaaagatttgaaaagctgttgatgtgta

SEQ ID NO: 5689 - DNA, 3277 bp, Setaria italica
caaaattcatgcaatccaaacagtcctccaaatataaaggctgtgccaccaaataagcacgcagagtatcctactcctgccgtgtgggatacaaaggagtaattgaaaaataaacaaaaaaatatataccatccagaacgctacaaagctctggcaaagaaacctgcaagcaagcaagcacaaaaggcaaggcaacacacgcagtcacgcacccagccgccgtctctcgcgaatcaaaagttcaaaaccgcagcccgaaaatcggctatccaccagaaaaagcctcccacccaattaacccccctcgccgagactcgccgccgcctcctctgtcctctcctcgcctcccgcctccggcctccgtcgccttcgcctacgccgcttcgtgcgccgcggcagccgccctcccctcctcctcgttggctgccggcctccgcgcggcggccggagcaggctagggtaccggcggcacccccccggctcccttctcggtcgagctggaggacacgcgtagcagccccgggttcttctgcggcgagctctggtgtggcctcatggagcccaagggcgagctgggccagaagcctattgaagaagcaatggacagcttgaagattgatgctagcacgaaggcaagcaatgtcaacttgcctgctaagaaagacgcaagttcttctgatgcagtatcttgcatttcctcgggcgacgcagctagtactgtgaaggaaagtgaaatgaaccaagaagcttctattggggaccaagggatgtattactacggatattactatcctggctcatatggaggatgggatgagaatggctactttgttggatataatggcctagagatgcacccagcagtggttcaaggtgataatggctcatatttgtgttatctcccggggtatgaaagtggatatgcttcgtatagtccggttgttcctggaggcattactagtgcagatggtcaatatgtcagcaaagagccatattactccactgcaattccaatgcaagatcctagcacacctggcatttttgctcaaccaattgcttatggacctgaactagtccctgcgtactcatgggacccttcttttgttcttctggatggggttcagggacatccagttggtgtgcatcaaacaaattatgctgcaagaccaaaatattcttctaataagcatggtgttccttcctccaaagctgcccgcagtgcaaaatctgctccagaaactatcaaaggatcatcatcagctctagaaactttaccaaatgctgctaatagcatcccattatcaaagggtgcaaataaggcatctggtgcttccacaacaaaaggatatcttccatctagcaagtttgtgacgcatagtaataaccaaggaaaaagcagtgtttatcaaaacaaaggcattaatgtgaaagaaaatggtagaagctggatcaacaatgagaagcttaagacgagaagtaagctaaatggacatggtgattctgacatatctaatgagaatagccacactgataactcaaaacacagtttaagccctcgaggtgatgttgttggattgtcaagtgctggagatgctaacgagaccatactttcacctgtcacgataagcaaaaatgcatataatcttccagattttgttacgaagtatgagcaagctctattctttgtaattaaatcttacagtgaagatgatattcacaagagtatcaagtacagtgtctgggcaagtactcctaatggaaataaaaggcttgacaatgcctatagacttgcacaggaaaggatggcagaaaaaggaaccaaatgtcctgttttccttttcttctctgttaatgcaagtggtcagttctgtggtgtggctgagatggttggtccagtagattttaacaggaacatgaacttctggcaacaggacaagtggaatggtttcttttcagtaaaatggcacattatcaaggacgtgcctaatccacaatttcgtcacataattttggagaataatgagaacaaacctgtgacaaatagcagggacacacaagaggtcaaatttccacaaggtacagagatgctgaacattttcaaaaacttctcatgtaaaacatcaatattggacgattttgacttctacgagaatcggcagaaagtaatgcaggacagaaggggaaaaccacttactacgtcatttgatcacccattgccgaaagctgagaaacctgcagaaattaaaaagcaaacacaattgataagtggcgcacagcttgatacaaccaagaaaagtgaggaacagagcaacaatgttgcagaagtacttgatgtcgcccaaagtaataaagagctacccagcaaggttgcaacagaaggacgatgactgttgggctacttgagctgggaaaaatgagatagcctctgaaatggacttcaacctgaaatgataagtttgatgtgcgtaatgttgagaaacaatcattcttcaaggttcttccattctcatgccagcggaaaaggaaaaaggtgaagccatgaacctgtcttcccacgagaaacattcagtgattcaatgactgggaaaaaggttctgggacacatttagattgaggcccttggcaccgaggcattagagtgccctccttgtctattttttcatctgggagggcattttattttcttctgttgcatcttttttcttcttttcctattaagctgctgagattttgccaagcaatttgtgctgtggtctaaagaaggcagtttgcctcgtggccgggtgtttcttagggtatgcttgttgatgtgtgggttgtcctctaggatgtggtatgtgttggatgttttttcttttagaatttgtgtccttgttctaaaaaactgacattgaagaaaagaaaaaaggggggaggcggtgagggattaggaattgctagaattacaataacttcatatcgtgttgctgtttcttccattatcaagaaaaggaacaaaaaagatttgaaaagctgttgatgtgtacatcacagataccatgtgtcttgcagcctgctatgagcctttcattttcgcttggttctttctggccgaattgggtgtttgattcagacatctatggctggccttcgtcgtgtcgtgatgaatgaatatatatgtgtaagggggtgcttggatcctggagctaaagtttagttcgtgtcacatcgaatattcagaggctaattaggaggactaaatatgagttaattaaaaaattaattacacagatggagg

SEQ ID NO: 5690 - DNA, 2654 bp, Zea mays
gtttaaaactgcagagaccaaaaatcgccatccacgccagggaaacaaaagcttccacccaaacaaactcccctcgctgaaactcgccgccgtctcctcgccttccgcctcagcacaggccccgtcgcggtctcctaggccacgcttccgcctctcctcgtcggctgcccgcctccgcccggcggccggagcaggctaggttaccagcgccccccacttcgcggtcgagctggaggacacgcgtagcaacgccgggttcttctgcggcgacctgtggtgtggcctcatggagcccaagggcgagtcaggccagaagcctattgaagaagcaatcgacagcttgaagactgatgctagcatgaaggcaaacaatgtcaacttgcctgctaagaaagacgcaagttcttctgatgcagtatcttgcatttcctccggcgatgcagctagtactgtgaaggatagagaaatgaaccaagaaacttcttttggcgaccaagggatgcattactatggatattattatcctggtgcatacggaggatgggatgagaatggctactttgttggatataatggcctagaggtgcacccagcagtggttcaagctgacaatggttcatatctgtgttatcctctggggtatgaaaatggatatgcttcttatattccggttgttcctggaggcattgccagtgtggatggtcagtatgtcagcaaagaaccatattactccagtgcacttccaattcaggatcctagcacacctggcatttttgctcagccaattgcatatggaactgaactagtacctgcctactcatgggacccttttgttcttctggatggggttcagggacatccagttggtgtgcatcatacaaattatgctccaagaccaaaatattcttctaataagcatgttgttccttctttgaaagcttcccacagtgcaaaatccacagcagatactgtcaaaggatcatcatcagctctagaaactgtaccaaatgctgccaatagcagcacatcatcaaagggtgcaaataaggcacctggtgcttccataacaaaaggatatcttccatctagcaagtttgtgatgcacagtaataaccaagcaaaaagcagtgtttatcaaagcaaaggcatcaatctgaaagaaagtggtagaagctggcacagcagtgagaagcttaaagcgagaagtaagctaaatggacatggcgattctgaatctaatgagaacaaccacactgataactcgaaatatagtttgagctctcaatctgatgttgttggattgtcaagtgtaggggatgctaacgccagcataccttcacctgtcgtaataagaaaaactgcatacaatctttcagattttgttacaaagtatgagcaagctctattctttgtaattaagtcctacagtgaagatgatattcacaagagtattaagtacaatgtttgggcaagtactcctaatggaaataaaaggcttgacaatgcctataggcttgcacaggaaaggatggcagaaaaaggaaccaaatgtcctgttttccttttcttctcagttaatgcaagtggtcagttctgtggcgtggctgagatggttggcccagtagatttcaacaggaacatgaacttctggcaacaggacaagtggaatggtttcttctctgtaaaatggcacattattaaggatgttcccaatccacaatttcgccatataattttggagaataatgagaataaacctgtgacaaacagcagggacacgcaagaggtcaaattttcacaaggtacagagatgttgaacattttcaagaacttcacgtgtaaagcatcaatactggatgactttgacttctacgaaaatcggcagaaagtaatgcaggatagaagaggcaagccacttacatcgtttggtcacccattgccaaaagctgaaaaaactgcagaagttaaaaggcaaacacaattgataagtgccacggaagttggtagagccgatacaaccaaggaaaatgaggagaagagcagcagtgttccagaaatactcaacgcagcatgtagtaacaaggagaaacccaacaaaatcgcaacagacggatgatgccttggctagttgactgggaaaatgagatagcttctggaacggacttcaacttgaattcctgaaatcataagttcgatgtgcgcaatgtcaagaaaccacaattggtcatgggttctcttgcattttctcatggaagtgaagaaacgaaaaaagtgaagcaacggaactgtcttcccacgagaaatgttcaatgactgggaaaaaggttctaggacgcatttaggttgaggcccctggtgctaaggcattagagcgccctccttgtctgtttttcccccatattggagggtcgtttcttttcttttgtcgtgcccctttttcccctcttcttttgcctattattctgcagctgagattttgggaagcagtttgcacttaggtccaaagaaagggaatgtctgttgctttgtgggttgtcctctaggatgtggtaggtgttgactgttttttagaatctgtgcacgttctagaaactgacagaaaaaaagagaaaaaaggattgtgagggattagaaataaaaaggatcttaaaaag

SEQ ID NO: 5691 - DNA, 3431 bp, Panicum virgatum
cgatggatggattcgtgcgttcatgtgtttgctgttggtgcttttgcgtgctttctgttggatcaataaaatttctggaactgttttgatgtggagtgctggagaattttggcgttccccttgctattgaacttcattgttgccctcctaaaatgcttttgcgttagtccggcttctgggaaacaaagaagaggagcatctcaacccgggggtgccctattggatcaccgtttgcaagaacttatcgccgaattgtctgtgcagttttttctttttcatgacctagctctgtagaattttgatcaaaacttttgatccgttttaaatttgatcttgacagttgacattactgagcctttcggttccatttgttatcattaccagttcagtaatatatactattattaggtgcccttcattattggggtttgagagatagtgagagctgagccaactcccatttatctgacaggtacaccaataatatggtgcctgcactgaaggattccggtatattgtttaggctagtggtgcatgtatcagtccctcaaatctagctcaatcggagttcccttgctgcccttgtttgtgatatagaaattaaattatctgtactttaatcaatttatttgtatatttatttttagatctgtccacacgatgagttgatggaggacaattattaactgcacaatatcagcctggtgttatgtttgtgggtcattatggtgtggttggcttattttattggccactcgtggacaatgacccttagaagtatatattctgtttgcaacccttgacttttctatcatccagctatcgaagaagcaatggacagcttgaagattgatgctagcacgaaggcaagcaatgtcaacttgcctgctaagaaagacgcaagttcttctgatgcagtatcttgcatttcctcgggcgatgcagctagtactgtgaaggaaagcgaaatgaaccaagaagcttctactggggaccaagggatgtattactacgggtattactatcctggctcatatggaggatgggatgaaaatggctactttgttggttataatggtctagagatgcacccagcagttgttcaaggtgataacgggtcatatttgtgctatctcccagggtatgaaaatggatatgcttcttatagtccggttgttcctggtggcgttactagtgcggatggtcaatatgtcagcaaagagccatattatcctactgcaattccaatgccagatcccagcacacctggcatttttgctcaaccaattgcttatggacctgaactagtccctgcatactcatgggacccttcttttgttcttctggatggggttcagggacatccagttggtgtgcatcaaacaaattatgctgcaagaccaaagtattcttctaataagcatggtgttccttcttccaaagctgcccgcagtgcaaaagctgctccagaaactatcaagggatcatcatcggctctagaacctttaccaaattctgctaatagcaacccattatcaaagggtgcaaataaggcatctggtgcttccataacaaaaggatatcttccatctagcaagtttgtgacacataataataaccaaggaaaaagcagtgtttatcaaaacaaaggcatcaatgtgaaagaaagtggtagaagctggaccaacagtgacaagcttaagacaagaagtaagctaaatggacatggtgattctgacatatctaatgagaatagccacactgatgactcaagacacagtttaagccctcgaggtgatgctgttggattgtcaagtactggagatgctaacaataccataccttcacctgtcgcaataagcaaaaatacatataatcttccagattttgttacaaagtatgagcaagctctattctttgtaattaaatcttacagcgaagacgatattcacaagagtatcaagtacaatgtctgggcaagtactcctaatggaaataaaagacttgacaatgcctatagacttgcacaggaaaggatggcagaaaaaggaactaaatgtcctgttttccttttcttctctgttaatgccagtggtcagttttgtggtgtggctgagatggttggtgcagtagattttaacaggaacatgaacttctggcaacaggacaagtggaatggtttcttttcagtaaaatggcacattatcaaggatgtgcctaatccacaatttcgccacataattttggagaataatgagaacaaacctgtgacaaatagcagggacacacaagaggtcaaatttccacaaggtacagagatgttgaacattttcaagaacttctcatgtaaaacatcaatattggacgactttgacttctacgaaaatcggcagaaagtaatgcaggacagaaggggcaagccacttgcttcatcatttgatcacccattggcaaaagctgaaatatctgcagaaattaaaaagcaaacacaattgataagtggcacacagcttgatagaactaagagtaatgaggggcagggcagtactgttggtatggcacctgatacaaccaagaaaaatgaggagcagagcaacaatgttgcagaagtacttgatgttgtccagagtaataaggagctacccagcaaggttgcaacagaaggatgatgactgtttgagctacttgatctggggaaaatgagatagcctctgaaattgacttcaacctgaaacgataagtttgatgtgcgtaatgtcgaaaaacaatcattctgcaaggttcttttccattttctcatgccagcggaaaaggaaaaaggtgaagccatgaaactgttttcccacgagaaacattcgatgactgggaaaaaggttccgggacatttggttcaggccctcagtgcccaggcattagagcgccctccttgtctattttttcatctgggagggcactttcttttcttctgttgaatctttttctcctccttcctattaagctgctaaggttttgccaaggaatttgtgctgtggttcaaagaagctagtttgcctcacggccgggtgtttcttagggtatgttgatgtgtgggttgccctctagaatgtggcatatgttggatgttttcttttagaatccgtgtccttgttctaaaaaaactgacatagaaaagggggaaaaaaaggaaaaaaggggtatactgtgagagattaggaattgcttgctagaattacaatggcttcatattgtgttactgtttcttccattatcaagaaaagggacaaaaagaattgaaaaggcgttgatgtgcgcagcccgttacgggcctttcattctcgcttagttctttctgggcgaattgggtgtttgattcagacgtctgtggctggccttcgtcgcgtcgtgatgggtggatatgtataaagctgccg

SEQ ID NO: 5692 - DNA, 1537 bp, Zea mays
tcagttacggagttaccgtcgccagcagtctccgcgccacacctgtcagcacaacctatccgatttccgggctcatcccgacgtacagcgtcacatcggcgtcgccgcgatgctactcctcccggggcgtccagtgctctcgccggcgctgcagtactcctcctcgccgtcaccatcccgtctccgccccctcccttgcaccagcaacgcccccacatctgcttccaccgccgcagacgctgccacgccctcgtccttctccgtcgaagactacctcgtgaacaggtgcaatctctacgccaacgtggccgcgcgcgtggcgccggagctctccgccatcaggtctccctcgaaacccgacgccgtgctcgccttcctcgccaacacgctcgagctctccccgccgctcattgccgtggcagtggcccgcgacccgacgatactcacctgcagcgtgccaaggacgctcgcgccgcgcgcggaagagctccgcgccctcggtttcaccgcgtttcagatgggccttatcgtcgcgcgttgcggcgcggccgcattccgctcacgcgcgctcgtccccagtgtccagttctggctcccgtatcttcgtggtcgcgtcgacaagctcgtcgccgcgctcaagggcaacccgggcctcctcaccgccgacctccggacggtcaagtccaccgtcgcgctgctccaagaggaaggcaccctcaccgatggcgacgtcggctggttcgccatctcatactgctccaagctgcttgtcgcgagcccggacgaggtcgactccgtcctagcccgcgccgacgagttcggcgtgccgcgcaagacgcgggcgttcaaggacgcgatcatcgcggcgttcagcgtcactccggagcggctcgcatggaaggtcgcgttcttcagggacgagctcgggtggacggaggcgcaggtgaagacggcagctgcgaagatgccgacgctgatgacggtctccgcggagcggatccggaggaactgggagttcctgaccacagaggtcgggatggacgcggagcgcgtggccagcttcccggcgctgctgaggtacgacctggaggggcggctggtgccgcggttccaggtgatgagggtgctgcaggcgcggcggctgtggcgcggcagggacttcaacaacatcgctgccatcacggaggaggatttcgtggccaagttcatcaggccatttctggtcaaagtcccaagcttggccaagatctacgaggccgctgtcatcgagaaggaagaacagtagcgggatagtgtatcatcagtgggatgctggacaaccggagagctgatgatccctgtagatagccaggcatatgcaactccgttgtagattttagttttgataaaaggattacatgcctttaatgcaaagattagattcaacatgaaactgttgaactgtgtaaagtgagaaacaacttttgaacacaggagtccggagcttctattgtgaaggcgtggtataattgccatttttttctatagaattgtctgc

SEQ ID NO: 5693 - DNA, 1632 bp, Setaria italica
gttggacggacggttgttggtagttgttaccgccgggcttgcagtctcgcggcgcatcgctcagccagtgagcgttcctatccgattcccatccgccggttcatctcgaggccgtcacgccggtgttgccgcgatgctcctcctcccgaggcatccagtcctctcctcgccggcgctgccatcctccccctccccatctccatcccgcttccgccccctcccctgcaccaacgcgtccacctctgcttccaccgccgcacctgcaggcgccttctcggtggaggactacctcgtgaccaggtgcaacctctaccccaacgtggccgcccgcgtggcgccggagctctccgccatcaagtcgccctccaaccccgacgccgtactggccttcctcgcctccgcgctggagctctcccctccgctcgtcgccgtcgccgtggcgcgcgacccggcggtactcacctgcagcgtgccgaggacgctcgccccgcgcgcggccgagctccgcgcgctcggcttcaccacgttccagatgggcctcctcatcgcgcgctgcggcgcggccgcgttccgttcgcccgacctcgtccccagggtccagttctggctcccgtacctccgcggccgcgtcgacaagctcgtcgccgcgctcaagggcaacccgggcctcctcgccgcggacctccggacggtcaggcacaccgtcgcgctgctccaggaggaaggcaccctcaccgacgacgacgtcggctggttcgccatctcctactgctccaagctgctcaccgcgagccccgacgaggtcgacgccgtcctggcccgcgccgacgggttcggcgtgctgcgcaggacgcgggcgttcaaggacgcgatcatcgcggcgttcagcgcgacgccggagcggctcgcctggaaggcggcgttcttcagggacgagctcgggtggacggaggcgcaggtgaagacggcggcggcgaagatgccgacgctgatgacggtctccgcggagcggctgcggaggaactgggagttcctgaacacggaggtgggcatggacgcggagcgcgtcgccagcttcccggcgctgctcaggtacgacctggaggggcggctcgtgccgcggttccgggtgatgagggtgttgcaggcgcggcggctgtggcgcggcagggatttcaacaacatcgccgccatcacggaggaggacttcgtggccaagttcatcaggccgttcctggtcaacgtcccggacctggccaaggtttacgaggccgccattgtcaagaaggaagcagtgaagcacagtagttgatggtggccgttcctgctagacaactggagagctgtaaatccctgtggatttcgcaagattttccggccggtgtatgtaactccgatgtagagtacaagtacagttctgatgaaaatgaaacgtttcatatggctttgatgtaaagattagatactactggaatgaaattgctgatctgtgttaaactggccctgccgttagtataggaccttgtttagttaccaaaatttggagtgccaaaattactgtgctagcactgtagcatactgtagcgtttcgtttgtatttgtaaattattgtcaaaatattgactaattagg

SEQ ID NO: 5694 - DNA, 1580 bp, Setaria italica
gacggacggttgttggtagttgttaccgccgggcttgcagtctcgcggcgcatcgctcagccagtgagcgttcctatccgattcccatccgccggttcatctcgaggccgtcacgccggtgttgccgcgatgctcctcctcccgaggcatccagtcctctcctcgccggcgctgccatcctccccctccccatctccatcccgcttccgccccctcccctgcaccaacgcgtccacctctgcttccaccgccgcacctgcaggcgccttctcggtggaggactacctcgtgaccaggtgcaacctctaccccaacgtggccgcccgcgtggcgccggagctctccgccatcaagtcgccctccaaccccgacgccgtactggccttcctcgcctccgcgctggagctctcccctccgctcgtcgccgtcgccgtggcgcgcgacccggcggtactcacctgcagcgtgccgaggacgctcgccccgcgcgcggccgagctccgcgcgctcggcttcaccacgttccagatgggcctcctcatcgcgcgctgcggcgcggccgcgttccgttcgcccgacctcgtccccagggtccagttctggctcccgtacctccgcggccgcgtcgacaagctcgtcgccgcgctcaagggcaacccgggcctcctcgccgcggacctccggacggtcaggcacaccgtcgcgctgctccaggaggaaggcaccctcaccgacgacgacgtcggctggttcgccatctcctactgctccaagctgctcaccgcgagccccgacgaggtcgacgccgtcctggcccgcgccgacgggttcggcgtgctgcgcaggacgcgggcgttcaaggacgcgatcatcgcggcgttcagcgcgacgccggagcggctcgcctggaaggcggcgttcttcagggacgagctcgggtggacggaggcgcaggtgaagacggcggcggcgaagatgccgacgctgatgacggtctccgcggagcggctgcggaggaactgggagttcctgaacacggaggtgggcatggacgcggagcgcgtcgccagcttcccggcgctgctcaggtacgacctggaggggcggctcgtgccgcggttccgggtgatgagggtgttgcaggcgcggcggctgtggcgcggcagggatttcaacaacatcgccgccatcacggaggaggacttcgtggccaagttcatcaggccgttcctggtcaacgtcccggacctggccaaggtttacgaggccgccattgtcaagaaggaagcagtgaagcacagtagttgatggtggccgttcctgctagacaactggagagctgtaaatccctgtggatttcgcaagattttccggccggtgtatgtaactccgatgtagagtacaagtacagttctgatgaaaatgaaacgtttcatatggctttgatgtaaagattagatactactggaatgaaattgctgatctgtgttaaactggccctgccgttagtataggaccttgtttagttaccaaaatttggagtgccaaaattactgtgctagcactgtagcatactgtag

SEQ ID NO: 5695 - DNA, 1956 bp, Panicum virgatum
ctccgtaggctgttcgtctgttatcggcgaggtctcgcggcgcgtcgcgctcatccagagacatccactgagccatctcctatccgatacccatcagccgccggctcatctcgaggccgtcacgcacgccggcgttgctgcgatgctgctcctgccgaggcagccagtcctctccgccccggcgctgccatccttcccctccccctcgctccctccatcccgcttccgccccctcccctgcaccgactcgcgcacctgtgcttccaccacggcatcagcagacgccacctctgcttccagcgccgcatcagctggagccttttcggtggaggactacctcgtgaccaggtgcaatctctaccccaacgttgccgcccgcgtggcaacggagctctacgccatcaagtcgccctccaagcccgacgccgtgctggccttcctcgcctccgcgctggagctctccactccgctcatcgccatcgccgtggcgcgcgacccgaccatactcacctgcagcgtgtcgaggacgctcgcgccgcgcgcggacgagctccgcgcgctcgggttcaccacgttccagatgggcctcctcgtcgcgcgctgcggcgcggccgcgttccgctcgcgcgagctcatctcgagggtccggttctggctcccgtatctccgtggccgcgtcgacaagctcgtcggcgcgctcaaggtcaacccgggccttctcagcgcggacctccggacggccaggtccaccatcgcgctgctccaggaggagggcaccctcaccgacgacgacgtcggctggttcgccctatcctactgctccaagctgctcaccgcgagcccggacgaggtcgacgccatcctggcccgcgccgacgagttcggcgtgccgcgcaggacgcgggcgttcaaggacgcgatcatcgcagcgttcagcgcgaagccggagcggctcgcctggaaagccgcgttcttcagggacgagctcgggtggacggaggcgcaggtgaagacggcggcggcgaagatgccgacactgctgacggtctccgcggagcggctgcggaggaactgggagttcctgaccacggaggtcggcatggacgcggagcgtgtcgccaacttcccggcgctgctcaggtacgacctgcagggccggctcgtgccacggttccaggtgatgagggtgctgcaggcgcggcggctgtggcgcggcagggatttcaacaacatcgccgccatcacggaggaggacttcgtggccaagttcatcaggccgttcctggtcgaagtcccaaatttggccaaagtttacgaggccgccgttgtcaagaaggaagcacagtagtagctggccaaagtttacgagatgctggacaataggagagctcctaattcctgtggatttctcaataacgccgatgtagagtacagttccaacaaaacatttcagatggctttgatgtagatagtagcatgaagctgctgatccgtgtaaactgacgagcaactcttggacaatggcactgctattggaattggtgtagtagtagtagtagtagtacagttgttattttgcggagcattcactcttgagcaaatgcagttgatagggagctggataagaaaagctccccggagcggctgctccaggccagcgactggaactactggctcctcacctccgacctcgagagggtggtcgagcccaacgtcgcgtacctcaagcagtgcgggctcagcgccgccgacatcgccaagctgctcgtcgccgcgccacggctcgtcaccatgcacccggagtacgttcaggacgccgtgcgacgcgccacgcagctcggcgtggcgcccggctcccagatgttccgccacgcgctctctaccgcgggatgcatcggccaggagaaggtcgacgccaaggttgccgtcctgaaagagacgctcggctggtcgcag

SEQ ID NO: 5696 - DNA, 1493 bp, Panicum virgatum
tccactgagccatctcctatccgattacattcgccgggtcatctcgaggccgtcacgccggtgttgctgcgatgctcctcctcccgaggaatccagtcctcaccgccccggcgctgccatcctccccctccccctcgctctctccatcccgcctccgcccctcccctgcaccgactcgcgcacctgtgcttccaccacggcatcagcagacgccacatctgcttcccccgccgcatcagctggcgctttctcggtggaggactacctcgtgagcaggtgcaatctctaccccaacgttgccgcccgcgtggcgccggagctctcggccatcaggtcgccctccaagcccgacgccgtgctggccttcctcgcctccgcgctggagttctccactccgctcatcgcctgcagcgtgctgaggacgctcgcgccgcgcgcggacgagctccgcgcgctcgggttcaccacgttccagatgggtctcctcgtcgcgcgctgcggcgcggccgtgttccgctcacgcgagctcatctcgacggtccagttctggctcccgtatctccgtggccgcgtcgacaagctcgtcgccgcgctcaagggcaacccgggccttctcagcgcggacctccggacggtcaggtccaccatcgcgctgctcctggaggagggcaccctctccgacgatgacgtcggctggtttgccatatcctactgctccaagctgctcatcgcgagcccggaagaggtcgacgacgtcctggcacgcgccgacgagttcggcgtgccgcgcaagacgcgggcgttcaaggacgccatcatcgcggcgttcagcgcgaagccggagcggctcgcctggaaagccgcattcttcagggacgagctcgggtggacggaggcgcaggtgaagacggcggcggcgaagatgccgacgctgctgacggtctccgcggagcggctgcggaggaactgggagttcctgaccacggaggttggcatggacgcggagcgtgtcgccaacttcccggcgctgctcaggtacgacctggaagggcggcttgtgccgcggttccaggtgatgagggtcctgcaggcgcggcggctgtggcgcggcagggatttcaacaacatcgccgccatcacggaggaggatttcgtggccaagttcatcaggccgttcctggtcaaagtcccaaacttggccaaagtttacgaggccgccattgtcaagaaggaagcacagtagctggccaaagtttacaagatgctcgacaattgaagagctcctagttcctgtagattttcgcaagattgtgcggcgagtgcatgtagagtacaattcgtatgaaacatttcaaatgcaggcttttatgtaaagagtagatagtagcatgaaactgctgatccgtgtaaactgacgagcaactcttggacaatggcagtgctattggaatttttttttgagggggtattgctattggaattggtgtagtaca

SEQ ID NO: 5697 - DNA, 2361 bp, Pennisetum glaucum
ggctgccgcggaggcgatccctgcctgctcctgctcctgctctgctccccatgagagcagcagcacaacccgccctcaggcaagtgaatggttttggtcttctgctgaaacttgattcatcagtcaatatccaagtttgttctgtatacactttctctcttgattgattagtgagtagccaaaactgtattatggctacttattactcaagcccaggtagtgaaagggactcacagaacatgtactcaagagacccgggcaatgcatcctatcctatgccatcagctctagggaacttgctttatctgaacaattctacttccgggccatacacggaattcagtggcattctgcagcctcagcagaatttcatggagatgcctgaccctgggcatccttcagtgatgtcccaagactcatctgctagggagtctgacatgcttggttcccaccaggggcagagctcttttggtccagtcaaggatatgaaaaatgagatgttgatgcacatgatggatggatcacaaagcagcacagctgatctcatccacgatgatgcccacaatggtgcgcagcttgattttggtgttctgaacaaccacagctcatcgaacattccctcagtgcaaggccaaggtttatctctgagcctcaacacacaaatcctggcaccttccttaccatactggtctgtcaaaccagacatgttgtcaccgcactcttaccatgacagtcttcgagttgatgacatccgaatgaagagtatgcagtctgaggcgtcacgtgcaatccggaactccaggtatctgaaggcagcacaagaactgcttgatgaggttgtgaacgtttggaagaatattaagcagaaagctcagaaagaacaagtcgaagccggaaaaacagatggcaaagagaccgagggaggggcaaaaagtgagggctctaatccgcaggagtctgctgccaatgcagcacctgagctttctactgctgagaagcaagagcttcagaacaagatggcgaagctgatggctatgttggatgaggtggaccggaagtacaagcactactaccaccaaatgcaaagtgtggtttcatcttttgatgtggtagctgggcctggagcagccaagccttacactgcagttgccctccagacaatctcgcgacacttccggtgcctgaaggatgctatcaatgatcagatcaatgtcatcaggaagaagcttggcgaggaggaaaattcatctggcaaggagggcaaattaactcgtctacggtacatcgatcagcagctaaggcaacagcgggctttccaacagtatggcatgattccacaaaatgcttggcggccacagagagggcttcctgaaaactctgttaccattcttcgtgcttggctctttgagcatttccttcacccataccctaaagattctgaaaaaatgatgctagcaaggcaaacaggcttgacaaggagtcagatttcaaattggttcatcaatgcccgtgtccgcctttggaaaccgatgattgaggacatgtacaaagaagagattggagacatcgagcaagactccaactcttcctccgacaatgcgccaagaagcaagggcaaaatggcgtcttctgaagacaaggaggacctgaaaagctccacacctcgagtctgtgacagcagccagctgagcgagtcgagagccagcatagggactatgaacatcggcggagcacctgtcggattccataacgagcccaaccctgacgacagcttcatgaacctgatgctgaaagaccagcgatccaacgaagcagatggtggcctcctcctccacaacgccgtcgcacatcaccaagatgagaacgccaggttcatggcctaccacctggcagagcttgggagatatgggaatggcaacgtctcgctgacactgggcttgcagcactccagcagcagcctctcggttcctaacgcccatcaccagcagagctttcctggtgtcggagacgacgacatctacaacgctaccgctcctctcggtgtgagcatcgcgtcttcggactatgattcaatgaaccaaatggatcaacggcagcggttcgagcaatcgcctctcctgcatgattttgtggcctgaacgctcaacacctctcaagatttgtaacacctggctttttggctgggtgaataacatatatacatatgcctaaaaggagcattgggtcgtagcctgtagtttcaattcgacacagattggaggtatagcaggaaatgtaatatagtgtaggtggtggggtgatagcataaaaaaggatcttgtaaagatgaaacacactatactatacatgtaaaagcttgtg

SEQ ID NO: 5698 - DNA, 2508 bp, Triticum aestivum
cctctatcttactctctccatagcccggtggaggaggaggagatcagctttggatgcaatcttcttcttcttctgcctgccccccacgaggagcacaccctcgcccccagattgatcaggaagccatcctcgcatcggtaacgcgctagcggagcgtcttcgaggggtttcatgttggtttaacaaggaggttggattgatcttgtactgaaacttgctactggttgttcataatatctatgcttcacggtgatctgggtcagtaaaagagagatggctacttactactcgagccctggcagcgaaagagagtcgcaagacatgtactcgagagacccgggcggtgcatcctatccgatgtcgtctgctctgggcaacttgctctatctgaacaatccatcttctgggccatacactgagttcagcggcattctgcagactcagcagaacttcatggagatgcctgcccatggccatcattctgcaatgtcccaggactcatcggcaagggagtcgcaggacatgcttgcttcccaccatgggcaacgctccttcggtcatgtgaaagatatgaagaatgagatgttgatgcatatgatggatggagcacagagtggtggtgctgaactcatccatgatgatccccacaatggtgcacagttcgagtttggtgtcctgaacaaccatgactcgtcggatgttccggttgggcaagggcaagggcaagggcaagggctgtctctgagcctcaacacacaaatcctcgcgccgtccttgccatactggtccatcaaaccagacatgttgacgccaaactcttaccaggaaagccttagaatagacgacatccggatgaagaacatgcagtctgaggcctctcgtgcgatccggcactcgaggtatctcaaggcagctcaagaagtgctagatgaagttgtgaatgtttggaagaacatcaagcagaaagctcagaaagagcaagctgaaccaggtaaagcagatggcaaagagaccgatggagggccaaaaagcgagggcgcgtcgcaagaatccggcgcaaatgcagcacctgagctgtccactgctgagaagcaagagcttcagaacaagatggccaaactgatggcaatgttggatgaggtggaccggaaatacaagcactattaccaccaaatgcaaaatgtggttgcatctttcgacatggtggctgggcccggatctgccaagccttacaccgcagttgctctgcagacaatctcgcgacacttccggtgcttgaaggacgctatcaatgatcagatcaatgctatcaggaagaagctcggcgaggaagaaaatccgtctagcaaggaaggcaaattgacccgtcttcggtacattgatcagcagctaaggcagcagcgtgctttccaacagtacggtatgattcctcagaatgcctggagaccgcagaggggattgcctgaaaactcggttacagttcttcgcgcttggctctttgaacacttccttcacccgtatccaaaagattctgaaaagttaatgcttgcaaggcagactggcttgacaaggagtcagatttcgaattggttcataaacgctcgtgtccgcctttggaaaccaatgattgaagacatgtacaaagaagagaccggtgatctggagcaagactccaactcttcctccgacaatgtgccgagaagcaagagcaaagtggcatcttcagaagagaatgaagatctgaagaacgccagggctcgggtttgcgagaccagccagctaagcgagtcgagagccagcatgggaactatgaatgttggcggggcacctgttagcttccagaacgagcccaaccccgacgacagtttcatgaacctgatgatgaaggaccagcgatccggtgaggcggacggaggcctcctcctccacaacgccgtcgcgcagcactcggacgagagcgcgcggttcatggcctaccacttggcagagcttgggaggtacggaaacggcaacgtatcgctcacgctcggcctacagcactctggcagcggcctctcggttccaaatgcccaagcaaacttcgccggtgtcggtgacgacgacatctacaatgccggtgctcctctcggtgttagcattgcatcttcagactacgaatctttgaaccagatggatcagcggcaacgcttcgagcaatcgcctcttttgcatgattttgtggcctgaatgatgatgatacgtcagatcaggaccattgacacaaagattgggtgggggtgacagcatttgtaaactcctagtggcagaataataacatgcctacaagagcatggggttgtagtttgtagttgccatttgatacaggagagggggtatagcaggaaatgtaatataaagcgtaggtggtgggggtgatagggggtggtaaagatggaaaatcttttgttgtaaagataaaatgcaatttactatatatacgtgtaaaagctttgtgctcagtattgtaaa

SEQ ID NO: 5699 - DNA, 2202 bp, Secale cereale
cccccacgaggcgcacacccccgcccccagattgatcaggaagccgtcctcgcatcggcgacgcgctagcggagcgtcttcggggtgtctcgtgtcggtttaacaaggtactcctggaaaacggaggttgaactgatcttctgccgaaacttgctactggttctgcgtaatatctatgctttgctgtaatctcggtcggtaagtattcaggaccaggagatggccacttactactcgagccctggcagcgaaagagagtcgcaagacatgtactcgagagaccccggcggcgcatcctatcccatgtcctctgctctgggcaacttgctctatctgaacaacccgtcttctgggccatacacggagttcagcggcattctgcagtctcagcagaatttcatggagatgcctgctagccatggccatcattctgcaatgtcccacgactcatcggcaagggagtcgcacgacatgcttgcttcccaccatgggcaacgctcgttcggtcatgtcaaagatatgaagaatgagatgttgatgcatatgatggacggagcacagagtggtggtggtgctcaactcatccatgacgatccccacaacggtgcacacttcgagtttggtgtcctcaacaaccatgactcgtcggatgttcccgtaggccaaggccaaggccaaggccaagggctgtctctgagcctcaacacacaaatcctcgcgccgtccttgccatactggtctatcaaaccagacatgttgacgccaaactcttcttaccaggaaagccttagaatagacgacatccgcatgaagaacatgcagtctgaggcctctcgtgcgatccggcactcgaggtatctcaaggcagctcaagaagtgctagatgaagttgtgaatgtttggaagaacatcaaacagaaagctcagaaagagcaagctgaaccaggtaaagcagatggcaaggagaccgatggagggccaaaaagcgagggcgcgtcgcaagaatccggcgcaaatgcagcacctgagctgtccactgctgagaagcaagagcttcagaacaagatggccaaactgatggcaatgttggatgaggtggaccggaaatacaagcactattaccaccaaatgcaaaatgtggttgcatcttttgacatggtggctgggcccggatctgccaagccttacaccgcagttgctctgcagacaatctcgcgacatttccggtgcttgaaggatgctatcaatgatcagatcaatgttatcaggaagaagctcggcgaggaagaaaattcgtctagcaaggaaggcaaattgacccgtcttcgctacattgatcagcagctaaggcaacagcgtgctttccaacagtacggtatgattcctcagaatgcctggagaccgcagaggggactgcctgaaaactcggttacggttcttcgcgcttggctctttgaacacttccttcacccgtatccaaaagattctgaaaagttgatgcttgcaaggcagactggcttgacaagaagtcagatttcgaattggttcataaacgctcgtgtccgcctttggaagccaatgattgaagacatgtacaaagaagagaccggtgatcttgagcaagactccaactcttcctccgacaacatgtcgagaagcaagaacaaagtggcatcttcagaagagaatgaagatctgaagaacgccagggctcgggtttgcgaaaccagccagctaagcgagtcaagagccagcatcggaactatgaatgttggcggtgcacctgttagcttccagaacgaggccaaccctgatgacagtttcatgaacctaatgatgaaggatcagcgatccggtgaggcggatggaggcctcctcctccacaacgccgtcgcgcagcactcggacgagaacgcacggttcatggcctaccacttggcagagcttgggaggtacggaaacggcaacgtgtcgctcacgctgggcctacagcactctggcagcggcctgtcggttccaaatgcccaagcaaacttccccggtgtcagtgacgatgacatctacaacgccggtgctcctctcggtgttagcattgcatcttcggactacgaatctttgaaccagatggatcagcggcaacgcttcgagcaatcgcctcttttgcatgattttgtggcctgaatcatgatgatacatcggatc

SEQ ID NO: 5700 - DNA, 2504 bp, Avena sativa
tctcgcatcgataacgcgctagttgaagcatctctgaggagtcttatactagttaaacaagggagttgttagtagaagattttaatctgatcaacactgaacttgtgctgaaacctgaccgagtttcgttgcaagaaagctggttctacataccatctatgctcggcagcaatctcggtcggcgagcgatcagaacttgagatggctacttactactcgagccccggtaatgaaagagagtcgcacgacatgtactcgagagacccgggcagtggatcctacccgatgtcgtcggctctaggaaacttgctctatctgaacaacccgtctcctgggccatacacggagttcagcggcatcctgcagtctcagcagaactgcatggagatgcctggccatcatgggcaccattccggaatgtcccacgactcatcggcgagggagtccgacatgcttgcgcgctctttcgggcatgtcaaggatatgaagaatgagatgctcatgcacatgatggatggagcacaacagagtggtactggtgctgaactgatccatgacgacgcgcacaacggcgggcagtttgagtttggtgttctgaataaccatggctcaccaaatgttccgtcagggcaaggccaggggctgtctctgagcctcaacacgcagatcctggccccttccttgccttactggtccatcaagccagacatgctgacaccgagctcttaccacgacagcctcagagtcgacgacatccggatgaagaacatgcagtccgaagcctcgcgcgcgatccggcactcgaggtatctgaaggcggcacaagaagtgctagatgaggttgtgaatgtttggaagaatataaaacagaaggctcagaaagagcaggctgaaccagggaaagcagatggcaaagagactgatggtgggccaaaaagcgaaggcccgcaagaatccggggcaaatgctgtacctgagctttccactgctgagaagcaagaacttcagaacaagatggccaaactgatggcaatgttggatgaggtggaccgtaaatacaaacactattaccaccaaatgcaaaatgtggtttcatcctttgacgtggtggctgggcccggatctgccaagccgtacaccgcagttgctcttcagacaatctcgcggcacttccggtgcttgaaggatgccatcaatgatcagatcaatgttataaggaagaagctcggcgaggaagagaattcatctgggaaagaaggcaaattgacccgtctccggtacatcgatcagcagctgaggcagcagcgagctttccagcagtacggtatgatcccgcaaaacgcttggagaccacagagggggctgcctgaaaactcggttacggttctccgcgcttggcttttcgaacacttccttcacccgtaccctaaagactcagaaaagctaatgctagcaaggcagactggattgacaaggagccagatatcgaattggttcatcaacgctcgtgtccggctttggaaaccaatgatcgaagacatgtacaaagaagagaccggtgatcttgagcaagactccaactcttcctccgacaatgttccgagaagcaagaacaaagtggcaacttcagaagaaaacgaggatctgaagaacgccagggctcgggtctgcgaaaccagccagctaagcgactcgagggccagcatcggcgccatgaacgtcggcggggcgcctctcaggttccagaacgaggccaaccatgacgacagtttcatgaacctgatgatgaaggagcagcgatcaggcgaggcggacgggggcctcctcctccacaacgctgccgtcgcgcagcactcggacgagaacgcgcggttcatggcctaccacttggcagggtttggtggtaggtacgggaacggcaacgtgtcgctgacgctgggcttgcagcaccccggcagcggcctctcggttccgaacgcccaggcgaacttccccggtgtcggcgacgatgacatctacaacgccggtgcgcctctcggtgtcagcatagcgtcttcggactatgaatctttgaaccagatggaccaacggcagcggttcgagcagtcgcctctgctgcatgattttgtggcctagatgatgatacatcaggaaaaggaccattgacacaagaattgtaaaactcctagtggcagaagaataacatgcctgaaagagcatgcatggggttgtagcttgtagacagttgccattggatacaggagaggtatagcaggggatgtaatataagcataggtgctgggggtgataggggtaaacaaatcttttgtaaagatgaaaaaaatggaattactatacgtgtaaaagcttgtgatttgagcaacagtattgtaaggtaatggccacctttagggatgccctagtaaaagtgtacactgctacatgcatggtagctattttggtcttcttttaccctgcacagcaagcattatattgtttcttgc

SEQ ID NO: 5701 - DNA, 2668 bp, Avena sativa
gagctctgtctgtctctctagctagctcccttttatccttttgagctttgggtatttttaatcttgggatctgattttgtccccatattgggaggatcgattatctttctccccaccccctcctctgccctctccccctctctttctatctctctctctctctctgcccagagcctgcctggagggaggagatcagctttggatgcaaaatcttcttcctgctgcttgccccccacgaggagcacgcccgccctctcagattgattgatcacgaagttacatctcatctcgcgtcgataacgcgctagttgaatcatctctgaggagtcttatactagtttaacaagggagttgttagtagaagattttaatctgatcaacactgaacttgtggtgaaacctgaccgagtttcgttgcaagaaagctggttctacataccatctatgctcggcagcaatctcggtcggcgagtgatcagaacttgagatggctacttactactcgagccccggtaatgaaagagagtcgcacgacatgtactcgagagacccgggaagcgcgtcctacccgatgtcgtcggctctaggcaacttgctctatctgaacaacccgtctcccgggccatacacggagttcagcggcatcctgcagtctcagcagaactgcatggagatgcctggccatcatcatggtcaccattccgcaatgtcccacgactcgtctgcgagggagtccgacatgcttgcgcgctcgttcgggcatgtcaaggatatgaagaatgagatgctcatgcacatgatggatggagcacaacagagtggtactggtgctgaactgatccatgacgatgcccacaacggcgggcagtttgagtttggtgttctgaacaaccatggctcaccaaatgttccgtcagggcaaggtcaggggctgtctctgagcctcaacacgcagatactggccccttccttgccttactggtccatcaagccagacatgttgacgccgagctcctaccacgacagcctcagagttgacgacatccggatgaagaacatgcagtccgaagcctcgcgcgcgatccggcactcgaggtatctgaaggcggcacaagaggtgctagatgaggttgtgaatgtttggaagaatataaaacagaaggctcagaaagagcaggctgaaccagggaaagcagatggcaaagagactgatggtgggccaaaaagtgagggcccgcaagaatctggggcaaatgctgtacctgagctttccactgctgagaagcaagaacttcagaacaagatggccaaactgatggcaatgttggatgaggtggaccgtaaatacaaacactattaccaccaaatgcaaaatgtggtttcatcctttgacgtggtggctgggcccggatctgccaagccgtacaccgcagttgctcttcagacaatctcgcggcacttccggtgcttgaaggatgccatcaatgaccagatcaatgttatcaggaagaagctcggcgaggaagagaattcatgtgggaaagaaggcaaattgacccgtctccggtacatcgatcagcagctgaggcagcagcgagctttccagcagtacggcatgatcccgcaaaacgcttggagaccgcagagggggctgcctgaaaactcggttacggttctccgcgcttggcttttcgaacacttccttcacccgtaccccaaagattcagagaagctaatgctagcaaggcagactggattgacaaggagccagatttcgaattggttcatcaacgctcgtgtccggctttggaaaccaatgatcgaagacatgtacaaagaagagaccggtgatcttgagcaagactccaactcttcctccgacaacgtgccaagaagcaagaacaaagtggcaacttcggaagaaaacgaagacctgaagaacgccagggctcgggtctgcgaaaccagccaactgagcgactcgagggccagcatcgggaccatgaacgtcggtggggtgcctctcggctaccagaacgaggccaaccatgacgacagcttcatgaacctgatgatgaaggagcagcgatcaggcgaggcggacgggggcctcctcctccacaacgccgccgtcgcgcaacactcagacgagaacgcgcggttcatggcctaccacctggcagggttcggtggtaggtacgggaacggcaacgtgtcgctgacgctgggcttgcagcaccccggtagcggcctcacggttcccaacgcccaggcgagcttccccggtgtcggcgacgacgatgacatctacaacgccggtgcgcctctcggtgtcagcatagcgtcttcggactatgaatctttgaaccagatggaccaacggcagcggttcgagcagtcgcctctgctgcatgattttgtggcctagatgatgataatgatgatgatacatcaggaaaaggaccattgacacaagaattgtaaaactcctagtggcagaagaataacatgcctgaaagagcatgcatggggttgtagcttgtagacagttgccattggataccggagaggtatagcaggggatgtaatataagcataggtgctgggggtgataggggtaaacaaatcttttgtaaagatgaaaaaatggaattactatacttgtaaa

SEQ ID NO: 5702 - DNA, 2777 bp, Secale cereale
agggaagaaacagaggaagagagagagagagaaagggagggcctttttttttctccttttgagctctggttttttgggtattttaatcctgggatctgattttgtccccatattgggaggatccattatctttctccccaccccctccctcccccctctatcttactctctctccatagcctgctggaggaggaggagatcagctttggatgcagtcttcttcttcttcttcctccgcctgccccccacgaggagcacacccccgtccccagattgatcaggaagccgtcctcgcatcggtgacgcgctagcggagcgtcttcggggtgtctcgtgtcggtttaacaaggcactcctggaaaacggagggagaactgatcttctgccgaaacttgctactggttctgcataatatctatgcttcgcagtaatctcggtcggtaagtattcaggaccaggagatggccacttactactcgagccctggcagcgaaagagagtcgcaagacatgtactcgagagacccgggcggcgcatcctatccgatgtcctctgctctgggcaacttgctctatctgaacaacccgtcttctgggccatacacggagttcagcggcattctgcagtctcagcagaatttcatggagatgcctgctagccatggccaccattctgcaatgtcccacgactcatcggcaagggagtcgcacgacatgcttgcttcccaccacgggcaacgctcgttcggtcatgtcaaagatatgaagaatgagatgttgatgcatatgatggacggagcacagagtggtggtggtgctcaactcatccatgacgatccccacaacggtgcacacttcgagtttggtgtcctcaacaaccatgactcgtcggatgttccggtagggcaaggccaaggccaaggccaagggctgtctctgagcctcaacacacagatcctcgcgccgtccctgccatactggtctatcaaaccagacatgttgacgccaaactcttcttaccaggaaagccttagaatagacgacatccgcatcaagaacatgcagtccgaggcctctcgtgcgatccggcactcgaggtatctcaaggcagctcaagaagtgctagatgaagttgtgaatgtctggaagaacatcaagcacaaagctcagaaagagcaagctgaaccaggtaaagcagatggcaaggagaccgatggagggccaaagagcgagggcgcgtcgcaagaatccggcgcaaatgcagcacctgagctgtccactgctgagaagcaagagcttcagaacaagatggccaaactgatggcaatgttggatgaggtggaccggaaatacaagcactattaccaccaaatgcaaaatgtggttgcatcttttgacatggtggctgggcctggatctgccaagccttacaccgcagttgctctgcagacaatctcgcgacatttccggtgcttgaaggatgctatcaatgatcagatcaatgttatccggaagaagctcggcgaggaagaaaattcgtctagcaaggaaggcaaattgacccgtcttcggtacattgatcagcagctaaggcaacagcgtgctttccaacagtacggtatgattcctcagaatgcctggagaccgcagaggggactgcctgaaaactcggttacggttcttcgcgcttggctctttgaacacttccttcacccgtatccaaaagattctgaaaagttgatgcttgcaaggcagactggcttgacaagaagtcagatttcgaattggttcataaacgctcgtgtccgcctttggaagccaatgattgaagacatgtacaaagaagagaccggtgatcttgagcaagactccaactcttcctccgacaacatgtcgagaagcaagaacaaagtggcatcttcagaagagaatgaagatctgaagaacgccagggctcgggtttgcgaaaccagccagctaagcgagtcaagagccagcatcggaactatgaatgttggcggtgcacctgttagcttccagaacgaggccaaccctgatgacagtttcatgaacctgatgatgaaggatcagcgatccggtgaggcggatggaggcctcctcctccacaacgccgtcgcgcagcactcggacgagaacgcacggttcatggcctaccacttggcagagcttgggaggtacggaaacggcaacgtgtcgctcacgctgggcctacagcactctggcggcggtctgtcagttccaaatgcccaagcaaacttccccggtgtcagtgacgatgacatctacaatgcgggcgctcctctcggtgtgagcattgcatcttccgactacgaatctttgaaccagatggatcagcggcaacgcttcgagcaatcgcctcttttgcatgattttgtggcctgaatcatgatgatacatcggatcaggaccattgacacaaagatatattgggtgggtggggtgacagcatttgtaaaagaaactcctagtggcagaataataacatgcctgcaagagcatggggttgtagcttgtagttgccatttgatacagggagagcatggggtatagcaggaaatgtaatataaagcgtaggtggtgggggtgatagggggtaaagatggaaaatcttttgttgtaaagatataatgcaatttactacacgtgtaaaatcttgtgctcggtattgtaaagtaattaatggccacttcagggtgatagtatacattgctaaatgatatatagttacaaacaaaa

SEQ ID NO: 5703 - DNA, 2822 bp, Hordeum vulgare
gaggaggagagggagaaagggaggagctttttttccctcctccttcttcttcctgtgcttcttttgagctctggttttttgggtattttaatcctgggatctgattttgtccccatattggggaggatccattatctttctccccacccctctccccctctatctttctctctctctccctccatagcccgcctgctggtggaagagaagatcagctctggatgcaacctgctcctcctccttcttcttcttcctccgcctgcccccggcgaggagcaggagcacacccgcgcccccagattgatcgggaagccgcggtggcatcggtaacgcgctagaggggtttcacgttggtttaacaaggaggttggattcatcttgtgctgaaacttgctactggttgtgcataataatatacatgcttcgcagtaacctcggtcagtgagcatttaggagcaggagatggctacttactactcgagccccggcagcgaaagagagtcgcaagacatgtactcaagagacccaggcaatgcgtcctacccgatgtcatcagctctaggcaacctgctttatctcaacaacaatccgtcctctgggccatacacagcagagttcggcggcatcctgcagacccagcagaacttcatggagatgcctggccatggccatcatcctgcaatgtcccaggactcatcggcgagggagtcgcatgacatgcttgcttcccaccatggccaacgcccgttcggtcatgtgaaagatatgaaggatgagatgttgatgcatatgatggacggagcgcggagtggtggtggtgaactcatccatgacgacccccacaatggcgcgcagttcgagtttggtgtcctgaacaaccatgactcgtcggatgttccggtagggcaaggccaagggctgtctctgagcctcaacacgcagatcctcgcgccgtcgttgccgtactggtctatcaaaccagacatgctgacgcccaactcttaccaggaaagcctgagaatagacgacatccggatgaagaacatgcagtcggaggcctctcgtgcgatccggcactcgaggtatctcaaggcagctcaagaagtgctggatgaagttgtgaatgtttggaagaacatcaaacggaaagctcagaaagagcaggctgaaccaggtaaagcagacggcaaagagagcgacggggggccgaaaagcgagggcgcatcgcaagaatccggcgcaaatgcagcacctgagctctccactgctgagaagcaagagcttcagaacaagatggccaaactgatggcgatgttggatgaggtggaccggaaatacaagcactactaccaccaaatgcagaatgtggttgcatcttttgacatggtggctgggcccggatccgccaagccttacaccgcagttgctcttcagacaatctcgcggcatttccggtgcttgaaggatgccatcaatgatcagatcaatgttatcaggaagaagcttggcgaggaagagaattcgtctggcaaggaaggcaaattgacccgtctccggtacattgatcagcagctaaggcaacagcgtgctttccagcagtatggtatgatccctcagaatgcctggaggccgcagagagggctgcctgaaaactcggttacggttcttcgcgcttggcttttcgaacacttccttcacccgtatccaaaagattctgaaaagttaatgcttgcaaggcagactggcttgacaaggagtcagatttcgaattggttcataaacgctcgtgtccgcctttggaaaccaatgattgaagacatgtacaaagaagagactggtgatctggagcaagactccaactcttcctccgacaatgtgccgaggagcaagaacaaagtggcatcttcagaagagaatgaagatctgaagaacgccagggctcgagtttgcgaaaccagtcagctaagcgagtcgagagcaagcatcgggaccatgattgttggcgcggcgccggttggcttccagcatgctgaggccaaccctgatgacagtttcatgaacctgatgatgaaggagcagcgatccggtgaggcggatgggggcctcctcctccacaacgccgttgcgcagcactcggacgagaacgcgcggttcatggcataccacttggcagagcttgggaggtacggaaacggcaatgtgtcgctgacgttgggcctgcagcaccctggcagcggcctctcggttccgaatgcccaagcacacttccccggtgtcggcgacgatgacatctacaatgccggtgctcctctcggtgtcggcatcgcatcttccgactacgaatctttgaaccagatggatcaacgacaacgcttcgagcaatcgcctcttctgcatgattttgtggcctgaatgacgatacatcagatcaggaccattgacacaaatattggggttgggggtgacagcatttgtaaaactcctagtggcagaataatagcatgcctgcaagagcatggggggtgtagctttgtagttgccatttgatacaggagagcatggggtatagcaggaaatgtaatataaagcttaggtggtgggggtgatagggggggtaaagatggaaatcttttgtaaagataaagtgcaatttactatacgtgtaaaagcttgtgctcagtattgtaaagtaatggccacttcaggataatagtatacattgctaaatgatggctattcttcatcaagctaaagattatatgtttgttgcacatacatatatataatgggattggcaatatagccaaacatttaactcttgc

SEQ ID NO: 5704 - DNA, 2853 bp, Avena sativa
gggggctctggagaaacaataggtagagagagagaggagctctgtctgtctctctagctagctcccttttatccttttgagctttgggtatttttaatcttgggatctgattttgtccccatattgggaggatcgattatctttctccccaccccctcctctgccctctccccctctctttctatccctctctctctgtccagactccagagcctgcctggagggaggagatcagctttggatgcaaaatcttcttcctgctgcttgccccccacgaggagcacgcccgccctctcagattgattgatcaccaagttacatctcatctcgcgtctataacgcgctagttgaatcatctctgaggagtcttatactagtttaacaagggagttgttagtagaagattttaatctgatcaacactgaacttgtggtgaaacctgaccgagtttcgttgcaagaaagctggttctacataccatctatgctcggcagcaatctcggtcggcgagtgatcagaacttgagatggctacttactactcgagccccggtaatgaaagagagtcgcacgacatgtactcgagagacccgggaagcgcgtcctacccgatgtcgtcggctctaggcaacttgctctatctgaacaacccgtctcccgggccatacacggagttcagcggcatcctgcagtctcagcagaactgcatggagatgcctggccatcatcatggtcaccattccgcaatgtcccacgactcgtctgcgagggagtccgacatgcttgcgcgctcgttcgggcatgtcaaggatatgaagaatgagatgctcatgcacatgatggatggagcacaacagagtggtactggtgctgaactgatccatgacgacgcgcacaacggcgggcagtttgagtttggtgttctgaataaccatggctcaccaaatgttccgtcagggcaaggccaggggctgtctctgagcctgaacacgcagatcctggccccttccttgccttactggtccatcaagccagacatgctgacaccgagctcttaccacgacagcctcagagttgacgacatccggatgaagaacatgcagtccgaagcctcgcgcgcgatccggcactcgaggtatctgaaggcggcacaagaggtgctagatgaggttgtgaatgtttggaagaatataaaacagaaggctcagaaagagcaggctgaaccagggaaagcagatggcaaagagactgatggtgggccaaaaagtgagggcccgcaagaatctggggcaaatgctgtacctgagctttccactgctgagaagcaagaacttcagaacaagatggccaaactgatggcaatgttggatgaggtggaccgtaaatacaaacactattaccaccaaatgcaaaatgtggtttcatcctttgacgtggtggctgggcccggatctgccaagccgtacaccgcagttgctcttcagacaatctcgcggcacttccggtgcttgaaggatgccatcaatgaccagatcaatgttatcaggaagaagctcggcgaggaagagaattcatgtgggaaagaaggcaaattgacccgtctccggtacatcgatcagcagctgaggcagcagcgagctttccagcagtacggcatgatcccgcaaaacgcttggagaccgcagagggggctgcctgaaaactcggttacggttctccgcgcttggcttttcgaacacttccttcacccgtaccccaaagattcagaaaagctaatgctagcaaggcagactggattgacaaggagccagatttcgaattggttcatcaacgctcgtgtccggctttggaaaccaatgatcgaagacatgtacaaagaagagaccggtgatcttgagcaagactccaactcttcctccgacaacgtgccaagaagcaagaacaaagtggcaacttcggaagaaaacgaagacctgaagaacgccagggctcgggtctgcgaaaccagccaactgagcgactcgagggccagcatcgggaccatgaacgtcggtggggtgcctctcggctaccagaacgaggccaaccatgacgacagcttcatgaacctgatgatgaaggagcagcgatcaggcgaggcggacgggagcctcctcctccacaacgccgccgtcgcgcaacactcagacgagaacgcgcggttcatggcctaccacctggcagggttcggtggtaggtacgggaacggcaacgtgtcgctgacgctgggcttgcagcaccccggtagcggcctcacggttcccaacgcccaggcgagcttccccggtgtcggcgacgacgatgacatctacaacgccggtgcgcctctcggtgtcagcatagcgtcttcggactatgaatctttgaaccagatggaccaacggcagcggttcgagcagtcgcctctgctgcatgattttgtggcctagatgataatgatgatgatacatcaggaaaaggaccattgacacaagaattgtaaaactcctagtggcagaagaataacatgcctgaaagagcatgcatggggttgtagcttgtagacagttgccattggataccggagaggtatagcaggggatgtaatataagcataggtgctgggggtgataggggtaaacaaatcttttgtaaagatgaaaaaaatggaattactatacgtgtaaaagcttgtgatttgagcaacagtattgtaaagtaatggccacctttagggatgccctagtaaaagtgtacactgctacatgcatggtggctattttggtctctttttaccctgcacagcaagctttatattgtttcttgcatatatata

SEQ ID NO: 5705 - DNA, 2852 bp, Lolium multiflorum
tgtccccatattgggaggatcgattatctttctccccacctccggcctctgcctctgcctctcctcccctgtgctctctatctttatctctctctgtccagagcctggagagaggagatcagcttttggatgcaaaatcttcttcccttgccctgccccccatgaggagcacaccctctcagattgattgatcaggaagctgcgcctcacctcgcaccacgcgctaatccaagcatctttgagcaatcatatattgggttttacaagaaactgtaagtggaagattttaatctggtcaacactgaacttgtgctgaaacctgaccgagtttcgttcaaagaaagctggttctgcctaccatctatgcttggcagcaatttcggccagcacataatcagagcttgagatggccacttactactcgagccccggtaacgaaagagagtcacacgacatgtactccagagatccaggcagttcatcgtacccgatgtcgtcggctctaggaaacttgctctatctgaacaaccagtctcccgggccatacacagagttcagcggcatcctgcagtctcagcagaattgcatggagatgcctggccatggtcaccattctgcaatgtcccacgactcatcagcaagggagtccgacatgctcgcttcacacctcgggcaacgctcgttcggtcatgtgaaggatatgaagaatgagatgctgatgcatatgatggatggagcacaaggtggtggcgctgagttaatccatgatggtggccacaacggtgcgcagtttgagtttggtgttatgaacaaccacaactcgccaaatgttccatcagggcaaggccaggggctgtctctgagcctcaacacacagatactggcgccttccttgccttactggtccatcaaaccggacatgttgacgccaagttcttaccacgacagcctcagagtcgacgacatccggatgaagaacatgcagtccgaagcctcgcgcgcgatccggcactcaaggtatctgaaggcggcacaagaagtactagatgaggttgttaatgtttggaagaatataaaacagaaggctcagaaagagcaggctgaaacagggaaaacagatggcaaagaggccgatggagggccaaaaagcgaggaccagcaagagtccggcgcaaatgctgtacctgagctttccactgctgagaagcaagaacttcaaaacaagatggccaaactgatggcaatgttggatgaggtggaccggaaatacaaacactattaccaccaaatgcaaaatgtggtttcatcttttgatgtggtggctgggcctggatctgcaaagccgtacactgcagttgctcttcagacaatctcgcggcacttccggtgcttgaaggatgccatcaatgatcagattaatgttatcaggaagaagcttggtgaggaagagaattcatctggcaaggaaggcaaattaacccgtctccggtacatcgatcagcagctgaggcagcagcgagctttccaacagtatggcatgattccgcaaaacgcatggagaccgcaaagaggactgcctgaaaactcggttacggttctccgtgcttggcttttcgaacacttccttcacccgtacccaaaagattcagaaaagttgatgctagcgaggcagacaggcttgacaaggagccagatttcgaactggttcatcaatgctcgtgtccggctttggaaaccaatgatcgaagacatgtacaaagaagagactggtgatttggagcaagagtccaactcttcctccgacaacgtaccaggaagcaagaacaaggtggcatcttcagaagaaaacgaagatctgaagagtgccagaattcgcgtatgcgaaaccagccagctaagcgactccagggccagcatcgggaccatgaacatcgttggggcacctgtcggcttccacaatgaggccaaccatgacgacagtttcatgaacctgatgatgaaggagcagcgatccagtgaggcggacggagacctcctcctccatagtaccgtctcacagcactcagacgagaacgcgcggttcatggcctaccacctggctgggcttgggaggtacgggaacggcaacgtttcgctgacgctgggattgcagcaccccggcagcggcctctcggttccgaatgcccagacgaacttccccggtgttggcgatgatgacatatacaacaccggtgcgcctctcggtgtcagcatcgcatcttcggactatgaatctatgaaccagatggaccaacggcagcggttcgagcagtcgcctttgctgcatgattttgtggcctagatgatgatgatacatcaggaaaggaccattgacacaagaattgtaaactcctagtggcagaagaataacatgcctgaaagagcatgggattgtagcttgtagttgccatttgatacaggagaggtatagcaggggctgtaatataaagcatagctggtgggggtgataggggtaaagaaatcttttgtaaagatggaaaaatggaattactatacgtgttacagcttgtgatttgggcaacagtattgtaaagtaatggccacttttagggatctcctagaaatagtgtatattgtacatgatggctagtttttgtctctttttgccctacacaacgagcttatatgtttctttcttgcacatatataatgggaaactggcaatctgttagtcttaaaaattcatcaaaatttatagttgaagaatactacatatttcattcttgtttttagaaaaggggaagtagtacatatggcaattatttcttttattcaacaaagacgagcaaaag

SEQ ID NO: 5706 - DNA, 2552 bp, Zea mays
ctttctggagctgttattttatccggggaaggatctggttttgtcccccgtattgggaggatttattatctttctccttcttccccctcccctcgaccctctcagcctcaccaggatcagctttgttgctgcggaggcaatccctgtcgcctgctccctccccatgagagtaccacgccacgcacacccttcaggaacgccgtaagctgaagctttcagtcggctgctgaaacctcgttcatcagtcagtctccaaggcggttcgatcgtggtggccatcatcagccgagcggccagagctgcacgatggctacctactactcgagccagggcagtgaaagggagccgtcgcagaacatgtactccagagaccccggcaatggcaccgcgtcctaccctcctctgccgtcggctctggggaacttgctctacttgaacagcccggcttctggcgggccgtacacggatttcggcggcgtccagcaggactgcatcgagatgcctgaacctggacatccttcggtgatgtcccatgactcgtctgccagggagatcgagcccgacatgctggggcagcagcggcgctcgttcggcctagccagaggcatgaaggacgaggtgctgatgcgcatgatggatggatcaggatcacatagcagcgcagccgatgccatccatgacgacgccccgaatggcatacagctcgatttcggcgttctgggcagccacggcccgccggcgcagggcggccaaggctccttgtctctgagcctcaacacgcacatcatggcgcctgccttgccgtactggcctgtcgtcaaggcagacatgctgtcgccgcactcctacgaccatggctgcggcggcggcagcggcggccttggctcggagccgtcgcgggcgatccggaactcgaggtatctgaaggcggcacaggagctgcttgacgaggtcgtcaacgtctggaacagcatcaagcagaaggcccagaaagagcaggtggaggcagggaagacggaagggaaggagaacgagggaggagggcccaagagtgagggtccgcaggagtctggcgccaacgctgcaccggagctttctactgccgagaagcaggagcttcagaacaagatggcgaagctgatggcgatgctggacgaggtggaccggaagtacaagcactactaccaccaaatgcagagcgtggtctcgtccttcgacatggtagcgggggctggagccgccaagccatacaccgcggtggctctgcagacgatctcgcgccacttccggtgcctcaaggacgccatcaacgaccagatcagcgtcatcaggaagaagctcggggaggaggagagctcgtccggcagggagggcaggctgacccgtctccgctacatcgaccagcagctcaggcagcagcgggcgttccagcagtacggcatgatcccgcagaacgcttggcggccacagaggggccttcctgagaactccgtcaccattcttcgtgcttggctcttcgagcacttccttcacccgtaccctaaggattctgaaaagctgatgctggcaaggcaaacaggcctgacgaggagtcagatttcgaactggttcatcaacgcccgcgtccgcctctggaaacccatgatcgaggacatgtacaaggaagagaccggagacatcgagcaagactccaactcctcctccgacaacgcgccagcaggaagcaaggccaagacggcgtcttcgcgagacaaggaggaccacctggcgagaagctgctgcacgccgcgggccgtctgcgagagcagcagccagctgagcgagccaccaggaggagccagcatgagggccatgagcgtcgccgccgccgccgctggagcgcccatggggttattccagaacgagcctggccacgaccacgaccacgacgacagcttcatgagcctgatgctcaaggagcagcgaccgaacgacggcggcggcggcctcctcctccaccacagcgccgtggcgcagcaccaggacgagaacgcccggttcatggcgtaccacctggcggagctgggcaggtacggcaacggcaacgtgtcgctcaccctggggctgcagcgctccagcagcagcctctcggttccgcacgctcagcagagcttccccggtgtcggaatcggtgtcggagacgacgacatctacaatgccaccgccgctcctctcggtgtcagcgtggcgtcgccggactacgagtccatgagccagatggatcagcggcaacggttcgagcagtcgccccttctccatgattttgtggcgtgattgttcgtttgcctatactcactctccgttccaaatcgcaagacgtttttttttttggcttttctaaatccatggcctttgctatactaaatataagatatgtgtttagatatacccaaaacgttttataatttggaacggaagagagtacctcagatgattatatatgtgttacatatgtgcctgaaaggagcattgggttgtagtagcctgtagtttttcaattgtatacagattgg

SEQ ID NO: 5707 - DNA, 4778 bp, Setaria italica
cgtctcgtctcgtctccgcccgacacaccttgaaccctcgcgagtcgcgacgactggaaaagcaggcaagcgcaatcccacagctcggcagctcctcctcaccgtcgccgccgatttagatggagatggaggcggcggcggcggcggcctccgacgaaaccctagccgccgtcttcgcccagctcaagccccacaccgtcgctctcctcgacctcctccgcagccgccgggccgcctccagctccgcctcctccctccgcgaaatggccgccttcctccgctccgcccccgcccccgcactgcagctctgcttcgactatacagtgtttccactgctgatgctcctggatgcggcggtgcagtgcaggaagcaaggcaatgcaccggggcagggtgctggggacattggcatcgctgatgccgtcgccgaagctgggctggcctgccttgaagtgctcctaaccaagtgccgcctcacctcagtcaatcagatggttgcaatgctgaaaaagttgacttctggggccatgcttttgcctttggaggcttcagaggagttccgcattggaatcataagatgcttcagagccatggttttgcagttacaaccatgcttggagcggtcctgttcttgcaagcaagcaacagtgttgcctacgtcctcaaccaatacaagcttggaggccaggagtgtagttcactcaaagctccctgcacagccagaagagtgcctgcttgcattccttcagtcacaaaatgcttcagctgccgttggacactggctctcacttcttctacaggcatcagaacttgaggcatcaagagggcaccgtggaagtgcagatgttagaaaggaagcattacacgctctccgtattcttattgccaaggtaggttctgctgatgcacttgcctttttccttcctggaattgtcagtcgcctcggaaaggttctctacagatcgaagactatgattagcggtgctgctgggagttctttgagcattgaacaagccattcttggattgacagaggctttgatgatagtcctaaatgacaaggaaaattttagtgcccttgatatggctataaatgaggattgggcccattcttctggtggtgatggttcaactgagcatgtattgcagatgcttcgccaattaccaaccaaaagtctatctgaacagataggtcatgatgaaactacagatgactctacctccgatgccaataatccctctgctgatagaaaggcactacatgtaaagcggaccaaaaaatggcttgaggaaacaactagtaatgttgataaattgctttctgccacattcccacatctttctattcattcatctgagaaggtgaggaggtcggtggttagtggtgtgagggggcttttgtctagctgcggctctacattaaagcgaagcaagatgctacttgtggaatgcttatgtgttcttgcatgtgatgatgccgccgctgtgtctgaggctgcacaagatgctctcctttatcttttcaaccagggtcacaattttattacagaaaatgagatttctgatatttttaccaggctagttgaaaggttgccacaagtggtacttggaagtgaggagacaactgcattgtcacatgctaagaggctgttggctctgacattttatgcaggacctcagtttctgataaatcatcttcaccattctcctgttatcgctactcgtttctttgattgtttgggtctatgcataagtcatagttcgcagttttctggttcaatggacaagttaatcgtatcaaagccactgtctgttggttacctctattcagttgctgagttgaagggtggtgcctattctaaagatatgactaatagttctctgcaggccacgtatacgccggcagcctccaaaatatctgttatccatgataacggtttgtcgaatgcaatacttggtactgttgaatatgagttgccccatgtgcctccatggtttgtgcatgctggcagtcagaaactttacttggttcttgctggaataattagacttgttggcctatcaacagtgtcagggaaagaaactgctgcatccttatctccttttgttgatattctactcgatcacttcaggaggttgagcactgtggtgcgatccaaaaatatttacagagatggccataggtggtacatgaatggtgaagctggacatacactacgccaggcaagttcagctgtttgcatgctcaatgagctcatatatggtttgtcagatagatctcttggtatgtttttgcaactgttccagaagagatcagcacagatggtaaggacagcttgtcagaatgatcaattgatcgcttctgttaaacataatggagttactaatgaaagagaagtctggggatgtaatgaacaaaagggtactaaagacaatattattcattgtatcggcagtattctgcatgaatatatatgtccagaagtgtgggatcttccaacagaaaaggatgttgagctatgcctaacagagttgaacctgccattgcacttctaccgtgataccactgctttgcacacggtgacgcttgaaggaattggagtcttgggtgctgttcttggtcaagatttcgcacgtagtgggtttatgcactcttccctttatcttctgctccgtgaacttatcagctcaagtgctcagataagaattgcatcagatgctgtcttaagagcgcttgctgctgctggcggtcattgttcggttggccaatttgttgtcgcgaatgcagattacattgttgactctctttgtagacagctacgtcacttggacatgaatccccatgtccctgatgttcttgcttccatgctgtgttacattggtgcttctcatgatattttaccattcttggaagaaccgatgcgagcagtttcttctgagctggaggtacttggcaggcatgaccacccacatctaactgttccatttctgaaggcggtttctgagattgccaaggcatgcaaacatgaatctactagtttgccagatgacgcccaatcattttatttgaaggtcagttcagaaggccaagaagtcaaaaatatgatcgagaagagaatggaatccagtgcaacatctgaaagaatgaatgctgatgctcaacttgattttatgagcttggaatattgggaggacttactttgtaagttaaatgagatgagaagatataggagaatagttggatcacttacaggttcttgcttatcagctgccaccccacttctctcttcaactaaggaaacagcttgtcttgtggcccttgatgttgtggagaatgctattatatctatcaccaaggttgaggaggcttacaagtgtgaaaatcaaagtaaaggaattattgaggagtccatccagtttctgtcatttgatgaacttcttgatggtacagatgccagcgaagatgctgatgagaatcgattgctcccagctatgaacaaactatggccttacttgattatctgtctaaggaacaagatatcagtgccggttgttagaaagtgcactgaagtattgagtagagcaattagtatgtctggtggtgatttttatgtacgccgctttcataaggatggacatattgtttggaggttgctggcattatctccattccgacgaaaaagaatgtcaatgatggatgaaaaagcaatcattttaccatatagggatacctcacttacctcagaggaacccatggctgagatctccagtcaaaaaattcagattgcggtcctggacatgatcgccacaatatcttccagcaaaagaagtgctattgcattagaaagtgtactaaagaaggtttgtggccttgtggttggtatcgcctacagtagtttgacaggtttgcaagaagctgctataagggcattggcaggccttgcctgtatggatgctgaccttgtctggcttctcttggcggatgtttattactcactaaaccaaagggatatacctttaccgcccaaccaagatgtggcagagatatcagatcttttgcccccaccaatgtctgcgagagaatacctctttgtacagtacggaggcgatggtgtgagatgtgatgtagacccgtcatctgttcacgaggtgttcaaaaggatgcaggatgtggtcctaacatgaaaatcaggttgatctccctgtataaaaaccttgccgatgggattttgtgtcactgctggctagcccgccagtgtcacatattttgcctgtactggaaaatggaacaatgatgaaggatgagctggagttgccagggaacatctttgtggtgtcgcaattggatatgtcattggcattatgctttgttgctagaatcagtgaagagtgcgatctgtttctatcaagcaattgcacttggcatgtgtgactgtatgccatggacattgttctccatgatgttgtgagcaaggagcagcaaccgcttggaggggtcatcaagcaaattacaacacaagcaaagtacaggatggttttctgatggggtgcatgtgtaattatatcgagcaaacgtgtatcacatggtggagtttagtcgtgtgaaaagaaaggtagatgatgtataaaccatctctgagttgattgctcccttttctgaagcgtttttttattctgggtctgggatattcatgtctaatgcccgtcaaaattcgttggtaaacatcttgctagccctttctaatctgtaaaacaaaaggtgaacacctcgcttcagtc

SEQ ID NO: 5708 - DNA, 4750 bp, Setaria italica
gtctcgtctccgcccgacacaccttgaaccctcgcgagtcgcgacgactggaaaagcaggcaagcgcaatcccacagctcggcagctcctcctcaccgtcgccgccgatttagatggagatggaggcggcggcggcggcggcctccgacgaaaccctagccgccgtcttcgcccagctcaagccccacaccgtcgctctcctcgacctcctccgcagccgccgggccgcctccagctccgcctcctccctccgcgaaatggccgccttcctccgctccgcccccgcccccgcactgcagctctgcttcgagaagcaaggcaatgcaccggggcagggtgctggggacattggcatcgctgatgccgtcgccgaagctgggctggcctgccttgaagtgctcctaaccaagtgccgcctcacctcagtcaatcagatggttgcaatgctgaaaaagttgacttctggggccatgcttttgcctttggaggcttcagaggagttccgcattggaatcataagatgcttcagagccatggttttgcagttacaaccatgcttggagcggtcctgttcttgcaagcaagcaacagtgttgcctacgtcctcaaccaatacaagcttggaggccaggagtgtagttcactcaaagctccctgcacagccagaagagtgcctgcttgcattccttcagtcacaaaatgcttcagctgccgttggacactggctctcacttcttctacaggcatcagaacttgaggcatcaagagggcaccgtggaagtgcagatgttagaaaggaagcattacacgctctccgtattcttattgccaaggtaggttctgctgatgcacttgcctttttccttcctggaattgtcagtcgcctcggaaaggttctctacagatcgaagactatgattagcggtgctgctgggagttctttgagcattgaacaagccattcttggattgacagaggctttgatgatagtcctaaatgacaaggaaaattttagtgcccttgatatggctataaatgaggattgggcccattcttctggtggtgatggttcaactgagcatgtattgcagatgcttcgccaattaccaaccaaaagtctatctgaacagataggtcatgatgaaactacagatgactctacctccgatgccaataatccctctgctgatagaaaggcactacatgtaaagcggaccaaaaaatggcttgaggaaacaactagtaatgttgataaattgctttctgccacattcccacatctttctattcattcatctgagaaggtgaggaggtcggtggttagtggtgtgagggggcttttgtctagctgcggctctacattaaagcgaagcaagatgctacttgtggaatgcttatgtgttcttgcatgtgatgatgccgccgctgtgtctgaggctgcacaagatgctctcctttatcttttcaaccagggtcacaattttattacagaaaatgagatttctgatatttttaccaggctagttgaaaggttgccacaagtggtacttggaagtgaggagacaactgcattgtcacatgctaagaggctgttggctctgacattttatgcaggacctcagtttctgataaatcatcttcaccattctcctgttatcgctactcgtttctttgattgtttgggtctatgcataagtcatagttcgcagttttctggttcaatggacaagttaatcgtatcaaagccactgtctgttggttacctctattcagttgctgagttgaagggtggtgcctattctaaagatatgactaatagttctctgcaggccacgtatacgccggcagcctccaaaatatctgttatccatgataacggtttgtcgaatgcaatacttggtactgttgaatatgagttgccccatgtgcctccatggtttgtgcatgctggcagtcagaaactttacttggttcttgctggaataattagacttgttggcctatcaacagtgtcagggaaagaaactgctgcatccttatctccttttgttgatattctactcgatcacttcaggaggttgagcactgtggtgcgatccaaaaatatttacagagatggccataggtggtacatgaatggtgaagctggacatacactacgccaggcaagttcagctgtttgcatgctcaatgagctcatatatggtttgtcagatagatctcttggtatgtttttgcaactgttccagaagagatcagcacagatggtaaggacagcttgtcagaatgatcaattgatcgcttctgttaaacataatggagttactaatgaaagagaagtctggggatgtaatgaacaaaagggtactaaagacaatattattcattgtatcggcagtattctgcatgaatatatatgtccagaagtgtgggatcttccaacagaaaaggatgttgagctatgcctaacagagttgaacctgccattgcacttctaccgtgataccactgctttgcacacggtgacgcttgaaggaattggagtcttgggtgctgttcttggtcaagatttcgcacgtagtgggtttatgcactcttccctttatcttctgctccgtgaacttatcagctcaagtgctcagataagaattgcatcagatgctgtcttaagagcgcttgctgctgctggcggtcattgttcggttggccaatttgttgtcgcgaatgcagattacattgttgactctctttgtagacagctacgtcacttggacatgaatccccatgtccctgatgttcttgcttccatgctgtgttacattggtgcttctcatgatattttaccattcttggaagaaccgatgcgagcagtttcttctgagctggaggtacttggcaggcatgaccacccacatctaactgttccatttctgaaggcggtttctgagattgccaaggcatgcaaacatgaatctactagtttgccagatgacgcccaatcattttatttgaaggtcagttcagaaggccaagaagtcaaaaatatgatcgagaagagaatggaatccagtgcaacatctgaaagaatgaatgctgatgctcaacttgattttatgagcttggaatattgggaggacttactttgtaagttaaatgagatgagaagatataggagaatagttggatcacttacaggttcttgcttatcagctgccaccccacttctctcttcaactaaggaaacagcttgtcttgtggcccttgatgttgtggagaatgctattatatctatcaccaaggttgaggaggcttacaagtgtgaaaatcaaagtaaaggaattattgaggagtccatccagtttctgtcatttgatgaacttcttgatggtacagatgccagcgaagatgctgatgagaatcgattgctcccagctatgaacaaactatggccttacttgattatctgtctaaggaacaagatatcagtgccggttgttagaaagtgcactgaagtattgagtagagcaattagtatgtctggtggtgatttttatgtacgccgctttcataaggatggacatattgtttggaggttgctggcattatctccattccgacgaaaaagaatgtcaatgatggatgaaaaagcaatcattttaccatatagggatacctcacttacctcagaggaacccatggctgagatctccagtcaaaaaattcagattgcggtcctggacatgatcgccacaatatcttccagcaaaagaagtgctattgcattagaaagtgtactaaagaaggtttgtggccttgtggttggtatcgcctacagtagtttgacaggtttgcaagaagctgctataagggcattggcaggccttgcctgtatggatgctgaccttgtctggcttctcttggcggatgtttattactcactaaaccaaagggatatacctttaccgcccaaccaagatgtggcagagatatcagatcttttgcccccaccaatgtctgcgagagaatacctctttgtacagtacggaggcgatggtgtgagatgtgatgtagacccgtcatctgttcacgaggtgttcaaaaggatgcaggatgtggtcctaacatgaaaatcaggttgatctccctgtataaaaaccttgccgatgggattttgtgtcactgctggctagcccgccagtgtcacatattttgcctgtactggaaaatggaacaatgatgaaggatgagctggagttgccagggaacatctttgtggtgtcgcaattggatatgtcattggcattatgctttgttgctagaatcagtgaagagtgcgatctgtttctatcaagcaattgcacttggcatgtgtgactgtatgccatggacattgttctccatgatgttgtgagcaaggagcagcaaccgcttggaggggtcatcaagcaaattacaacacaagcaaagtacaggatggttttctgatggggtgcatgtgtaattatatcgagcaaacgtgtatcacatggtggagtttagtcgtgtgaaaagaaaggtagatgatgtataaaccatctctgagttgattgctcccttttctgaagcgtttttttattctgggtctgggatattcatgtctaatgcccgtcaaaattcgttggtaaacatcttgctagccctttctaatctgtaaaacaaaaggtgaacacctcgcttcagtcccgtatagatcacggatattccttttgtt

SEQ ID NO: 5709 - DNA, 1002 bp, Saccharum officinarum
aggagtagcagccggcggcggccatagcacaggagcccggagctgtttcttcgtcgcaagaatgagcaagaatggcatccagtacgcagtggtggacgccttcacggcggagccgttcaagggcaaccccgccgcggtgtgcctcctcgaggacgccgccaaggccgctgacgagcggtggatgcagtccgtcgccgccgagttcaacctctccgagaccgccttcctcctccgggactcctccgcgtccggcgccgccccgcggttccagctccgatggttcacccccgccgctgaggtggagctctgcggccacgcgacgctggcctccgcccacttcctcttcacatccgtcctcgcggagcacgaggcgctcatcgagttctcgaccaagtcggggattcttacggccaaaaaggttcctgcgccggagagcacgggcgtgtcaggcgaggggaaactgttcattgagctggatttccccatgattgacctcgttgattgccatccttctgagctgccgtccatccccgagacgctgaacggagcctccattgtcagcgttcacaagtcaacgaccgctggtgacctcattgtggagctttcatcaggaaaagaggttgctgatatcattcctaacattcatgaaattaaaatgtgttctggcagaggaattattgttacagggccagcgcctgctggatctggttatgacttcttcacgcgttttttctgcccaaaatttgggatacctgaggatcccgtttgtggcagtgcgcattgtgtcttagcaccttattggggcgggaagctggggaaacacaaactgacggcatttcaagcatctccacggagtggaatactatacctggagttagaagctgcaggcaggagagtgcaaattcagggcgaagctgttactgtgatgactggtaccctcctagcgtagccgctcaatgaacttccgctgtcttcagtttggttgtgcggcatgattactct

SEQ ID NO: 5710 - DNA, 1129 bp, Zea mays
cagcagccggcggcggccatagcccaggagcccggagctgtttcttcgtcgcaggaatgggcaaggacggcatccagtacgcagtggtggacgccttcacggcggagccgttcaagggcaacccagccgcggtgtgcctcctcgaggacgccgccaaggccgccgacgagcggtggatgcagtccgtcgccgccgagttcaacatctccgagaccgccttcctcctccgggaaaagtcctccgcggccggcgccgtcccgctgttccagctccgatggttcacccccgtcgctgaggtggagctctgcggccacgccacgctggcttccgcccacttcctcttcacatccgtcctcgcggagcacgagaagctcgtcgagttctcgaccaagtccgggattcttacggccaaaaaggtccctgcgccgcagagcacgggcgtgtcgggcgaggggaagctgttcattgagctggatttccccacgattgaccttgttgattgccatccttccgagctgccggcaatccccgacaccctcaacggagcctccattgtcagcgttcacaagtcaacgacggccggtgacctcattgtggagctttcatcaggaaaggaggttgctgatatcattcctaacattcatgaaattgaaaagtgttccggcagaggaattattgttacagggccagcgcctgctggatctggctacgacttcttcacgcgttttttctgcccaaaatttggaatagatgaggatcccgtttgtggcagtgcacattgtgttttagcaccttactggggtgggaagctggggaaacacaaactgatagcgtttcaagcatcccctcggagtggaatactatacctggagttagaagctacaggcaggagagtgcgaattcagggagaagcggtcagtgtgatgactggcaccctcttagcataacccctgctcaatgaacatcctatgtcttcacttcagttgtgtggcatgatttctctgcagctaggaataaattaagtctcttttcacctgtccaaaggtgttagatacactgcttccagactatgaagcagagtgtatgaggatgtttcttttgaataaatcagtgggtgttcaatgtgtgt

SEQ ID NO: 5711 - DNA, 3047 bp, Sorghum bicolor
gttccaaaaaattttgcaaaataggaatagtaccactttcgtttgtatttgacaaatattatccaaacatgtactatgtagatttaaaaagttcgtctcgtcaattccgaccaaactgtgcaattagttttattttcgtctatatttaatacttcatgcatgcgtttaaagatttgatgtgacgaggattctgaaaaattttgcaaaattttctggcaactaaacaaggcccgaaccaaactgcacctcatgcatacaaaaagcagacggcgacctttcgaagaccggcataggaaatagccaggagcagcagccggcggcagtatagcacaggagccccgagctgtttcttcgccgcaggaatgggcaaggatggcaccaagtacgcagtggtggacgccttcacagcggagccgttcaagggcaaccccgccgcggtgtgcctcctcgaggacgcctccaaggccgccgatgagcgctggatgcagtccgtcgccgccgagttcaacctctccgagaccgccttcctcctccgggacgactcctccgcggccggcgccgtcccgcggttccagctccgatggttcacccccgccactgaggtggacctctgcggccacgcgacgctggcctccgctcacttcctcttcacatccgttctcgcggagcacgaggcgctcatcgagttctcgaccaagtcggggattcttacggccaaaagggttcctgcgccggagagcacgggcgtgtcaggcgaggggaaactgttcattgagctggatttccccgtgattgaccttgttgattgccatccttccgagctgccgtccatccccgagaccctgaacggagcctccattgtcagtgttcacaagtcaactggtgacctcatcgttgtggagctttcatcaggaaaagaggttgctgatatcactcctaatattcatgaaattaaaatgtgttctggcagcggaattattgttacagggccagcggcagctggatctggttatgacttcttcacacgttttttctgcccaaaatttgggatagatgaggatcctgtttgtggcagcgcgcattgtgttttagcaccttattggggtgggaagctggggaaacacaaactgacagcatttcaagcatcctctcggagtggaacactatacctggagttagaagctgcacgcaggagagtgcgaattcagggagaagctgtcagtgtgatgactggtaccctcctagcatagccctgctcaatggacgtttgctgtcttaactttagttgcgaggcataattcttctgcagctaggattaaatcaaacctctgtggtataattccagactaagcagagtgtatgtgggtgtttcttttgaataaatcagtggatgttcaatgtgtgcagtattttctgtttgcattggcttgaattgaagcaatgaactagatttatgggctggatgaagaacatagatctgaacaaactgtctgtagagtatactagttaattgtcaacatttgcttctaatgcccaagggtgccaagacttgtcagatttggatctctcacaattctattcgtttttttaatgagaaatcttgtagtcccaagtcccaagtcccaaacaaacatgcaggctgctggtcagacccctatttcatttcatttcatttcattttcatgactatgccgtcactgctgattgcaaacttagcagccagcacgacaacactaacatgtattcccctgttccaaattataagttatgttacctttataggtacatatattttactataaatctagacttacactatctaggtgcacaataaaaactatatagagaaaaactaaaattccttataatttagaacggagcagcagcagtgtaccaatatcaaagaccgacaagccatgtctataatgggcggctatactacactatgtctaatatataattaaagcgactatgtctaatatataattaaagcgatgtataagtgtattataatttggaatggagggagtactattccgtggtgaacagtgcttgaaaaaagaacactgagtggaacttcgccacatcggggtgggggacaacatttctatggtctcgaattagtggtttcgcatgatgcggttcaattgctgtgagaattctggtagtcccaagcaaacatgtattttcgatttttcgatttcgagagaggcgacaagctcgatgtggtcattgctgattgcaacattcagcagtcaggacaacgcactcatgttaatcgtgcataaaaaaaaaagcaaaagcagccctgttcgtagtaaaaaggagcagcagccgccgccggcggccatagcacaggagcccggagctgtttcttcgtcgcaggaatgggcaagaatggcacccagtacgcagtggtcagtagtactgctctgtactctcttggacgggagcgatgctcccttttcttatcagctcgcaggaggatacctgacatcgtcgccgtggtcgtccgcagctggacgccttcacggcggagccgttcaggggcaaccccgccgcggtgtgcctcctccaggacgccgccaaggccgctgacgagcggtggatgcagtccgtcgccgccgagttcaacctctccgagaccgccttcctcctccgggactcctccgcgtctggcgccgccccgcggttccagctccgatggttcacccccgccgctgaggtaggtacccacccgactcatcgtcacacagttgcgcgtaatccagtctcgagtcttctcttgacgcggttccaggtggagctctgcggccacgcgacgctggcctccgcccacttcctcttcacatccgtcctcgcggagcacgagacgctcatcgagttctcgaccaagtcggggattcttaccgccaaaagggttcctgcgccggagagcacgggcgtgtcaggcgaggggaaactgttcattgagctggatttccccatgattgaccttgttgattgccatccttccgagctgccgtccatccccaagaccctgaacg

SEQ ID NO: 5712 - DNA, 1140 bp, Saccharum officinarum
aggagcagcagccggcggcggccatagcccaggagcccggagctgttccttcgtcgcaggaatgggcaagaatggcatccagtacgcagtggtggacgccttcacggcggagccgttcaagggcaaccccgccgcggtgtgcctcctcgaggacgccgccaaggccgctgacgagcggtggatgcagtccgtcgccgccgagttcaacctctcccagaccgctttcctcctccgggactcctccgcggccggcgccgtcccgcggttccagctgcgatggttcacccccgccactgaggtggacctctgcggccacgcgacgctggcctccgcccacttcctcttcacatccgtcctcgcggagcacgaggcgctcatcgagttctcgaccaagtcggggattcttaccgccaaaagggttcctgcgccggagagcacgggcgtgtcaggcgaggggaaactgttcattgagctggatttccccatgattgacattgttgattgccatccttccgagctgccgtccatccccgagaccctgaacggagcctccattgtcagcgttcacaagtcaactggtgacctcatcattgtggagctttcatcaggaaaagaggttgctgatatcactcctaatattcatgaaattaaaatgtgtcctggcagcggaattattgttacagggccagcgccagctggatctggttttgacttcttgacgcgttttttctgcccaaaatttgggatagatgaggatcccgtttgtggcagtgcacattgtgttttagcaccttattggggtgggaagctggggaaacacaaactgacagcatttcaagcatccactcggagtggaacactatacctggagttagaagctgcacacaagagagtgcgaattcagggagaagctgtcagtgtgatgactggtaccctcctagcatagcccagctcattgaacttctgctgtcgtcactttagttgcgaggcatagttcttctgcagctaggaataaatcaaacctctgcggcataattccagactatgaaagcagaggtgtatgtgggcgtttcttttaaataaatcagtggatgttcaatgtgtgcagtattttctgtttgcattgccttgaattgagac

SEQ ID NO: 5713 - DNA, 2169 bp, Panicum virgatum
tctgtgtagctgtgaatgacccgtatgtcctgaatggatgggcagaaaagctacaggctaaagatgcaattgagttctacggtgactttgatgggagtttccacaaaagtttggatttggagatagacctatctgctgctttgctcggccgtcgatctcacaggtggtcggctttcgttgatgatggcaagatcaagtcattcaatgttgaggaagcaccctccaatttcaaggtttctagcgcggaggtgattcttgaccagatctgagcttaccaacgaacctgggatgccttcagtttgctcgtgcagcatgcttgctcagctgcagtaaataaatgaaaactccttttatctttgtaaagaactaaagatgctaggtgctcccatatactgtctcggatacactgcagtgtcttgagtcttcgactggaccgtgaaggacttgagtatttctgtatttgatgcccaagtggaagcctgaccaagtgccaagtgaccatggcgtcttctggcttcatctggctaggcacgtctccgtttcaaattcggcatctcgccacgctgcgatgcaattcccgcgccatttctcaccgttccaaacattagcaggctaggcagtactgtgtgcaggtagttcttatctttttcttggaaaaaatatgtagtttattatcttggctccattggagtgggtccccaactctccaccaggaacaggacaagttgaatgtcgtcactgctgattgctgcactcgacagtcagcacaacagtcagcacgacgccacgacgcactcaccgactcccacacgacgcactcacatgagcgaaacctgaaggctaccgccgctacaagaccccaacacacaaaattgccggagcagcagccggcgccggcgacagcagagagccccggtgtactcgtcgtcgcaagaatggccaagggtggcatcgagtatgccgtggtggacgccttcacggcggagccgttcaagggcaacccggccgcggtctgcctcctccaggacgccgccaaggccgcggacgagcggtggatgcagtccgtcgccgccgagttcaacctctccgagaccgccttcctgctccgcgactcctccccagccgccgctgccgccccgcggttccagctccgatggttcacccccgccgccgaggtcgagctctgcggccacgcgacgctggcctccgtccacttcctcttcacatccgttctcgcggagcacgagactctcgtcgaattcgcgaccaagtcgggggttctcaccgccaagaaggtagctgcaccggcgagtgcggcggtttcaggtgaggggaaactgttcatcgagctggatttccccatgattgaccttgtcgattgccatcctgccgagctgccgtccatccccgagactctgaacggagcctctgttgtcagcgtccacaaatcggcgacagctggtgacctcattgtggagctttcatcaggaaaagaggttgctgatatcatccctaacattcatgaaattaaagtgtgttctggcagaggagttattgttacagggccagcacctgctggatctggttttgacttcttcacacgtttcttcaacccaaaatttggggtagatgaggatcccgtttgtggcagcgcacattgtgttttagcaccctactggggtggggagctggggaaacaaagactgatggcattccaagcatctccacggagtggaatattacacttggagttggagcctgcaagcaggagggtgcgaattcagggggaagctgttacagtaatgactggcaccctcctagcgtaacagttccccatgctttgagatttgaaggacagcggtcaccattattagcttatggaaacaaaaagatcctgaactttttctagagcatcaaaataaattcgcagtgaaagcatgatgtcataaatcaccaggtcattttggtttgtcatttctaaagaacctagaccaagagtgtcttttattaagaagatttttttttgccatttctcgatcctattgccttgttgaaacttaaaagcaataaaggatggatatgaatttaaaaccatccgtgaagtctgaacaaaaagatggagcgagaggatggaatttgaggttctgcgtgatgacgaatatttatctt

SEQ ID NO: 5714 - DNA, 1222 bp, Setaria italica
ccgccgctggcgctagcacagagccccggtcagcagtgctcgtcgtcgcaagaatggccaagagtggcatccagtacgccgtggtggacgccttcacggcggagccgttcaagggcaacccggccgcggtctgcctcctcgaggacgccgccaaggccgccgacgagcggtggatgcagtccgtcgccgccgagttcaacctcgccgagaccgccttcctcctccgcgactcctccgccgccgccgccccacggttccagctccgatggttcacccccgccgccgaggtcgagctctgcggccacgcgacgctggcctccgctcacttcctcttcacatccgtcctcgcggagcacgagacgctcatcgaattcgcgaccaaatcggggattctcaccgccgagaaggttcctgcaccggcgagtgcggcggcctcaggtgaggggaagctgttcatcgagctggatttccccatgattgaccttgtcgattgccatcctgccgagctgccgtccatcccccagaccctgaacggagcttccgtcgtcagcgttcagaagtcggcgactgctggtgacctcattgtggagctttcatcaggaaaagaggttgccgatatcattcctaacatccatgaaattaaaaactgttcaggcagaggagttgtatttacagggccagcacctgagggatctggttatgacttcttcacacgtttcttctgcccaaaactaaacatagatgaggaccccgtttgtggcagtgcgcactgtgttttagcacccttttggggcgcgaagctgggaaagcagaaactgacagcatttcaagcatctcgacggagcggaatattacacctggagttggaacctgcaggcaggagagtgcgaattcagggagaagctgtcgctgtgatgactggtaccctcctagcctagcagctctccgtgcatgcttccattcatgaaacacaatagtcaatgaatctgctggcaaatctttttgtcctgctatgggattgtttaaagttattcagtttcgggaataaaagatcctgaacttttcttgtggactggaataaagttggagtgaaatcgtgatgtcctaaattaccagctccttttggtgcgtcatttctcagtgtccatagcaggagagttctagaaaaaagtgaatgatgctttgatctgaattgtggatataaacagttgagagtgtgcaa

SEQ ID NO: 5715 - DNA, 1207 bp, Setaria italica
ccgccgctggcgctagcacagagccccggtcagcagtgctcgtcgtcgcaagaatggccaagagtggcatccagtacgccgtggtggacgccttcacggcggagccgttcaagggcaacccggccgcggtctgcctcctcgaggacgccgccaaggccgccgacgagcggtggatgcagtccgtcgccgccgagttcaacctcgccgagaccgccttcctcctccgcgactcctccgccgccgccgccccacggttccagctccgatggttcacccccgccgccgaggtcgagctctgcggccacgcgacgctggcctccgctcacttcctcttcacatccgtcctcgcggagcacgagacgctcatcgaattcgcgaccaaatcggggattctcaccgccgagaaggttcctgcaccggcgagtgcggcggcctcaggtgaggggaagctgttcatcgagctggatttccccatgattgaccttgtcgattgccatcctgccgagctgccgtccatcccccagaccctgaacggagcttccgtcgtcagcgttcagaagtcggcgactgctggtgacctcattgtggagctttcatcaggaaaagaggttgccgatatcattcctaacatccatgaaattaaaaactgttcaggcagaggagttgtatttacagggccagcacctgagggatctggttatgacttcttcacacgtttcttctgcccaaaactaaacatagatgaggaccccgtttgtggcagtgcgcactgtgttttagcacccttttggggcgcgaagctgggaaagcagaaactgacagcatttcaagcatctcgacggagcggaatattacacctggagttggaacctgcaggcaggagagtgcgaattcagggagaagctgtcgctgtgatgactggtaccctcctagcctagcagctctccgtgcatgcttccattcatgaaacacaatagtcaatgaatctgctggcaaatctttttgtcctgctatgggattgtttaaagttattcagtttcgggaataaaagatcctgaacttttcttgtggactggaataaagttggagtgaaatcgtgatgtcctaaattaccagctccttttggtgcgtcatttctcagtgtccatagcaggagagttctagaaaaaagtgaatgatgctttgatctgaattgtggatataaaca

SEQ ID NO: 5716 - DNA, 1350 bp, Zea mays
gacgagccttggttcagagaaacagggcactgggtttagagcccttcggatctagtattgtcgttcaccggcggcgaccaggccaaaccctagaaccttgccaagatgaggtcgttgcgagcggcgcagaccctagtctcccgttcccttttctcagcgcgccatctaagcggcgcagcctcccccgccacggccgccgccgcgggcgcgcggtggtgtgcagcgccggcgccaccgccccgttcgccgcttccatcctcgagggtgatgcctgccggggttgccggcgcagtatccttctcccttaccttcgctactgtagcggcggcggaggccaaggccaaggagcgaccgcaaccggatctgttgccgcagaacgtggtgctgtaccagtaccaggcgtgccccttctgcaacaaggtcagagcctttttagattatcatgatataccatataaagttgtggaagttaatccattgagcaaaaaggaactcaagtggtctgattacaagaaagttccaatattgacagtagatggtgaacagcttgttgattcatcagatataatcaatatactacagagcaggatcaaccccaatgaagaactcactagtgacgaggaagcaaaatggcgaaggtgggttgatgagcaccttgtgcatgtcttatctcctaacatatatcggacaacttcagaagctctagaatcttttgactacattgcaaaacatggtaatttcagttttacagagaggtttgccgtgaagtatgctggtgctgcggccatgtacatggtatctaagaaactaaagaagaaatacaacataactgacgagcgtgcttcattgtatgatgctgccaatacatggatcgacgcactgaacggaagagatttcctgggtggctccaagcctaacttggcagatcttgccgtcttcggtgttctgagacctatccgatacttgagagcaggaaaagatatggttgagaacactgaaatcggcgattggtaccgacgcatggaagacgcagttggagaaccatcaagaatacaggatgcagaaggaaactagaattttgacaacattcttttaaatactttagcggtatccgtgcctatgcatggaggctattcaaattttttgccagaatcaagtgtatgcaataatgctctgccagattattaagtatactagcacctgaggaacagtgtttgacttgggaacttggttgtgttactgtgtaaggttttgctcccctagctgttcacgtctgtattgtctgcgatgtggttttgaagattcagcatcagcgattctgctgtgccttgcatacagtttaaagaattt

SEQ ID NO: 5717 - DNA, 1666 bp, Setaria italica
gtcgtccatctggagcttcttgtagaggccacggtttgcgccccttctccacgcaaattttcttcccccggcacccgcaggccgccgccgccatcccccacaccgctagtccgccgcaagccgtcgcgaactcgcgtgtcgctcgctcccgaccgcgccgcataatgaggtcgctgcgagcggcgcagaccctagctttccgctccctcctctccgctcgcgcgctccacggcgccgcctccccagcggcggccgccgctgcgggcgcgcggtggagcgctccgctggtgccgccgccccgttcgccgcctccgtcctcgagggcggtgccggccggggtcgctggcgccgtgtccttctcccttaccttcgctactgtagcggcggcggaggcgaaggcgaaggagcgcccgcctgcggatctgttgccgcagaatgtagtgctataccagtaccaggcgtgccccttctgcaacaaggtcagagcctttttagactatcatgatataccatacaaggttgtggaagttaatccattgagcaaaaaggaaatcaagtggtctgattacaagaaagtcccgatattgacagtagatggtgaacagcttgtggattcatcagatataattaatatactacagggcaggatcagacctgatgatgaactcactaatgaagatgaagcaaaatggcgaaggtgggttgatgagcaccttgtgcatgtcttgtctcctaacatatatcggacaacttcagaagctctagaatcttttgactacattgcaaaacatggtaatttcagttttacggagaggtttgctgtgaagtatgctggtgctgctgccatgtacatggtgtcaaagaagctaaagaagaaatacaatataactgatgagcgtgcttcattgtatgatgctgccaacacatgggttgaagccctgaatggaagagatttcctgggtggttccaagcctaacttggcagaccttgctgtcttcggtgttctgagacctattcggtacttgagagcaggaaaggatatggttgagaatactcaaatcggtgagtggtaccagcgcatggaagatgcagttggagaaccatcaagaatcgaggagtagaaggaaactataattttgacatcagaatatatccttagacaccaaactattcaaatttttgcccgtgtatgaaataatgctctgccatatacaaagcacgaagagtgttttgacttggaaacatcgcagtggtcgtttgtgctctgacaatgtgctccaactttgaataccacggaggaactgagtgtttgacctggaaaatggttgtggttgtttgtggtggtgtggtctgacgatatgctccgactttggaggattaaaaatgtcggaggatgtctgttgtgcctagcttacagttcgttagagcatcagtttaccagagcacggagtagcggtgacgagctcacggccgggaggtcaggttcatgctactccctcgtttagttcatttagatttgttttaagctgaacatctctaactttgatgaattctttgaaaaatacattaacatgtctataacattataaattggttttattaaattgaccatgttttgatagtgactacttagtactgtatatgttaatgtaagggattgcgtacg

SEQ ID NO: 5718 - DNA, 1477 bp, Oryza sativa
gcgttccatccagcaccatccaggatctcccttgtaattcctaaatccgtctcttcttccgccggcgccggcgaggcaaaccagtccaaaaccctaacagccccgctctattcgtttgccaagatgaggtcaatcagagcggcgcaagctctggcctcccgctcgctgctcctctcctcgcgcgctctccatggggacgccgcctccacggcggcggccgcggcgggcggcgggagattgggcgtccagccgtcgcccccatcccaggcatcatcatcatcatcctcgcgggccatgccagctggaatcgctggggcggtctccttctccctgaccttcgcgacgatggcggcggcggaggccaaggaaaggccgcccatggatctgctgccgcagaacgttgtgctgtaccagtaccaggcctgccccttctgcaacaaagtcagagctttcctagactatcatgatataccctacaaggttgtggaagttaatccattgagcaagaaggaaatcaagtggtctgagtacaagaaggtcccaatactgacggtagatggtgaacagctggttgattcatcagatataatcaatatattacagcaaagggtccgccctgatgataaagccactaatgaagaggaagaaaaatggcgcaggtgggttgatgagcaccttgtgcatgtcttgtcgccaaatatatatcggacaacttcagaggccttggaatcttttgattatatttcaaaacatggcaacttcagttttactgagcggtttgctgtgaagtatgctggtgctgcagcaatgtacatggtgtctaagaagctaaagaagaagtacaatataactgatgcgcgtgcttcattatacgatgctgccaacacatggatggaagcccttgatggaagggattttctaggtggctccaagcctaacttggcagatcttgcagtatttggtgttttgagacctatccgatacttgacagctggaaaagatatggttgagcatacacaaattggtgactggtaccaacgtatggaagatgcaattggagaaccatcaagaatccaggagtagaacgaaattagtagaatttctttttgcctcttcaagtctttgaccatttcaaacggaaggaagtatatgctttagacattgaaattattgaagttttgcagaatgtgtgacaatgtaataatgtgacatcatatatttagtacacagagaattgaacatgaaaaagaaggaactcgaacttcctgttttggttttaaatcattgtacggctgtttgtatctaacttttccaagtcgcgacgtcattatttcgttcctggtttaggagtatatgagaaatttttgggggggtcagtcgtgaagtattaacttgtgatcgtgttgatggataaactgcaagatttacattctccatcgatattttgtgatgttctaatacagcttgattgtgcttt

SEQ ID NO: 5719 - DNA, 1329 bp, Setaria italica
cccacaccgctagtccgccgcaagccgtcgcgaactcgcgtgtcgctcgctcccgaccgcgccgcataatgaggtcgctgcgagcggcgcagaccctagctttccgctccctcctctccgctcgcgcgctccacggcgccgcctccccagcggcggccgccgctgcgggcgcgcggtggagcgctccgctggtgccgccgccccgttcgccgcctccgtcctcgagggcggtgccggccggggtcgctggcgccgtgtccttctcccttaccttcgctactgtagcggcggcggaggcgaaggcgaaggagcgcccgcctgcggatctgttgccgcagaatgtagtgctataccagtaccaggcgtgccccttctgcaacaaggtcagagcctttttagactatcatgatataccatacaaggttgtggaagttaatccattgagcaaaaaggaaatcaagtggtctgattacaagaaagtcccgatattgacagtagatggtgaacagcttgtggattcatcaggtcacagtttttttctcttttgtcccttttgcatagtcgtaattgcaaaccccatgttcttttttccatatgggctaaacaatgtattccttttgcatttttgtgatcttttattggcagatataattaatatactacagggcaggatcagacctgatgatgaactcactaatgaagatgaagcaaaatggcgaaggtgggttgatgagcaccttgtgcatgtcttgtctcctaacatatatcggacaacttcagaagctctagaatcttttgactacattgcaaaacatggtaatttcagttttacggagaggtttgctgtgaagtatgctggtgctgctgccatgtacatggtgtcaaagaagctaaagaagaaatacaatataactgatgagcgtgcttcattgtatgatgctgccaacacatgggttgaagccctgaatggaagagatttcctgggtggttccaagcctaacttggcagaccttgctgtcttcggtgttctgagacctattcggtacttgagagcaggaaaggatatggttgagaatactcaaatcggtgagtggtaccagcgcatggaagatgcagttggagaaccatcaagaatcgaggagtagaaggaaactataattttgacatcagaatatatccttagacaccaaactattcaaatttttgcccgtgtatgaaataatgctctgccatatacaaagcacgaagagtgttttgacttggaaacatcgcagtggtcgtttgtgctctgacaatgtgctccaactttgaataccacggaggaactga

SEQ ID NO: 5720 - DNA, 3195 bp, Avena sativa
ggcccggggacgaccccttcgacatccccgccaagcgggcccccgtcgagcgcctcaggcgatggaggcaagctgcacttgtgctcaatgcttctcggcgattccgatatacactggacttgaaaaaagaggaagaaaaagaacacataaggaggaaaattagggctcatgctcaagtcataagggccgcattacttttcaaggaagcaggagaaaagcagaatggcgatagagaattaccagaaattcccccacggggttttggcattggagaggaacaacttacgtcgatgacaagggaccataacttttccactctgcaagaatatggaggggttaaagggctcctaaatttactgaaaacaaactcagagaagggaatccatggagatgaagaagatttatcatgcagggcgaatgcttttggggctaacagatatcctcgcaagaaaggaagaagcttttgggtttttctctgggaggcctgccaggacttgacactggttatccttattgtggctgcagccatttctctagcattgggcatcgctacagagggtatcaaagaaggatggtatgatggtgctagtatagcatttgctgtctttcttgtgatatttgttactgctgtcagtgattacaaacagtccctgcagttccaacacctcaatgaggagaaacaaaatatccaagtcgaggttattaggggcggtagaaggattcaagtgtcaatctttgacattgtggttggcgatgtagtagctttaaaaattggtgatcaggttccagctgacggtattttaattagcggccattctcttgccattgatgaatccagtatgactggggaaagtaaaattgttttcaaggatcagaagtcaccttttctaatgggaggatgcaaagtagctgatggttatggttccatgttggtaaccgcggttggtctgaatacggaatggggtttactaatggctagcatttcagaagacaacaatgaagagactccattacaggtgcggttgaatggagtagcaacattcataggcattgtggggcttgtcgtcgctgcactggttcttgtagtcctttttgcaagatattttacaggacatactacaaactcagatggcaccgttcagtttgttaagggacaaacaagtgtgaaaaatataatatttggatcaataaagatactaactgttgcggtcactattgttgttgttgctgtacctgagggactaccgctggctgtaacactaaccctggcttattcaatgcggaaaatgatggcagacaaagctttggtgagaagactttcagcttgtgaaacgatgggctctgctacaacaatttgtagtgacaagactggtacattaacactcaaccagatgactgtggtgcgatcaatagttgcggggatagagctgcaacctcaggctactatcgagaagttgtcacctacagttacctcttttgtacttgaaggaattgcacagaatacttcaggcagtgtgtttgagccagaggatggtagcactgtcgaggtaacaggctcaccaactgagaaagcaatcctttcgtggggtgttgagcttcacatgaaatttgcggtggagagatcgaaatcttctatcattcatgtctctccattcaactcagagaaaaaacgtggtggtgttgcagtaactgggagagattcagatgttcatgtgcactggaaaggggctgctgaaatagttcttgccttatgtacaaattggcttgatgtagatggctcaactcatgaaatgacacctgatgaggctaatcaattcaagaaatacatagaagatatggccgagcaaagtcttcgctgtgttgcttttgcttatagaaatcttgatctgaaggacattccaagtgaggaacaaagaattagctggcagttgccagataatgacctgactcttatcggtattgtggggatgaaggatccttgtcgccctggagtgagagatgctgttgagctgtgcaccaattctggcgttaaggtacggatggtaactggagataatctgcagacagctagagcaatagcactcgagtgtggaatactcactgacccccaggcttctacaccagttataatagagggaagagttttccgtgcgttcagtgatgcccaaagggaggaagttgccgacaagatatccgtgatgggaagatcctcaccgaatgataagcttctccttgtaaaagcactcaagaagaatggccatgttgttgctgttactggtgatggaacaaatgatgctcctgcattgcatgaggcagatattggtctttctatgggcatccaaggaacagaagtagctaaagagagctcagacataattattctggatgataattttgcttccgtcgtgaaggtggttcgctggggtcgttctgtttatgccaatatccaaaaatttattcaattccagcttactgtaaatgttgcggctcttatcatcaatgtggttgctgccatttcctctggcaatgttcctctaaatgctgttcagcttctctgggttaatctcataatggacacacttggtgcacttgcattggctactgaaccaccaacggaccaacttatgaagcggacacctgttggacggagagaacctcttgtgactaatatcatgtggagaaacttgttcattcaggctgtctatcaagttgctgttcttctgacgcttaactttggaggccgaaatcttctgcatttgactcaagatacccttgaacactcaagcaaagtgaaaaattcatttatattcaacacatttgtcctgtgccaggtgtttaatgagttcaattctcgtaaaccagaagagctgaacatatttgaaggagtttcaagaaaccatctctttttggccgttgtgagcataactgttgtgctgcaggtgataattattgagttcctggggaaatttacatcaactgtgagactcagttgggagctttggcttgtttctgtgggtattgcttttgtcagctggccgttggcttttgttgggaagttcattccagttccccagactccattgaagaatttaatcctaaagtgttggccaaaaaggaagaagcaaggtgccgaaggaccaactccaccggtgtgagactgaacatctctccaagtgacagaaattatcagctacc

SEQ ID NO: 5721 - DNA, 6136 bp, Brachypodium distachyon
ctcagcgtcgcacttcctcttaagacgatgccttgccccccctccgctcccttcccttccattcctcgccaccgccgccatccatctgctcgatcaccacttcaccaccaacaccatcgccttccgcccgcggcggtgccggggaggtggccggcggcatgtccatgtcgagcggcggcgggccgtctgggccgcagcggcagcggtcgacgacactggggccgcggggcatgtcgcgggcgatcaccatgcggacggacggtttgtccggtgaggaaggcggggatccaatcatcgtggagaccgagctcgtgccgtcctcgctcgcgcccatcgtcccaatcctccgcgcggccaatgagattgaggaggagaacccgcgcgtcgcatacctctgccggtttactgcattcgagaaggcacacaccatggatccaaactcgagttggcgtggagttcggcagttcaaaacatacctgttgcataggctggaaaaggatgaacaagagacaacacgtaggcttgcgtcaactgatgcaacagagattcagaggttctatgagcagtattgtaaaaaaaatcttgaggagggtcttcacatgagaaaaccggaagagatgtccagatactatcagattgcatccgtcctatatgacgtgctaaaaactgtgaaacctgaaaagtcgaagtttgatcagtacgctaaaggggttgagaaggagaaagcttcctattcacattacaacattttgccccttaatatttctggtcccacacaaccagtaatgaacattcctgagataagagcagcagtacatcttcttcgcaggatggagaatcttccaatgccaaggccagatctgcctgctgtgcctgaagagatagatgaacctaacgtccatgacttacttgattggctctggcaaacatttggatttcagaaaggtaatgtggagaatcaaaaggagcatttgattttgctgcttgccaacatcgatatgagaaaaggtggtgaaagacacatgatagataacgacacagtggaacacttgatgaagaagatttttcaaaactacatttcatggtgccgttatttgcatttggagtcaaacatcaaaattccaaacaatgcctccacacaacaaccagagcttctttacatagggttgtatttgctgatttggggcgaagcttctaatgttcgctttatgcctgagtgcctttgttatatattccaccatatggcaagggatttgtatgacataatatcagataaaagtgaaggttcctttgacccacccttccggcgagaggggagtgatgatgcatttctgcagctggttatccaacctatatacagtattattcagaaggaagctgcaatgaataaggttggtactgttagccactcaaagtggagaaactatgatgacctgaatgaatacttttggtcgaagaaatgcttcaaacagcttgggtggccaatggatccaacagctgacttttttgcagatcctacaaaaacgaaaaatgaaattgagcgacatgatcattcacttagcagaaggaggatgccaaaaacaaattttgttgaagttcgtacgtttttgcaccttttcagaagttttgatcgaatgtggtcttttttcatattagctttccaggcgatggtaattattgcatggagcccttccgggtcactttctgctatcttcgatccagctgttttcagaaatgttatgacaatattcataacagctgcatttttaaacttccttcaagccacacttgagatagttcttaactggaaggcttggaggagcctggtgtgctcgcagatgatacggcatattctgaaatttgttgtagctattggctggttgataattcttccatcaacatactcaagttctattcaaaatcccacaggccttgtcaagttcttcagcaattggattgggaacttacagagtcaatcgatttataattttgcagttgcgatttacatgttaccgaacattttcagtgccttgtttttcatatttctaccaatacgaagagcattggaacgttcaaattcacgttttgttagatttctcttgtggtggactcagccaaagttatatgttgcccgaggcatgtatgaggacacatgttcacttcttaaatacacaacattctggattctattgcttatatgcaagctcgccttcagtttttatgtcgagatttctcctctagttgtacctaccaggataattatgtttttgggacgggggaagtacgtgtggcatgagttctttccatacttgcagcataatttaggtgttgtttttactgtatgggcaccgattgtcatggtatacttcatggacacacaaatatggtatgctattttttccacaatatgtggtggagtaaacggggccttcagccgcttgggtgagatccgaacccttgggatgttaagatcaagatttgaggcaatcccaagagcttttggtaaaaagcttgtgcctggagatggtattaaatcaaagagacgtgaacaggaggaggaaaaaaatccgcatattgataagttctctgaaatatggaatgcatttattaactctttacgagaagaagacttaataagcaatagggagaaagacttattgattgtcccatcatctgtgggtgacactagcgtttttcagtggcctcctttccttctcgctagtaagattccaattgcaattgacatggcaaagggtgtcaagaaaaaggatgaagaattgcgaaagaggataaaccaagatccatatacctattatgctgtagtagagtgctatgagacattgttaattattctatacagccttataacagaagcaagcgataggaaagttattgatcgaatcagtgatagcattactgcaagcatacataatcagtcacttgtgaaagatttccgactggatgaacttcctcatctaagtgctaagtttgagaagttgctaaagctactattgtcaccgaaagctgagtcaggggagcatgacaccccagagaagacacagattgccaatctattacaggatacaatggaaatcatcacacaggatattatgaagaatggacaaggtattttgaaggatgaaaataaaggcaatcaactatttgcaaatctaaatctggactcaataaagagtcaagcttggagggagaagtgtgttaggcttcaattgttgttgacaacgaaagaatctgcaatttatgtaccaataaacttggaagctcggcgcaggattactttttttgcgaattcactgtttatgaaaatgccaagggctccaccggtccgcagcatgatgtccttcagtgttttaactccatacttcaaagaggaggtgctcttttcaaaagatgatctttatgaaaaaaatgaggacgggatatccatactgttctatttacggaaaatttatccagacgaatggaaaaattttcttgaacggatacagttcaaaccgaaggatgaagattcccttaaatcagagatggatcgcatcgcaccctgggcatcatataggggacaaacgctcaccaggacagtgagaggaatgatgtattataggagggcacttgagattcagtctattcatgatagaactgatattgctaaactggagcgtcaaaaaacaaccgcatcctatcaagagggtgggtccattgtagatacggcggcactggccattgctgatatcaaattcacatatgttgtctcttgtcaagtctatggcatgcacaaaatatccaaggatgcaaaagagaaagtttgctatctgaacatccttaatctcatgataacgtatccatcgttacgaattgcatatattgatgaggtagaagctccgactagaaatggaacgacagagaagacttattattctgttcttgtcaaaggagtaggtgaaaagtatgatgaggaaatttaccgcatcaagcttcctggcaaacccacagaaattggagagggaaaacctgaaaatcaaaatcatgccataattttcaccaggggagaagccctccaggccattgatatgaatcaggataattacctcgaagaggcctttaaaatgagaaatgtactggaggagttcgcgagtgatgattatggaaagagcaaacccactatattaggtcttcgagagcacatttttactggaagtgtttcatcacttgcttggtttatgtccaatcaagagaacagctttgttaccattggacaacgggttctggcaaatcctctcaaggttcggtttcattatggtcatcctgatatctttgatagactcttccacattactaggggtggcataagtaaagcttccaaaactataaatttaagtgaagatatattttcaggttttaactcaacaatgagagaaggaaatatcacacatcatgaatacatgcaagtcggtaaagggcgtgatgttggaatgaaccaaatttcaagctttgaagctaaggtcgccaatggcaatggtgaacaaacattaagtcgtgacatctatcgtcttggacgcagatttgacttctatagaatgctatctttctacttcactacagttggcttttatttcagtagcatggttactgtacttactgtctatgtatttttgtatgggaggttatatctcgttatgagtggcctggaaaagtctattttgctggatccacgtattcaagcggacatcaggccccttgaaaatgcgctagcttcacagtctgttttccagcttggtttgctgcttgttctgcctatggtcatggaagtcggcttagagaagggattccgcacagcgttaggagagtttgtcatcatgcagcttcagttggcctctgtgttcttcacattccagcttggcaccaaaacacatcactatgggcgaacaatactccatggtggcgctaaatacaggcctacaggccgtggctttgttgtgtgccatgcaaagtttgctgacaattatcgcgtgtactcccgtagccactttgttaaaggacttgaactgttgatacttctggttgtgtatcttgtttacggaaagtcctaccgcggctcgaagttgtacctatttgtaacattctccatatggttcctggttgcatcatggctctttgcaccgtttatcttcaatccatcatgttttgagtggcagaagaccgttgatgactggacagattggaggaaatggatggggaaccgagggggtatcggcatgttaggggaacagagctgggaggcttggtggacaactgaacaggagcatctcaggaagactagtattcgtgctcttctcttggaaatcatcctctcgcttcgtttcttgatctaccagtatggtattgtgtaccagctgaacatagcacgccacaacacaagcattctggtatacggattgtcatggttggttatgctgacagttctagtagttctgaagatggtttcaataggacggcaaaaatttgggacggacctgcagcttacttttcgcatcctgaagggccttctcttccttggatttgtttctgtgatggcggtcctatttgttgtatgtgaactcacaatttctgatgtctttgccagtattctcgggttcctacctactggttggtgtatccttctgatcgggcaagcatgctatccggtgattaagaagactacgctatgggagtctatcatggagctcgggagggcatacgacaacatcatgggcctcgtcctcttccttcccatcggcttcttgtcatggtttcccttcgtctcagagttccaaacaaggttgctcttcaaccaagccttcagtcggggcctccaaatttcaaggatccttgccggtcagaaggacatgggggagttcgagtgaccagtttcattgcctgcactgtgtactcgtgtaggcagcaaagcaagatacatgctccaggtcatgtgttacgatcgattttgggtgtctgtaccttgataggaccttagttcttctgctatgtagctttccttttgtagaatatgacatagtaaaatattaacattactattaatattaacatagtaatgaagatatcatctatatagagagccaaa

SEQ ID NO: 5722 - DNA, 6026 bp, Brachypodium distachyon
caccgccgccatccatctgctcgatcaccacttcaccaccaacaccatcgccttccgcccgcggcggtgccggggaggtggccggcggcatgtccatgtcgagcggcggcgggccgtctgggccgcagcggcagcggtcgacgacactggggccgcggggcatgtcgcgggcgatcaccatgcggacggacggtttgtccggtgaggaaggcggggatccaatcatcgtggagaccgagctcgtgccgtcctcgctcgcgcccatcgtcccaatcctccgcgcggccaatgagattgaggaggagaacccgcgcgtcgcatacctctgccggtttactgcattcgagaaggcacacaccatggatccaaactcgagttggcgtggagttcggcagttcaaaacatacctgttgcataggctggaaaaggatgaacaagagacaacacgtaggcttgcgtcaactgatgcaacagagattcagaggttctatgagcagtattgtaaaaaaaatcttgaggagggtcttcacatgagaaaaccggaagagatgtccagatactatcagattgcatccgtcctatatgacgtgctaaaaactgtgaaacctgaaaagtcgaagtttgatcagtacgctaaaggggttgagaaggagaaagcttcctattcacattacaacattttgccccttaatatttctggtcccacacaaccagtaatgaacattcctgagataagagcagcagtacatcttcttcgcaggatggagaatcttccaatgccaaggccagatctgcctgctgtgcctgaagagatagatgaacctaacgtccatgacttacttgattggctctggcaaacatttggatttcagaaaggtaatgtggagaatcaaaaggagcatttgattttgctgcttgccaacatcgatatgagaaaaggtggtgaaagacacatgatagataacgacacagtggaacacttgatgaagaagatttttcaaaactacatttcatggtgccgttatttgcatttggagtcaaacatcaaaattccaaacaatgcctccacacaacaaccagagcttctttacatagggttgtatttgctgatttggggcgaagcttctaatgttcgctttatgcctgagtgcctttgttatatattccaccatatggcaagggatttgtatgacataatatcagataaaagtgaaggttcctttgacccacccttccggcgagaggggagtgatgatgcatttctgcagctggttatccaacctatatacagtattattcagaaggaagctgcaatgaataaggttggtactgttagccactcaaagtggagaaactatgatgacctgaatgaatacttttggtcgaagaaatgcttcaaacagcttgggtggccaatggatccaacagctgacttttttgcagatcctacaaaaacaaggaggatgccaaaaacaaattttgttgaagttcgtacgtttttgcaccttttcagaagttttgatcgaatgtggtcttttttcatattagctttccaggcgatggtaattattgcatggagcccttccgggtcactttctgctatcttcgatccagctgttttcagaaatgttatgacaatattcataacagctgcatttttaaacttccttcaagccacacttgagatagttcttaactggaaggcttggaggagcctggtgtgctcgcagatgatacggcatattctgaaatttgttgtagctattggctggttgataattcttccatcaacatactcaagttctattcaaaatcccacaggccttgtcaagttcttcagcaattggattgggaacttacagagtcaatcgatttataattttgcagttgcgatttacatgttaccgaacattttcagtgccttgtttttcatatttctaccaatacgaagagcattggaacgttcaaattcacgttttgttagatttctcttgtggtggactcagccaaagttatatgttgcccgaggcatgtatgaggacacatgttcacttcttaaatacacaacattctggattctattgcttatatgcaagctcgccttcagtttttatgtcgagatttctcctctagttgtacctaccaggataattatgtttttgggacgggggaagtacgtgtggcatgagttctttccatacttgcagcataatttaggtgttgtttttactgtatgggcaccgattgtcatggtatacttcatggacacacaaatatggtatgctattttttccacaatatgtggtggagtaaacggggccttcagccgcttgggtgagatccgaacccttgggatgttaagatcaagatttgaggcaatcccaagagcttttggtaaaaagcttgtgcctggagatggtattaaatcaaagagacgtgaacaggaggaggaaaaaaatccgcatattgataagttctctgaaatatggaatgcatttattaactctttacgagaagaagacttaataagcaatagggagaaagacttattgattgtcccatcatctgtgggtgacactagcgtttttcagtggcctcctttccttctcgctagtaagattccaattgcaattgacatggcaaagggtgtcaagaaaaaggatgaagaattgcgaaagaggataaaccaagatccatatacctattatgctgtagtagagtgctatgagacattgttaattattctatacagccttataacagaagcaagcgataggaaagttattgatcgaatcagtgatagcattactgcaagcatacataatcagtcacttgtgaaagatttccgactggatgaacttcctcatctaagtgctaagtttgagaagttgctaaagctactattgtcaccgaaagctgagtcaggggagcatgacaccccagagaagacacagattgccaatctattacaggatacaatggaaatcatcacacaggatattatgaagaatggacaaggtattttgaaggatgaaaataaaggcaatcaactatttgcaaatctaaatctggactcaataaagagtcaagcttggagggagaagtgtgttaggcttcaattgttgttgacaacgaaagaatctgcaatttatgtaccaataaacttggaagctcggcgcaggattactttttttgcgaattcactgtttatgaaaatgccaagggctccaccggtccgcagcatgatgtccttcagtgttttaactccatacttcaaagaggaggtgctcttttcaaaagatgatctttatgaaaaaaatgaggacgggatatccatactgttctatttacggaaaatttatccagacgaatggaaaaattttcttgaacggatacagttcaaaccgaaggatgaagattcccttaaatcagagatggatcgcatcgcaccctgggcatcatataggggacaaacgctcaccaggacagtgagaggaatgatgtattataggagggcacttgagattcagtctattcatgatagaactgatattgctaaactggagcgtcaaaaaacaaccgcatcctatcaagagggtgggtccattgtagatacggcggcactggccattgctgatatcaaattcacatatgttgtctcttgtcaagtctatggcatgcacaaaatatccaaggatgcaaaagagaaagtttgctatctgaacatccttaatctcatgataacgtatccatcgttacgaattgcatatattgatgaggtagaagctccgactagaaatggaacgacagagaagacttattattctgttcttgtcaaaggagtaggtgaaaagtatgatgaggaaatttaccgcatcaagcttcctggcaaacccacagaaattggagagggaaaacctgaaaatcaaaatcatgccataattttcaccaggggagaagccctccaggccattgatatgaatcaggataattacctcgaagaggcctttaaaatgagaaatgtactggaggagttcgcgagtgatgattatggaaagagcaaacccactatattaggtcttcgagagcacatttttactggaagtgtttcatcacttgcttggtttatgtccaatcaagagaacagctttgttaccattggacaacgggttctggcaaatcctctcaaggttcggtttcattatggtcatcctgatatctttgatagactcttccacattactaggggtggcataagtaaagcttccaaaactataaatttaagtgaagatatattttcaggttttaactcaacaatgagagaaggaaatatcacacatcatgaatacatgcaagtcggtaaagggcgtgatgttggaatgaaccaaatttcaagctttgaagctaaggtcgccaatggcaatggtgaacaaacattaagtcgtgacatctatcgtcttggacgcagatttgacttctatagaatgctatctttctacttcactacagttggcttttatttcagtagcatggttactgtacttactgtctatgtatttttgtatgggaggttatatctcgttatgagtggcctggaaaagtctattttgctggatccacgtattcaagcggacatcaggccccttgaaaatgcgctagcttcacagtctgttttccagcttggtttgctgcttgttctgcctatggtcatggaagtcggcttagagaagggattccgcacagcgttaggagagtttgtcatcatgcagcttcagttggcctctgtgttcttcacattccagcttggcaccaaaacacatcactatgggcgaacaatactccatggtggcgctaaatacaggcctacaggccgtggctttgttgtgtgccatgcaaagtttgctgacaattatcgcgtgtactcccgtagccactttgttaaaggacttgaactgttgatacttctggttgtgtatcttgtttacggaaagtcctaccgcggctcgaagttgtacctatttgtaacattctccatatggttcctggttgcatcatggctctttgcaccgtttatcttcaatccatcatgttttgagtggcagaagaccgttgatgactggacagattggaggaaatggatggggaaccgagggggtatcggcatgttaggggaacagagctgggaggcttggtggacaactgaacaggagcatctcaggaagactagtattcgtgctcttctcttggaaatcatcctctcgcttcgtttcttgatctaccagtatggtattgtgtaccagctgaacatagcacgccacaacacaagcattctggtatacggattgtcatggttggttatgctgacagttctagtagttctgaagatggtttcaataggacggcaaaaatttgggacggacctgcagcttacttttcgcatcctgaagggccttctcttccttggatttgtttctgtgatggcggtcctatttgttgtatgtgaactcacaatttctgatgtctttgccagtattctcgggttcctacctactggttggtgtatccttctgatcgggcaagcatgctatccggtgattaagaagactacgctatgggagtctatcatggagctcgggagggcatacgacaacatcatgggcctcgtcctcttccttcccatcggcttcttgtcatggtttcccttcgtctcagagttccaaacaaggttgctcttcaaccaagccttcagtcggggcctccaaatttcaaggatccttgccggtcagaaggacatgggggagttcgagtgaccagtttcattgcctgcactgtgtactcgtgtaggcagcaaagcaagatacatgctccaggtcatgtgttacgatcgattttgggtgtctgtaccttgataggaccttagttcttctgctatgtagctttccttttgtagaatatgacatagtaaaatattaacattactattaatattaacatagtaatgaagatatcatctatatagagagcca

SEQ ID NO: 5723 - DNA, 1405 bp, Phaseolus vulgaris
gtgtataagcttctcttactcggaaagtgaattagggttttagcagtggtggaaggtttgttgaggactgaggagggttttacaacagattcgtctctctctctctctctctcttttctgatcccaatggcgaccaccgttcttcctcctcctcctcctcctcctgccgccgtcgaaaccgtcgtcgatttcttcaaccttccatgtccaattcccttcgaggagctccatcgcgaagccatgatgtcgttgaagccagatctttttgagggcatgcgttttgatttcaccaagatgctcaatcagaagttcactctcaatcacagcgtgttgatgggacctactgagattccgtctcagtctacggaaactattaagattccaactgctcaatatgagtttggctcaaccttcattgatcatcctaggttgttgctctgggggaggattttgaccgatgggaggctgaatgctagagttaagtgtgatttgtctgagaatctcacttttaaagccaatgctcagcttacgaatgagccacatatgtctcatgggatgttcaactttgattacaagggaaaagactataggtcacagtttcaactcgggaatggagccttactaggagcaagttatattcagagtgtgacgcagcacttatcattgggaggggaggtattttgggctggtcagcataggaagtctggtattggttatgctgctcgctacaacactgaaaaaatggttgctacggggcaagttgctagcactggaatggttcttctaagctatgttcagaaggtatctgagaaggtttctctagcatctgagtttatgtgtaactacttgtcaagagatgtcacggctagctttggttatgactacatccttagacagtgccgccttaggggaaaggtagattcgaatggatgtgttgctgcttttttggaggagcgattaaatatgggtctgaattttattctttctgcagagcttgaccacaggaaaaaagactacaaatttgggtttggtttgaccgttggagaatgaataagcgggactagaactttgttttcattgttttagccagcttagcaaggttccttgcatctttttccttgttggagatttttctttccaaaaaagaaaagaggaaatatcgtttgtgtcgggaaacaatttacaatccacaagtagctgcagaattttcagtagtcatcaatttatttggaacttgggctgaaacaacaacatttatttggaactattgccctgttttcccttgaggggggttgtagagtgaatcagattaatgcatattatgagattcaatttcaataatgattctagttctcgtttatttatccatttcttatactttagtttaaatggcctgtgcctttgt

SEQ ID NO: 5724 - DNA, 1324 bp, Vigna unguiculata
ggagggttttagcagtggtggaaggttgttgaggactgaggagggttttagaatcagatttgttcgttccttctcttttgctctctctctgtgattccaatggcgacccctgttcctcctcctcctgccgccgccgacaccgctgtggattacctcaatcttccatgtccaattcccttcgaggagctccatcgcgaagcttttatgtcgttgaaaccagatctttttgagggcatgcgttttgatttcacaaagatgctcaatcagaagttcactctcaatcacagcgtgttgatgggacctacggagattccctctcagtcgacggagacgatcaagattccaactgctcactatgagttcggctcaaccttcattgatcatcctaggttgttgctctgggggaggattttaactgatgggaggctcaatgctagagtcaagtgggatttggctgaaaatctcacttttaaagccaatgctcagcttacgaatgaaccgcatatgtctcatggagtgttcaactttgagtacaagggaaaagactataggtcccagtttcaactcgggaatggagccttacttggagcaaattatattcagagtgtgacacagcacttatcattgggtggggaggtattttgggctggtcagcataggaagtctggtgttggttatggtgctcgctacaacactgataaaatggttgctacagggcaagttgctagcactggaatggttgttctaagctatgttcagaaggtatccgagaaggtttctctagcatctgaatttatgtgcaactacttgtcaagagatgccacggctagctttggttatgactacatccttagacagtgccgtcttaggggaaagatagattccaatggctgtgttgctgcttttttggaggagcgattaaatatgggtctgaattttattctttctgcagagcttgaccacaagaaaaaagactacaaatttgggtttggtttgaccgttggagaataaataagcaggactagaattgtgttttcattgctttagccagcttagcaagcttctttgcatcttgttccttggcggagatttttctttccaaaaaagaaaagaggaaatatggtttgtgtcgggaaacactatttgcaatccacaagtagctgcagaattttcagtagatcaatttatttggaacttgggctgaaacaacttcatttatttggaaatattgccctgttttcccttgagggggatgtagagtgaatcagattaatgcatattgtgagattcaatttcaataatgattctagtgctcgtgtccatt

SEQ ID NO: 5725 - DNA, 1655 bp, Cicer arietinum
gaaaaatacaaacatataaccggatagtagtgattcgggttcaagataccgtaccactccgaaacgggtcggattaaagagtgaatcaatgcaagtgtgtgtataagcgagtgaagcaagaaaagttagctagctagggttttagcagtcatcgagttttgggaggggttttaggaatttccgaatctgatttacaattctcccctctctcttcgattcctaacaatggcgtctccgattcctcctcccaccggcgacaccaaggtcgacgacaaagtcgattacttcaaccttccttgtcccattccattcgaagagctccaccgtgaagctatgatgtctttgaaaccagatctttttgaaggtatgcgttttgatttcaccaaaatgctcaatcagaagttctctctcaatcacagtgtgtcgatgggacctactgaggttccttctcagtccacggaaactattaaaattccaactgctaactatgagtttggtgcaaccttcattgaccaccctaagttgttgctttgggggagagcgatgaccgatggcagactgaatgcaagagtcaagtgtgacgtatctgagaatctcacttttaaagccaatgctcagctaacaagtgagccacatatgtcgcatgggatgggcaactttgattacaagggaaaggattataggacacagtttcaatttgggaatggggccttgctaggggcaagttatattcagagtgtgacaaatcatttatcattgggtggggaggtattttgggctggtcagcatcggaagtctggtattggttatgctgctcgttacaacactgataaaatggttgccacaggacaagttgccagcactggaatggttcttctaagctatgttcagaaggtatctgagaaggtttctctagcttctgagttaatgtgtaactacttgtcaagagatgttactgctagctttggttatgactacatcctaagacagtgccgccttaggggaaaggttgattccaatggcgttgttgctgcgtttttggaggagcggttaaacatgggtctgaatttcattctttctgcagagcttgatcacaagaaaaaagactacaaatttgggtttggtttgaccgttggagaataaatagcactgactagagctgtatttccattgccttagccagcctagcctagcaagctttcttgcttctttacttgttggagatttgtctttttgaaaagagaaaacaaaggaatataaattgtgtcggcaaactacatttgttatccgcaagttggccccaaaaaacttaaaatttatttggaactcttgccctgttttcccttgagggggatgtagagtgatggtagcagatcaatgcatattatgatattcattttcaatatcctggtgttatgctaaaatatctatcgatttcttagacttctaataatctatgtaacctctgcagcaagacgataatttggtgatatgttaacggtttgtatgttttcacaatcatggaagacttgttggaggagtcttttatgtaaaggattgatcaagttaaataaacgatagtagtaattatattgttggcttatcagaatttgaaactataagattaaataaatttgttttagaaagaaatccag

SEQ ID NO: 5726 - DNA, 1439 bp, Lotus japonicus
agcgtaagagaagaaaaactagggttttagcagtcgtcgaagatttgtttggagaggggttttagaaattttctgaatcttcccctctctctctctctctctcatcattcccaaaccctatctctctctttctcctccgtagcaatggcgaccgtgcctcctcccaccgccaccaagcccgatgagaaaaccgattacttcaaccttccttgtcccattcccttcgaagagctccaccgtgaagccatgatgtctttgaagcctgatcttttcgagggtatgcgttttgatttcaccaagatgctcaatcagaaattctccctcaatcacagtgtgttgatgggacctactgagattccttctcagtcgaccgagactattaagattcctaccgcgcactatgagtttggctcaaccttcattgatcatcctaagttgttgctatgggggagagtcatgactgatggcaggctgaatgcaagggtcaagtgtgatttgtctgaaaatgtcacttttaaagccaatgctcagctttcgaacgagccacacatgtctcatggaatgatgaacttcgattacaagggatcagactacaggtctcagtttcaatttggaaatggcgctttgcttggagcaagctacattcagagcgtgacccgcaatttatcactgggcggtgaggtattttgggctggtcagcatcgtaagtctggtgttggttttgctactcgctacaacactgatcaaatggttgctacagggcaagttgctagcactggaatggttcttttaagctatgttcagaaggtgtctgagaaggtttctctagcttctgagttgatgtgtaactacttgtcaagagatgtcactgctagctttggttatgactacatccttagacagtgccgtcttaggggaaaggttgattccaatggctgtgtcggggctcttctggaggagcggttaaatatgggtctcaattttattctttctgcagagcttgatcacaagaaaaaagactacaaatttggatttggtttgactgttggggaataacttagcaaggactagagctgtgtttccattgctgtagccagcttagcaagctttcttggttctttttccttgttggagacttttattttttctgaaaaaagagataacagaggaagcatcattgtgtcgggaaacacaatttataatgcacgagttgctggagaaattttagtagtcatcgatttatttggaaacttgccgagaaaatctgaattatttcgaactcttgccctgttttcccttgagggggatgtagagtgatatcttatcaatccatattgtcagtttcaatttcaataatgcttctagtaatctagagctcgtgttatccatccatttctgataataatgtcttggtaagttggtatcccaatttaaatcta

SEQ ID NO: 5727 - DNA, 1348 bp, Arachis hypogaea
acgaaacagaagcttagggttttagcaggcagccgtcgaagccttccggggttttagaaagagaatagaaagaatcactcatttcatttgtgatacagattctctttcacacctcacacctcactctcactctgcaccaacaataatggctcaggcgcctcccaccgacaccaagctcgatgagaaggtcgactacttcaacctcccatgtcctattcccttcgaagagctccaccgtgaagctatcatttctttgaagccagagcttttcgagggtatgcgttttgatttcaccaagatgctcaaccagaaattctccctcaatcacagcgtttcgatggggcctactgagatcccttctcagtcaacggagactattaagatccctaccgctaactatgagtttggtgcaaccttcattgatcatcccaagttgatgctgttggggagaatattgactgatggaaggctcaatgcaagagtcaagtacgaggtctctgaaaatctcactcttaaagccaatgctcagcttacgaatgagccacacatgtctcaagggatggtcaactttgattacaagggaaaagactataggtcacagtttcaacttgggaatggtgccttactcggagcaagttatattcagagcgtgactcgtaacttatcattgggcgcggaggtattttgggctggacagcatcgtaagtctggtgttggttatgctgctcgctataacactgacaaatgggttgctacggcacaagttgctagcactggaatggttcttgcaagctatgttcagaaagtatctgagaaggtttctttagcgactgagttactgtgcaactacttgtcacgagatgtcacggctagctttggatatgattacatactaagacagtgccgcctaaggggaaagattgattccaatggttgttgcgctgcgtttttggaggagcgattaaacatgggcctgaattttatactttctgcagagcttgaccacaagaaaaaagattacaaattcgggtttggtttgaccgttggagagtagattagcatgagtagacttatgtttccattgcatctagtttagcaagctctcttgcttccttttcctttatttctagaaaagaacaaaatcaaaggaggaaagatcatttgtgccgggaaaagtacattattataattcacgagttactgcagagattttagtagtcgccaatttatttggaacttgtgcctaaaaagaggaactttgatttatttggactcttgccctgttttcccttgagggggatgtagagtgatatctgattaatgcatattatgagattcatttaccaaa

SEQ ID NO: 5728 - DNA, 1485 bp, Trigonella foenum-graecum
agggttttagcagtcacagacccagagtagtagcatactttgggaacgaacgaacgaaacaagggttttagaaaacaaattccgaatctctctctttctctgatctctaacaatggcgactatggttccaccgattcccaccgccgatgacaagaaggtcgatcagaaaaccgattactccaatcttccttgtcccattcccttcgaagaactccaccgcgaagctatgatgtctttgaaacctgaactttttgaaggtatgcgttttgatttcaccaaaatgcttaaccagaaattttctctcaatcacagtgtgtcgatgggacctactgagattccttctcagtctgcggaggttattaaaattccaactgctaactacgaatttggtgctaacttcattgatcatcctaagctgttgcttttggggagagcaatgactgatggaagggtaactgcaagagtgaagtatgatgtcttcgataatttgacgttgaaagccaatgctcagctaacaagtgagccacatatgtcgcaagggatgatcaactttgattacaagggaaaggattacaggacacagtttcaaatgggtaatggagctttgctaggagcaagttatattcagagtgtgacaaatcatttgtcattgggtggagaggtattttgggctggtcagcatcggaagtctggtgtaggttatgctgctcgctataacactgataaaatggttgccacaggacaagttgctagcactggaatggttcttttaagctatgttcagaaggtctccgagaaggtttctctagctgctgatctaatgtgtaactacatgtcaagagacgttactgctagctttggttatgactacattcttagacagtgccgccttaggggaaaggttgattccaatggagtttgtgctgcttttttggaggagcgtttaaacatgggtctgaatttcattctttctgcagagcttgatcacaagaaaaaagactacaaatttggatttggtttgaccgttggagaataaattcgagctggactagagctgtatttccatttctttagccagactagcctagcaagttttcttgcttcttttacttgttgggaattttcttttgaaagaagaaacaaaggaggaatatatcatttgtgtcgacaaacatcatttgttatccacaagttgacctaacactacttcaaatttatttggaactctttgccctgttttcccttgagggggaaggatgtagagtgatagtagcagatcaatgcatattttgcgattcattttcaacatgctcgtgctatgcttatatcttactttttaatgatctatggaactctgcagcaagacaacttagagttcttgcataagttcgtggtttgcttacgatttggatgttttcttcttgtaagacttcttggaggaatcctatgtaagaattaatcaagttaataaagcgattagtgttc

SEQ ID NO: 5729 - DNA, 1438 bp, Medicago truncatula
agaatactttgggaacgaacgaacgaaacaagggttttagaaaatcaattccgaatctctctctttctctgatctctaacaatggcgactatggttccaccgattcccaccgccgacgacaagaaggtcgatcagaaagttgattactctaacctttcttgtcccattgccttcgaagaacttcatcgcgaagctatgatgtctttgaagcctgagctttttgagggtttgcgttttgatttcaccaaaatgcttaatcagaaattctctcttaatcacagtgtttcgatgggacctactgagattccttctcagtctgcggaggttattaaaattccaactgctaactatgaatttggcgctaacttcattgatcatcctaagctgttgcttttgggaagagctatgactgatggaagagtaactgcaagagtcaagtatgatgtgtttgacaatctcactttgaaagctaatgctcagctaacaagtgagccacatatgtcgcaagggatgatcaactttgattacaagggaaaggattataggacacagtttcaaatggggaatggagccttgctaggggcaagttatattcagagtgtgacaaatcatttatcgttgggtggagaggtattttgggctggtcagcatcggaagtctggtgtaggttatgctgctcgctacaacactgataaaatggttgccacaggacaagttgccagcactggaatggttcttttaagctatgttcaaaaggtttctgaaaaggtttctctagctgctgatctgatgtgtaactacttgtcaagagacgtcactgctagctttggttatgactacatcctcagacagtgccgccttaggggaaaggttgattccaatggtgtttgtgctgcttttttggaggagaggttaaacatgggtctgaatttcattctttctgcagagcttgatcacaagaaaaaagactacaaatttggatttggtttgaccgttggagaataaattagagctggagtcagagctgtatttccatttcctttagccagactagccttgcaagttttcttgcttctttttacttgttgggaatttttctttttgaaaagaagaaaacaaaggaggaatatatcatttgtgtcggcaaacatcatttgttatccacaagttgacccaacaatacttcaaatttatttggaactcttgccctgttttcccttgagggggaaggatgtagagtgatagtagcagatcaatgcatattttgcgattcaatttcaacatgctcataatgctcgttatgctaatataaatcgatttcttacttttaatgatctatgaaactcggcagcaagaatgacttcttgaagtccttgaataatttggtgatttgttcaagatttggtgggttttcacacattcttgtaagacttcttgg

SEQ ID NO: 5730 - DNA, 1480 bp, Nicotiana tabacum
gcattcaacgaagaaggaaatcacctcctccttcttctcctttgttatatttattttcattcaagtcttacgcagttggatctagacacagatccttagaataatctgcaatggccactctcgttcctcctacaaccactgttcctccagcttgttctaaaccggcggctgtcgaaccggagaaagttgattattcgaacttgccttgccctattccctatgaagaaattcaccgcgaagctctcatgtctttaaagccagaactttttgaaggattgcgctttgatttcaccaaaggacttaatcagagattttcactcagtcacagtgtacttatgggccccacagaacttccttctcagtctacagagatcgatcaaaattccaacagctcactatgagtttggtgctaactttatagatccgaagctgatgcttttcggcagagtattgacagatggaagggttaatgctagagtgaagtgtgatttatctgagaatcttaccttgaaggcgaatggtcagttgaccggtgagccacacatgtcgcatggcatggttaatttcgactacaagggaaaagatcacaggactcaatttcaacttggcaatggtgcattatttggagccagctacatccagagtgtcagtccacatttgtctctgggtggggaagtattctgggctggtcagcaccggaaatctggcattggttatgctgctcgctataatactgataagatggttgccactgggcaagttgctagcaccggtatggtcgcactgagctatgttcagaaagtttctgaaaaggtctctcttgcatcagactttatgtacaactacatgtccagagatgtcacggcaagttttggttatgattacatcctccggcagtgtcgtcttagaggtaaaattgattcaaatggctgcgttgctgctttcctggaagagcgcttgaacatgggtcttaatttcattctttcagctgaggttgaccataaaaagaaagactacaagtttggtttcgggcttacagtgggagaataggaagggtgggtttggagatttagtttttagaagttgatcacaaggttggaactcaaagcatctttactcagtattctttttctacgcgataaggatcaaagcatcagttttgtaattttattgagcgacattgttggtgcaatcaactgctgcagccatcgatcattacttgattttgtagtttgggatgtttatatgcccagtttgtagttgtagagttcacttttattcagaatgagatagcccatttggctactccaccatttgaagatgggtaataattctaaagcttgaatagcacatttgactgctggaccacaaatagtcctactcgggaaaaccttttgttctgtaccggatttgtcgttaaattaaaatatgttcctttagcggccgcatgaggggtacctgtcctctccaaatgaatgac

SEQ ID NO: 5731 - DNA, 1337 bp, Malus domestica
acttttttggaggttttgccactagaaaccctccagttgcaggctcttcgttctgatttgatcggaatcctcgatagccattcttcttctctccgagtattgttgccgacgaaaggcagagcacaagcaatggcgggcctcgttcctcctcctcctccaaccgccgcggctgatacgattccgaagccgaaagaggatgagaaagtggattacttgaatcttccttgccctattccctacgaggagatccaccgtgaagctctcatgtctttaaagccggaactgtttgaggggatgcgctttgatttcactaaaggactcaatcagaggttctcactcagtcacagcgtgttcatgggacctaccgaggttccttcacaatctcccgaaactattaaaattcccactgctcactatgagtttggtgccaactttatagatccaaagttgatgctttttgggagaatcatgactgatgggaggcttaatgcaagagtaaagtgcgatttatctgagaatcttactttgaaggccaattctcagcttaccaacgagcctcacatgtcacatggcatggtcaattttgattacaagggaaaagattacaggtcacagtttcaactaggaaatggtgcactgtttggagcaaactacattcagagtgtgaccccccatctcgctttgggcggtgaagtgttctgggctggtcagcatcggaagtctggtattggctatgctgctcggtataacacagaaaagatggttgccacagggcaagtcgctagcactggaatggttgctcttagctatgtacaaaaggtttctgataaggtttctcttgcatcagatttcatgtacaactacatgtcaagagatgtcacagctagttttggttatgattacattcttcgacagtgccgtcttagaggaaagattgattccaatggcaccgtagctgcatttttggaagagcgactaaatatgggtcttaattttgttctttctgcagagattgatcacagaaagaaagactacaaattcgggtttgggttgactgtcggggagtagagtgcaggaccaatgctgttgcatcattcttgccggcaagatactctctctttatttttcctttcgagtcgaacaagagatccctgtatacttaatctcgggtaacattatcgcagggcggcatcagtttagccagttttagtagccggtttccgtttggagttcccttttttcagttaggagatgtagaataagatttcgaaataattcaaattgaatttctagtcacaacttgaacctttgcccgaaaaacaaaactcgatttcttg

SEQ ID NO: 5732 - DNA, 1686 bp, Prunus mume
ccaaacagccacctcttctcactagggttttagacttttcggaacttcggaggttttgcaatttgatactgttcaggctcctctctctctctctctgatttgatctgaatcatcgaaagccattgttgtcctttaattctacagaaaaagctgtcggggtttttctgtcaacagaagctaagagcataaagaacaataacaatggcggcccttgttcctcctcctcctccaaccactgcggctgatactacccagaagccgaaagaggatgagaaagttgattactttaatcttccttgtcctatcccctacgaggagatccatcgtgaagctctcatgtctttaaagccagaactttttgaggggatgcgcttcgattttaccaaaggactcaaccagagattctcactcagtcacagcgtgttcatgggacctatggaggttccttcacaatctccggaaactattaaaattcctactgctcactatgagtttggtgccaattttatagatccaaagttgatgctttttgggagaataatgactgatgggaggcttaacgcaagagtaaagtgtgatttatctgagaatcttactttgaaggctaattctcagcttactaatgagccacacatgtcacatggcatggtcaattttgattacaagggcaaagattacaggtcacaatttcagctaggcaatggtgcattatttggagcaaactacattcagagcgtgactccccatctgtctttgggtggtgaagtattttgggctggtcagcatcggaagtctggtattggctatgctgctcgatacaacactgacaagatggttgccacagggcaagtcgctagcactggaatggttgctctaagctatgtacaaaaagtttctgagaaggtttctctagcatcggatttcatgtacaactacatgtcacgagacgtcacagctagttttggttatgattacattcttcgacagtgccgtcttagaggaaagattgattccaatggcaccgtggctgcatttttggaagagcgactaaatatgggtcttaattttgtgctttctgcagagattgatcacagaaagaaagactacaaatttgggtttggattgactgttggggagtaaattgcagcaccgatgttgtttcatcattcttgccggcaagatatattatctctttatttttccatttgagttgaaccagagatgatgtacttgagtaacattatcgcagggtggcatcagttgagtcagttttagcagccggtattcaagtttggagttcgcttttttcatataagagttgtagaattctgtttcaaaataattcaaattgaattcctagtcagtggtagcctttgtcggaataaacctgatttcttgtttgatcaatttggtttactcacatgagcaacgatgaattggatcaacttggattgcttcccaacacattttaatgttaaaatgctaggggcattttcctattccctgcttggttgccaggaattccttagtaattttattcctattttggtcatattgggatttctatattgtttgggcctaaattccacgtgacagcccatttgactattgccccatgtcaacaacaacaatccggtccttaattaatatttaattattaatttattctaataaaagacaattata

SEQ ID NO: 5733 - DNA, 1349 bp, Prunus persica
gggttttagacttttcggaacttcggaggttttgcaatttgatactattcaggctcttctctctctctctctctctctctctggtttgatctgaatcatcgagagccattgttgtccttttattctacagaaatagctgtcgcagtttttctgtcaacagaagctaagagcataaagaacaataacaatggcggcccttgttcctcctcctcctccaaccactgcggctgatactacccagaagccgaaagaggatgagaaagttgattactttaatcttccttgtcctatcccctacgaggagatccatcgtgaagctctcatgtctttaaagccagaactttttgaggggatgcgcttcgattttaccaaaggactcaaccagagattctcactcagtcacagcgtgttcatgggacctatggaggttccttcacaatctccggaaactattaaaattcctactgctcactatgagtttggtgccaattttatagatccaaagttgatgctttttgggagaataatgactgatgggaggcttaatgcaagagtaaagtgtgatttatctgagaatcttactttgaaggctaattctcagcttactaatgagccacacatgtcacatggcatggtcaattttgattacaagggcaaagattacaggtcacaatttcagttaggcaatggtgcattatttggagcaaactacattcagagcgtgactccccatctgtctttgggtggtgaagtattttgggctggtcagcatcggaagtctggtattggctatgctgctcgatacaacactgacaagatggttgccacagggcaagtcgctagcactggaatggttgctctgagctatgtacaaaaagtttctgagaaggtttctctagcatcggatttcatgtacaactacatgtcacgagacgtcacagctagttttggttatgattacattcttcgacagtgccgtcttagaggaaagattgattccaatggcaccgtggctgcatttttggaagagcgactaaatatgggtcttaattttgtcctttctgcagagattgatcacagaaagaaagactacaaatttgggtttggattgactgttggggagtaaattgcagcaccgatgttgtttcatcattcttgccggcaagatatattatctctttatttttccatttgagttgaaccagagatgatgtacttgagtaacattatcgcagggtggcatcagttgagccagttttagcagccggtattcaagtttggagttcgcttttttcatataagagttgtagaattctgtttcaaaataattcaaattgaattcctagtca

SEQ ID NO: 5734 - DNA, 1495 bp, Nicotiana benthamiana
gggtttctcggtagttgggcgaaggaaagggttttacactcttcactctcggagctctcttccctccacgtagccgcagtcaagaagaaggaaatcacctcctcctcctacttcttcttcttcttttcatttgttatatttattggatccagacgcagatccttagaatattctgcaatggccactctcgttcctcctacaaccactgttcttccagctggttccaaaccggcggctgttgaaccggagaaagttgattattcgaacttgccttgccctattccctatgaagaaattcaccgcgaagctctcatgtctttaaagccagaactttttgaaggattgcgctttgatttcaccaaaggacttaatcagagattttcactcagtcacagtgtacttatgggccccacagaacttccttctcagtctacagagacaatcaaaattccaacagctcactatgagtttggtgctaactttatagatccgaagctgatgcttttcggcagagtattgacagatggaagggttaatgctagagtgaagtgtgatttatctgagaatcttaccttgaaggcgaacggtcagttgactggtgagccgcacatgtcgcatggaatggttaatttcgactacaagggaaaagatcacaggtcccaatttcaactcgggaatggtgcattatttggagccagctacatccagagtgtcactccacatttgtctctgggtggggaaatattctgggctggtcagcaccggaaatctggcattggttatgctgctcgctataacactgataagatggttgccacagggcaagttgctagcaccggtatggttgcactgagctatgttcagaaagtttctgaaaaggtctctcttgcatcagactttatgtacaactacatgtccagagatgtcacggcaagttttggttatgattacatccttcggcagtgtcgtcttagaggtaaaattgattcaaatggctgcgttgctgctttcctggaagagcgcttgaacatgggtcttaatttcattctttcagctgaggttgaccataaaaagaaagactacaagtttggtttcgggcttacagtgggagaataggaagggtgggtttggagatttagtttttagaagttgatcacaaggttggaactcaaagcatctttactcggtattctttttctacgctataaggatcaaagcatcagttttgtaattttattgagcgatattgtttgtgcaatcaactgctgcagccatcgatcattacttgattttgtagtttgggatgttttatttgcccagtttgtagttatagagttcacttttattcagaatgagatagcccatttggctactccacaacacttgaagatgggtaataactgtaaagcttgaatagcacatttgactactcaggaaaacctgttgctctgtactggatttgtcgttaaattaaaattatttcatcagaaaaaaa

SEQ ID NO: 5735 - DNA, 1164 bp, Humulus lupulus
agatgagaaggccgattacttcaatcttccatgccccattccctatgaagagatccatcgtgaagctctcatgtctttaaagccagaactttttgaggggatgcgctttgattttactaaagggctcaatcagaagttctcactcagtcacagtgtgttcatggggcccactgaggttccttcccagtcggcggaaactatcaaaatccctactgctcactatgagtttggagccaattttatagacccaaagttgatgctttttggaagaatactaactgatgggaggttaaatgcaagagtgaagtgtgatttgaccgaaaatctcattttgaaggctaatgcacagctcacaaatgaaccacatatgtcacacggcatgctcaattttgattacaagggtagtgacttcaggacacagtttcagctagggaatggggcattatttggggcaagttacattcagagtgtgaccccacatttttctctcggtggtgaagtattttgggctggtcagcatcggaagtctggtattggttatgctgctagatacaacacagacaagatggttgccacagggcaggttgctagcacaggaatggttgctctgagctatgttcagaaggtatctgagaaggtttctctagcatcagacttcatgtacaactacatgtcacgggatgtcacagcaagttttggttacgattatattcttcgacagtgtcgccttagaggaaagatagattcaaatggctgcgcagctgcttttctggaagagcgattaaatatgggtcttaattttattctttctgccgagctagatcacaaaaagaaagactacaaatttgggtttggattgactgttggagaatagattggctggacctaaaggtgttcttttttctatattttttacctgccttttgctgtcgccggcaacttccgcaagttcttctgcctgatttttcttgtgttgagtagattcaaagtttgtacttgtgtaattttggcaacattgtttctgggcagcatttgctgcagcctctctgctagcagcagtaattcatggattttgcgtatacagttacagaagtttattttagaataatgcaaattggattgtttagcggcaatatgtagtctacttattaatagaagagattt

SEQ ID NO: 5736 - DNA, 1323 bp, Vaccinium corymbosum
aacagcttctctctctctagccgcatcagtcgaagaagaagaggaagaagaattagtctcacttcttcttcttctttctgagtattcgaacttcaacccggtccataccggatcgaaacagaagctcgcaatggccacactcgtccctcccacggccgcgccgccgccggctgtgatccagccggaaaaagtcgattaccttaacctgccttgccccattccctacgaagaaatccaacgcgaagctctcatgtccttaaagccagaactgtttgaggggatgcgctttgattttaccaaaggactcagtcctagattctcgctaagtcacagtgtattcatgggacctactgagattccttctcagtctcctgagaccattaagattccaactgctcactatgaattcggtgctaacttcatagatccaaagttaatgcttttcgggagaataatgacagatggtaggctaaatgcacgagtgaagtgtgatctgtctgaaaacttaactctgaaggcaaatgctcaacttacaaacgagccacatatgtctcatggcatgttcaattttgattacaagggcaaagactataggactcaagttcagcttgggaatggtgccttatttggagccagttacatacagagtgtgaccccacatttatctttgggtggtgaagtattttggactggtcagcacaggaagtcgggtattggatatgctgctcgatacaacacagataagatggtttccactgcgcaagttgcaagcactggaatgattgctttgagctatgttcaaaaagtatctgagaaggtttctttggcatctgaattcatgtacaattacctgtcaagagatgtcacatccagctttggctatgattacattctccgtcagtgccgtcttaggggcaagattgattccaatggctgcacatctgctttattggaagagcgattgagtatgggtcttaattttattctttctgctgagatagatcacaggaagaaagactacaaatttgggtttgggctgacagttggagaataggatagaaggctgggatgctattctcggtttgattaaagctcatcaatgtaagcaactctgcactgcattgagttttgatttttccgttctgatgcagatcaacgaaccagttttgtattttaagttgtcattaattgtggggctgtaccagctgctgcaacgatttctaggctttttggcattatggaacttctatttgttttccccctacaaggctgtagaattcgttagaatggaaattgagctatttataattgacatcggttgca

SEQ ID NO: 5737 - DNA, 1185 bp, Ambrosia trifida
cctcacctcaccatactccttccattccatcctctcaaaacacacacaaaacccttattttactatcatcttcatcaatgctctgaatcactaccacaacataaaccacaaacacaaacccattaacatacatatacaaaaaccccatcaaaacccacccacaatcaacaatggctacacatattcctccacctgcaccggcggctgaacccacccaagcctgagaaagttgactactttgacctcccttgccctattccctatgaggagatccatcgtgaagccatgatgtcgttgaagccagagcactttgagggtatgcgttttgattttaccaagggtctaaatcagaagttctctctaagtcacagtgttgttatgggacctactgaagttccttctcaatctgctgaaacgattaagattcctactgcaaactatgagtttggtgctaactttatagatccaaagttgatgctttttggaaggatcttgaccgatggacggctaagtgctcgagtgaagtgtgacttgtctgagaatcttactctgaaggccaatgctcagcttacaaatgagcctcatatgtcacatggaatgttcaacttcgactataagggttcggactacaggactcagttacaactaggaaatggtggcctgattggagctagttatattcagagtgtgacacctcacctatctttaggtggagaagtgttttgggctggtcagcataggaagtctggtctcggttatgctgcacgatacaacactgataaaatggttgcctcgggacagattgctagcactggaatggtggttcttggttatgttcagaaagtgtctgaaaaggtttctctggcaacagatatgatgtacaattacatgtcacgagatgtcactgctagctttggctatgattatatactccgtcagtgtcgccttagagggaagattgactcaaatggttgtacatctgcatttcttgaagagcggttgaatatgggtctgaatttcattctgtcagctgagatagaccacaagaagaaagactacaagtttggtttcgggatgactgttggagaatagatcaaaaagcatgagagcggatgcaaatttaggtattaattaattttgtaggacgaattgtcataccaagtagtgatcttgttattttattga

SEQ ID NO: 5738 - DNA, 1432 bp, Ambrosia trifida
cgtccccaactttaagggtttttgtgtagtcttgctgcacaagcacaaggaggcgcctcacctcaccacactccttccattccatcctctcaaacacacacaaaaccctttattttacatcatcttcatcaatgctctgaatcactaccacaacataaaccacaaacacaaacccattaacatacatatacaaaaaccccatcaaaacccacccacaatcaacaatggctacacatattcctccacctgcaccggcggctgaacccaccaagcctgagaaagttgactactttgacctcccttgccctattccctatgaggagatccatcgtgaagccatgatgtcgttgaagccagagcactttgagggtatgcgttttgattttaccaagggtctaaatcagaagttctctctaagtcacagtgttgtcatgggacctactgaagttccttctcaatctgctgaaacgattaagattcctactgcaaactatgagtttggtgctaactttatagacccaaagttgatgctttttggaaggatcttgaccgatggacggctaagtgctcgagtgaaatgtgacttgtctgagaatcttactttgaaggccaatgctcagcttacaaatgagcctcacatgtcacatggaatgttcaacttcgactataagggttcggactacaggactcagttacaactaggaaatggtggcctgattggagctagttatattcagagtgtgacacctcacctatctttaggtggggaagtattttgggctggtcagcataggaagtctggtctcggttatgctgcacgatacaacactgataaaatggttgcctcaggacaaattgctagcactggaatggtggttcttggttacgttcagaaagtgtctgaaaaggtttctctggcaacagatatgatgtacaattacatatcaagagatgtcactgctagctttggctatgattatatactccgtcagtgtcgccttagagggaagatcgactcaaatggttgtacatctgcatttcttgaagaaaggttgaatatgggtctcaatttcattctgtcagctgagatagaccacaagaagaaagactacaagtttggtttcgggatgactgttggagaatagatcgaaaagcatgagaacggatgcaaaactttaggatttaaattaatttttgagtgacaatttgtcataccaagtgtgatcttgttattttatgatgatggacagagtcagttttgtacttgttttgaagcagctattttctgtggcggctacaagctgcgcagacgatttagagcgcgacataatctctcattgtcaagttttgcagcttggatacgtaattcggttgaattcttacttgaggctgtagaatgcaatttgacaatacatttatttggcatgagatt

SEQ ID NO: 5739 - DNA, 1201 bp, Carthamus tinctorius
aaggggggcgctcccttccgttcacaataccttcttctttcttacaacatcaatggccgcaatcaccaactaaaacaagagtcacaaaccattcatctgctaaccactactcaaatccaaccgaaatccattcaaaaacgaccttgttaacaatggcaaccatcgttcctccacctacaacaccttcaccggcggcggaagctatcaagccggagaaagttgattacatggacctaccatgccctattccttacgaagaaatccatcgcgaggctatgatgtccttgaagcctgaccattttgagggtatgcgtattgattttaccaagggtctcaatcagcggttctcactaagtcacagtattgcaatgggtcccacggaagttccttctcaatctgctgaaacgattaaaattcctactgctaactatgagtttggtgcgaactttatagacccaaagttgatgcttattggaaggatccataccgatgggcggctaactgctcgagtgaagtgcgacctgtctgagaatcttactatgaaggccaatgctcagcttacaaacgagcctcacatgtctcatggaatgttcaactttgactataagggtacggattacaggactcagttccaactaggaaatggcggcctgctcggagctagttatatccagagtctgacacctcacctctctttgggtggggaagtattctgggctggtcagcatcggaagtctggtattggctatgctgcacgatacaacactgataaaatggttgcatcgggacaaattgctagcactggaatgctggctcttagctatgttcagaaagtgtctgaaaaagtttctcttgcatcagatcttatgtacaattacatgtcaagagatgtcactgccagctttggatatgattatatactccgccagtgtcgacttagagggaagattgactcaaatggctgcacatctgcttttcttgaagaaaggttgaatatgggtctaaatttcattctatcagccgagatagaccacaaaaagaaagactacaagtttggattcgggttgacagttggagaatagatcaagcccagatgcaaaacgtaggatttaagcccgtattttttttgtgacatcacttgtcgtacccgaggtatgattttttgaaaaatcatgatggatgaatatcaaagttagttttg

SEQ ID NO: 5740 - DNA, 1519 bp, Mimulus guttatus
tataatagccgctccccatttctctctctcctctctctttctctctctagaagaagaatctaattgttcactcttcttcttcttcttcttaatttttatttaatttaggtttagaaaaacaaaattcagtgtgattcagataacgaagagaaaatagtcggctatggcaacccttattcctccctcacccgcgacggcgacgactcatccagctgccggtccaacaaatccgaccgccaccgagcagccgaaagtggattacttaaatctcccttgccccattccgtatgaagaaattcaccgcgaagctcttatgtccttgaagccagagctctttgagggattgcgctttgattttacgaaagggctcaatcaaaagttttctctgagccatagcgttatgatgggacctactgaagttccttctcagtcaaccgaaacgattaaaattcccaccgctaactatgaatttggcgctaactttatagacccaaagttgatgcttttcgggagggtaatgacagatgggagattaaatgcaagactgaagtgtgatttgactgagaatcttactctcaagggcaatgctcaacttacgaatgagccacatatgtcacatggcatgttcaatttcgattataagggatcagactatagaactcagtttcaactggggaatggagccttatttggtgcaagttacatccagagtgtgagtcctcatttatccttgggtggtgaagtattctgggctggtcaacacaggaaatctggcattggttatgctgcgcgttacaacactgacaagatggtcacaaccggacaagttgctagtactggtatggttgctctaagctatgttcagaaagtatctgaaaaggtttctttagcatcagacttcatgtacaactatatgtctcgggatgttactgccagcttcggatatgattacatcctccggcagtgtcgtttaagaggcaagattgattctaacggtgtcgttgctgctttcttggaagagcggtttaatatgggtcttaactttcttctctctgctgagatagatcataagaagaaagactacaagttcgggttcggattgacagtgggagaatagaatagaaacgaaacacgaaaggcatattcactctgtttcaatttaagatgtttgttgcaagtatgagaggatggatggggagatttttctccagataagaatcaaagaatcgattttgttttttttctctgagttgaattatcatttactcgttgcaacagaatcacttgtagttgattttgcaggttggagataatattattattgattccccaaagatactttttattgttatgcatacttggtgaaatagtgatacacttaattgtgtgcttgcactaataatatcttacaatttttttttttaaatattttgctgcatgtgctaatatgtaataatatattttttcttttctactattgcctatttgcaaattacccaaagtagccctagtatttaac

SEQ ID NO: 5741 - DNA, 1378 bp, Echinacea purpurea
cggccggggggacaggcaagggttttgcaaaactttcttcaggaggcgccctactcctcccattctctgcacacacaaaacccttacatcatcatcatcaatgcacgcaatcaccacataaaaccaccaccaacaaacttctatccaccatttttcttctcatcaactttcaattccgacgttgataccaatggcaactcatattcctccacctgcaacaccctcaccggcggcggaacctcttaagccggagaaagttgattacatgaaccttccctgtcctattccgtacgaggagatccaccgcgaagctatgatgtccttgaagccagaacattttgagggtatgcgttttgattttaccaagggtctaaatcaaaagttctctctaagtcacagtgttgttatgggacctactgaagttccttctcaatctgccgaaacgattaaaattcctactgcaaactatgagtttggtgctaactttatagacccaaagttgatgctttttgggagggtcttgactgatgggcgactaagtgcacgagtgaaatgtgacttgtctgagaatcttactatgaaggccaatgctcagcttacaaatgagcctcacatgtcacatggaatgttcaactttgactataagggttcggactacaggactcagttgcaacttggaaatggtggcctgattggagctagttatattcagagtgtgaccccgaacctgtctttaggtggagaagtattttgggctggtcagcataggaagtctggtcttggttatgcagcaagatacaacactgataaaatggttgcttcaggacagattgctagcactggaatggtggttcttggttatgttcagaaagtgtctgagaaggtttctcttgcaacagatatgatgtacaattacatgtcaagagatgtcactgctagctttggctatgattatatactccgtcagtgtcgtcttagagggaagatcgactcaaatggttgtacatctgcatttcttgaagaaaggttgaatatgggtctaaatttcattctgtcagctgagatagaccacaagaagaaagactacaagtttgggttcggcttgacggttggagaatagatgtagaaaaacatgagcccggctgcaagcttttaggatttaaatttatttttgagcgactgtcataccaagtgtgatcttttttatttataatgatggacagagtcaattttgtactcgttttgaagcgcattattgtggcggctattccagctgtgcagatggtttagagcatgacataatccttggttgtcaagttttgcagcttggatatttgaattcttacttgaagctgtagaatgcaatttgacaatacat

SEQ ID NO: 5742 - DNA, 1379 bp, Helianthus annuus
tcttgtagaatagaaggaggcgcctcaccataatccttccatttctctgcaacacacacacaaaacccttgcatcatcaatgcccgcaataatcaccacataaaacaacaaccgtttcacatcttctcaccactcaatcccgatcaaaatccactcaaaatcgacgttaacaccaatggcaactcatattcctccacccgtagcaccctcaccggcggcggagcctgtcaagccggagaaagttgactacatggacctgccgtgccctattccttacgaggagatccaccgtgaagccatgatgtccttgaagccagaacattttgagggtatgcgttttgattttaccaagggtctaaatcaaaagttttctctaagtcacagtattgttatgggacctacggaagtcccttctcaatctgctgaaacgattaagattcctactgcaaactatgagtttggtgctaactttatagacccaaagttgatgcttttcggaaggattttgactgatgggcggctaagtgcgcgagtgaaatgtgacttgtctgagaatcttactatgaaggccaatgctcagcttacgaatgagcctcacatgtcacatggaatgttcaactttgactataagggttcggactacaggactcagttacaactaggaaatggtggcctgatcggagctagttatattcagagtgtgacacctcacctgtctttaggtggcgaagtgttttgggctggtcagcataggaagtctggtcttggttatgctgcacgatacaacactgataaaatggttgcatcaggacaaattgctagcactggaatggtggttcttggttatgttcagaaagtgtctgaaaaggtttcgctggcaaccgatatgatgtacaattacatgtcaagagatgtcactgctagctttggctatgattatatactccgtcagtgtcgccttagagggaagatcgactcaaatggttgtacatctgcgtttcttgaagaaaggttgaatatgggtctaaatttcattctgtcagctgagatagaccacaagaagaaagactacaagtttgggttcgggttgacagttggagaatagatcaaaaaccatgagccgggatgcaagcttttaggatttaaatttgtttctgagtaacggcctgtcatagtgtgatctttttgttttattttatgatggacagtgtcagttttgtactctttttgaagcagcattatttctagcggctattaaagctgcgcagaccgtttagagcataacataaaattcagttgtcaagttttgcagcttggacatgtaattcactttgaattcctccttgaagctgtagaatgcgatttgacaatacattatt

SEQ ID NO: 5743 - DNA, 1312 bp, Helianthus annuus
catcatcaatgcccgtaataatcaccacataaaacaacaaccatttcacatcttctcaccactcaaatccgatcaaaatccactcaaaatcgacgttaacaccaatggcaactcatattcctccacccgcagcaccctcaccggcggcggaacccgtcaagccggagaaagttgactacatggacctgccgtgccctattccgtacgaggagatccaccgtgaagccatgatgtccttgaagccagaacattttgagggtatgcgttttgattttaccaagggtctaaatcaaaagttttctctaagtcacagtattgttatgggacctactgaagtcccttctcaatctgctgaaacgattaagattcctactgcaaactatgagtttggtgctaactttatagacccaaagttgatgcttttcggaaggattttgactgatgggcggctaagtgcgcgagtgaaatgtgacttgtctgagaatcttactatgaaggccaatgctcagcttacaaatgagcctcacatgtcacatggaatgttcaactttgactataagggttcggactacaggactcagttacaactaggaaatggtggcctgatcggagctagttatattcagagtgtgacacctcacctgtctttaggtggcgaagtgttttgggctggtcagcataggaagtctggtcttggttatgctgcacgatacaacactgataaaatggttgcatcaggacaaattgctagcactggaatggtggttcttggttatgttcagaaagtgtctgaaaaggtttcgctggcaaccgatatgatgtacaattacatgtcaagagatgtcactgctagctttggctatgattatatactccgtcagtgtcgccttagagggaagatcgactcaaatggttgtacgtctgcatttcttgaagaaaggttgaatatgggtctaaatttcattctgtcagctgagatagaccacaagaagaaagactacaagtttgggttcgggttgacagttggagaatagatcaaaaaccatgagccgggatgcaagcttttaggatttaaatttgtttctgagtaacggtctgtcataccgagtgtgatctttttgttttattttatgatggacagtgtcagttttgtactctttttgaagcagcattatttgtagcggctattaaagctgcgcagaccgtttagagcataacataaaattcagttgtcaagttttgcagcttggacatgtaattcactttgaattcctacttgaagctgtagaatgcgatttgacaatacattatt

SEQ ID NO: 5744 - DNA, 1300 bp, Panax ginseng
aagcagtggtatcaacgcagagtacatggggaaggaagaagaagaagaaagagccgacctcttcttcttagacacaaatcctttcggtcaaaacatacaatggccacactagttcctccggcgacttcaaagcctacggtaatcgaaccagagaaagtcgattacatggacttgccttgccccattccctatgaagagattcaccgcgaagctctcatgtccttaaagccagaactttttgagggattgcggtttgattttactaaaggactgaaccaaaaattctcactcagtcacagtgtgttcatgggacctactgaagtcccttctcaatctgctgaaacaattaagatacccactgctacctacgagtttggtgccaactttatagacccaaaattgatgcttattgggaggatattgacggatggtaggctaagtgcaagagtgaagtgcgacttgtctgataaccttactctgaaggccaatgctcaacttacaaatgagccacacatgtcacatggcatggtcaattttgattataagggaaaggactttaggagtcaagttcaacttggtaatggtgctttatttggagccagttatatccagagtgtgacaccacatttttccttgggtggtgaagtattctgggctggtcagcatcggaaatctggtattggttatgctgcacgatataacacagataagatggttgccacagggcaagttgctagcaccggaatggttgctctgagctatgttcagaaattatctgacaaggtttctctagcatcggacttcatgtacaactacatgtctagagatgtcactgcaagcgttggttatgattacattcttcgtcagtgtcgtcttagagggaagatcgactccaatggctgcacagctgccttcctggaagagcgattgaatatgggtcttaactttattctttccgcagagattgatcacaagaagaaagactacaagtttggttttggtttgacagtaggagaatagaaggctccattgaggtcttcagttttagttcagctttgttgctgcaaacagcacggcacggcatgactcggcattgtttttctctagatgaaggtgaaaggataaatattgtacttgtggagcaacatttatggaggcatctgtttgccataaaaaaatgttgtacaagtttttaaaaacggaaattgaaatttacattacatgagatggcatttatgatacaaataagattattatgatacttggtgctgcctgaaaattctgaaatagttttgacaaa

SEQ ID NO: 5745 - DNA, 1231 bp, Flaveria ramosissima
actcacagaaggaggcgcttctcatcgttctcctcaacaacacacacaaaaccctcacaaacatcaatgcccacaatcactacataaaaccataaacacataaagttcaactcaccattgtactctcaatcatcgctcaaatccgatcaaaatccacccaaaatcaccaccaataacaatggcaacacgtgttcctccgcctgcaaccgtcccaccgccgcgccgccgccggcggcggaagctatcaagccggagaaagttgattacatggacctgccgtgtccgattccgtacgaggagatccaccgcgaggcgatgatgtcattgaagccagatcattttgagggtatgcgtgttgattttaccaagggtctcaatcagaagttctctctaagtcacagtattgttatggggcctactgaagttccttctcaatctgccgaaacgattaaaattcctactgcaaactatgagtttggtgctaactttatagacccaaagttgatgcttttcgggaggatcttgactgatgggcggctaagtgctcgagtgaaatgtgacttgtctgagaatcttactatgaaggccaacgctcagcttacaaatgagcctcacatgtcacatggaatgttcaactttgactataagggttcggattacagaactcagttacaactaggaaatggtggcctgattggagctagttatattcagagtgtgacacctcacctgtctttaggtggggaagtgttttgggctggtcaacataggaagtctggtattggttatgccgcacgttacagcaccgataaaatggttgcttcaggacaaattgctagcactggaatggtggttcttggttatgttcagaaagtgtctgaaaaggtttctctggcaacagatatgatgtacaactacatgtcaagagatgccactgccagctttggctatgattatatactccgtcagtgtcgtcttagagggaagatcgactcaaatggctgtacatctgcatttcttgaagaaaggttgaatatgggtcttaatttcattctgtcagctgagatagaccacaaaaagaaagactacaagtttggttttgggttgacggttggagaatagatcaaaaaacgcaagctcagaggcaaacttctaggatttaaatttattttttgagtgacaatttgtcataccaaagtgtgatcttttgttttattctatgatgatggac

SEQ ID NO: 5746 - DNA, 1345 bp, Helianthus annuus
aaatgggagttgccttagccagatgctagttaattgctgagccgggcctgaggcagtgagccgtgtgcatctccagccgacttaagggaagggttttgcaagcaaaactcatcatcatcaatggccgcaatcagcagatagacaatccaactctctcgaacctagaatcagatggcgacacatattcctccaccggaacctgaaaaagtcgattacatggatctaccgtgtcccattccttacgaagaaatccatcgcgaggctttgatgtccttgaagcctgaacattttgagggtttgcgttttgattttaccaagggtctcaatcaaaaattctcactaagtcacagtattgttatgggacctacggaagttccttctcaatctgctgaaacaattaaaattcctactgcaaactatgagtttggtgctaactttatagacccaaaggtgatgctttttggaagaatcttgactgatgggcgcctaagtgctagagtgaaatgtgacttgtctgagaatcttactatgaaggccaatgctcagcttacaaacgagcctcacatgtctcacgggatgttcaactttgactacaagggaacagattacaggactcagttccaactaggaaatgggggtctgcttggagctaattatatccagagtgtgacacctcacctttctttaggtggagaagtattctgggctggtcagcataggaagtctggtcttggttacgctgcacgatacaacacggataaaatggttgcctcagggcaaattgctagcactggaatggtggctctaagctatgttcagaaagtgtctgaaaaggtttctctggcaacagatatgatgtacaattacatgtcaagagatgtcactgccagcgttggctatgactatatactccgtcagtgtcgtcttagagggaagatcgactcaaatggctgtacatctgcttttcttgaagaaaggttgaatatgggtctaaatttcattctgtcagctgagatagaccacaagaagaaagattacaagtttggctttgggttgacagttggagaatagattaaaaaaacatgagcgcagatgcaaaatttaggaattaaactgatttttgatcttgtcataccaagtctggtcttttttatattttatttatggacaaagaagcagttttgtacttattttcaagcaacattagttttggcgccaatttgagctttagggcacataacataatctatagctgtaattcagttgaattcttatttgaagctgtagaatgtcagccaatgcaattggctgaatattattcaaatggagatacacattttacgtg

SEQ ID NO: 5747 - DNA, 1063 bp, Helianthus annuus
agggaagggtttttgcaagcaaaactcatcatcaatggccgcaatcagcagatagagtttctggaacctagaatcagatggcgacacatattcctccaccggaacctgaaaaagtcgattacatggatctaccgtgtcccattccttacgaagaaatccatcgcgaggctttgatgtccttgaagcctgaacattttgagggtttgcgttttgattttaccaagggtctcaatcaaaaattctcactaagtcatagtattgttatgggacctacggaagttccttctcaatctgctgaaacaattaaaattcctactgcaaactatgagtttggtgccaactttatagacccaaaggtgatgctttttggaagaatcttgaccgatgggcgcctaagtgctagagtgaaatgtgacttgtctgagaatcttactttgaaggccaatgctcagcttacaaacgagcctcacatgtctcacgggatgttcaactttgactacaagggaacagattacaggactcagttccaactaggaaatggtggtctgcttggagctaattatatccagagtgtgacacctcacctttctttaggtggagaagtattctgggctggtcagcataggaagtctggtcttggttacgctgcacgatataacacggataaaatggttgcctcagggcaaattgctagcactggaatggtggctctaagttatgttcagaaagtgtctgaaaaggtttctctggcaacagatatgatgtataattacatgtcaagagatgtcactgccagcgttggctatgactatatactccgtcagtgtcgtcttagagggaagatcgactcaaatggctgtacatctgcttttcttgaagaaaggttgaatatgggtctaaatttcattctgtcagctgagatagaccacaagaagaaagattacaagtttggctttgggttgacagttggagaatagattaaaaaacaatgagcgcagatgcaaatttaaggtaagttaaacttagattttgttatcttgttcataccaagtctggtcttttt

SEQ ID NO: 5748 - DNA, 1140 bp, Centaurea maculosa
caccaaaaaatttctctaatttctcttccattctttaaccagcgatcttggcagcaatggcgaccatcgttcctcccccaatctctccgccggcggcggaagcgatcaagccggagaaagtcgattacatggacctgccgacccctattccgtacgaagaaatccaccgggaagccctcatgtcgttaaagcctgaacatttcgaggggatgcgtgttgattttaccaagggactcaatcagaggttctcactgagtcacagtatcatgatgggacccactgaggttccttctcaatcggctgaaacaattaaaattcctactgcacactatgagtttggtgctaactttatagatccaaagttgatgcttttcggtagggtcttgactgatggacgggttaacgccagagtgaaatgtgacttgtctgagaatcttagcatgaaggccaatgctcagcttacaggtgagcctcacatgtcgcatggaatggttaactttgactacaagggtaccgactataggactcaattccaactaggaaatggtgccttactcggagctagttatatacagagtgtgacccgcaacctatctttgggcggggaagtattttgggctggtcagcatcgtaagtctggtcttggttatgctgcccgatacaacacagataaaatggttgcctcaggacaaattgctagcactggaatggtggctcttagctatgttcagaaagtgtctgaaaaggtttctttggcgtctgatttgatgtacaattacatgtcaagggatgtcagtgccagtttcggctatgattatatacttcgccagtgtcggcttaggggcaagatcgactcaaatggctgcacatcggcttttcttgaagaaaggttgaatatgggtctcaatttcattctttccgctgagctagaccacatgaagaaagactacaagtttgggtttggattgacggttggagaatagggagaagcagcgagaacacatggatgcagaatctactcattgttttcaagtgagtcagcttgtcatacgagactgattatttatttttttcatcttacggacaattttgtacgttttttgagcgatatcggcagttccaaatgcatcaaaagtttag

SEQ ID NO: 5749 - DNA, 1079 bp, Cirsium arvense
aactaaaaaaaattgtttacaggtgatttcgttttccatttttgaaccagccgaaccaaatcttggtaacaatggcggccctcgttcctcctccaatctctccggcggcggcggaagcgatcaagccggagaaagttgattacatggacctgccgacccctattccttacgaagaaatccaccgggaagccctcatgtcgttaaagcctgaacatttcgaggggatgcgtgttgattttaccaagggactcaatcagaggttctcactgagtcacagtattatcatgggaccgaccgaggttccttctcaatccgctgaaacaattaaaattccgactgcacactatgagtttggtgctaacttcatagatccaaagttgatgctttttggaagggtcttgactgatggacgggttaacgccagagtgaaatgtgacttgtctgaaaatcttagcatgaaggccaatgctcagcttacaagtgagccacacatgtcgcatggaatggttaactttgactacaagggtactgactacaggactcaattccaactaggaaatggtgccttactcggagctagttatatacagagtgtgaccccccatctgtccctgggcggggaagtattttgggctggtcagcatcgtaagtctggtcttggttatgctgcccgatacagcacagataaaatggttgccgcaggacaaattgctagcactggaatggtggctcttagctatgttcagaaagtgtctgaaaaggtttctttggcatctgatttgatgtacaattacatgtcaagagacgtcactgccagcttcggctatgattatatacttcgccagtgtcggcttaggggcaagatcgactcaaatggctgcacatcggcttttcttgaagaacggttgaatatgggtctcaattttattctttccgctgagatagaccacatgaagaaagactacaaatttgggttcggattgacggttggagaataggggagaagagtagcaacacaaatgcagaatcctactcattgtttcaagtgagtcagcttgtcttacgagactgattttttt

SEQ ID NO: 5750 - DNA, 1287 bp, Panax ginseng
ggggaagggtttttctcctctactgctctgccgagtattttgttactccaaagtccaaagcccaaaccataaaccctcaactctctatctagccgcgcctaaggaagaagaagaagaaagagccgacctcttcttcttagacacaaatcctttcggtcaaaacatacaatggccacactagttcctccggcgacttcaaagcctacggtaatcgaaccagagaaagtcgattacatggacttgccttgccccattccctatgaagagattcaccgcgaagctctcatgtccttaaagccagaactttttgagggattgcggtttgattttactaaaggactgaaccaaaaattctcactcagtcacagtgtgttcatgggacctactgaagtcccttctcaatctgctgaacaattaagatacccactgctacctacgagtttggtgccaactttatagacccaaattgatgcttattgggaggatattgacggatggtaggctaagtgcaagagtgaagtgtgacttgtctgataaccttactctgaaggccaatgctcaacttacaaatgagccacacatgtcacatggcatggtcaattttgattataagggaaaggactttaggagtcaagttcaacttggtaatggtgctttatttggagccagttatatccagagtgtgacaccgcatttttccttgggtggtgaagtattctgggctggtcagcatcggaaatctggtattggttatgctgcacgatataacacagataagatggttgccacagggcaagttgctagcaccggaatggttgctctgagctatgttcagaaattatctgataaggtttctctagcatcggacttcatgtacaactacatgtctagagatgtcactgcaagcgttggttatgattacattcttcgtcagtgtcgtcttagagggaagatcgactccaatggctgcacagctgccttcctggaagagcgattgaatatgggtcttaactttattctttctgcagagattgatcacaagaagaaagactacaagtttggttttggtttgacagtaggagaatagaaggctccattgaggtcttcagtttttgttcagcttttgttgctgcaaacagcacggcacggcacagctcggcattgttttcctctagatgaaggataaattttgtacttgtggagcaacatttatggagcatctgtttgccataaaaaaatgttgtacaagtttttaaaaacggaaattgaaatttacattacatgaga

SEQ ID NO: 5751 - DNA, 1130 bp, Primula obconica
ccttctccctctctctctctagacatatatataatacatataaaatagtatatctatatatagtaagggacttggatctaagaaaatggcaactctggttccaccgccgccggcgaccaaccggttgtgaccccgccggagaaagttgattacatgaacttgccgtcgcccattccctatgaagaaatccaccgtgaagctttcatgtccttaaagccagaactttttgaggggatgcgatttgattttaccagagcactcaatcagaagtttgctctcagtcacagcgtatctatgggacccacggaaattccttctcaaggttctgaagcctttaagattcccactgctaattatgagtttggagccaactttttagacccaaagttgatgcttgtcgggagaatattgacagatgggagacttaatgctcgagtgaagtgtgatttgtcagaaaatcttactttgaaggccaatgctcagcttacaagtgaaccacatatgtcacaaggcatggctaatttcgattacaagggtaaagatttcaggactcagttccaactaggaagcggtgccttacttggagccagttacattcagaatgtgaccccacatttgtctctgggtggtgaagtattttgggctggtcagcatcgaaagtctggtattggttatgctgcccgatacaataatgacaagatggttgctactggacaagttgctagcaccggactggttgtccttagctatgttcaaaaagtatctgagaaggtttctttggcctcggacttgatgtacaactacatgtcaagagatgtgaccgcaagctttggatatgattacattctccgacagagtcgccttaggggaaaaattgattccaacggttgcactgctgcatttttggaagagcgtcttaatatgggtctcaattttatcctttctgccgagattgatcacaagaagaaagactacaaattcgggtttggcctgacagtaggagaataagcttgtaggttgatttattttcatggataaagagaagcttttctcgtctgtggttgattttcccccttttgatgcagatggatataattgttttttacttgtctggagtagttatatttttg

SEQ ID NO: 5752 - DNA, 1329 bp, Centaurea maculosa
tttcttacaacatcaatggccgcaatcaccaactaaaagtagaaccacaacttccacaaaccattcatcttctcaccagtactcaaatccaactgaaatccatacgaaaaacgaccttattaacaatggcaaccatcgttcctccaccagcaacacctccaccgccggcggcggcggcggaagccatcaagccggagaaagttgattacatggacttaccgtgccctattccgtacgaagaaatccatcgcgaggctatgatgtccttgaagcctgaccattttgagggtatgcgtgttgattttaccaagggtctgaatcagcggttctcactaagtcacagcattgcaatgggtcccacggaagttcctgctcaatctgctgaaacgattaaaattcctactgcaacctacgactttggtgcgaactttatagacccaaagttgatgcttattggaaggatccatactgatgggcggctaactgcaagagtgaagtgtgacttatctgagaatcttactatgaaggccaatgctcagcttacaaatgagcctcacatgtctcatggaatgttcaactttgactacaagggtacggattacaggactcagttccaactaggaaatggcggtctgctcggagctagttatatccaaagtgtgacacctcgcctctctttgggtggggaagtattctgggctggtcagcatcggaagtctggtactggctttgctgcaagatacaacactgataaaatggttgcgtcgggacaaattgctagcactggaatgctggctcttagctatgttcagaaagtgtctgaaaaagtttctcttgcatcagatcttatgtacaattacatgtcaagagatgtcactgccagctttggatatgattatatactccgccagtgtcgacttagagggaagattgactcaaatggctgtacgtctgcttttcttgaagaaaggttgaatatgggtctaaatttcattttatcagccgagatagaccacaaaaagaaagactacaagtttggattcgggttgacagttggagaatagatcgaacccagatgcaaaacgtaggatttaagctcgtattttttgttgacatcacttgtcgtacctgaggtatgactttttttgttaaaatcacgatggacgaatatcaaagagtcagtttttgtgattttttgcgtgcagcattatttgtggctgcaattccagctgcatattgacagtttagagcataatccatagatatcgaaatttgcagcttggatatgtaattcaatcgggttccattagaagctgtagaatgcatcat

SEQ ID NO: 5753 - DNA, 1322 bp, Taraxacum officinale
tcttccttcctgaaacacacactctctcttacacatcaatggccgcaatcaccttgtaaaccagaagaaataggttttacgaaccattatacttctcactagtactcaaatctaatccaaatccatccaaaatcaacggtgataccaatggcagctcttttccctcctcctcccgcaacagcttcaccggcggcggcggaagctatcaagccagaaaaagttgattacatggacctcccatgccctattccttacgaagaaatccaccgcgaggctatgatgtcattaaaacctgaacattttgagggcatgcgtgtggactttaccaaaggtctaaatcagagattctcactaagtcacagtattgttatgggacctactgaagttccttctcaatctcccgacacaattaaaatccctactgcaaactatgagtttggtgctaactttatagacccaaagttgatgctatttggaaggatcttgactgatgggagactaagtgcccgagtgaaatgtgatatatctgaaaatctcaccatgaaagctaatgctcagcttacaaacgagcctcacatgtcacatggaatgttcaactttgactataagggtagtgattacaggacacagttccaactaggaaatggtggtctaattggaactagttatattcagagtgttacccctcacctgtctttaggtggtgaagtattttgggctggtcagcatcgtaaatctggtcttgggtatgctgcacgatacaacacggacaaaatggttatgtcgggacaaattgctagtactggtatggtcgctctaagctatgttcagaaagtgtctgaaaaggtttctctggcgtctgatttgatgtacaattacatgtcaagagatgtaactgcaagttttggctatgattatatacttcgccagtgtcgtcttagagggaagatagactcaaacgggtgtacatctgcttttcttgaagaaagactaaacatgggtctaaatttcattctatcagccgagatagatcacaggaagaaagactacaagtttgggtttgggttgacagttggagaataggtggaaaaaaacctaggatttaaaaaaaaaaactttattttgagtgagaaagaaaaaacttgtcatatcaggtatgattttttttatcgtgatgaagaacgattggaatgaaagagtcggtttttgtatttgttttcgagcaagcatttatttgtggcggccattacagctggcattgacagttttttttttagagcataaacataaaccctagttgtcaaaaaatttgaagcttttct

SEQ ID NO: 5754 - DNA, 1663 bp, Sarracenia psittacina
tgcttctctatcagctctgttcactgtcgtcccacaaaacctgtaaagatctctctctctcgtctttagccgcaacagtcgaagaaaaatcatattctctctgcttagccgccgtattcgaccttcaatctccgccgttacgttcggaatcgatcgaaagggtaccgaccaatggccactcttgttcctcccgcggcctcgtcgccaccggcatcgaagccgaccgtgatccagccggagaaagtcgattacctgaacctaccgtgccctattccatacgaagaaatccaccgcgaagctctcatgtccttgaagccagaactatttgaggggatgcgctttgattttaccaaaggactcaatcagaaattctcactaagtcatagtgtgttcatgggacctactgagattccttctcagtcttctaagccattagattccactgctcactatgaatcggtgctaactttatagacccaaagttgatgcttttggagaattatgacagatgggaggctgaatgcacgagtgaagaatgatttgactgaaaatctactttgaaggccaatgctcaacttacaaatgagccacatatgtcacatggcatggtcaattttgattataagggtaaagactataggacccaacttcaactagggaatggtgctctatttggagctagttacatacagagtgtgaccccacatttgtctttgggtggtgaggtattctgggctggtcagcatcggaagtctggcattggctatgctgctcgatacaacacggataagatggttgctactgggcaagttgcaagcactggaatggttgccctgagctatgttcaaaaagtaatctgagaaggtttcttggcatcagatttcatgtacaactacatgtcaagagatgtcacggcaagctttggttatgattacattctccgacagtgccgtcttagagggaagattgattctaatggctgcacagctgcttttctggaagagcggttgaatatgggtcttaattttattctttctgctgagatagatcaccggaagaaagactacaaattcgggttcgggttggcagtaggagaataggatagaaagctcaatgctgtcctcaggttagatttaagctcatgaatgcaagcaactctgcatgcatgcggggttgtaatgactaatatattccctgatgcagatcacagaattagtattgtacttttatttggattttggagtgtcattatttgcggggcagcactggctgctgcaacagttttacgagtccacagtagattttgcagtttggagctactttgcggttttcccccctcttttcaaagctgtagattccatcgccagagggatttatgaagtgccattattgatggaaatctcacttgcttttataatttatttagaagttctcacctcttttgtttccgaattttgtgattggtggagagttctgtttggttctctctccttttttttaaatttttttttataattagtgatatactgctgatattgtgctctcaacaattggagaaccaaattgagacttggattcacatttctgaactattgtttgggagttggcagtttgcactctgcataacatggtactattttaatgatcaggctcttccttgtat

SEQ ID NO: 5755 - DNA, 1053 bp, Arnica chamissonis
gcagatagagaagaaagaaaacacgttttgctaaccattctacttcccattagtataatcggatcaaaatccatccaaatcgacgttaattacaatggcaacacattttcctccacctacaacagcttcaccggtggcggcggaagctatcaagccggaaaaagttgattacatggatctaccatgtcctattccttacgaagaaatccatcgcgaggctatgatgtccttgaagcctgaacattttgagggtatgcgtgttgactttaccaagggtctgaatcaaaggttctcactaagtcacagtattgttatgggacctacggaaattccttctcagtctgctgaaacaattaaaattcctacttcaaactatgagtttggtgctaactttatagaccctaaggtgatgctttttggaagaatcttgactgatgggcggctaagtgctcgagtgaaatgtgacctgtctgagaatcttactatgaaggccaatgctcagcttacaaacgagcctcacatgtcacatgggatgttcaacttcgactataagggaacagattacagaactcagttccaactaggaaatggtggcctgcttggagctagttatatccagagtgtgacacctcacctgtctttaggtggggaagtattctgggctggtcagcataggaagtctggtcttggttatgctgcacggtacaacacagataaaatggttgcctcaggacaaattgctagcaccggaatggtggctcttagctatgttcagaaagtgtctgaaaaggtttctctggcaacagatatgatgtacaattacatgtcaagagatgtcactgccagctttggctatgattatatactccgtcagtgtcgtcttagagggaagatcgactcaaatggttgtacatctgcttttcttgaagaaaggttgaatatgggtctaaatttcattctgtcagccgagatagaccacaagaagaaagactacaagttcgggtttgggttaacagttggagaatagatcaaaaaacatgagcccggatgcaa

SEQ ID NO: 5756 - DNA, 1181 bp, Vicia sativa
acaatggcgtcgatggttcctccgattcccaccgccgacgacaacaagcccgatgtcaaagtcgattactccaacctcccttgtcccattcccttcgaagagcttcatcgcgaagctatgatgtcgttgaaacctgagctttttgagggtatgcgttttgatttcaccaaaatgctaaatcagaaattctctctcaatcacagcgtgtcgatgggacctactgaggttccttctcagtctgcggagattattaaaattccaactgctaactatgagtttggtgcaactgtcattgatcatcctaagatgttgcttatggggagagctttgactgacggcagggtaactgctagagtcaagtatgacttgactgagaatctcactgtaaaagccaatgctcagctatcaagtgagccacatgcgtcgcaagggattgtcaactttgattacaagggaaaggattataggacccagattcaactaggaaatggatctttgctaggagcaagttatattcagagtgtcaccaatcatttatcattgggcggggaggtattttggactggtcagcatcggaagtctggtgttggttatgctgctcgctacaacactgataaaatggttgccactggacaaattgccagcactggaatggcccttctaagctatgttcagaaggtatctgataaggtttctctggctactgatttgatgtgcaacttcaactccatgtcaagagatgtcactgctagctttggttatgactacatccttagacagtgccgccttaggggaaaggttgattccaatggcgtctgtgctgcatttttggaggagcggttaaacatgggtctgaacttcattctttctgcagagcttgatcacaagaaaaaagactacaaatttggatttggtttgactgttggagaataaaattgcaggactagagctgtatttccttttctttagccagcctagcctagcaagttttcttgcttcattttacttgttggagatttttcttttcgggaaaaagaaaacacaggaggaatatatcatttgtgtcggcaaacatcatttaatccacaagttgggctaaaaatacttcaaatttgttttgaacccttgccctgttttccctggagggagatgtagagtgataatagcagaccatgcatatt

SEQ ID NO: 5757 - DNA, 1497 bp, Lactuca sativa
atccaaagaccagggtttttatagagtaccaagggtttttttattttatttctttgttgctcctcaaatcttccacttcgaagaagaaaacactgtacaaagccttttcttcttccaatttttgaccagctaaatctatctttggtaaaaatggcgactcttgttccccctccaccagcggcggcggcggcggaaactatcaaaccggagaaagtcgattacatggacctaccatgccctattccttacgaagaaatccaccgggaagccctcatgtccttaaaggctgattattttgaggggatgcgagttgattttactaagggactcaatcagagattctcactaagtcacagtattgccatgggacccacggagcttccttctcaatctgctgaagtaattaaaattccaactgcaaactatgagtttggtgcaaacttcatagatccaaagttaatgcttattggaagagtcttgactgatggacgagtcaatgccagagtgaaatgtgacttgtctgagaatcttaccatgaaggccaatgctcagcttacaagtgagccacacatgtctcatggaatgttcaattttgagtacaagggtagcgactatcggagtcaattccagcttggaaatggtggtttacttggtgctagttatattcagagtgttacccctcacttgtcattaggtggggaagtattctgggcaggtcagcatcgtaagtctggtcttggttatgctgcccgatacaatacggataaaatggttgcctcaggacagattgctagcactggaatggtggctcttagctatgttcagaaagtgtctgaaaaggtttcattggcatctgatttaatgtacaattacatgtcaagagatgtcactgccagctttggctatgattacatacttcgccagtgtcggcttagaggcaagattgactcaaatggctgcacatctgcttttcttgaagaaaggttgagcatgggtcttaattttatcatctctgctgagatcgaccacatgaagaaagactacaagtttgggttcggattgacagttggagaatagataacaacatgcttcattgctttgtgagtcaaattgattatttttttcaatcttgaggacacaaatatttgagatttatttttatcttttttgagcaatataacttgtgggtggcgcttccagctgcatgacagtttagagtagcatttaccagttgtaggcatttaattttgcagtttggagatgtaatttaatgtagtctgttttcagccatttccattcccatttccatttgtatggatgaatcataataggggataaactacggttgattgtgattgtgattgatgggacaaaatccagaaaagatacaagttcaaaaatgagaaacccttgtcaaatatgaccaatccgtgaaccaattgtggaaaatgttgaacccattaatttagtttcttgttaaattattttacaaaacca

SEQ ID NO: 5758 - DNA, 1340 bp, Panax ginseng
cagtggtatcaacgcagagtacgcggggactgcaaatcaggaactatatttttctagctagccgcacccaaggaagaagaagagcttaacttcttcttcttaatcaaaacttacaatggccacgctcgttcctccgccgtattcagctccaccggcgacttcaaagccgccggtgatcgaaccagagaaagtcgattacatggacttgccctgccccattccctatgaagaaatccaccgcgaagctctcatgtccttaaagccagaactttttgagggattgcgatttgattttaccaaaggactgaaccaaaaattttcactcagtcacagtgtgttcatgggacctaccgaagtcccttcgcaatctgccgaaacaattaaaattcccactggtcactatgagtttggtgccaactatgtagatcccaaattgatgcttattgggaggatattgacagatggtaggctaaatgcaagagtgaagtgtgacttgtctgacaatctaactatgaaggccaatgctcagcttacaaatgagccacacatgtcacatggcatggtcaattttgattacaagggaaatgactttaggacccaacttcaactcgggaacggtgctttatttggagccagttacatccagagcgtgacaccacagttttctttgggcggtgaagtattctgggctggtcagcatcggaaatctggtattggttatgctgcgcgatacaacacagataagatggttgccacagggcaagttgctagcactggaatggttgctttgagctatgttcagaaattatctgataaggtttctctagcatcagacttcatgtacaactacatgtctagagatgtcactgcaagctttggttatgattacattcttcgtcagtgtcgtcttcgagggaagatcgactccaatggctgcacagctgcttttctggaagagcgattaaatatgggtctaaattttattctttccgcagagatagatcacagtaagaaagactacaagtttggttttggtttgacggtaggagaatagaagtctctcccatgatatgtacaactagagagtcttgatgatgcaggcgaaggaaggataaattttattatactcagatgagtgacatttatttgttggcggaaacagtttgtagtagtttatttttgcagtatggagcttcagtttacaaggagaagctgtaaaattcattacaggggagagtgaatttttcattaaatctgtgacatgacatgaggggccggatgcctgttaactaagggtactgaatttattcagtcatatttaattttagtaatttgacaaa

SEQ ID NO: 5759 - DNA, 1055 bp, Valeriana officinalis
ccaatggctactctaattcctccgccgcttccatcgcagcccgctgtcgtcgaaccgaagaaagtcgactatatggaccttccttgccctattccttttgaggaaatccaccgtgaagctctcatgtccttaaagccagaactttttgagggaatgcgatttgattttacaaaaggcctaaatcaaaagttctgtctcagtcacagtgtcttcatgggacccactgaagttccttcacaaggagctgaaacaatcaagattcccactgcacactatgaatttggcgcgaactttattgatccgaaattgatgcttgttggtagggttttgacagatggaagagtgaatgcgagactcaagtgcgatttgactgataatcttattttgaaggggaatgctcaacttacgagtgagccacatatgtcgcatgccatgggaacttttgattacaggggtaaagattaccggactcagtttcaacttggtaatggtgctttatttggagccagttacatccagagtgtaacaccatcattgtctttgggaggcgaagtattctgggctggtcagcatcgaaaatctggcattggttatgctgctcgttacaacacagataagatggttgctaccggtcaagttgctagcactggaatggttgctttgagctatgttcagaaagtatctgaaaaggtttcacttgcagcagatttgatgtataattatatgtctagggacgttacttcgagttttggttatgattatatccttcgtcaggcacgcattaggggtaagattgattcaaatggctgcacgtctgctttcttggaagaacgattaaacatgggtctaaatttcattctttcagcagagatcgatcatgtgaagaaagactacaagtttggcttcggattaacagtaggagaatagaaattggaggttcatcggtctaattcgagctctcgttgttgagagcaaaattccaacgttgttttaggttattattatcattgctattattccaagttgttacttactaagtttctagttttgtatcg

SEQ ID NO: 5760 - DNA, 1279 bp, Juglans hindsii x Juglans regia
ggggagacgctctcctctcggattcagatttttgtttgattacttaattggatacaatggcgacggccctgaacgttcctccagctaccaccaccactacgctgccggagatgaagaaagaggaggagaaagtggattacttgaacctcccttgtcctattccctacgaggagatccaccgcgaagctctcatgtctttgaagccagaactatttgaaggaatgcggtttgattttaccaaggtctcaatcagaagttttcactaagtcacagtgtgttcatgggaccaatggagattccctcacaatcttctgaaacaatcaaaattcctactgctcactatgaatttggtgccaactttatagacccaaagttgatgcttttcgggagaattctgaccgatgggaggctcaatgcaagactgaagggtgatttaactgacaatctttctttgaaggctaatgcgcagcttacaaatgagccacatatgtcacatggcatggtttcttttgattacaagggcaaagactacaggactcagtttcaactgggaaatggtgccttatttggagcgaattatattcagagtgtgaccccccatttgtcttttggtggtgaagtattttgggctggtcagcatcggaagtctggtattggttatgctgctcgatacaacacggacaagatggttgccacagggcaagttgctagtacaggattggttgctctgagctatgttcagaaggtatctgagaaggtttctctagcctcagatttgatgtacaactacatgtcaaaagatgtcacggcaagttttggttatgattacatccttcgacagtgccgccttagagggaagattgattccaatggctgtgccgctgcctttctcgaggaacgattgaatatggggctaaattttattctttcgtcggagctagatcacaggaagaaagattataaatttgggtttgggctgacagttggcgagtagattcaagcaaaacttggagctgttttatatcctcatttgtccgtggcaaccttgcgggctcttgctttgtttctcctattgtcgcagatcatagaatcagttttgtactacttctatttcaggcaaagttcttgtggggtagcttcagatgctgccacaattcaagagatcatcatattgattgatttggagttgcactctttgttaccctttaggtcttcagaatgagatcgaataacgaacatgaagatattttagcacttttaataacgtgcttattttgta

SEQ ID NO: 5761 - DNA, 1370 bp, Solanum tuberosum
cttttcttcctttatagccgcagtcaggaggaagaagaaggaaaacagaatcaaatttcttccttctttttttttattaatttatttttgtgcaaatggctactctcattcctccgtcagttatagttccaccggcgaattcaaggtcggcagccgtcgaatcggagaaagagaaagttgattacctgaacttaccttgtccaattccttatgaagaaatccatcgtgaagctctcatgtctttaaagcccgagctttttgaaggactgcgttttgattttaccaaaggacttaatcagagattttcactcagtcatagtgtttttatggggcctacagaacttcctactcagtctgcagacatcgtcaaaataccaactgcacactatgagtttggtgccaactttatagatccacagatgatgcttattgggagagtaatgacagatggtagggtgaatgctagggtgaagtgtgatttatctgagaatctttcattgaaagccaatggtcagctgactggtgaaccacacatgtcacatggcatggttaatttcgattacaagggtaaagactacaggactcaatttcaacttggcaatggtgcattacttggagccagctacatccagagtgtcggtccacatttgtctctgggtggggaagtgttctgggctggtcagcatcggaaatctggcattggttatgctgctcgctacaacacagataaaatggttgctgcagggcaagttgctagtactggaatggttgcactgagttatgttcagaaaatttctgataaggtgtctctagcatcagattttatgtacaactacatgtcaagagatgtaacagcaagctttggttatgattacatccttcggcagtgccgtctcagagggaagattgattccaatggttgtgtagctgctttcttggaagagcgcttgaacatgggtcttaatttcattctttcagctgaggtcgatcacaaaaagaaagactacaagttcggttttggactcacagttggagaatagaggaggcagcttaaacaggaattaggtattagcatatgagcacaagattaaaattgaaagcatcttaacaagtgatgctttttctcagcgataaaagaatcgaaacatcagttttgtatttttatcgagcgacattggttctggaacatacatttcatcaactggtgcaactagtcactaatagttgatttttgcaatttcggaaaattcttttagacagtttagaattgtagagttgactttattttgataaagagatctaccattctgattttactggatgctatatgcttaataattctatggttaaatttaatgtagtgtttagag

SEQ ID NO: 5762 - DNA, 1380 bp, Solanum phureja
actctactgagtttttcttcctttatagccgcagtcaggaggaagaagaaggaaaacagaatcaaatttcttccttctttttttttattaatttatttttgtgcaatggctactctcattcctccgtcagttatagttccaccggcgaattcaaggtcggcagccgtcgaatcggagaaagagaaagttgattacctgaacttaccttgtccaattccttatgaagaaatccatcgtgaagctctcatgtctttaaagcccgagctttttgaaggactgcgttttgattttaccaaaggacttaatcagagattttcactcagtcatagtgtttttatggggcctacagaacttcctactcagtctgcagacatcgtcaaaataccaactgcacactatgagtttggtgccaactttatagatccacagatgatgcttattgggagagtaatgacagatggtagggtgaatgctagggtgaagtgtgatttatctgagaatctttcattgaaagccaatggtcagctgactggtgaaccacacatgtcacatggcatggttaatttcgattacaagggtaaagactacaggactcaatttcaacttggcaatggtgcattacttggagccagctacatccagagtgtcggtccacatttgtctctgggtggggaagtgttctgggctggtcagcatcggaaatctggcattggttatgctgctcgctacaacacggataaaatggttgctgcagggcaagttgctagtactggaatggttgcactgagttatgttcagaaaatttctgataaggtgtctctagcatcagattttatgtacaactacatgtcaagagatgtaacagcaagctttggttatgattacatccttcggcagtgccgtctcagagggaagattgattccaatggttgtgtagctgctttcttggaagagcgcttgaacatgggtcttaatttcattctttcagctgaggtcgatcacaaaaagaaagactacaagttcggttttggactcacagttggagaatagaggaggcagcttaaacagggattaggtattagcatatgagcacaagattaaaattgaaagcatcttaacaagtgatgctttttctcagcgataaaagaatcgaaacatcagttttgtatttttatcgagcgacattggttctggaacatacatttcatcaactggtgcaactagtcactaatagttgatttttgcaatttcggaaaattcttttagacagtttagaattgtagagttgactttattttgataaagagatctaccattctgattttactggatgctatatgcttaataattctatggttaaatttaatgtagtgtttagag

SEQ ID NO: 5763 - DNA, 1249 bp, Ocimum basilicum
acccacccatttaaatagccgctttcttcttcatcaacaacaagaagaggaacacattatcactcttcttctactccaattcattccatcagaaatggcgacgctcattcctccgccgcccgccgcttccaattcggctgccgaaccgcagaaagttgactacctaaatctgccttgccccatcccctacgaagaaattcatcgggaggcactcatgtccttgaagccggaactctttgaaggactgcgctttgatttcacaaaaggactcaatcagaaattttcactcagccacagcgtaacaatgggacctactgaaattcctgcccaatcatccgatgtcattaaaatcccaactgcgaattatgagttcggagccaactttatagacccaaagttgatgctttttgggagagtaacgacagatggcagactaaatgcaagactaaaatgcgatttgactgataatctttcgttgaagggcaatgctcaacttaccaacgagcctcacatgtcacatggcatgttcaattttgattataagggttcagactttaggactcagtttcaagtagggaatggggccttgttcggtgcaagttacatccagagtgtgactcctaatttatctctaggtggtgaggtattttgggctggtcagcatcggaagtctggaattggctatgctgctcgttacaacactgacaaaatggttgcaactggacaagtagctagcactgggatagttgcccttggctatgtccagaaagtatctgaaaaggtttctctagctacagacttcatgttcaactatatgtctagagatgttactgccagcgttggttacgattacatccttcggcagtgtcgcctgagaggtaagatcgactccaatggcgtaacttccgctttcctcgaagagagacttaatatgggccttaattttcttctttctgctgagattgatcaccggaagaaggattacaaattcgggttcgggttgacagtgggagaatagaagaagaatggtatttcattgattaggagtggggcaagccccgctcttgtttttgtatgcattggttagcagggagatctgcctgctagtagatgtttttgcaggttggctacacttctttattataacaactataatggatgagtagtgagtgttcctttatataccaaccaactaattatgtgtccaattaataaaatgttattcaactttgctccataaagggtgaca

SEQ ID NO: 5764 - DNA, 1376 bp, Nicotiana benthamiana
gcactcaaatcaagcttttctccctttcctatatagccgcagtcagcaagaagtcgaagaagaagggaaacaaaacaaattccttccttatatatatatatatatattttttttttgtattcagagttcctacacgtacatcagttgcaatggctactctcgttcctccgtcaactacagttccaccggcggcaggttcaaaatcgccggcagtcgaatcggagaaagttgattacctgaacttgccttgtcccattccttatgaagaaattcatcgggaagctctcatgtctttaaagccggagctttttgaaggattgcgttttgactttaccaaaggacttaatcagagattttcactcagtcatagtgtttttatggggcctacagaacttcctactcagtctgcagacatcgttaaaataccaactgcccactatgagtttggtgctaactttatagatccaaagatgatgcttattgggagagtattgacagatgggagggtgaatgctagggtgaagtgtgatttgtctgagaatctttcgttgaaagccaatggtcaactaacaggtgaaccgcacatgtcgcatggcatggctaatttcgactacaagggtaaagactacaggactcaatttcaacttggcaatggtgcattatttggagccagctacatccagagtgtcagtccacatttgtctctgggcggggaagtattctgggctggtcagcatcggaaatctggcattggttatgctgctcgctacaacacagataaaatggttgcttcagggcaagttgctagcactgggatggtggcactgagttatgttcagaaaatttctgaaaaggtgtctctagcatcagactttatgtacaactacatgtctagagatgttacagcaagctttggctacgattacatccttcggcagtgtcgtctcagagggaagatcgattccaatggatgtgttgctgcttttctggaagagcgcttgaacatgggtcttaatttcgttctttcagccgaggtcgatcataaaaagaaagactacaagtttggctttggactcaccgtcggagaatagaggaggcagctttaacaggggattatgttttataatttgagcgcaagattaaattgaaagcatctttaacaaatgattctttttctcagtgatcagaatcaaaaaccagttttgtatctttattgagggacattgtttttagagcatatcaactggtgcaactagtcactagtagttgattttgcaatttgagacattctttagatagtttagaattgtagaggtgactttattcagctggagagatctaccattctggtcttactatgtgtgacacattgccta

SEQ ID NO: 5765 - DNA, 1091 bp, Ricinus communis
catcacttgattagtggagttgcaattgtaatggcggggattgtacctccacctactactgcgtcttccaagaccatcaatgaagttcacagcaaagtcgattacatggaccttccttgccctattccttatgaagaactccatcgcgaagctctcatgtctttgaagccagagctctttgaggggatgcgctttgattttactaaaggactcaatcagaaattctctctcagccacagtgtttttatgggacctatggaacttccttctcaatcttcggaaaccatcaaaatccccactgctcactatgagtttggtgctaactatatagaccctaagttgatgcttttcgggagggtgttgacggatgggagactaaatgccagagtcaagtgtgatttgaccgacaatcttactttgaaggctaatgctcagctaacaaatgagcctcatatgtcgcatgccatgttcaactttgattacaagggcaatgattataggacccagcttcaactaggaaatggtgccttatttggagccagttacatccagagtgtgaccccacatttatctttgggtggtgaagtattttgggccggtcaacatagaaagtccggtgttggatatgctgctcggtacgagacagataagatggttggaactgggcaagttgctagcactggaatggttgctttgagctatgttcagaaggtttctgagaaggtttcactggcaacagacctcatgtacaactacatgtcaagagatgtgacagcaagtgttggttatgattacatccttagacaagcccgtctaagagggaaaattgattcaaatggctgtgcatcagctttcttggaagagcgcttaaatatgggtctcaattttattctgtctgcagagttagatcataagaagaaagactacaaatttggatttgggttgacagtgggttaagtgttgtattggaagagcaaatggctcagaaattttcaattcttttgacgtataactgggtggtagctgctcagcaaggtctttccgtcaaggatctctttggtactgtttgggtggtatttgtgttgtggctg

SEQ ID NO: 5766 - DNA, 1452 bp, Ricinus communis
ggcggaagcaaaagtaggtcacataaaaccctttctaaaacctccgaataagcaataaaaatacggatacagccacccatatcatcaatatctgtgtccctccctccgtccctccctccctcccgtattatagcatcacttgattagtggagttgcaattgtaatggcggggattgtacctccacctactactgcgtcttccaagaccatcaatgaagttcacagcaaagtcgattacatggaccttccttgccctattccttatgaagaactccatcgcgaagctctcatgtctttgaagccagagctctttgaggggatgcgctttgattttactaaaggactcaatcagaaattctctctcagccacagtgtttttatgggacctatggaacttccttctcaatcttcggaaaccatcaaaatccccactgctcactatgagtttggtgctaactatatagaccctaagttgatgcttttcgggagggtgttgacggatgggagactaaatgccagagtcaagtgtgatttgaccgacaatcttactttgaaggctaatgctcagctaacaaatgagcctcatatgtcgcatgccatgttcaactttgattacaagggcaatgattataggacccagcttcaactaggaaatggtgccttatttggagccagttacatccagagtgtgaccccacatttatctttgggtggtgaagtattttgggccggtcaacatagaaagtccggtgttggatatgctgctcggtacgagacagataagatggttggaactgggcaagttgctagcactggaatggttgctttgagctatgttcagaaggtttctgagaaggtttcactggcaacagacctcatgtacaactacatgtcaagagatgtgacagcaagtgttggttatgattacatccttagacaagcccgtctaagagggaaaattgattcaaatggctgtgcatcagctttcttggaagagcgcttaaatatgggtctcaattttattctgtctgcagagttagatcataagaagaaagactacaaatttggatttgggttgacagtgggttaagtgttgtattggaagagcaaatggctcagaaattttcaattcttttgacgtataactgggtggtagctgctcagcaaggtctttccgtcaaggatctctttggtactgtttgggtggtatttgtgttgtggctggctgcaaacaagtttagattttcatgatgaaaaatttagtagttttgattctaagagttgtattttttttttttttttattatgtcaaatgaaaagtagggattgatgataataaataaggtttttggttgcaggtacttatggttgattcttgatatgtattaaatcataagctgcttcttaaatgatttaattcaagagaagctaattttggtttcgctattaaaa

SEQ ID NO: 5767 - DNA, 1006 bp, Panax ginseng
tcgttcctccggcgacttcaaagcctacggtgatcgaaccagagaaagtcgattacatggacttgccttgccccattccctatgaagagattcaccgcgaagctcttatgtccttaaagccagaactttttgagggattgcggtttgattttactaaaggactgaaccaaaaattctcactcagtcacagtgtgttcatgggacctactgaagtcccttctcaatctgccgaaacaattaagatacccactgctacctacgagtttggtgccaactttatagacccaaaattgatgcttattgggaggatattgacggatggtaggctaagtgcaagagtgaagtgtgacttgtctgataaccttactctgaaggccaatgctcaacttacaaatgagccacacatgtcacatggcatggtcaattttgattataagggaaaggactttaggagtcaagttcaacttggtaatggtgctttatttggagccagttatatccagagtgtgacaccgcatttttccttgggtggtgaagtattctgggctggtcagcatcggaaatctggtattggttatgctgcacgatataacacagataagatggttgccacagggcaagttgctagcaccggaatggttgctctgagctatgttcagaaattatctgataaggtttctctagcatcggacttcatgtacaactacatgtctagagatgtcactgcaagcgttggttatgattacattcctcgtcagtgtcatcttagagggaagatcgactccaatggctgcacagctgccttcctggaagagcgattgaatatgggtcttaactttattctttctgcagagattgatcacaagaagaaagactacaagtttggttttggtttgacagtaggagaatagaaggctccattgaggtcttcagtttttgttcagcttttgttgctgcaaacagcacggcacggcacagctcggcattgttttcctctagatgaagg

SEQ ID NO: 5768 - DNA, 1382 bp, Solanum lycopersicum
tactctactgagcttttcttcctttatagccgcagtcaggaggaagaagaaggaaaacagaatcaaatttcttccttctttttgtttattaatttatttttgtgcaatggctactctcattcccccgtcagttatagttccaccggcgaattcaaagtcggcggctgtcgaatcggagaaagagaaagttgattacctgaacttgccttgtccaattccttatgaagaaatccatcgtgaagctctcatgtctttaaagcccgagctttttgaaggactgcgctttgattttaccagaggacttaatcagagattttcactgagtcatagtgtttttatggggcctacagaacttcctactcagtctgctgacatcgtcaaaataccaactgcgcactatgagtttggtgccaactttatagatccacagatgatgcttattgggagagtaatgacagatggtagggtgaatgctagggtgaagtgtgatttgtctgagaatctttcattgaaagccaatggtcagctgactggtgaaccacacatgtcacatggcatggttaattttgattacaagggtaaagactacaggacccaatttcaacttggcaatggtgcattacttggagccagctacatccagagtgtcggtccacatttgtctctgggtggggaagtgttctgggctggtcagcatcggaaatctggcattggttatgctgctcgctacaacacagataaaatggttgctgcagggcaagttgctagtactggaatggttgcactgagttatgttcagaaaatttctgataaggtgtctctagcatcagattttatgtacaactacatgtcaagagatgtaacagcaagctttggttatgattacatccttcggcagtgccgtctcagagggaagattgattccaatggttgtgcagctgctttcttggaagagcgcttgaacatgggtcttaatttcattctttcagctgaggtcgatcacaaaaagaaagactacaagttcggttttggactcacagtcggagaatagagggcagcttaaacagggattaggtagcacaagattaaaattgaaagcatcttgacaagtgatgctttttctcagcgataaaagaatcaaaacatcagttttgtatttttatcgagcgacattggttctgaaccatacatttcatctactggtgcaactagtcactgatagttgatattgcaatttcggtaaattctttacagtttagaattgtagagtttactttattttgataaagagatctaccattctcattttactggatgctatgtgcttaataattctatggttaaaatttaatgtaagagcagagattttgaagatgtttgaa

SEQ ID NO: 5769 - DNA, 1336 bp, Citrus clementina
gccccaaaccctctttttccatttactttcgcccgcttctttacttgagtgaaggcaaacgcagcagcagcaatggcgggccttgtacctcccggtacaacagtgaaacctgacgcatcgacggccaagcctaaggaagaagagaaagttgattacatgaacttgccttgcccgattccctatgaggaaatccatcgcgaagctttaatgtctttgaagccggaactttttgagggattgcgctttgattttaccaaaggacttaatcagaaattctcactcagtcatagtgtgatcatgggaccaacagaaattccttcacaatccacagaaaccattaaaatccctactgctcactatgagttcggtgctaactatattgacccaaagttgatgctcattgggagggtattgaccgatggcagactaaatgctagagtgaagtgtgatctgtccgacaatctttctttgaaagctaatgctcagcttacaaatgagcctcatatgtcacatggcatgatcaactttgattataagggtaaggactacaggactcagtttcagttcggaaatggtgccctatttggagccagttacatccagaatgtgtctccacatttgtctttgggtggtgaagtattttgggctggtcagcatcgaaagtcgggtattggttatgctgctcgatatgaaaacgataagatggttgccacagggcaagttgctagtactggaatggttgctctgagctatgtgcagaagttatcagagaaggtttctctagcaacagatctcatgtacaactacatgtcaagagatgtcacatctagtgttggttatgattacatccttagacagtgtcgtctgagagggaagattgattccaatggctgtgctgccgcttacctggaggagcggttaaatatgggccttaattttattctttctgctgagatagatcacaggaagaaggattacaagttcggctttggtttgacagtgggctaaaaaaaactgatgaattaggagttcagtggtgtactattttatttaatttacgtgagcccattgttgttagcgaatagcaacgaagcagatctctgtttcaaccttgcttgccttctgtttgaaaatcataaaattcattttatactgactgcttttggctttgagtaaaacattaatcgcggggtggcattagatgctgcaacaattttagagcctcatttattgctgtactgtttgaagctattattattattttttaccccattttcttttaatcttatttaagagctgtagaatttttaattcaatggaagtagagagatttacc

SEQ ID NO: 5770 - DNA, 1338 bp, Citrus sinensis
gccccaaaccctctttttccatttactttcgcccgcttctttacttgagtgaaggcaaacgcagcagcagcaatggcgggccttgtacctcccggtacaacagtgaaacctgacgcatcgacggccaagcctaaggaagaagagaaagttgattacatgaacttgccttgcccgattccctatgaggaaatccatcgcgaagctttaatgtctttgaagccggaactttttgagggattgcgctttgattttaccaaaggacttaatcagaaattctcactcagtcatagtgtgatcatgggaccaacagaaattccttcacaatccacagaaaccattaaaatccctactgctcactatgagttcggtgctaactatattgacccaaagttgatgctcattgggagggtattgaccgatggcagactaaatgctagagtgaagtgtgatctgtccgacaatctttctttgaaagctaatgctcagcttacaaatgagcctcatatgtcacatggcatgatcaactttgattataagggtaaggactacaggactcagtttcagttcggaaatggtgccctatttggagccagttacatccagaatgtgtctccacatttgtctttgggtggtgaagtattttgggctggtcagcatcgaaagtcgggtattggttatgctgctcgatatgaaaacgataagatggttgccacagggcaagttgctagtactggaatggttgctctgagctatgtgcagaagttatcagagaaggtttctctagcaacagatctcatgtacaactacatgtcaagagatgtcacatctagtgttggttatgattacatccttagacagtgtcgtctgagagggaagattgattccaatggctgtgctgccgcttacctggaggagcggttaaatatgggccttaattttattctttctgctgagatagatcacaggaagaaggattacaagttcggctttggtttgacagtgggctaaaaaaaactgatgaattaggagttcagtggtgtactattttatttaatttacgtaaagcccattgttgttagcgaatagcaacgaagcagatctctgtttcaaccttgcttgccttctgtttgaaaatcataaaattcattttatactgactgcttttggcttttgagtaaaacattaatcgcggggtggcattagatgctgcaacaattttagagcctcatttattgctgtactgtttgaagctattattattattttttaccccattttcttttaatcttatttaagagctgtagaatttttaattcaatggaagtagagagatttacc

SEQ ID NO: 5771 - DNA, 1326 bp, Lippia dulcis
agaagcagtaagcaccactcttcttctacttcactttcaagccctataatcggagaaaggagctcctcttcgccggcatcggatcagattagctagaaatggcagcgcttgttcctccgtcccccgccgcgccagcggctgccgcttccagttcagatgcggagcagcctaaagttgactaccttaatcttccttgccccattccctacgaagaaattcatcgcgaggcactaatgtcgttgaagccagaactctttgaaggattgcgttttgattttacgaaaggactcaatcaaaaattctctctcagccacagtgtgatgatgggacctactgagattcctgctcaatctgccgagacaattaaaatccccactgctaattatgaatttggggccaactttatagacccaaagttgatgctttttgggagggtgatgacagatggcagactaaatgcaagactaaaatgcgatttgactgataatcttactttgaagggcaatgctcaacttaccaacgagcctcatatgtcgcatggcatgttcaattttgattataagggttcagattataggactcagtttcaagtaggaaatggagccttacttggtgcaagttacattcagagcgtgactcgtaatttatctttaggtggtgaagtattctgggcaggtcaacaccggaagtctggcattggctatgcggcacgttataacactgacaagatggtcgcaagtgggcaagttgccagcactgggatggtagcacttagctatgtccagaaagtatctgacaaggtttctctggcaactgacttaatgtataactatatgtctggggatgtcacatccagtgttggttacgattacattcttcggcagtgccgcctgcgaggaaagattgactccaacggttcagtgtctgctttcctcgaagagagactcaatatgggtctcaattttcttctttccgcagagatagatcaccgaaagaaggattacaagtttggcttcggcttgacagtgggagagtaggacatgaactatattcgttatcgagtctcaaattaagctgattattacaaggtgagagcaggagttaggcaatccctctcctcttaaaactggaaacagttttgtatgctcaaatgaccttattcgttagcagtgagatctgctgcagcgcatttgctagtagatggtttttgcaggtttgcgatattatttttattcgagacaactttgttctatagctaatgaatgagaaaacaattttcctttacattacaacgtattctgtggttggattaatgaagtagtacta

SEQ ID NO: 5772 - DNA, 1300 bp, Solanum melongena
aaggcaaaaaggaagaacggaggaggacatctacttactcttctgtatttttttcccttcacatttgccttatttatacaaatggccactctcgtccctccggcaactgcagcttctccggtaggtacaaagccaacggtgatcgaaccggagaaagtcgattacttcaacttgccatgtcccattccttacgaagaaatccaccgtgaagctttaatgtctttaaagcctgagcttttcgaaggcatgcgctttgactttaccaaaggtcttaatcagagattttcactcagtcacagcgttttcatggggcccacggaacttcctactcagtctacagatgtagtcaaaattccaactgctcactatgagtttggtgccaactttatagatccaaagatgatgcttttggggagagtaatgacagacggtagggtgaatgcaagagtgaggtgtgatttgtctgagaatcttgcaatgaaggctaatgcacagctaatgggtgaaccacacatgtcgcatggcatggttaattttgattacaagggtaaagactacagagcacaatttcaattcgggaatggtgcattatttggagccaactatatccagagtgtcactccacatttgtctctaggtggtgaagtgttctgggctggtcagcatcggaagtctggcattggctatgctgctcgttacaacactgataagatggttgctacagggcaagttgctagcactggaatggttgcgctgggttatgttcagaaagtttctgaaaaggtgtctcttgcatcagactttatgtacaactatatgtccagggatgttacagcaagcgttggttatgattacatcctgcggcagtgtcgtcttagaggaaagattgattccaacggctgtgttgctgctttcctggaagaacgcctgaacatgggtcttaatttcattctttctgccgaggttgatcacaaaaagaaagattacaagttcgggtttgggctgacagtgggagaatagaggaggcatgcatacatttagacaaggataaacttttaatggatcatatccgtggaatgaaaagcctctaggtgattcttttcttcaataagaatcaacggatcagttcattgtaggtgattcttttcatcaatgggaatcaacacaccagttttgcattttttttttaattgagcaacatgctatgtggtaaactagccatcagtagttgagtttgcaatgtggtaagggcattgttcatgaccaaattcaaatggaaggcagaattgttttctttcct

SEQ ID NO: 5773 - DNA, 1605 bp, Cucumis melo
aaaaccggaacttagggttttagcgcattccctctggggtttagagagagataaccctaaactctccctctctctctctctctctcgttctccgatcgctacactaactcaaatcaatctcattcccgtttcctttccgatcgtcccctcgccattactacacttgattctctgctatttacttttgttgattctacacaatggcgggccttgctcctccgaccgccgccactgctacggctgcgccttatcccctacccgtcccaccgaaaaagacagaggatgagaaggttgattacttgaacctcccttgtccgatcccctacgaggagattcaccgtgaagctttcatgtccttaaagccggaactatttgaagggatgcgatttgattttactaaaggactcaatcaaaagttttccctcagccacagtgtgtttatgggaccaactgagattcctaaccaatctgccgaaaccatcaaaatacctactgctacttacgagtttggtgccaattttatagatccgaagttgatgctttttgggaggatactcaccgatggtaggctgaatgcaagagtgaagtgtgatttatctgacaatctcactttaaaggccaatgcacagctgacaaatgagccacatatgtcacatggaatggtcaacttcgattataagggcagagacttcagaactcaatttcaattgggcaatggtgccttatttggagccagttacattcagagtgtatcccctcacctgtcgttgggtggtgaagtattttgggctggtcagcatagaaagtctggtattggttatgctgcaagatacaacactgataagatggttgccactggacaagttgccagcacaggtatggtagccctgagctacgttcaaaaggtgtctgagaaggtttcgttggcaactgatttcacgtataattacatgtcaagagatgtaatatccagccttggctacgactacattcttcgacagtctcgtcttagagggaagattgattccaatggttgtgtagctgctttccttgaagagcggctaaatatgggcgttaatttcatcctttccgcagagattgatcacaggaagaaagattacaaatttggatttggtttgacagtaggagagtaagattgtggaaggactgggcccggctggtggctaatcttgtcctcattgctttagtagaaacgtagtggagttctttccttcgcatgatttttgtttctgttgaattctcagtttctttagttaatcattcagcacattattttgagcagaatctaactgctgttgcagtttttagaggccatatctctgtccccattccaaaattttatttatcaattaataattctatttttcacctgagggctggacaacgagatgacaaatatagtgctgagatttcgaagttttaagcatttgttggtatgtttattaatcgagttttggttgatatatttagaatgctatacatcagtgaatggaatttgtttcttatgatatatttatttatttagacagctatatttaactcatttcctttgctttggaacattctttccaagcagtgtcaaaa

SEQ ID NO: 5774 - DNA, 1337 bp, Orobanche aegyptiaca
tcatttataatagccgctttctttctcattctacaagaagaaagaatccaatcaactcttcttttccatctgaaggataaactgtgtgtttgattcaggatccaaagcaaacaccagcaatgacgaccctcattcctccttcgccagccccggcagtcactccaccggcggcggggtcaaatccgaccgtctcggagcagccaaaagcaaattacttaaatctcccttgcccgtttccgtatgaagaaatccaccgggaagctctcatgtcctgaagccagaactcttcgagggaatgcgctttgactttacgaaaggacttaatcagaaattttctctaagccatagtgtgatgatgggacccacagagattcctgctcagtcttcagaaactattaaaattcccactgctcactatgagtttggtgctaactttatagacccaaagttgatgctttttggtagggtgatgacagatgggagattaaatgcgaggctgaagtgtgatttgactgagaatctgtctctcaagggcaatgctcaacttacaaatgagcaacatatgtcgcatggcatgttcaattttgattataagggatcagactataggactcagtttcaagtgggaaatggagccttacttggtgcaagttacattcagagtgtgactcctaatttgtcattgggtggtgaagtattctgggctggtcaacatcggaaatctggcattggctatgctgctcgctacaacactgacaagctggtcgcaacgggacaagttgctagcactggtatggttgctctaaactatgttcagaaagtatctgaaaaagtttctctagcatcagactttatgtacaactatatgtctagggatgtcacagccagctttggatatgattatgtgctgcgccagtgtcgtttaagaggcaagatcgattccaatggtgtcgtggctgctttcctggaagagcgatttaatatgggtctcaactttattctttctgctgagattgatcacaagaagaaagattacaagtttggatttggactgactgtgggagaatagattaagcatgggggtttctctggtacatttaatctcctgttggataaaaatcaaagaatcagttctgcatctgtcgagtgacattattcattgacagcaagaagctcccatgaatggtttgtagttgattttgtagtttggagattttgttgattctccaaaatgctgtagctgcattatattcaatcgggagttgttgattcgattatttgtggttttatcaataattatagatactcagaaaattccgtggtgagaaattaaatgc

SEQ ID NO: 5775 - DNA, 1441 bp, Quercus alba
gacttaaacttttccgagttagagcccaagaaggacaacaacaacaaccttaataacaacgaacaagcccctagggttttagttttagatcctctctctcaactctgtctggggtttagtcttttacactttacccacagacctctctctctctgtgagatcaaaataactcattgagttacaacaatggcaactgccactgccactgcgcctccaactagcagtaccactgcgctgccacagatgaagaaagagaacgaaaaagtcgattacttcaacctcccttgtcctattccctatgaggagatccaccgtgaagctttcatgtctttaaagccagaactatttgaagggatgcgctttgattttaccaaaggactcaatcagaggttctcactcagccacagtgtgttcatgggaccaatggagattccttcacaatcttctgaaacaattaaaatccctactgctcactatgaatttggtgccaactttatagacccaaagctgatgctttttgggagaataatgactgatgggaggctcaatgcaagagtgaagtgtgatttaaccgacaatctttctttcaagggtaatgctcagcttacaaatgagccgcatatgtcacatggaatggcctattttgattacaagggcaaagactacaggtcccagtttcagctgggaaatggtgccttacttggagcaaattatatacagagtgtgacccccaatttgtcttttggtggtgaagtgttttgggctggtcagcatcggaagtctggtattggttatgctgctcgatacaacacggataagatggttgccactgggcaagttgcaagtacaggattggttgctctgagctatgttcagaagatatctgagaaggtttctctagcttcagacttaatgtacaactacatgtcaaaagaagccacagccagtttcggttatgattacatccttagacagtgccgccttagagggaagattgattccaatggctgtgcgtctgcttttctggaagagcgattgaatatgggtctaaattttattctttctgcggagctagatcacaggaagaaagactacaaatttggttttgggctgacagtcggagagtagataagcatgacttgatgctgttttatcctcattcttggtagcaactttgcgagctattcttgctttatttttcctattgtcgcagagcaaagaaacagttttgtatttctacttttggcaacgttatgtgtgagtagcatcgtgtgctgccacagtttagccgtcttatttatttattcggagttaacactcttattaccatttagggctgtagaatgagatcaaataatgcgaattaagatatttatcacttcaataacgttgttttgattctcttctatttcttaagtggaaatgtggaatgtggaaagag

SEQ ID NO: 5776 - DNA, 1397 bp, Gossypium hirsutum
agggagaacaattaaacaaaaccctaccgtctaaaaaaagcctaaaacccactaaaaagccctgccctgcctctgcctgcaactcgctgctgcgactcgccccttcatttcattcctctctttcacactaaccgtcgcggctgttcgaatttttgcgtccaaaaggttttgtttccttgaccaaaatgcggggcttgtacctccagttaccaccacgattccagccgatgcatccaagacgaagaaagccgacgagaaaaccgattacatgaatcttccttgccccattcctttcgaagagattcaccgcgaagctctcatgtctctgaagccagaaacttttgaaggattgcgatttgattttaccaaaggactaaatcagaaattctcactcagtcacagtgtatctatgggcccaactgaaattccttctcaatctgctgaaaccattaaaatccctacctctcactatgaatttggtgccaattatattgatccaaatttgatgcttattgggagggtcttgactgatggtagactcaatgcaagagtgaaatgggatttgactgacaattttactgtgaaggctaatgctcagctcacaaatgagcctcatatgtcacatggcatgttcaactttgattacaagggtaaagactacaggtctcagtttcagattggaaatggcgcattatttggagctagttatttccagagtgtcacaccacatttatccatgggtggtgaagtattttgggctggtcagcaccgaaagtcaggcataggttatgctggccgttatgaaacagataaaatggttgccacaggccaagttgcaagcactggaatggttgctttgagttatgttcagaaggtatctgagaaggtttctctggcatcagatttcatgtataactacatgtcaaaagatgtaacagcaagtgtcggctacgattacatccttagacagtgtcgcttgaggggaaagattgattcaaatgggtgcacgactgcttttctggaagagcggttaaatatgggtctaaattttattctctctgctgagatagatcataaaaagaaagactacaaatttggatttggattgaccgtaggatgagattcgattttatttttcctcgtaaaaaaagcaatcgaagatgtttctcggtaagaaatgagtttaaaacaatgttgaatttggaggtgagcaattttatcggttgatatacttcatgtttttcagtttagagttgtagcattttgttacataaaatgcaatatgagatttgcttacaattactccctctctttatacacataataatgaattgggatttgggttcaaccaaaccaaccggttcatggatccttcttgacctatgttattatcagga

SEQ ID NO: 5777 - DNA, 1196 bp, Theobroma cacao
actactctccttttgcccttccctcttcacactcgcgctcgcggctgcttggtttcgcatcaaattcatcaaaagaatagcagagagaaatggcggggcttgtacctccaggtattacgacgattccagccgacgcatccaaaacggcgcataccaaacatgaggagaaaactgattacatgaatctcccatgccctattccttacgaagagatccaccgcgaagctctcatgtctctgaagccagaaacttttgaaggattgcgatttgatttcaccaagggactaaatcagaaattctcactaagccacagtgtgtttatgggcccaacagaaattccttctcaatctgctgaaaccattaaaattcctactgctcattatgaatttggtgccaacttcattgacccaaatttgatgcttattgggagggtactgactgatggtaggctcaatgcaagagtgaaatgggatttgactgacaatcttgccttgaaggctaatgcccagcttacaaatgagcctcatatgtcacacggcatggtcaactttgattacaagggtaaagactacaggtctcagtttcaaatgggaaatggtgccttatttggagctagttatatccagagtgtgacaccacatttatccttgggtggtgaagtattttgggctggtcagcaccgaaagtcaggcattggttatgctgcccgatatgagacagataagatggttgccacaggccaagttgcaagtactggaatggttgctttgagctatgttcagaaggtatctgagaaggtttctctcgcatcagatctcatgtataactacatgtcaagagaggtaacatcaagtgtcggctatgactacatccttagacagtgtcgcttgagggggaagattgattcaaatggatgcacagctgcttatctggaagagcggttaaatatgggcctaaattttgttctctctgctgagatagatcataggaagaaagactacaaatttggatttggattgactgtagggtgattcaattaccaaataaaagcagttgaaaaagtttccaattgtcaccttttagcatctggttgaagattaaagaattgaatgtgtacttgaacagctgatgtagcaattttaacagtcgttggtatcaatttgttcggtttaacgtttcccgttttcagttgagag

SEQ ID NO: 5778 - DNA, 1390 bp, Centaurea maculosa
cgggacccaatgcttcatacttataatcctcaattcgagctctacatttccacttccatccataataaccatgaaaaaagattcaccaaaatcatggaaaccctactgttgttcagcagataaagataaggttttctgcaacttcagccggtgccggccctcgaggtcggagttctccaagaatgtggcaccgtcgccatctttcaggcggatgtctttctcggaccttagcaggtcgtcttctatgcgtattaatgaagatatagcgcatgcttttgggcccgacttgtttgactttaaattgagcgagttgcgagccataactcagaatttctcaagcaatttcttgctgggcgaaggagggtttgggaaggtgcataagggttatgttgatgagaacatgaggcctgggttgaaagctcaaccgattgccgttaagcttcttgatattgaaggattgcaaggccatcgcgagtggcttgcggaggtcatatttctcggtcaacttaggcatccaaatttggtaaaattgatcgggtattgttgtgaagaagaggagagacttctcgtatacgagttcttggctcgtggtagcttggaaaatcatttgttcaaaaggatctcggtttgtctgccatggggaattagaataaaaattgcaataggcgcggccaaaggtctcgcgttcttgcacggtgccgataaccctgttatatatcgtgacttcaaaacgtccaacatcttacttgattccgattttaatgccaaattatctgattttgggttggcaacaatggggccagaaggatcaaatactcatgtgacaactagagtcatgggcacctatggatatgctgcacctgaatatgtaaacaccgggcacttgaccacgaagagtgacatttatagcttcggagtggtgttgctagaactattgacgggaagaagagcaatggataaaaacaggccgaaaagcgaacaaaatcttgtggagtgggcaaagccgtacttgactagcagccgaagagtgcgtggagtaatcgatcctcggttggcaggacaatactcagttagaggagccaaagaaatggctcttctagcgttatattgcgtgagcccgaaccccaaagataggccaaaaatgcctgcaataatcgaaacccttgaagggctcaagaatttcaaagatatggcaatcacttgtggccagtggcccccggcctcacgaaagaccccgagggatgcagtttatatgccaaaagatagtacagaaaccaatggcggtcggatctactggaaacagactcctgttaaaactgtacgcacaaaggggtagtgaacggagatgaagattgtgcggaggagaagaaaagtatgctcctaatttcgt

SEQ ID NO: 5779 - DNA, 1637 bp, Cichorium intybus
tccgattttagtagagtggttgaagagttgttgcatgtcctctttgtccatttagccttcttcaagatttatatcaagataatcccagatgattaatacttatactcctccactacccacccactcttacacttaaccatttccatcaataatcatgaaagactcaccaaaaccttggaaaccctactgttgttcagccgagaataaggtttttcacagctttagccgttgcagaccctccaaatcggagttttccaaaaatgtagcaccgtcaccatctttccggcgcatgtcgttctcggaccttagcaggtcgtcttctatgcgtcttaatgaagacatacagagtttcggacctgacttgtttgattttaaactgagcgagctccgagctgtaactcaaaacttctcgagtaatttcttgctgggtgaaggagggttcgggaaggtgcacaagggttatgtcgatgagagcatgagacccggtttgaaagctcaacccgttgcagttaagcttcttgatattgaaggattacaaggtcatcgagaatggcttgcggaggtgatatttctcggtcaacttaggcatccgaacctagtgaaattgatcggatattgttgtgaagaagaagagagacttcttgtttacgaattcatggctcgtggaagcttggagaatcatttgttcaagaggatttcggtttgtttgccatgggcgattagaataagaattgcaataggtgcggccaaagggcttgcgttcttgcatggtgctgaaagccctgttatatatcgtgacttcaaaacatccaacatcttacttgattccgattttaatgccaagttatctgattttgggcttgcaacaatgggcccagaaggatcaaacacgcatgttaccactagagttatgggcacctatggatatgctgcccctgaatatgtcaatactgggcacttgaccacgaagagcgacatttatagctttggagtggtattgttagaactattgacaggaagaagagcaatggataaaaagagaccaaaaagtgaacaacatcttgtggattttgcgaagccatacttgactagtagccgaagagtgcgtgcaataattgacccgcgttttgggggacaatattcggttaaaggagccaaggaggtggcacttttggcattgtattgtgtgagctcgaacccgaaagataggccaaaaatgcctgtgataattgaaacccttgaaggggtcaagaattttaaagacatggcgattacttgtggacagtgggccccaccttcacagaagaacgcgaggaatgcagtttatatgccgaaagaaaacaaagagatgaatgggggtcggatttattggaaacaaactcctgttaagacggtcagcactaaggggtagtgaatggtcacatgtggtgttactttggtagatattatgtaaatgataaaacgcatgtgtacataaattttgatgaatatgtggtcatatatatataagtgctttgtgtgcaaaaaataatgagctaatctaatgtccttttcttcataacacgctgcaatgtagagatatttaattctaagacggagtaatgttatgaacattaaaacacaacacgcatatatag

SEQ ID NO: 5780 - DNA, 1437 bp, Cichorium intybus
aaccatttctatcaataatcatgaaagactcaccaaaaccttggaaaccctactgttgttcagccgagaataaggtttttcacagctttagccgttgcaggccctccaaatcggagttttccaaaaatgtagcaccgtcaccatctttccggcgtatgtcgttctcggaccttagcaggtcgtcttctatgcgtcttaatgaagacatacagagtttcggacctgacttgtttgattttaaactgagcgagctccgagctgtaactcaaaacttctcgagtaatttcttactgggtgaaggagggttcgggaaggtgcacaagggttatgtcgatgaaagcatgagacccggtttgaaagctcaacccgttgctgttaagcttcttgatattgaaggattgcaaggtcatcgagaatggcttgcggaggtgatatttctcggtcaacttaggcatccgaacctagtgaaattgatcggatattgttgtgaagaagaagagagacttcttgtttacgaattcatggctcgtggaagcttggagaatcatttgttcaagaggatttcggtttgtttgccatgggcgattagaataagaattgcaataggtgcggccaaagggcttgcgttcttgcatggtgctgaaagccctgttatatatcgtgacttcaaaacatccaacatcttacttgattccgattttaatgcaaagttatctgattttgggcttgcaacaatgggcccagaaggatcaaacactcatgttaccactagagttatgggcacctatggatatgctgcccctgaatatgtcaatactgggcacttgacaacgaagagtgacatctatagctttggagtggtgttgttagaactattgacaggaagaagagcaatggataaaaagagaccaaaaagtgaacaacatcttgtggattttgcaaagccatacttgactagtagccgaagagtgcgtgcaataattgacccacggtttgggggacaatattcggttaaaggagccaaggaggtggcacttttggccttgtattgtgtgagctcgaacccgaaagataggccaaaaatgccggtgataattgaaacccttgaaggggtcaagaattttaaagatatggctattacttgtggacagtgggccccaccttcacagaagaacgcgaggaatgcggtttatatgccaaaagaaaacaaagagatgaatgggggtcggatttattggaaacagactcctgttaagacggtcagcacaaaggggtaatggatggagatggaagggtcacatcacatgtggtgttactttggtagatattatgtaaatgataaaacgcatgtgtacataaattttgatgaatatgtgggcatatatataagtgctttgtgtgcaacaaataatgagctaatctaatgtctatttcttc

SEQ ID NO: 5781 - DNA, 2246 bp, Lactuca sativa
attttgcccgaattctagacaaaatggtaaaatggttggtatttataaaatggtaaaatgtttttttaattaaatctatagccgttgaagaagagaaaagaacgagagaaaatgcaataaaatctcatggcgtggttccttacatcgctttgagtgcactagcaatgtggtgttcaccaccgggtgaaagctcccaattcaccccaccaatccaccataccatatggggctactccttcggtcctcaaagttacacttgataatacttgtatctctagcctagacatgtaagaaacaaatctaggtgagagtattagttgaatctctagcctagacatctaaaagaaacaaaacaaacaagtcaaaacctaataaatagggaacaaatcttttaatctgtacttgacgttcacattcatatatgtacccaatctttttgtaactcagggttacatactattggctaaaaattggctaaaaaggggggttttctctaaagttataaaaatatacataaaatggaccagtttgaagacaaacctaaatgacaaatctagtaacataaacaatacccctacaaaagaaaagactgcaacaaagcatccagttttagtagagtggttgcagagttgttgcaatttcaacatttatatcaagataatgataatcccacaagattaacacttacttatacaccaccattactcactagtcactaaccaattttcatccataaaaatcatgaaagcgaaggactcaccaaaaactacatggaaaccctactgctgttcggctgaaaacaaggtttttcacagctttagccgttgcagaccctcaaaatcggaattctcgaaaaatgtagccccatcaccttctttcagacgcatgtctttctcagatctaagcaggtcgtcttctatgcgtcttaatgaagacatacagagcttcggaccagacttgtttgattttaaactgagtgagctccgaggtgtaactcagaatttctcgagtaattttttgctgggtgaaggagggttcgggaaagtgcataagggttatgtcgatgaaaccatgagatccgggttaaaacctcaacccgttgctgttaagcttcttgatattgaaggattacaaggtcatcgagaatggcttgcggaggtgatatttctgggtcaactaaggcatcctaatctggtgaaattgattggatattgttgtgaagaagaagagaggcttcttgtttacgaatttatgcctcgtggaagtttggagaatcatttgttcaagaggatttcggtttgtttggcatgggggattaggataagaattgcaataggcgcggctaaaggtcttgcattcttgcatggtgctgaaagccctgttatatatcgtgacttcaaaacatccaacatcttacttgattccgattttaatgcgaaattatctgattttgggctggcaacaatgggtccagaaggatcgaacactcatgttactactagagttatgggcacctatggatatgctgcccctgaatatgtcaacaccgggcacttaaccacaaagagcgacatttacagctttggagtagtgttgttagaactattgacaggaagaagggcaatggataaaaagagaccaaaaagcgaacaaaatcttgttgactttgcaaggccgtatttgactagcagccgaagggtgcgtgcgataattgacccacggttagggggacaatattcggttaaaggagccaaagaggttgcccttttggccttatattgtgtgagtttgaaccctaaagataggcccaaaatgcctgtgatcattgagacccttgaaggagttaagaatttgaaagatatggctattagttctggacagtgggccccaccccctacacagaagacagcaagaaatgcggtttatatgcccaaagaaagcaaagatatgaatggaggaggtcggatttattggaaacaaactcctgtcaagacagtgagcactaagggctagtgaattgggatcaagattcagatatgtccgattgtcagtgactcagttctggtttggtagatattattatgtaaatgataaaacgcatatatgtacataaatttagatgaataagtggtcatgtatatatataagtgccttgtgtgcaacaaaatggtgcaatacatgatataaattaatatgtatgaagcatgccagagttgacaatgagagcatcaattgcatacttaaaa

SEQ ID NO: 5782 - DNA, 2940 bp, Chrysanthemum coronarium
ataaccccaaatggttaatacttatactcctccattgatcaccttctcactaaccatttcaaacaataaccatgaaagagacacggaaatcttggaaaccccgctgttgtacagccgaagacaaggttttttgcaactttagccgatgcagaccctcaaaatcaaagttttccaagaacgtaggaccgacaccatcttttaggcgcatgtctttctcggaccttagcaggtcttcgtctttacgtataagtgaaaacatagctaacactttcgggcccgacttgttagactttaagttaagtgagttgagagccataactcagaatttctccagtaatttcttgctaggtgaaggtgggttcggtaaggtgcacaagggttatgtggatgagaatatgaggcccggtttgaaggctcaacctattgctgttaagcttcttgatattgaaggattgcaaggtcatcgagagtggcttgcggaggtgatatttctcggtcaacttaggcacccaaacttggtaaaactggttggatattgttgtgaagaagaggagagagtcctcgtgtacgaattcatggctcgtggaagcttggaaaatcatctgttcaagagaatctcggtttgcctaccatggggtattaggataaaaattgcaataggtgcagctaaaggccttgcattcttgcatggtgcagaaactcctgttatatatcgtgacttcaaaacatccaacatcttacttgattctgatttcaatgcaaagttatctgattttgggctggcaactatgggtccagaaggatcaaacactcatgtcacgactagagtcatgggaacatatggatatgctgccccagaatatgtcaatactggacacttgaccacaaagagcgacatttatagcttcggagtggtgttgctagaactattaactggaagaagagcaatggatggggggggggggggggggggggggggggcgaaagaacgagcaaaatcttgtggactgggccaagccatacctgactagtagccgaagagtccgcacagtaattgaccctaggttggcaggtcaatactcggttaagggagccaaggagatggcccttttagcactttactgcgtgagctcgaaccccaaagataggccaaagatgcctgcgataattgaaactcttgaaagccttaaacatctaaaagacatggcaataactagtggacagtggccccctgcttcaaaaaagacgaccgataggaatgcagtttacatgcccaaagaaggaaataagatcaatggaggtgtgatctactggaagcagactcctcttcaagagaaagctggcaagaagagcacaaatcttagatcgactctgcactccagaataatagaaccatcaggccatcacttggtcaatatataaagtaacatcccttttgccagatgatctcatccagttacaaaagatctttccgagtgacactctataacaggaagaggaaagacggacccagggtttacattagacgcttttctgtaagctgctgttctcgacaatccatcaattgcatatttaaaactcagactatttggagtgaagccaagtttctgcatcctgttctgatattccatcgacttacgaatatcaccctcctcacaaaccgctttaaaaacctcattatagctttcattatcacataactggtattcctctgcaaagaaccttaataatgactccgcttgatcaagattcttctctttacaatggccagaaatcaaagatctgcaaattgtcgtatcaggttgaatgccaaattcagccatatccctcatgaaaacttcaccctcaattgttctatttagtctacataaacacccaatgattgctttataggaggtcaaactcggattttcattcttgaaaaacatttcatcttttagctgtatagcctcgtttacataatctaatctacaaaatgtaacaatcaattcattgtagatttcgaacttgcgtgtttctttcccatcttgcgttaggcgttcccacagactcttggctgcaaacggtttatccactcgacacaaatcaacaactaaatcaacttgaagatcactcgaaaccgatactccaaatctttgaagctctacaacaagattcacagctgaaattattacgtttttctttctatatccttctataagtactaaacaggtaaaatcgttaggaaaaactttttccttgatcatgtcatgaagcaaaccacgtgcttcttgcatcatttccttcttaacgtaaccacatataagagtattgtagcagaacacatctggtttaagcccaatttgaaccatccgatgaaatagcttatgagcttcccttacattaccttctttacaaagcccgtttatcaaagacgtatgagtaatcaaatccggtatcacacgccgaatatacattatattataaagataaagcgcatcttttaaccgacctttcctcacataactatctatcaaagtgttatatgtcacaatatcaggatcaaatccttcctcttccattttctctaaaaactcgttcaccttatcaacatcctcacttttacatataacatgagtcaatatattaaacgtaaacgtattcccacgaaccccaacttttcccatctcctcataaacccgccaacactcatctatcctatccagcttcaaaagcccatccaaaagaaaattaaccgaaacaactttcggcacaaaaccagctttaaccatcttcctaaacgtaacaaacccatcacgaaccaaacccgctttcaaatacgccttaagaagcatatcaaacacaacaggatcccagctacaatctttactacacataaccaaattctcaaaaatactaactttctcagttctactcctattaacctcaatcaactccgcg

SEQ ID NO: 5783 - DNA, 1519 bp, Lactuca sativa
accatttgccacaaaacaattcccatgactaatacttatactccttcaattctctcttcttttagcatctttaatcattttcattgctaatcatgaaagactcctcaaaatcctggcaaccctttatagcaaactgttgttctgttaaggatcaaacagtgttcaacaattttagcagatgtaggacttcaaggtccgatttctcaaagaatgtgactccatcaccatcttttaggcacctatctttctcagaccttagccagtcttcttctatgcgtataaatgaggacatagcgcagacttttggtcctgatttgtttgacttcaaactcagtgagttacgagccataactcaaaatttctctagcaacttcttgcttggggaaggtgggtttggtacagttcataagggttatgtggatgacaacatgagatgtggaatgaaggcacaagccgttgcagttaagcttcttgatattgaagggttgcaaggacatagggaatggctagcggaagtgatatttctcgggcaacttaggcatcctaacttagttaaactaatcggatattgttgtgaagaagaagaaagactcctagtgtatgagttcatgccacgtggaagcttggaaaatcatttgttcaagagaatctcagtttgcctaccatggggaaacagattaaagattgcaataggtgctgctaaagggctcgcattcttgcatggtgctgataagcctgttatatatcgcgacttcaaaacttccaatatcttattagattcggattttaatgcaaagttatccgattttgggttggcaacaatgggtcctgaaggatcaaacactcatgtaaccactagagtcatgggtacttatggttatgctgctcctgaatatgtcaacactggccatttgaccacaaagagcgacatttacagcttcggagtggtgttgatagaactactaactggaaaaagggcaatggacaaaacgaggcctaagagtgaacaatatcttgtggattgggcaaaaccgtatatgactagcagtcgaagattgcgttgcataattgacccaagattgacaggtcaatactcagtgaggggagtgaaggagatggcagttttagcactaaattgtgtgaacttgaaccctaaagataggccaaaaatgactgaaataatcgaaactctagaacgccttgaaaatctgaaggacatggcagtgacttgtgggcaatggcctgtagcttcaagaaaaaccgctagagatgcagttttttctcctaaaggaagaaaagaaattaatggaggtcatatatattggaaacagactcctgttaaaaacataaaagtgaaaggataatgaataaaatatagtgaatttattataaaattgtgaagaaaagtcaacaagtgctcctatttgtgtactaatgcttatattataagtcagatatacatataaattttgagagatatgtgccctacatgtatgtcatgcttgtattagatgcttcc

SEQ ID NO: 5784 - DNA, 1142 bp, Centaurea maculosa
aaaaagattcaccaaaatcatggagaccctactgttgttcagcagataaagataaggttttctgcaacttcagccggtgccggccctcgaggtcggagttctccaagaatgtggcaccgtcgccatctttcaggcggatgtctttctcggaccttagccggtcgtcttctatgcgtattaatgaagatatagcgcatgcttttgggcccgacttgtttgactttaaattgagcgagttgcgagccataactcagaatttctccagcaatttcttgctgggtgaaggagggtttgggaaggtgcacaagggttatgttgatgagaatatgaggcctgggttgaaggctcaaccgattgccgttaagcttcttgatattgaaggattgcaaggccatcgcgagtggcttgcagaggtcatatttctcggtcaacttaggcatccaaatttggtgaaattgatcggttactgttgtgaagaagaggagagacttctcgtatacgagttcttggctcgtggtagcttggaaaatcatttgttcaaaaggatctcggtttgtctgccatggggaattagaataaaaattgcaataggtgcggccaaaggtctcgcattcttgcacggtgccgataaccctgttatatatcgagacttcaaaacgtccaacatcttacttgattccgattttaatgccaaattatctgattttgggttggcaacaatggggccagaaggatcaaatactcatgtgacaactagagtcatgggcacctatggatatgctgcacctgaatacgtaaacaccgggcacttgaccacgaagagtgacatttatagcttcggagtggtgttgctagaactattgacgggaagaagagcaatggataaaaacaggccgaaaagcgaacaaaatcttgtggagtgggcaaagccgtacttgactagcagccgaagagtgcgtggagtaatcgatcctcggttggcaggacaatactcggttagaggagccaaagagatggctcttctagcgttatattgcgtgagcccgaaccccaaagataggccaaaaatgcctgcaataatcgaaacccttgaaggggctcagatttttaagatatggccatcacttgtggccagtggcccc

SEQ ID NO: 5785 - DNA, 1355 bp, Chrysanthemum coronarium
ataaccccaaatggttaatacttatactcctccattgatcaccttctcactaaccatttcaaacaataaccatgaaagagacacggaaatcttggaaaccccgctgttgtacagccgaagacaaggtcttttgcaactttagccgatgcagaccctcaaaatcaaagttttccaagaacgtaggaccgacaccatcttttaggcgcatgtctttctcggaccttagcaggtcttcgtctttacgtataagtgaaaacatagctaacactttcgggcccgacttgttagactttaagttaagtgagttgagagccataactcagaatttctccagtaatttcttgctaggtgaaggtgggttcggtaaggtgcacaagggttatgtggatgagaatatgaggcccggtttgaaggctcaacctattgctgttaagcttcttgatattgaaggattgcaaggtcatcgagagtggcttgcggaggtgatatttctcggtcaacttaggcacccaaacttggtaaaactggttggatattgttgtgaagaagaggagagagtcctcgtgtacgaattcatggctcgtggaagcttggaaaatcatttgttcaagaggatctcggtctgcctaccttggggaaacagattaaagatcgcaataggtgcagccaaagggcttgcgttcttgcatggtgccgagagccctgtcatttatcgcgatttcaagacttctaacatcttacttgattcagactttaatgctaagttatcagatttcgggctggcaacaatgggacctgaaggttcaaacactcatgtgactactagagttatgggtacttatggttatgcagcccctgaatacgtcaacactggccatttgaccacgaagagcgacatatacagctatggagttgttctactagaactactaaccggaaaaagggcaatggacaaaagtaggcctaagagtgagcaatatcttgtagattgggtcaaaccatacttgactagtactcgaagattacgctacatcattgacccgagattgtcaggacaatactcggtcaggggtaccagagagatggctgttctagcactaggttgtgttagcttgaatcctaaggataggccaaaaatgactgagataatccacatccttgaagcccttcaagatctaaaggacatggcaataagttgcggccaatggccggtaacttcacaaaagaatgcaagaaacgcggttttcaatcccaacggaagaaaagaaaggaatggaggtcgcgcgtattggaaaacaacacccgttagcaccataaaatcgaaaggatgatgagtaaaaatacaaatgggggac

SEQ ID NO: 5786 - DNA, 760 bp, Panax ginseng
ggtatcaacgcagagtacatgggggagacagaaaaaaaatgcaatcgctgcagcagaaagcttcggaatggagtggggtagctactgatgatgcgttcgcaattgataaaactaatttatttcagaaactcggtctccaagcattcatcaatctctccaccaatttctatacaagggtttatgatgaagatgaagaatggttcaggtcaattttcgccaattcaaagaaagaagatgcaattcagaatcagtatgagttctttgtgcaaagaatgggagggcctcctctgtattctcaaagaaaaggccatcctgcgctgattggacgacaccggccatttcctgtcactcatcgagctgcagagaggtggttacatcacatgcaacaagcattagatgacagtacggatattgatgccgactcaaaaactaaaatgatgcatttttttaggcacactgcattttttttggttgctggagatgagttgaagaatccaaaccaaggagtgccccctaagcctggagccagctaaccagaagcaatgtaaacctacaacagaagtttttaatttgggttcttcctgcaagaacatgatgaaatatataacttattaatctctcagatgtaaaatacataatttttcatcaagtttatttgaaattaagcttggagttagattttttatttgctactgctgacaaattccagaattactgatatagcagtcgtgggagcaaaggcacacaggggataggcccc

SEQ ID NO: 5787 - DNA, 819 bp, Helianthus annuus
tgtcattcatttcgatcatcaaattcttcatctttctcaagcatccgatcatggccaacattagggcttttttcatcctcgctcttcttctcctctcttcttctttcttccttcaagttgctaggtctcagtctgatccagacgcagaagcggatgccgaacttgtggcggaaactgtcgaggaaggaagtcatgttggtgacgatgttgaggatatcggtgttgggaattataatccggctcctggtgtggaaaccgtgtcggttttccctaaaaactttgcgaaattggtagtagcagggcaagaaactgagcttttgattggattgaaaaacgaaggagaacaaaacgttaaggtttttgctgttcacgctagtgttcatcttcctttcgatcatcggatgttggttcaaaacctctctacagtggctttcaacgatgcatcggttcctgcttcagttcaagctacatttccctatacatttgctgtcagcaaattcttgcagcctggtacatttgatcttgttgggacaatagtgtacgagatcgaccaactaccatatcagaacgtattctataatggcaccattgaagttaccgaagccggtggtcttgttagcgttgagaccgtgttcttggtgtcacttggacttgctcttcttgtgctcttcggcttgtgggtccgcactcagctacagtctctttccaagaaaactaagaagataaccaaggtggaagttggaacccgaactgttgatgcatcaatggacgagtggctgcagggaactgcttatactccatcacaatcgaacaaactga

SEQ ID NO: 5788 - DNA, 827 bp, Helianthus annuus
cgggggctgatctttgtgtcattcattccgatcatcaaattcttcatctttctcaagcatccgatcatggccaagattagggcttgtttcatcctcgctcttcttcttctctcttcttctttcttccttcaagttgctaggtctcagtctgatccagacgcagaagcggatgccgaacttgtggcggaaactgtcgaggaaggcagtcatgttggtgacgatgttgaggatatcggtgttgggaattataagccggctcctggtgtggaaacagtgtcggttttccctaaaaattttgcgaaattggtagtagcagggcaagaaactgaacttttgattggattgaaaaacgaaggagaacaaaacgttaaggtttttgctgttcatgctagtgttcatcttcctttcgatcatcggatgttggttcaaaacctctctacagtggctttcaatgatgcatcggtccctgcttcagttcaagctacattcccctatacatttgctgtcagcaaattcttgcagcctggaacatttgatcttgttgggacaatagtgtacgagatcgaccaactaccataccagaacgtattctataatggcaccattgaagttaccgaagccggtggtcttgttagcgttgagaccgtgttcttggtgtcacttggacttgctcttcttgtgctcttcggcttgtgggtccgcactcagctacagtctctttccaagaaaactaagaagataaccaaggtggaagttggaacccgaactggtgatgcatcaatggacgagtggctgcagggaactgcttatactcagtcacaatcgaa

SEQ ID NO: 5789 - DNA, 998 bp, Ambrosia trifida
tttgtcattccattaccaaattctccatctttcctaagcattcgatcatggccaagatcagggcttttttcatcctctctcttcttgttcttctctcttcatctttcttccttcaagttgctaggtctcagtctgaaccagactcagaagctgacgctgaacttgtagctgaaactgttgaggaaggaagtcatgttgatgacgatgtccaggatattggtttcgggaattataatccggctccgggtgtggaaacagtgagtgttttccctaaaaactttgcgaaattggtagtagcagggcaagaaactgaacttttggttggattgaaaaatgagggggaacacagtgttaaggttattgcagttcgtgctagcgtccatcttccttatgatcatcggatgttggtccaaaatctctctacagtggctttcaacgatgcatcagttcctgcttcggttcaagctacattcccctatacatttgctgtcagcaaattccttcagcctggaacatttgatcttgttgggacaatagtgtatgagattgaccaagtaccataccagaatgtattttataatggcaccattgaggttactgaagctggtggtcttgttagtgttgagactgtgttcttggtgtcacttggacttgctcttcttgtgctcttcggcttgtggatccgcactcagctacagtctctatccaagaaaactaagaagattaccaaggtggaagttggaactcgaactgttgatgcatcaatggacgaatggttgcagggaactgcgtacactcaatcacagtcgaacaaactgaaaaagaagaagtagaggaatagttttcgacttgagcaagggtagtcgggtgtagagcgagcaacatgttcgttttccgttgagttttaactggcacttacaggcatttgttttcttttagtgttttttatattacctgcacttttagttttggcagattttcaatgactttccgttggt

SEQ ID NO: 5790 - DNA, 1041 bp, Flaveria ramosissima
tcgatagtatcgctattgaatctccgtcattccgataatcgaattcttcttctttttcaagcattcgatcatggcgaagattagggcttttttcatcctcgctcttcttcttctctcttcttcattctttcttcaagttgctaggtctcagtctgattcagactcagaagctgatgctgaacttgtggcggaaactgttgaggaaggtagttatgttggtgatgataaccaggatattggtattgggaattataatccagctcctggtgtggaaacagtgtgtgttttccctaaaaactttgcaaaattggtagtagcagggcaagaaactgaacttctggttggaatgaaaaatgagggggaacaaagcgttaaggttatcgcagttcatgctagtgttcatcttccttttgatcatcggatgttggttcaaaatctctctacaatggctttcaacaatgcatcagttcctgcttcggttcaagctacatttccctatatatttgctgtcagcaaattcttacagcctggaacatttgatcttgttgggacaatagtatatgaaattgaccaactaccataccagaatacattttataacggcaccattgaagttactgaagctgggggtcttgttagtgttgagactgtgttcttggtttcacttggacttgctcttcttgtgctccttggcttgtgggtccgctctcagctacaatttctttccaagaaaacgaagaagataacaaaggtggaagttggaactcgaactgttgatgcatcaatggatgagtggctgcagggaactgcttatactcaatcacagtcgaacaaattgaaaaagaagaagtagaggaatagcttctgatgttcagcaaacgtagtcggttgtagaacgagcaacatcctcagttttctttttgagttttagctagcaattaccggcgtttgcttttaatttagagtgtttcatatacagttttactttttgtacaaagacttcaactaactttcctattagtttgtaatacctgttattct

SEQ ID NO: 5791 - DNA, 917 bp, Ambrosia trifida
ccatccgatcatggccaagatcagtgcttttttcttcctctctcttcttcttctctcttcttctttcttccttcaagttgcgaggtctcagtctgattcagaatcagaagccgatgctgaacttgtggctgaaactgttaaggaaggaagtcatgttgatgatgatgtccaggatatcggttttgggaattataatccggctccgggtgtggaaacagtgagtgttttccctaaaaactttgcgaaattggtagtagcagggcaagaaacggaacttttggttggattgaaaaatgagggggaacacagtgttaaggttattgcagttcgtgctagtgttcatcttccttatgatcatcggatgttggtccaaaatctctctacagtggctttcaacgacgcatcagttcctgcttcagttcaagctacatttccctatacatttgctgtcagcaaattccttcagcctggaacatttgatcttgttgggacaatagtgtatgagattgaccaagtaccataccagaatgtattttataatggcaccatcgaggttactgaagctggcggtcttgtcagtgttgagactgtgttcttggtgtcacttggacttgctcttcttgtgctcttcggcttgtgggtccgcactcagctacagtctctatccaagaaaactaagaaggttaccaaggtggaagttggaactcgaactgttgatgcatcaatggacgaatggttgcaggggactgcttatactcaatcacagtcgaacaaactgaaaaagaagaagtagaaggaatagttttctatgctgagcaagggtagttggttgtagagcgagcaatgtgttcgttttccgttgagttttaactagcaatcacaggcgtttgttttctttctagagttgttttatataa

SEQ ID NO: 5792 - DNA, 976 bp, Flaveria ramosissima
tttctcaagcattcgatcatggcgaagattagggcttttttcatcctcgctcttcttcttctctcttcttcattctttcttcaagttgctaggtctcagtctgattcagactcagaagccgatgctgaacttgtggcggaaactgttgaggaaggtagttatgttggtgatgataaccaggatattggtgttgggaattataatccagctcctggtgtggaaacagtgtgtgttttccctaaaaactttgcaaaattggtagtagcggggcaagaaactgaacttttggtaggaatgaaaaatgagggggaacaaagcgttaaggttatcgcagttcatgctagtgttcatcttccttttgatcatcggatgttggttcaaaatctctctacaatggctttcaacaacgcatcagttcctgcttcggttcaggctacatttccctatatatttgctgtcagcaaattcttacagcctggaacatttgatcttgttgggacaatagtgtatgaaattgaccaactaccataccagaatacattttataacggcaccattgaagtaactgaagctggaggtcttgttagtgttgagactgtgttcttggtttcacttggacttgctcttcttgtgctccttggcttgtgggtccgctctcagctacaatttctttccaagaaaacaaagaagataacaaaggtggaagttggaactcgaactgttgatgcatcaatggatgagtggctgcagggaactgcttatactcaatcacagtcgaacaaattgaaaaagaagaagtagaggaatagcttctgatgttcagcaaacgtagtcggttgtagaacgagcaacatcctcagtttttcttttttgggttttagctagcaattaccggattttaatttagagtgtttcatatacagttttgcttttgacaaatcatcaactactttccattagtttgaatcctgatatt

SEQ ID NO: 5793 - DNA, 991 bp, Flaveria ramosissima
aacccatcacgactcacgagctcgatagtatcgcgctattgaatctccgtcattccgataatcgaattcttcatctttctcaagcattcgatcatggcgaagattagggcttttttcatcctcgctcttcttcttctctcttcttctttcttccttcaagttgccaggtctcagtctgattcagactcagaagctgatgctgaacttgtggcggaaactgttgaggaaggtagttatgttggtgatgataaccaggatattggtgttaggaattttaatccggctcctggtgtggaaacagtgtgtgttttccctaaaaactccgcaaaattggtagtagcagggcaagaaactgaacttttggttggaatgaaaaatgagggggaacaaagcgttaaggttatcgcagttcatgctagtgttcatcttccttttgatcatcggatgttggttcaaaatctctctacaatggctttcaacaatgcatctgttcctgcttcggttcaagctacatttccctatatatttgctgtcagtaaattcttacagcctggaacatttgatcttgttgggacaatagtgtatgaaattgaccaactgccataccagagtacattttataacggcaccattgaagttactgaagctggtggtcttgttagtgttgagactgtgttcctggtttcacttggacttgctcttcttgtgcttcttggcttgtgggtccgctctcagctacaatttctttccaagaaaacgaagagataacaaaggtggaggttggaactcgaactgttgatgcatcaatggatgagtggctgcagggaactgcttatactcaatcacagtcgaacaaattgaaaaagaagtagaggaacagcttctgatattcagcaaacgtagtcggttgtagaacgagcaacatcctcagttttcttttgagttttagctagcaattaccggagttcgcttttaatttagagtgtttcat

SEQ ID NO: 5794 - DNA, 1079 bp, Helianthus annuus
gatttatgttctttgtccccacttcacacttataaaaccccatcacaagctcgatcatatcgctttgaatctgttcattcccattacaaatttcacatatctcccaccatggcgaaaattagggcttttttcttcttcactcttcttcttttatcctcatccttcttcatccaagttgctaggtctcagtctgactcagtagactcagatgctgatgccgaacttgtggctgaaaccgtcaaggaaggcgaatacgttggtgatgatacccacgacttcggtgtcgggaattataatcctgctcctggtgtggaaacagtgtctgttttccctaaaaaccctgtaaaactggtggtagctggtcaagaaactgaacttttggttggactgaaaaatgagggggaacaaagtgtgaatgttgttgctgttcatgctagtgttcatcttccttttgatcatcgaatgttggtccaaaatctctctgttatgtctttcaacaatgcatcagttcctgcttcagttcaagctacatttccttatatatttgctgtcagcaaattcttacagcccggaacattcgatcttgttgggacaattgtgtacgagattgaccaacaaccataccagaatacattttacaacggcaccattgaagttacggaagctggtgggcttgttagtgtcgagacggtgttcttggtttcgcttggacttgctcttcttgttcttcttggcttgtgggttcgcactcagcttcaatctctttccaagaaaactaagaagataacaaaagtggaagttggaactcgcactgtcgatgcatcaatggatgagtggctgcagggaaccgcttatactcaatcacagtccaacaaactgaaaaagaagaagtagaggaatagagtttagctagcaaatagcaaatgcagtttgttgtagaatgagcaacaattcctgttttctgagttttggctaacagttacggatgattgttttatttttggaatgttttatataactgaaattttgctttggcaaattttcagcaaagatccttaagttatgtgcgtttaagtcaa

SEQ ID NO: 5795 - DNA, 907 bp, Helianthus annuus
tctgttcattcccattacaaatttcccatatctcccaccatggcgaaaattagggcttttttcttcttcactcttcttcttcttctatcctcatccttcttcatccaagttgctaggtctcagtctgactcagtagactcagatgctgatgccgaacttgtggctgaaaccgtcaaggaaggcgaatacgttggtgatgatacccacgacttcggtgtcgggaattataatcctgctcctggtgtggaaacagtgtctgttttccctaaaaaccctgtaaaactggtggtagccggtcaagaaactgaacttttggttggactgaaaaatgagggggaacagagtgtgaatgttgttgctgttcatgctagtgttcatcttccttttgatcatcgaatgttggtccaaaatctctctgttatgtcgttcaacaatgcatcagttcctgcttcagttcaagctacatttccttatatatttgctgtcagcaaattcttacagcccggaacattcgatcttgttgggacaatagtgtacgagattgaccaacaaccataccagaatacattttataacggcaccattgaagttacggaagctggtgggcttgttagtgtcgagacggtgttcttggtttcacttggacttgctcttcttgttcttcttggcttgtgggttcgcactcagcttcaatctctttccaagaaaactaagaagataacaaaagtggaagttggaactcgcactgtcgatgcatcaatggatgagtggctgcagggaaccgcttatactcaatcacagtccaacaaactgaaaaagaagaagtagaggaatagattttggctagcaattagcaaatgcagtttgttgtagaatgagcaacaattcctgttttcttgagttttgg

SEQ ID NO: 5796 - DNA, 844 bp, Helianthus annuus
tctgttcattcccattacaaatttcccatatctcccaccatggcgaaaattagggcttttttcttcttcactcttcttctcctctcctcatccttcttcatccaagttgctaggtctcagtctgactcagtagactccgatgctgatgccgaacttgtggctgaaaccgtcaaggaaggcgaatacgttggtgatgatacccacgacttcggtgtcgggaattataatcctgctcctggtgtggaaacagtgtctgttttccctaaaaaccctgtaaaattggtggtagctggtcaagaaactgaacttttggttggactgaaaaatgagggggaacaaagtgtgaatgttgttgctgttcatgctagtgttcatcttccttttgatcatcgaatgttggtccaaaatctctctgttatgtctttcaacaatgcatcagttcctgcttcagttcaagctacatttccttatatatttgctgtcagcaaattcttacagcccggaacattcgatcttgttgggacaatagtgtacgagattgaccaacaaccataccagaatacattttataacggcaccattgaagttacggaagctggtgggcttgttagtgtcgagacggtgttcttggtttcacttggacttgctcttcttgttcttcttggcttgtgggttcgcactcagcttcaatctctttccaagaaaactaagaagataacaaaagtggaagttggaactcgcactgtcgatgcatcaatggatgagtggctgcagggaaccgcttatactcaatcacagtccaaacaactgaaaaagaagaagtagaggattagattttggctag

SEQ ID NO: 5797 - DNA, 1098 bp, Artemisia annua
atcgctgaacccccatcattcctctaaaaaaatccttgttcatcatcatcttgtcaaaaaccatggccaatttaagggcatttttcatcttcacacttctcctcctctcatcatcattcctaatccaagttgctaggtctcagtctgatccagactcagataacgctgaacttgtagccgaaaccgttgaggaaggaggagttgggaatgttggtgatgaagctcaggatttcggtgttgggaattataatccggctcctggggtggaaaccgtttgtgttttccctaagaacattggaaaattggttgtagcaggacaagagaccgaagttctaattgggttgaaaaatgagggggagcagaatgtaaaggtccttgcgattcattctagtgttcatcttccttatgatcatcgcatgttggtccagaacctgtctacagtggctttcaacaaggcatcagttcctgcttcagttcaagctacgtttccctatgtttttgccgtcagcaaattcttgcagcctggaacattcgatctagttgggacgatagtgtatgagattgaccaggtaccataccagaataccttctacaatggcaccattgaagttactgaagctggtggttttgttagtgttgagaccgtgttcctggtttcccttggacttgcttctcttgtcctctttggcttgtgggttcgcactaagcttcaagtcctttcgaagaaaactaagaagataacaaagattgaagttggaactcgcactgttgatgcatcgatggatgagtggctgcagggaactgcttatactcaatcgcagtcaaacaagttgaaaaagaagaagtagagtgatagctctttttgtagctgatgttgagaaaatgttctctgttgtagaatgagcaacaatactcgttttcttggagctttagctagcacttacaaacatatgttttttagagtgttctatttatttaattgcaaatttactttttgtcaaagtttagccgagtgtcgttacgtcccatgggtttgattttgcttttatccgtgttaattgtttttactgatcagactttatattaacatattgtcat

SEQ ID NO: 5798 - DNA, 1075 bp, Chrysanthemum coronarium
aacacaacaaactaaactcgatcgtatcgctgaattcctctaaaaaatcattgttcatcatctttctttcttcttcaaaatcatggccaatttaaagacatttttcatcttcactcttcttctcctttcatcatcattcctaatccaagttgctaggtctcagtctgatccagattcagataacgctgaacttgttgccgaaaccgttgaggaaggagcagttgggaatgttggtgatgaagctcaggatttcggtgttgggaattataatccggcccctggggtggaaaccgtttgtgttttccctaagaacattggaaaattggttgtagcaggacaagagaccgaagttctaattgggttgaaaaacgagggggagcagaatgtaaaggtccttgcgattcattctagcgttcatcttccttatgatcatcgcatgttggtccagaacctgtctacggtggctttcaacaaggcatcagttcctgcttcagttcaagctacatttccctatgtttttgccgtcagcaaattcttgcagcctggaacattcgatctagttgggacaatagtgtatgagattgaccaggtaccataccagaataccttctacaatggcaccattgaagttactgaagctggtggttttgttagtgttgagaccgtgttcctggtttcccttggacttgcttctcttgttctctttggcttgtgggttcgcactaagcttcaagccctttcgaagaaaactaagaagataacgaagattgaagttggaactcgcgctgttgatgcgtcgatggatgagtggctgcagggaactgcttatactcaatcgcagtcgaacaagttgaaaaagaagaagtagagtaatagctctttttgtagctgatgttgagaaaatgttctctgttgtagaatgagcaacaatactcgttttcttggagctttagctagcacttacagacatttgtttttttagagtgttctatttatttaattgcaaatttactttttgtcaaagttttgccgagtgtctttgcggtgccatgggtttgattttgcttcatctgtg

SEQ ID NO: 5799 - DNA, 893 bp, Centaurea maculosa
gttgaattctgtaatcttccctaatttgtatcgatcatggcgaaaattagggttttcttcctccttgctctccttcttctctcctcttccttcttccttcaagttgctaggtcccagtctgattcagacgcggatgctgatgctgagcttgtcgctgaaaccgttgaggaaggaggagatcttgggattgtaggtgatgacacccaggactttggtggtggaaattacagtccagcccctggtgtcaaaacagtgtgtgttttcccaaagaaccctgtgaaatttgtggtagcagggcaagagactgaacttttgattggactgaaaaatgagggggagcagagtgtgaaggtccttgcaattcatgctagcgttcatcttccttttgatcatcagatgttggtccaaaatctctctacacaggctttcaacaatgcatcagttcctgcttcagttcaagctacttatccctatatgtttgctgtcagcaagtttttacagcctggaacatttgatcttgttggaacaatagtgtatgagatagacaatctaccataccagaatacgttctacaacggcaccattgaagttactgaagccggtggccttgttagtgtcgagacagtcttcctggtttccctcggacttgctcttcttgtcctccttggcttgtgggttcgtggtcagctacaaaacctttccaagaaaactaagagggtgaaggtggaagttggaactcggacagttgatgcgtccatggatgagtggctgcagggaactgcttacactctatcgcaagccaacaagtcgaaaaagaagaagtagaggagtgttgcaggattaggttttgtaactcttgtactctactgtagaatgagcaggaactttcgttt

SEQ ID NO: 5800 - DNA, 901 bp, Helianthus annuus
ccattacaaatttccacatatctcccaccatggcgaaaattagggcttttttcttcctcactcttcttctcctctcctcatccttcttcatccaagttgctaggtctcagtctgactcagtagactcagatgctgatgccgaacttgtggctgaaactgtcaaggaaggcgaatacgttggtgatgatacccacgacttcggtgtcgggaattataatcctgctcctggtgtggaaacagtgtctgtttttcccaaaaaccctgtaaaattggtggtagctggtcaagaaactgaacttttggttggactgaaaaatgagggggaacaaagtgtgaatgttgttgctgttcatgctagtgttcatcttccttttgatcatcgaatgttggtccaaaatctctctgttatgtctttcaacaatgcatcagttcctgcttcagttcaagctacatttccttatatatttgctgtcagcaaattcttacagcccggaacatttgatcttgttgggacaatagtgtacgagattgaccagcaaccataccagaatacattttataacggcaccattgaagttacggaagctggtgggcttgttagtgtcgagacggtgttcttggtttcacttggacttgctcttcttgttcttcttggcttgtgggttcgcactcagcttcaatctctttccaagaaaactaagaagataacaaaagtggaagttggaactcgcactgtcgatgcatcaatggatgagtggctgcagggaaccgcttatactcaatcacagtccaacaaactgaaaagaagaagtagaggaatagagttggctagcaattagcaaatgcagtttgttgtagaatgagcaacaattcctgttttctgagttttggctaacagtta

SEQ ID NO: 5801 - DNA, 1179 bp, Chrysanthemum coronarium
gttggatttaaataacaagcacacttgcaactatatatataaaacccaaacaacaaccaaactcgatcgtatcgctgaatcttcatcaccattcccctaaaaattcatcatcttttttctttgtttcttgttaataataataatggcgaatttgagggcatttttcatcttcactcttcttctcctctcatcatccttcctaatccaagtggctaggtctcagtctgatccagactcggataacgctgaacttgtggccgaaaccgttcaggagggagaacacgttagtgatgaagctcaggatttcggtgttgggaattacaattcggctcctggggtggagaccgtttgtgttttccctaagaacattggaaaattggttgtagcaggacaagagactgaggttctaattgggttgaaaaacgagggggagcaaaatgtgaaggtcctagctattcattctagcgttcatcttccttatgatcatcgcatgctggtccagaatctgtctacattggctttcaacaaggcatctgttcctgcttcagttcaagctacatttccctatgtttttgctgtcagcaaattcttgcagcctggaacattcgatttagttgggacgatagtttatgagatcgaccaggtaccataccagaataccttctacaatggcaccattgaagttactgaagctggtggtcttgttagtgttgagactgtgttcctggtttccctaggacttgcttgtcttgtcctctttggcttgtgggctcgtaccaagcttcaactcttttccaagaaaaataagaagataacaaagattgaagttggaactcgcactgttgatgcatccatggatgagtggctgcagggaactgcttatactcagtcgcagtcaaccaaattgaaaaagaagaagtagagagtgatagctctttttgtagctgatgttgagaaaatgttctctgttgtagaatgagcaacaatactcgttttcttggagctttagctagcacttacagacattttcttttttagagtgttctatttaattaattgcaaattaactttttgtcaaagttttgccgagtgtctttgcggtgccatgggtttgattttgcttcatctgtgttaatgggtttttactcgtactgcagatgctttattatcaaatatctg

SEQ ID NO: 5802 - DNA, 973 bp, Centaurea maculosa
agctcgatagtatcgcttcttgaatctgtgtgttactcccattgttgaattttgcatctttcctaatttgatcgatcatggccaacattagggttttcttcctcctcgctctccttcttctctcctcttccttcttccttcaagttgctaggtctcagtctgattcggacccggatgctgatgctgagcttgtcgctgaaactgttgaggaaggaggagatcttgggattgtaggtgatgaaacccaggactttggtggtggaaattacagtccagctcctggtgtcaaaacagtgtgtgttttcccaaagaaccctgtgaaatttgtggtagcagggcaagagactgagcttttgattggactgaaaaatgagggggagcagagtgtgaaggtccttgcaattcatgctagcgttcatcttccttttgatcatcagatgttggtccaaaatctctctacacaggctttcaacaatgcatcagttcctgcttcagttcaagctacttatccctatatgttcgctgtcagcaagttcttacagcctggaacatttgatcttgttggaacaatagtgtatgagatagacaatctaccataccagaatacgttctacaacggcaccattgaagttactgaagctggtggccttgttagtgtcgagacagtcttcctggtttcccttggacttgctcttcttgtcctccttggattgtgggttcgtggtcagctacaaaacctttccaagaaaactaagagggtgaaggtggaagttggaactcggacagttgatgcatccatggatgagtggctgcagggaactgcttatactctatcgcaagccaacaagtcgaaaaagaagaagtagaggagtgttgcaggattaggtttttgtaactcttgtactctactgtagaatgagcaggaactttcgttttcacggaggttttgaccaattttagcgtttcttttttt

SEQ ID NO: 5803 - DNA, 1075 bp, Centaurea maculosa
gggggctcttcttgatctctgtactccgaattgttgaattctgcatcttccctaatttgatcgatcatggcgaaaattagggttttcttcctcctcgctctccttcttctctcctcttcttcttccttcaagttgctaggtctcagtctgattcagacgcggatgctgatgctgagcttgtcgctgaaaccgttgaggaaggagcagatcttgggattgtaggtgatgacacccaggactttggtggtggaaattacagtcctgcccctggtgtcaaaacagtgtgtgttttccccaagaaccctgtgaaatttgtggtagctgggcaagagactgaacttttgattggactgaaaaatgagggggagcagagtgtgaaggtccttgcaattcatgctagcgttcatcttccttttgatcatcagatgttggtccaaaatctctctacacaggctttcaacaatgcatcagttcctgcttcagttcaagctacttatccctatatgtttgctgtcagcaagtttttacagcctggaacatttgatctcgttggaacaatagtgtacgagatagacaatctaccataccagaatacgttctacaacggcaccattgaagttactgaagccggtggccttgttagtgtcgagacagtcttcctggtttcccttggacttgctcttcttgtcctccttggattgtgggttcgtggtcagctacaaaacctttccaagaaaactaagagggtgaaggtggaagttggaactcggacagttgatgcgtccatggatgagtggctgcagggaactgcttatactctatcgcaagccaacaagtcgaaaaagaagaagtagaggagtgttgcaggattaggtttttgtaactcttgtactctactgtagaatgagcaggaactttcgttttcacggaggttttgaccacttttagcgttctttttttgctagcagttccgacatttgatttatttttcccagtgctttatataattgcagttttaattttggcaacgcatgtcgttagtttctatgggtatgtttactggtctgattttata

SEQ ID NO: 5804 - DNA, 986 bp, Chrysanthemum coronarium
ccctctagaaaaacaccatcttttttctttgtttcttgttaataataataatggcgaatttgagggcatttttcatcttcactcttcttctcctctcatcatccttcctaatccaagtggctaggtctcagtctgatccagactcggataacgctgaacttgtggccgaaaccgttcaggagggagaacacgttagtgatgaagctcaggattttggtgttgggaattacaattcggctcctggggtggaaaccgtttgtgttttccctaagaacattggaaagttggttgtagcaggacaagagactgaggttctaattgggttgaaaaacgagggggagcagaatgtgaaggtcctagctattcattctagcgttcatcttccttatgatcatcgcatgctggtccagaatctgtctacagtggctttcaacaaggcatccgttcctgcttcagttcaagctacatttccctatgtttttgctgtcagcaaattcttgcagcctggaacattcgatctagttgggacgatagtttatgagattgaccaggtaccataccagaataccttctacaatggcaccattgaagttactgaagctggtggtcttgttagtgttgagactgtgttcctggtttccctaggacttgcttctcttgttctcgctggcttgtggcttcgcactaaggttcaagccttttccaagaaaaataagaagataacaaagattgaagttggaactcgcactgtcgatgcatccatggatgagtggctgcagggaactgcttatactcagtcgcagtcaaccaaattgaaaaagaagaagtagagttatagctctttttgtagctgatgttgagaaaaatgttctccgttgtagaatgagcaacaatactcgttttcttggagctttagctagcactttatagacatttgctttttagagtgttcaatttatttaattgcaaaataactttttgtcaag

SEQ ID NO: 5805 - DNA, 803 bp, Arnica chamissonis
agttgctaggtctcagtctgatttagactcagacgctgatgctgaacttgtggctgaaactgttgaggaaggtagtgatgttggtgatgatatccgggatataggtgttgggaattttaatccagctcctggtgtggaaacagtgtctgttttccctaaaaactttgcaaaagtggtagtagcagggcaagaaactgaacttttgattggaatgaaaaacgagggggaacacagtgttaaggttattgcagttcacgctagcgttcatcttccttttgatcatcggatgttggtccaaaatctctctacagtggctttcaacaatgcatcagttcctgcttcggttcaagccacatttccctatatatttgctgtcagcaaattcttacagcctggaacatttgatcttgttgggacaatagtgtatgagattgaccaactaccataccagaatgtattttataatggcaccattgaagttactgaggctggtggtcttgttagtgttgagactgtgttcttggtttcacttggacttgctcttcttgtgctccttggcttgtggatccgcactcagctacaatttctttccaagaaaacgaagaagataacaaaggtggaagttggaactcgaactgttgatgcatcaatggatgagtggctgcagggaaccgcttatactcagtctcagtcgaataaaatgaaaaagaagaagtagaggaatagtttttgttgtcccgcaacgtagtctatgagcagcattctcgttttctgttgagttttaactagaaattacaggcact

SEQ ID NO: 5806 - DNA, 1079 bp, Cichorium intybus
atttccgtttacatcaaaccttcctaacttctacgcctatataaccaatcacgagctcgatatcatcgttgttgaatctcttgacattccgattgtcgatttctatatctttcccaagcattggatcatggcaaagattagggtttctttcatcctcgctcttcttcttcttctctcatcttctttcttccttcaagttgttaggtcacaatctgattcagactcagattctgatgctgaacttgttgctgagactgtcgcggaaggaggagttagtgatgatgacatccaggactttggtactgggaatttcagtccatctcctgatgttgaaacagtttgtgttttccctaaaaattctgcaaaattggttgtagcaggccaagaaaccgaacttttgattggaatgaaaaacgagggggaacataatgtgaaggtccttgctgtttatgctagtgttcatcttccttttgatcatcgcatgttggtccaaaatcttaccacacagactttcaacaatgcatctgttccttcttcagttcaagctacctttccttatatatttgcagtcagcaaattcttacagcctggaacatttgatcttgttgcgacaatagtatatgagattgaccaattaccataccaaaacacattttataatggcaccattgaagttactgaagctggtggtcttgttagtgttgagacagtgttcttagtttcccttggacttggtcttcttatcctccttggcttatgggttcgtggtcagcttcaaaatctttccaagaaaactaagagggtgaaggtggaagttggaacaaagactgttgatgcatcaatggatgagtggttgcagggaactgcttatacacagtcgcagtcttacaaattgaagaagaagaagtagagagatgttgcgggaatagatttttgtaattcgtgttgaggaaatgttaatgtactcttttgtagaatgagcatggagtctcgttttttttctagcacttatgaacatttgtttatttttagaaagccttctataactgcaattttacttttgccaaatttacacaaag

SEQ ID NO: 5807 - DNA, 1112 bp, Carthamus tinctorius
agatttaagaaaaaattggagagtataataacgacaataacaaaacctaaaaagcatttgggtcctctcgtacccccatcaccattcgattggatcgctgttgaatttctcatccctctcaaaaatgtcgaaaattagggtttccttcatactcgctctcctgcttctatcatcttcttgcttccttcaagttgctaggtgtcagtctgagtcagattcagaatctgatgctgagcttgttgcggaaactgttgaggaaggaggagatcttgggattgttggtgatgatgtagttgactttggtgctgggaattttagtcccgctccaggtgtggaaacagtgtgtatttttccaaagaaccttgcaaaaacggtagtggcagggcaagagactgagcttttaattggattgaaaaatgagggtgatcaaaatgtgaaggttattgcggttcaggctagtgttcatcttccttatgatcaccgtatgttggttcagaatctctcaacacaggcttttaacaatgcatctgttcctgcttcagttcaagctacttttccctatatattcgctgtcagcaagtttttacagcctggaacatttgatcttgttggaacaatagtttatgaaatagatcagctaccgtaccaaaacacattctacaatggtaccattgaagttattgaagctggtggccttgttagcatcgagactgtgttcctagtctcccttggaatttctcttctcgtcttccttggtttgtgggttcgtggtcagatacaaaacctttccaagaaaactaagagggcgccaaaggtggaaactggaactaagaccgttgatgcatccatggatgagtggctggagggaactgcttacactcaatcaaaggcgagcaagttgaagaagaagaagtagagatgtgttggcatgaggtcgtacgcaggatagattcttgtaactgaagcttaggtgagaagctcccttcgaacgagtataccttgtttagtagttactgttgtagaatgaggaagaaacttttacgtaatcttttttcattgagatttttgacaacttgtctctttttaacaaatctaaaggaatttatggtaag

SEQ ID NO: 5808 - DNA, 1153 bp, Centaurea maculosa
tataacaaacctaaaaaccatatttgggtctcttaaccaacccccatccaccattcgattggatcgctgttgaatttctcacccctctcaaaaatgtcgaaattagggtttccttcttactcgctctccttcttctttcctcttcttgcttccttcaagttgctaggtgtcagtctgagtcagattcagactctgatgctgagcttgtcgcggaaactgttgaggaaggagcagatcttgggattgttggtgatgatgtagttgactttggtgccgggaattatagtcccgctccaggtgtggaaaccgtgtgtattttccccaagaaccttgcaaaaacggtagtggcagggcaagagactgagcttttaattggattgaaaaatgagggtgatcaaaatgtgaaggttattgcggttcaggctagtgttcatcttccttatgatcaccgtatgttggttcagaatctctcaacacaggctttcaacaatgcatctgttcctgcttcagttcaagctacttttccctatatattcgctgttagcaagtttttacagcctggaacatttgatcttgttggaacaatagtttatgaaatagatcagctaccgtaccaaaacacattctacaatggtaccattgaagttatcgaagctggtggccttgttagcatcgagactgtgttcctagtctcccttggaatttctcttctcgtcttcctcgggttgtgggttcgtggtcagatacaaaacctttccaagaaaactaagagggcgccaaaggtggaaactggaactaagactgttgatgcatccatggatgagtggctggagggaactgcttacactcaatcaaaggcgaacaagttgaagaagaagaagtagagatgtgttggcatgaggtcgtacgcaggatagattcatgtaacagatgcttaggtgagaaactcccttcgaacgagtataccttgtttagtagttactgttgtagaatgaggaagaaacttttacgtaatcttttttcgttgagatttttgacaacttgagtctctttataacaacaaatctaaaggaatttatgctagtagtgtctcacccatttagactacaaaaaagaaaaaagtaaccgaactgacgtggaccgctcgtctaga

SEQ ID NO: 5809 - DNA, 1039 bp, Cirsium arvense
aaaaccatttgggtctcgtaaccactcgatcgtatcgctgttgaactcttctccctctctcaaatgacgaagattagggtttccttcatcctcgctctccttcttctatcctcttcttgcttccttcaagttgttaggtgtcagtctgaatccgattcagatgctgatgctgagcttgttgctgaaactgttgaggaaggagcagatcttgggattgttggtgatgatgccgttgactttggtggtgggaattatagtcccgctccaggtgtggaaacagtatgtattttcccaaagaatcttgcaaaaaccgtagtggcagggcaagagaccgagcttttaattggaatgaaaaatgagggcgatcaaaatgtgaaggttcttgcagttcatgctagtgttcatcttccttatgatcaccgtatgttggttcagaacctctctgcagtggcttttaacaatgcgtctgttcctgcttcagttcaagctacttttccctatatattcgctgtcagcaagtttttacagcctggaacatttgatcttgttggaactatagtttatgagatagatcagctactgtatcaaaacacattctacaatggtaccattgaagttattgaagctggtggtcttgttagcattgagacggtttttctagtttcacttggaatttctcttctcatcttccttggtttgtgggttcgtggtcagatacagaacctttccaagaaaactaagaagggaccaaaggtggaaaccggaactcggactgttgatgcatctatggatgagtggctggagggaactgcttacactcaatcgaaggccagcaagttgaagaagaagaagtagaatagattcttgtaactgatgtttagaacaagtatactttgtttagttactgttgtagaatgaggaaggaagaaacttttttacgtaatctttttctttggagattttgaaaactcgactctcttttttttataacaaaatctaaggaaatttatgctaaaaaaaaaaaaaagtaccgactgcg

SEQ ID NO: 5810 - DNA, 936 bp, Cichorium intybus
cttcttctctcatcttctttcttccttcaagttgttaggtcacaatctgattcagactcagattctgatgctgaacttgttgctgaaactgttgcggaaggaggagtaagtgatgatgacgtccaggactttggtattgggaatttcagtccatctcctgatgttgaaacagtttgtgttttccctaaaaattctgcaaaattggtagtagcagggcaagaaaccgaacttttgattggaatgaaaaacgagggggaacatagtgtgaaggtccttgcagtttatgctagtgttcaccttccttttgatcatcgcatgttggtccaaaatcttaccacacaggctttcaacaatgcatctgttccttcttcagttcaagctacctttccttatatatttgcagtcagcaaattcttacagcctggaacatttgatcttgttgggacaatagtatatgagattgaccaattaccataccaaaacacattttataatggcaccattgaagttactgaagctggtggtcttgttagtgttgagacagtgttcttagtttcccttggacttggtcttcttatcctccttggcttatgggttcgtggtcagcttcaaaatctttccaagaaaactaagagggtgaaggtggaagttggaacaaagactgttgatgcatcaatggatgagtggttgcagggaactgcttatacacagtcgcagtcttacaaattgaagaagaagaagtagagagatgttgcgggaatagatttttgtaattcgtgttgaggaaatgttaatgtactcttttgtagaatgagcacggtgtctcgttttttttctagcacttatgaacatttgtttatttttagaaagtcttatataactgcaattttacttttgccaaatttacacaaatacaaataacccaaatggtataca

SEQ ID NO: 5811 - DNA, 1085 bp, Flaveria ramosissima
cactcgattgtatcgctgttgaatcttgtacctcctctcaatatggcgaaaattagggtttccttcatcatcgctctccttcttcttctatcctcttctttcttccttcaagttgccaggtgtcagtctgagtcagattcagaagacgcggagctggttgctgaaacggttgaggaaggaggagatcttggatttgttggtgatgatgttcaggactttggtggtgggaattacagtccagctccaggtgtggaaacagtatgtgttttcccaaagaatgctgctaaaacggtagtggcagggaaagagacggagattttaattggattgaaaaatgacggtgaacaaaccataaaggttcttgcagttcatgctagtgttcatcttccttttgatcatcgtatgctggttcagaatctctctgctcaggtcttcaataatgcatctgttcctccttcagttcaagctgctttcccttatatattcgctgtcagcaaatttttacaggctggaacatttgatcttgttggaacaatagtttatgagatagaccaactaccatatcagaatacattctacaacggcaccattgaagttactgaagcaggtggtctagtcagcatggagacggtctttctagtttccctcggaatttctcttcttgtcttcctcggcttgtgggttcgtggtcagatacaaaatctttccaagaaaacgaagaaggcgccaaaggtggaaactggaactcggaccgttgatgcatctatggatgaatggttggagggaactgcttacactcaatcaaaggccaacaagtcaaagaagaagaagtagaggtatgttgtcatgaggcatagatacttgtaactgttgtagaatgaggaagtgagtttattttcttggagattttgatatgtcaagccttgttaaacacacgcctaggctgcttaacgtttagcatacttatttaccatcttatatgatttgagatgtcgattgtgaacaatacggtataatgatggatatgtagcaacatgaaactaatagaacctgtggatttgggttttagcaaaaaaaaaaatatt

SEQ ID NO: 5812 - DNA, 1233 bp, Centaurea maculosa
cggggattcgattggatcgctgttgaatttctcatcattctctccaaaatgtcgaaaattagggtttccttcttactcgctctccttcttctatcatcttcttgcttccttcaagttgctaggtgtcagtctgagtcagattcagactctgatgctgagcttgttgcggaaactgttgaggaaggagcagatcttgggattgttggtgatgatgtagttgactttggtgccgggaattatagtcccgctccaggtgtggagaccgtgtgtatttttccaaagaaccttgcaaaaacggtagtcgcagggcaagagactgagcttttaattggattgaaaaatgagggtgatcaaaatgtgaaggttattgcggttcaggctagtgttcatcttccttatgatcaccgtatgctggttcagaatctctcaacacaggctttcaacaatgcatctgttcctacttcagttcaagctacctttccctatatattcgctgtcagcaagtttttacagcctggaacatttgatcttgttggaacaatagtttatgaaatagatcagctaccgtaccaaaacacattctacaatggtaccattgaagttatcgaagctggtggccttgttagcatcgagactgtgttcctagtctcccttggaatttctcttctcgtcttccttggtttgtgggttcgtggtcagatacaaaacctttccaagaaaactaagagggcgccaaaggtggaaactggaactaagaccgttgatgcatccatggatgagtggctggagggaactgcttacactcaatcaaaggcgagcaagttgaagaagaagaagtagagatgttttggcatgaggtcgtacgcaggatagattcatgtaacagatgcttaggtgagaaactcccttcgaacgagtataccttgtttagtagttactgttgtagaatgaggaagaaacttttacgtaatcttttttcgttgagatttttgacaacttgagtctctttttaacaaatctaaaggaatttatgctagtagtgtctcactctcacccatttagcccatttaacatacttgtttaccatcttgaccctacctttgagtgggatataatggggttgtttaatttggttcgttgtgttatctgattggggatatagtataatgggttgtttgaattggtttgctgtgttatttgagtgggatatactgggttggtttgatttgattc

SEQ ID NO: 5813 - DNA, 1110 bp, Cirsium arvense
taagacaataataaacaaataaagattgttgttgtataacataacctaaaaaccatttgggtctctctcttaaccaccattcgattggatcgctgttgaatttctcatcattctctccaaaaatgtcgaaaattagggtttccttcttactcgctctccttcttctatcatcttcttgcttccttcaagttgctaggtgtcagtctgagtcagattcagactctgatgctgagcttgttgcggaaactgttgaggaaggagcagatcttgggattgttggtgatgatgtagttgactttggtgccgggaattatagtcccgctccaggtgtggaaaccgtgtgtatttttccaaagaaccttgcaaaaacggtagtcgcagggcaagagactgagcttttaattggattgaaaaatgagggtgatcaaaatgtgaaggttattgcggttcaggctagtgttcatcttccttatgatcaccgtatgctggttcagaatctctcaacacaggctttcaacaatgcatctgttcctacttcagttcaagctacctttccctatatattcgctgtcagcaagtttttacagcctggaacatttgatcttgttggaacaatagtttatgaaatagatcagctaccgtaccaaaacacattctacaatggtaccattgaagttattgaagctggtggccttgttagcatcgagactgtgttcctagtctcccttggaatttctcttcttgtcttccttggtttgtgggttcgtggtcagatacaaaacctttccaagaaaactaagagggcgccaaaggtggaaactggaactaagaccgttgatgcatccatggatgagtggctggagggaactgcttacactcaatcaaaggcgagcaagttgaagaagaagaagtagagatgtgttggcatgaggtcgtatgcaggatagattcttgtaacagatgcttaggtgagaaactcccttcgaacgagtataccttgtttagtagttactgttgtagaatgaggaagaaacttttacgtaatcttttttcgttgagatttttgacaacttgagtctctttttaacaaatctaaaggaatttatgcta

SEQ ID NO: 5814 - DNA, 1051 bp, Cichorium intybus
catcaaaccttcctaacttctacgcctatataaccaatcacgagctcgatatcatcgttgttgaatctcttgacattccgattgtcgatttctatatctttcccaagcattggatcatggcaaagattagggtttcttgggggggtcttctctcatcttctttcttccttcaagttgttaggtcacaatctgattcagactcagattctgatgctgaacttgttgctgaaactgtcgcggaaggaggagttagtgatgatgacgtccaggactttggtactgggaatttcagtccatctcctgatgttgaaacagtttgtgttttccctaaaaactctgcaaaattggttgtagcaggccaagaaaccgaacttttgattggaatgaaaaacgagggggaacatagtgtgaaggtccttgcagtttatgctagtgttcatcttccttttgatcatcgcatgttggtccaaaatcttaccggacaggccttcaacaatgcatctgttccttcttcagttcaagctacctttccttatatatttgcagtcagcaaattcttacagcctggaacatttgatcttgttgggacaattgtatatgagattgaccaattaccataccaaaacacattttataatggcaccattgaagttattgaagctggtggtcttgttagtgttgagacagtgttcttagtttcccttggatttggtcttcttatcctccttggcttatgggttcgtggtcagcttcaaaatctttccaagaaaactaagagggtgaaggtggaagttggaacaaagactgttgatgcatcaatggatgagtggctgcagggaactgcatatacacagtcgcagtcttacaaattgaagaagaagaagtagagagatgttgcgggaatagaattttgtaattcgtgttgaggaaatgttaatgtactcttttgtagaatgagcacggagtctcgtttttttctagcacttatgaacatttgtttatttttagaaagccttctataactgcaattttacttttgccaaatttacac

SEQ ID NO: 5815 - DNA, 609 bp, Helianthus annuus
aaaccaaaaatgtctcttgtgaacaaaagcaattagggaaagtgcatcagaaatttatcatggtgatgcaatttgtcaagaaaatcaaaggaattactaaccgaatgggactaccaatggtctttgcctttagaagacattgtggaatgcgggtatgtgaaagacaccggttttgtgtggcttatacaaaagaaagagaagaaacacaagtttgaaaagatcgggaagcttacaacatatggaacggaggtaaccgcatacatagagaagtttaagatcaagaaactcacgggtgttaagtctaaggagcttttgatgtggatcacactgagtgagatcactcttgataatccgcccactggaaagatcaactttaaggccacttctggcctttacagatcttttccggtatcggcttttcaacttgatgatgtgaagaaagatgttggaggtgcgagtgtggctaaggatgcccaagtgaaggaggtttgagcaagtgatgaagtttaatataatatataacaatatgaagtaatatttatgagcactttcatttattgatgttgtaccatcttatcaataattatagacctaatgcatcatgacttt

SEQ ID NO: 5816 - DNA, 655 bp, Ambrosia trifida
tccaaaccactagagttacatacaaaatctaaattcaaatcaaaccaagcataaaaagaaaatgtctcttgtgacaaaagcaattagggacagtgcatcagaaatttatcatggcgatgcaatttgtcaagaaaaatcaaaggaattattgaccgaaatgggactacccaatggtcttttgcctttagaagacattgtggaatgtgggtatgtcaaagacaccggttttgtgtggcttacacaaaagaaagagaagaaacataagtttgaaaagatcgggaagcttacaacgtatggaacggaggtaaccgcatacatagagaagtttaagatcaagaaactcacgggtgttaagtccaaggaacttttgatgtggatcacactgagtgagatcacagttgataatccatccaccggaaagatcaattttaaggccacttctggcctttacagatcttttccggtgtcggcttttcaacttgatgatgtgaaaaaagatgttggaggcgtgagtgaggcgaagaaggattcccaagtcaaggaggtttgagcatgtggtgaaatttttatatcatatatggcaatgaagtaatttgttatgatcatttttacttcttacgttgtaccatcttatcttaaataaaaatctaaatga

SEQ ID NO: 5817 - DNA, 598 bp, Helianthus annuus
aaaaatgtctcttgtgacaaaagcaatccgggaaagtgcatcagaaatttattatggtgatgcaatttgtcaagaaaaatcaagggaattactagcagaaatgggactacccaatggtcttttgcctctagaagacattgtggaatgtgggtatgtcaaagacaccggttttgtgtggcttatacaaaagaaagagaagaaacacaagtttgaaaagatcgggaaggttaccgcgtatgaaaaagaggtaaccgcatacatagagaagttcaagattaagaaactcacgggtgttaagtctaaggagcttttgatgtggatcgcaccaagtgagataagtgttgacaatccacccacgggaaagatcaattttaaggccgcttcgggccttcaaagatcttttccggtgtcggcttttcaacttgatgatgtgaagaaagatgttggaggtgcgagtgtggctaaggatgcccaagtgaaggaggtttgagcaagtgatgaatcttgatataatgtatgacaatgaagtaatatttatgatcactttcattatataatgttgtactatcttttcaaaaataaacttctaatgacttac

SEQ ID NO: 5818 - DNA, 484 bp, Arnica chamissonis
tagtactcttagtgacaaaagaaatacagggcaagtgcatcagaaatctatcatggcgatgcaatctgtcaagaaaaatcaaagtttttgctgacagaaatgggactacccaacggtcttttgcctttagaagacattgtggaatgtgggtatgtcaaagacaccggctttgtgtggcttatacaaaagaaagagaagaagcataagttcgaaaagatcgggaagcttacgtcgtatgcaacggaggtaactgcgatcatagagaagttcaagatcacgaaactaacgggggttaagactaaggagcttttgatgtggatcacactgggtgagatcagtattgacaatccgcccaccggaaagatcaattttaaggccacttctggcctttacagatcctttccggtgtcggcttttcaaatcgatgatgttaagaaagatgttggaggtgtgagtcattcggctaaggatgctaaagaagtga

SEQ ID NO: 5819 - DNA, 821 bp, Senecio madagascariensis
tggatcccccgggctgcaggcaaacacaaaccacagagcaaaaaatgtctcttgtaacagaacaaattagggcaagtgcatccgaaatttaccatggggacgcaatttgtcaagagaaatcaaagtttttgctaaccgaaatgggattaccaaatggtcttttaccattagaagacattatagaatgtgggtatgtcaaggacaccggctttgtgtggcttattcaaaggaaagaaaagaaacacaaattcgaaaaggtcggtaagcttacacaatatggaaccgaagtaaccgcttacattgagaagtttaagatcaagaaactaaccggtgttaaaactaaggaacttttaatgtggatcacacttagtgagatcacagttgatgatccacccaccggaaagatcacttttaaggccacttcgggcctttatagacaattcccagtgtcggcttttcaacttgaggatgttaagaaagatgtcgcagttgatgttgctaaggaaacacaagttgttaaggataccgaaaaagtggaagatgttaagaaagatgttgaggttgatgttgctaaggaaccacaagttaccgaggtttaagtaagtgttttgcaccaagtaacgaagctttcataccttataaacaaacgaacgaaacgaagtcgtctttattgatgagcttcgctttattttatatcatgatcttaatatttaaaacctaatgcttcatgagtgtcacttttaatagaatcatgaatgtgttttatccatttctttgtattctccaatatattataatcagaggaaatgttatttcatcta

SEQ ID NO: 5820 - DNA, 695 bp, Cirsium arvense
tagtctcttgtgacagaagaaattagggcaagtgcatcagaaatttaccatggggatgcaatttgtcaagaaaagtcaaagttcttgctcactgaaatggggctacccaatggcctcttgcctttagaagacattgaggaatgtgggtatgttaaagacaccggctttgtgtggcttaaacaaaagaaagagaagaaacacaagttcgaaaagatcgggaagttgacgtcatacggaactgaggtaactgcgattatcgagaagtacaggatcaagaaactaactggtgtcaaaactaaagagcttttgatgtggatcacactgaatgagatatatgttgatgatccacccactggaaagatcactttcaaggccacttctggcctttacagatcttttccagtgtcagcttttgagattgaggacgtgaagaaagacgttggagcagtggatgtggctaaggatggtcaagtcaaggaggtttgaatatttaagaagtgttttgcaccccaacaagtaatgaagttttcatttcatatatgctatatatatcaatgaagtactaccttttaatcatgaattttacttcatgatgttatcgttttatcaataattatagatccaatgcttcatgagcttcattttaaaatcaataactcttcttttattagtgtattcgcctgattttgtaactg

SEQ ID NO: 5821 - DNA, 1232 bp, Centaurea maculosa
atgtctcttgtgacagaagaaattagggcaagtgcatcagaagtttaccatggggatgcaatttgtcaagaaaaatcaaagttcttgctcactgaaatggggctacccaatggcctcttgcctttagaagacattgaggaatgtgggtatgttaaggacactggctttgtgtggcttaaacaaaagaaagagaagaaacacaaattcgaaaagatcggaaaggtgtcgtcctatggaaccgaggtaactgcgtatatcgagaaatacaggatcaagaagctgacaggtgtcaaaaccaaggagcttatgatgtggatcacactgagtgagatctcagtggatgatccacccaccggaaagatcactttcaaggccacttctggcctttacagatcgtttccggtgtctgcttttgagatcgaggacgtgaagaaagacgttggaacggtggatgtggctaaggaaggtcaagttaaggaggtttgaattttaaagaagtgtttttacaccaactaaaaagtaatgaagttttcatttcatatatagcaatgaagtacaaccctttaatcatgaatattacttcatgatgtatcatgttatcaataatccaagatcctatgcttcatgagttccattttctaaaatcatcaagtcttttatttaatttagttctttttattactgaattcgtatgatgattaactaaaatgggtattttgatttagttttaatttatatacaaaaggaaatgaaatcaaaaaacagacgtgatttttacggtatgtgttttatgtggtatttttataattttgggtttgaatcatatcctcaagggttattgtagtttaaatttgtgtctaagttttcatgtgaagaatggaaaagaaaacacgaaaactaagaagaacgatgtcataatgatgcctaatacgaaatgtagaaattaaaatcagtttatcatataaaataaaatcatcttacaaagtacacctaattattaacaaaacttgtctagcccaatggtagaggtaacatccctgggtcaatgaattgtatccctgattacccgggttcgaaaccccgcggcagcaagtagagttacccatgttctaagccggtcgatgcggattagtcgggtgcccgaatggacccccaaataccgcaaagaacgttatatgtagagtttatctagaccgttaaaaaaaacacaaccttaattattatattcattt

SEQ ID NO: 5822 - DNA, 744 bp, Carthamus tinctorius
tccacccccacctcaacaaaaccaatccaagatctttaaaaacaaaacaaaaaaaaatcccaattcaaatcaaaatcaaatatgtctcttgtgacagaagaaattagggcaagtgcatcagaagtttaccatggggatgcaatttgtcaagagaagtcaaagttcttgctcactgaaatgggcctgcccaatggcctcttgcctctagaggacattgaggaatgtgggtatgttaaagacactggctttgtgtggcttaaacaaaagaaagagaagaaacacaagttcgaaaagatcggaaggctgacgtcctacgggaccgaggtaaccgcgatcatcgagaagtacaggatcaagaagctgacgggcgtcaagaccaaggagcttttgatgtggatcacactgagcgagatctcagtggatgatccacccaccggaaagatcactttcaaggccacttctggcctttacagatcctttccggtgtctgcttttgagatcgaggacgcgaagaaagacgttggagcggttgatgtggccaaggaaggccaagttaaggaggtttgaattttaaagaagtgtttttacaccaaccaaaaaacaaaagtaatgaagttttcatatcatatatggcaatgaagtactactactactaccccttaatcatgaattttacttcatgatgtatcatgtcatcatcatcccgatccaatgctccatcactttcaacccgtcttatttata

SEQ ID NO: 5823 - DNA, 762 bp, Cirsium arvense
ccgaacaaacactcccagaatacttacaaaaacaaaaaaatacccaattcaaatcaattcaaatatgtctcttgtgacagaagaaattagggcaagtgcatcagaagtttaccatggggatgcaatttgtcaagaaaagtcaaagttcttgctcactgaaatggggctgcccaatggcctcttgcctttagaagacattgaggaatgtgggtatgttaaagacactggctttgtgtggcttaaacaaaagaaagagaagaaacacaaattcgaaaagatcggaaaggtgtcatcctatggaaccgaggtaactgcgattatcgagaagtacaggatcaagaaactgacgggcgtcaaaaccaaggagcttatgatgtggatcacactgagtgagatctcagtggatgatccacccaccggaaagatcactttcaaggccacttctggcctttacagatcgtttccggtgtctgcttttgagatcgaggacgtgaagaaagacgttggagcggtggatgtggccaaggaaggtcaagttaaggaggtttgaattttaaagaagtgttttacatcaactagaaaaagtaatgaagttttcatttcatatatagcaatgaagtactaccctttaatcatgaattttacttcatgatgtatcatgttatcaataatccaagatccaatgcttcatgagttccaatttctaaaatcattaagtcttgcttatttaatttagtttctttttattactgaaaaaaaaaa

SEQ ID NO: 5824 - DNA, 904 bp, Helianthus annuus
tcaacgcagatacgcggggatccatccacaataacaaaccaaaaacaattgttaattcaaaccaaacaaaaatgtctcttgtaacagatgaaatcagggcaagtgcatcggaaatttaccatggggatgcacttggtcaagaaaagtcaaagtttttgctaacagaaatgggactacccaatgggttgttgcctctagaggacattgaggaatgtgggtatgtcaaagacactggctttgtgtggcttaaacaaaagaaatccaaggtacacaagttcgaaaagatcgggaagctcgtttcgtacgcgactgaggtaaccgcggttatagagaagtttaagatcaagaaactcacgggtgttaaaagtaaggagcttttgatgtggatcacattgagtgagatcacggttgatgacccgccaaccggaaagatcacttttacagccacttctggcctttatagaacctttccggtttcggcttttcaaattgaggatgtgaagaaggagggtgcaccacaagttggtgtggctaaggatggtcaagtggttgaggatgtgaagaaggatgctggtgctacacaagtggatgtggctaaggagaccaaagtccaagaggtttgagttaagtgttttgcatctagtgatgaagttttcacttttcatatcatatatagcaatgaagtaatctttgttgggggcttttactttgtgttgtaccatcttatcaataattgaacatcttatatgaagtgtttatttgattttgtttctatctaaatcttgaaaaaagaaaaggcataattgacttgatttagatgggaaagtaaccacttgctagagcatctcgaatgcatccggttttaattcactcacaaacgcgacacatcagctgacaaatctga

SEQ ID NO: 5825 - DNA, 799 bp, Helianthus annuus
gcggggacatcataccatcgacaataacaaaccaaaaatctattgttaattcaaaccaaacaaaaatgtctcttgtgacagatgaaatcagggcaagtgcatcggaaatttaccatggggatgcacttggtcaagaaaagtcaaagtttttgctaactgaaatgggactacccaatggtttgttgcctctagaggacatagaggaatgtgggtatgtcaaagacactggctttgtgtggcttaaacaaaagaaatccaaggtacacaagttcgaaaagatcgggaagctcgtttcgtacgcgactgaggtaaccgcggttatagagaagtttaagatcaagaaactcacgggtgttaaaagtaaggagcttttgatgtggatcacattgagtgagatcacggttgatgacccgccaaccggaaagatcacttttacagccacttctggcctttatagaacctttccggtttcggcttttcaaattgaggatgtgaagaaggagggtgcaccacaagttggtgtggctaaggatggtcaagtggttgaggatgtgaagaaggatgctggtgctacacaagtggatgtggctaaggagaccaaagtccaagaggtttgagttaagtgttttgcatctagtgatgaagttttcacttttcatatcatatatagcaatgaagtaatctttgttgggggcttttactttgtgttgtaccatcttatcaataattgaacatcttatatgaagtgtttattactttatttgattttgtttctatctaaatcttgaaaaaagaaaag

SEQ ID NO: 5826 - DNA, 691 bp, Helianthus annuus
aaaaacaattgttcattcaaaccaaacaaaaatgtctcttgtgacagatgaaatcagggcaagtgcatcagaaatttaccatggggatgcacttggtcaagaaaagtcaaagtttttgctaacagaaatgggactacccaatggtttgttgcctctagaggacattgagggatgtgggtatgtcaaagacactggctttgtgtggcttaaacaaaagaaatccaaggtacacaagttcgaaaagatcgggaagctcgtttcgtacgcgactgaggtaaccgcggttatagagaagtttaagatcaagaaactcacgggtgttaaaagtaaggagcttttgatgtggatcacattgagtgagatcacggttgatgacccgccaaccggaaagatcacttttacagccacttctggcctttatagaacctttccggtttcggcttttcaaattgaggatgttaagaaggatgtgaagaaggagggtgcaccacaagttggtgtggctaaggatggtcaagtggttgaggatgtgaagaaggatgctggtgctacacaagtgggtgtggctaaggagaccaaagtccaagaggtttaagtgttttgcatctagtgatatcatatatagcaatgaagtaatctttgttgggggcttttactttgtgttgtaccatcttatcaataattgaacatc

SEQ ID NO: 5827 - DNA, 2156 bp, Ambrosia trifida
attaacacatatcttccctacaatcaaataaataatatacagtccagacagcaaagcaatcaacaccacaacacaacacaagactaccgtttaactcacacagatcttcatcttctttatccaatacccaaaacaacaatggttcgaatcaaagacatattcatcaccttcttcaacaacagatggcttgtttttgtagcagcaatgtgggtccaatcatgtgcaggtattgggtacctgtttggaagcatatctccagttataaagagttccttaaactataaccagaaacaggttgctagattaggtgtagctaaggatcttggtgacagtgttgggtttttagctggaagtatgtcggagatattacccttgtgggccctactccttgttggtgctcttcagaactttgttgggtatggttgggtgtggcttgttgttactgggaaagctcctatgttgccattatgggttatgtgtctgctcatattcattggaaccaatggtgaaacctacttcaacacagtggcattagtttcttgtgtgcaaaatttccctaaaagccgtgggcctatagtgggaatactaaagggatttgcagggttaagtggtgcgatcttgacgcaaatatacgcgttaattaactcacccgataaagcatcgattatattcatggttgctgtcggtcctacgatggtgggtattgctcttatgtttattgttagaccggttggtggtcacagacagcttagactatcggaccggtctagtttctcgttgatctactgtgtgtgtcttgttttagcggcttatttgatgggcgttatgcttgtggaagacttaattgatctgaaccaaaccatagttaaaatattgacagccattttgtttgtgctattagtggctccaattgggattccgttatggttgacttttcttctgacccaaaaccctcagaagaagaagctcttttgtctgaaccacaaaataaagaacaacccgaatcgtcacatgatcctaatgagattatatttagtgaagtggaagatgagaaggcttcagatgtagatttgcttccggcttctgaacggcaaaaaagaatcttgcagttacagtcaaaagtggcccaagctgctgcggaaggagcggtgaggattaagaggagaagaggcccgcatagaggcgaagactttgatctcacacaggctttgattaaggctgattttggctccttttttggacccttttacttggatctggatcaggtttgactgtgattgacaatttgggtcaaatgagtgagtcattgggatacgacaacacacacatatttgtttcgatgattagcatttggaatttcttgggccgtgttggcgggggctatgtttctgagatcgttgttagggactacgcttaccctaggcccgtagctctagctgttgcccaaggcataatgtcaatcgggcatttattctttgccatgggttggcccggggcaatgtacatcggtacacttttaatcgggctaggatatggtgctcactgggccatcatacctgccaccgcctccgagttatttggggtcaaaaagtttggagctttgtacaatttcctcacccttgcgaatcccggaggttcactagtcttttctgggctcattgccagctatatatacgactctgaagcggagaaacaagctaaagaacgtggtgaaatcatcataaagtcaacttcttctatgctgaccaaactatttgaaacggatgacgccctcaaatgcacaggttcaatatgtttctttctgacttacatgctaatgtctggactctgtatcatagctctcatcctgagtttgatactcgtacgccgaactaaaaccgtctaccaaaacctctacggaagaacccgaacttaaaatccttcaaatgatgaaattatccaaaatatcaaatccgaggggcatcttgtcggttcccatcattcaatgtgttcgattttggaatcttgaatttggtttgtatatcgttgtatgttatcggttttcaacatttgttttggattgaagttttgctattcagttttattgtaataatttatatattctgtaacaatttgtgtgaaaaaaacaatacatatgatcattatttaaaaaagaa

SEQ ID NO: 5828 - DNA, 1910 bp, Flaveria ramosissima
acaacagatggctcgttttcgttgcagcaatgtgggttcaatcgtgcgccggtgttgggtacctgttcggaagcatatcgccggtgatcaagagctccctgaactacaatcagaagcaggtggcgagtttaggggtggctaaggatctcggtgacagtgttgggtttttggccggaagtatgtcggagattctgccgttgtgggctcttctgcttgttggtgctattcagaacttcgttgggtatgggtgggtgtggctcatcgtcatcggaaaagctcaggagttgccattgtgggttatgtgtttgctgatattcattggaacaaatggtgaaacctacttcaacacagtagcattggtttcatgtgtgcaaaatttccccaaaagccgcgggcctgttgtgggaatactgaagggattcgcggggctaagtggtgcgatcttgacacaaatatacgcgttaattaagacaccagatcaagcatcaattatattcatggttgctgttggtcctacaatggtggctattgctcttatgttcattgttagaccagttggtggtcataggcaacttagactatcagacgcgtcaagtttctctttgatctactgcgtgtgtctcgttttagctgcttatttgatgggagttatgcttgtggaagacttggttgatctgaaccaaaccattgttcagatattaacatccattttgtttgtgctcttggtgcttccaattggaataccgttgtggttgactttttcttctggcccaaaaacctcagaacaagaagctcttttatctgaaccacaaaataaagaacaacctgaaagttcacatgataatgagattatctttagtgaggtggaagatgagaagcctacagaagttgatttgcttccggcttctgaaaggcaaaaacgaatcttgcagttacaatcaaaactagctcaagctgctgcagaaggtgcggtgaggattaaaaggagaaaaggcccacatagaggcgaagactttgatcttacacaagccttgataaaggctgatttttggctcctgttttggacccttttacttggatctggttcgggcttgacaattattgataatttgggtcaaatgagtgagtctttaggatatgataacactcacatatttgtttccatgatcagcatttggaatttcttaggccgtgttggcggaggctatgtttctgagattgttgtcagggaccatgcttaccctaggcccgtagctctagccgttgcccaaggcttaatggcgatcgggcatttattctttgctatgggttggcccggggcaatgtacatcggaaccctcttaatcgggctagggtatggggctcactgggccatcatacctgccacggcctccgagttatttggggtgaaaaagtttggagctttgtacaatttcctcactctcgcgaaccctggaggctcactagtcttttctgggctcattgcgagctatatatacgactctgaagcagagaaacaagctcaacaacgcggtgaactcatcataaagtcagcttcttttttgaccaaactatttgaaacagatgatgccctcaagtgcacaggttcaatatgctactttctcacttgcatgataatgtcaggactctgtatcatagcagctatcttaagtatgatactcgtgcaccgaactaaaaccgtctaccaacacctatacgggacaacccgagcttaaagctctccggatgataaaatgatcaaagtatcagatcccaggtgtatcttgaattatgaatcttgaatttggtttgtatattgttgtatgttatccaattttctacatttgttttggattgaagttttggcttctttttatttatttataagattcagttttattgtaatactt

SEQ ID NO: 5829 - DNA, 2032 bp, Arnica chamissonis
tctctgttctgcttgaatttcaaagaatggttcgtagtcaaggatttgctcatcgtctttcttcaacaacagtatggctcggttttttgtggcggcaatgtgggttcaatcgtgcgccgggatcgggtacctgttcgggagtctatctcctgtgattaagagctcgttaaactacaatcagaagcaggttgcgagattaggggtagctaaggatcttggtgatagtgttgggtttttggccggaagtatgtcggagatattgccgttgtgggcacttctgcttgttggttctcttcagaactttgtcgggtatggttgggtgtggctcgtcgtcaccggtaaagctccgatgctgccattgtgggttatgtgccttctcatattcattggaaccaatggtgaaacctacttcaacacagtagcattagtttcatgtgttcaaaacttcccgaaaagccgtgggcctgttgtgggaatactaaagggatttgcagggctaagtggtgcaatcttgacacaagtatacgcgttaatcaaaacaccagatagcgcgtcacttatattcatggttgctgtcggtcctacaatggtgggcatttctcttatgttcattgttagaccagttggtggtcacagacaacttagactatcagacgcgtcaagtttctctttaatctactgcgtgtgtctcattttagctgcctatttgatgggggttatgcttgtggaagacttgattgatctgaaccacaccatagttcaaatattaacatccattttgtttgtgctcatagtggttccaattgggattccattatggttgactttttcttctgggtcaagaaccatagaagaagaagctcttttatctgaaccacaaaataaaggacaacccgaatcatcacatgatccgaatgagattatatttagtgagatagaagatgagaaatcttcagaagtagatttgcttccggcttctgaaaggcaaaaaaggattttgcaattacagtcaaaattggcccaagctgctgcagaaggggctgtgaggattaaaaggagaaggggaccacatagaggcgaagactttgaccttacgcaggctttgatcaaggctgatttttggctcctgttttggacccttttacttggatcaggttcgggtttgactgtgattgacaatttaggtcaaatgagcgagtctttgggatatgataatgcgcacatatttgtttccatgatcagcatttggaatttcttaggtcgtgttggcggaggctatgtttctgagatcgttgtcagggactacgcctaccctaggcccgtagctctagctgttgcccaaggcggaatggcaatcgggcattttatttttgccatgggttggcccggagcaatgtacatcggtacccttttaatcgggctaggatatggggcacactgggccatcataccagctacagcctctgagttatttggggtcaaaaagtttggagctttgtacaatttcctcacccttgcgaacccgggaggttcactagtcttttctgggctcattgctagctatatatacgactctgaagcagagaaacaggctcaacaacgcggtgacctcatcgtaaagtcaacttctttgttgaccaaactgtttgacacagatgatgccccaaagtgctcaggttcaatatgtttctttctgacttacatgataatgtcgggactctgtatcgtggcagtcatcctaagtttgatactcgtgcgccgaactaaaagcgtctaccaaaacctctatggaaaaacccaaacttaaaattctccggacgacgaaatgatcaaaacatcaatttgttcgatttaagaatcttgaattcggtttgtatatccttatatgaagtgtttttgtaactggaccggaccggccgatccaaccggcggaccggaatcgtagtctttaacggttcggtgtgttttaaccgctccgctttgttattcaattttcaacatttgttttggattgaagttttgggattctttt

SEQ ID NO: 5830 - DNA, 1954 bp, Flaveria ramosissima
gttgggtacctgttcggaagcatatctccggtgattaaaagctcactgaactacaatcagaagcaggtggcgaggttaggggtggctaaggatcttggtgatagtgttgggtttttggccggaagtatgtcggagattctgccgttgtgggctcttctgcttgttggtgctattcagaacttcgttgggtatgggtgggtgtggctcatcgtcatcggaaaagctcaggagttgccattgtgggttatgtgtttgctgatattcattggaaccaatggtgaaacctacttcaacacagtagcattggtttcatgtgttcaaaactttcccaaaagccgcgggcctattgtgggaatattgaagggattcgcggggctaagtggtgcgatcttgacacaaatatacgcgttaattaagacaccagatcaagcatcaattatatttatggttgctgttggtcctacaatggtggctattgctcttatgttcattgttagaccagttggtggtcataggcaacttagactatcagacgcctcaagtttctctttaatctactgcgtgtgtctcgttttagctgcttatttgatgggtgttatgattgtggaagacttggttgatctgaatcaaaccattgttcagatattaacatcaattttgtttgtgcttttggtggttccaattggaataccgttgtggttgactttttcttctggcccgaaaacctcagaagaagaagctcttttatctgaaccacaaaataaagaacaaccagaaagttcacatgagaatgagatcatttttagtgaggtggaagatgagaagcctacagaagttgatttgcttccggcttctgaaaggcaaaaacgaatcttgcagttgcaatcaaaactagctcaagctgctgctgaaggtgcggtgaggattaaaaggagaaggggcccgcatagaggcgaagactttgatcttacacaggccttgatcaaggctgacttttggctcctgttttggacccttttacttggatctggttcgggcttgaccattattgacaatttgggtcaaatgagtgagtctttgggatacgataacactcacatatttgtttccatgatcagcatttggaatttcttaggccgtgttggaggaggatatgtttctgagattgtggtcagggaccatgcttaccctaggcctgtagctctagctgctgcccaaggcttaatggcgatcgggcatttattctttgccatgggttggcccggggcaatgtacatcggtaccctcttaatcgggctagggtatggggctcactgggccatcatacctgccacggcctccgagttatttggtgtcaaaaagtttggagctttgtacaatttcctcacccttgcgaaccctggaggttcactagtcttttctgggctcattgctagctatatatacgactctgaagcagagaaacaagctcaacaacgcggtgaactcatcataaagtcagcttcttttttgaccaaactatttgaaacagatgatgccctcaagtgcacaggttcaatatgctactttctcacttgcatgataatgtcaggactctgtatcatagcacttatcttaagtatgatactcgtacaccgaactaaaaccgtctaccaacacctctacgggaaaacccgagcttaaagctctccagatgatgaaatgatcaaagtatcagatcccaggtgtatcttgaatcatgaatcttgaatttggtttgtatattgttgtatgttatccaattctctacatctgttttggattgaagttttgggcttctttttatttaattatttctaagattcagttttattgtaatctttcaaaaatctgtaacaatctgcttaaagtacattacatatgatcattatttatttgtctttggttacaatattaattaaaagtactgtgcagt

SEQ ID NO: 5831 - DNA, 1292 bp, Echinacea purpurea
ggccgggggatatacacccacactataaacacaaagaccactcactcaccgataccttatcttcaaccaccatgccgacggcaatttccctctccatcctcttcctcctgtccataaccaccaccatttccgcccacaacatcacccgaatcctcgcgaaacacccggaattctccaccttcaaccattacctcaccatcacacacctcgccaatgaaatcaaccgccggcagaccatcaccgtctgcgccgtcgacaatgccgcgatgtccgacctactctccaaaggcctatcaatccaaactgtcaaaaacgtcctctccctccacgtcttcgccgactacttcggcaccaaaaagctccaccaggtcaccaagggttccacctccaccgccaccatgtaccaggccaccggtgaagctccaggtaccgccgggtacgttcacatcaccgacatcaaaggcggtaaagtccggttcactccggaagacaatctatcacaaaccgactccgtttacgtgaaatccatcctcgaaatgccgtataacatctcggttattcaaatctccgcgattctacagtcaccagaagccgaagctccaaccgccgcacctgatctaaacttaacctcattgctacaacgagacggctgccagaacttttacgatctgctaacaacctcaggagccatcggaacgtttttaagcagtgtcgaaagcggagtaactgttttctgtcccgatgatgacgcggtcaccgcttttgctccgaaatataagaatttaacggcgtctgagaagacgtcgttgttgttgtaccatgcaattccggtgtacaattcgatgggaatgctgagatctagcaatggtctgatgaacacgttagcgacggaaggagccaagaagaagtacgattttacggtgcagaatgatggaaatgatgtcaagttgaagacgaaagttgtgacggccaccgtaagtgccacagttgttgatgaagagccgatcgccatttacaccatcgataaggttttacagcctagagagctgtttaaaggtgcggtggaagaagccgatgagccggcaccggcgccgaagggtgcaaagaataagaagaaggcgacgaagaagggagacgagacggaggatgatgcggaggctccggggccggattccgccgacgactacagtgatgatgatgcggcggatcagaaggctagtggtggtggaaggttggtggcgtcggtggttatgttgtgtctctcgtggttggtttttgtttgatttttattt

SEQ ID NO: 5832 - DNA, 1378 bp, Lactuca sativa
ccttctcctcctgtctatctccgccgccgtacacggccacaacatcacccgcatcctcgccaaacaccccgaattttccactttcaaccactacctcaccatcactcacctcgccaatgagatcaaccgccggcagacaatcaccgtctgcgccgtcgacaatgccgccatgtcttcattactttcaaaaggactatcaattcagaccataaagaatgtcctctccctccatgtcttcgccgactacttcggctccaaaaagctccaccaagtcaccaaaggctccacctccaccgccaccatgtatcaagccaccggtgaagctccaggaaccgccggttacgttcatatcaccgacatcaaaggtggtaaagtccggttcactcctgaagacaacccaagtcaaaccgataccacttatgtcaaatccatcttggaaatgccttacaacatctccgtgatccaaatcagcgcgattctacagtcgccggaagctgaagctccgactgccgcaccggatctgaacttaacctctttgttacaacgagaaggttgtcaagcgttttacgatctgttaacaacctcaggagcaatcggaacgtttttaagctccgccgacggtggagtcaccgtgttttgtcctggagacgacgctattgcggcgtttgccccaaaatacaagaacttgacggcgtcggagaagacgtccttgttgctttaccacggtgttccggtttacaactccatggggatgctcagatctagcaatggactgatgaacactctagcgacggaaggagctaagaagaagtacgatttcactgtacaaaacgacggcaacgatgtgacattgaagacgaaagtggtgaaggcgacaataagcggaacggtggtcgacgaagagccgattgccatttacaccatcgataaggttttattgccgagagagttgtttaagggtacggtggaggaggcggaggagccggcgcctgcgccaaaggcggcgaaaaagaaaaagaagccggcgaagaagggtgacaccgaggaggaagcagatgcgccgggaccggattcttctgatgattacagcgatgatgatgcggcggatcaaacggcaagtggcggtggaagattggtggcgtcggcggttatggcgttctgtttttcgtggttggctttcgtttgaattttatttttatttttttcttttttatttttgtcggtgtgataaggtgctagcgggtatcctgggtcttcccactcacgatatctcctcatgcatgaatagaattcctctctcctttttttttttttttttgatttatcatcaaaacatatttatttggttttatttatcaggaaaagaaaaataatgagt

SEQ ID NO: 5833 - DNA, 1395 bp, Chrysanthemum coronarium
cccccctcctcctccaccaccaccgcaacggcgacaatgtcgccactttccctcgccttcctcgtaatcctagctctcaccaccacagttcagagccacaacatcaccaaaatcctagccaaacaccctgaattttccacatttaaccattacctcactatcacacacttagcaaatgaaatcaaccgtaggcaaacaatcactgtctgcgcggtagacaatgccgcaatgtcggacttacttgctaaaggcttgtcaattcagacaattaaaaatgttctttcacttcatgtttttgctgattatttcggctcaaagaagcttcaccaagttactaaaggctctacctctacagcaacaatgtatcaagctactggtgaagcaccaggtaccgctggatatgtccacatcactgatgtgaagggaggcaaagtccgcttcacaccagaagacaacccctcccaaacagacaccacatacgtcaaatccatcctcgagatgccttacaacatctcagtcatccaaatcagcgccattttgaactcaccagaagccgaagcaccaacagcagctccagatctaaacttaacttccctactacagcgcgaaggttgtcaggcgttttacgaccttctgacaacctcgggcgcgatcggaactttcctaagttccgcggatggcggcgtcactgttttctgtcccagtgacgacgccatcactaagttcgcgcccaagtacaaaaacttgacagcctccgagaaaacatccttgttgttgtaccatggtgtgccagtttacaactccatgggaatgttgaggtctagtaatggcatgatgaacactctagctaccgaaggcgcgaaaaagaagtacgatttcgatgtgcaaaacgatggaaatgatgtgactttgaagactaaagttgtgactgctactattagtggtacagttgttgatgaagagccaattgctatttacacacttgacaaagttttgcaaccgcgggagctttttaaagggaccgcggttgaggctgatgagccggctgcagcgccggctccagcaaaaaagaaaaagaagcccgctaagaaaggcgcggccgcagatgaggacgcggccgcaccaggccccggggacggtgattatagcgacgatgaggccgcggattcgactaatggtggtggtagattggtggctccattgatggttatggtggcttgtttttcatggttgatttttgcttaaattaattttttttttttgtaatttttatttttgtcggtgtgataaagtaacagcgggtatcatgggtctaccacgagatattgctcatgcaaaaaatagaatggccagccgatttaaatgctttggcaagagttgatgctaaagactaga

SEQ ID NO: 5834 - DNA, 1469 bp, Chrysanthemum coronarium
atctcccccctcctcctccaccaccaccgcaacggcgacaatgtcgccactttccctcgccttcctcgtcgtcctagctctcacccccacagttcagagccacaacatcaccaaaatcctagccaaacaccctgaattttccacatttaaccattacctcactatcacacacttagcaaatgaaatcaaccgtaggcaaactatcactgtctgcgcggtagacaatgccgcaatgtcggacttacttgctaaaggcttgtcaattcagacaattaaaaatgttctttcacttcatgtttttgctgattatttcggctcaaagaagcttcatcaagttactaaaggctctacatctacagcaacaatgtaccaagctactggtgaagcaccaggtaccgctggatatgtccacatcactgatgtgaagggaggcaaagtccgcttcacaccagaagacaacccctcccaaacagacaccacatacgtcaaatccatcctcgagatgccttacaacatctcagtcatccaaatcagcgccattttgaactcaccagaagccgaagcaccaacagcagctccagatctaaacttaacttccctactacagcgcgaaggttgtcaggcgttttacgaccttctgacaacctcgggcgcgatcggaactttcctaagttccgcggatggcggcgtcactgttttctgtcccagtgacgacgccatcactaagttcgcgcccaagtacaaaaacttgacagcctccgagaaaacatccttgttgctgtaccatggtgttccagtttacaactccatgggaatgttgaggtctagtaatggcatgatgaacactttagctaccgaaggtgcgaaaaagaagtacgatttcgatgtgcaaaacgatggaaatgatgtgactttgaagactaaagttgtgactgctactattagtggtacagttgttgatgaagagccaattgctatttacacacttgacaaagttttgcaaccgcgggagctttttaaaggtaccgcggttgaggctgatgagccggctgcagcgccggctccagcaaaaaagaaaaagaagcccgctaagaaaggcgcggccgcagatgaggacgcggccgcaccaggccccggggacggtgattatagcgacgatgaggccgcggattcgacaaatggtggtggtagattggtggctccattgatggttatggtggcttgtttttcatggttgatttttgcttaaattattttttttttttgtaattttttttttaatttttatttttgtcggtgtgataaaagtgacagcgggtatcatgggtctaccacgagatattgctcatgcaaaaaatagaatggtccttttttttttttttaatttatgatttcaaaaaggtatttatttgagaaaaaaataatgagattgttgttattgtaagtatatttattttgtttcatggaat

SEQ ID NO: 5835 - DNA, 1491 bp, Chrysanthemum coronarium
ccactttccctcgccttcctcgtccttctcgcgctctcttcgaccgttcagagccacaacattaccaaaatcctagccaaacaccctgaattctccacatttaaccattaccttactgtcacacacttggcaaatgaaatcaaccgcaggcagactatcactgtctgtgctgttgacaatgccgctatgtccgacttgattgctaaaggcttatcacttcagactattaaaaatgtgctttcacttcatgtttttgctgattatttcggctccaagaagctgcatcaggttactaaagggtctacttctactgcaactatgtatcaagctactggtgaagcaccaggtactgccggatatgtccacattactgatgtgaagggaggcaaagtccggttcacaccagaagacaatccttcccaaacagacaccacatacgttaaatcgatcctcgagatgccgtacaacatctcagtcattcaaatcagcgccattttgaactcgccagaagccgaagcccccacagcagccccagatctaaacttaacttcccttctacagcgcgaaggttgccaggccttttacgaccttttgacaagctcaggcgcgataggaactttcctaagttccgcggatggcggcgtcactgttttctgtcccagtgacgacgccatcactaagttcgcgcccaagtacaaaaacttgacagcctccgagaaaacatccttgttgttgtaccatggtgtgccagtttacaactccatgggaatgttgaggtctagtaatggcatgatgaacactttagctaccgaaggtgcgaaaaagaagtacgatttcgatgtgcaaaatgatggaaatgatgtgactttgaaaactaaagttgtgactgccactattagtggtacagttgttgatgaagagccaattgctatttacacacttgacaaagttttgcaaccgcgggagctttttaaagggaccgcggttgaggctgatgagccggctgcagcgccggctccagcaaaaaagaaaaagaagcccgctaagaaaggcgcggccgcagatgaggacgcggccgcaccaggccccggggacggtgattatagcgacgatgaggccgcggattcgacaaatggtggtggtagattggtggctccaatgatggttatggtggcttgtttttcatggttgatttttgcttaaattaattttttttttttgtaattttttttttaatttttatttttgtcggtgtgataaagtaacagcgggtatcatgggtctaccacgagatattgctcatgcaaaaaatcgaatggtcctttttttctattttttttttttgtttttaatttatgatttaaaagggtacttatttggaaagaaaataataatgagattgttgttattgcaattatatttattttgtttcatgaaatagaaaatatttgtatgatattttggaattcgaattcctgcagcccgggggat

SEQ ID NO: 5836 - DNA, 1057 bp, Ambrosia trifida
ccccgaattctccaccttcaaccactacctcaccatcactcacctcgccaacgaaatcaaccgccgccaaaccatcaccgtatgcgcggtcgacaatgccgcaatgtccgacctcctctccaaaggcttatcaatccaaacaataaaaaacgtcctctccttacacgttttcgccgactatttcggctcgaaaaagctccaccaagtcaccaaaggttccacttcaaccgccaccatgtaccaagctacaggagaagctccaggaacagcagggtatgtccacatcacagacatcaaaggtggcaaagtacgcttcactccagaagacaaccttaagcaaacagattccgtatacgtcaaatccatactagaaatgccgtacaacatatccgttattcaaataagttctgtactacaatcgccagaagctgaagcacctacttcagctcctgacctaaacctaacctcgttactagaccgagacggttgccagtccttccacaacctattaacaacatcaggtgctataggcacctttttaagcagcgtcgaaagcggcgtaaccgtattctgtcctgacgacgatgcggtcgccgctttcgcgccaaagtacaaaaacctaacggcgcctgaaaagacgtcgttacttttgtaccacggaatacccatatacaactctatggggatgttgaggtctagtaatggtttaatgaacactttggcgactgaaggcgccaaaaagaagtatgactttactgttcagaatgatgggaatgatgttaagttgaagactaaggttgtcacggcgacaataagtgggacggttgtggatgaagagccgattgcgatttatactattgataaggttttgcagccaaaagagctgtttaaaggcgctgtagaggaagcggatgagcctgcgcctgcgcctaaagcggacgaaaaagagaagaaggcgacgaagaaaggcgacgaggcggatgaggacgctggtgcgcctggaccgggttcggatgaggattatagtgatgatgcggcggatccgacggcgagtgac

SEQ ID NO: 5837 - DNA, 1487 bp, Chrysanthemum coronarium
gcgcgacaatgtcgccactttccctcgccttcctcgtccttctcgcgctctcttcgacagttaacagccacaacattaccaaaatcctagccaaacaccctgaattctccacatttaaccactacctcactgtcacacacttggcaaatgaaatcaaccgcaggcagactatcactgtctgcgctgttgacaatgccgcaatgtccgacttgattgctaaaggcttatcacttcagactattaaaaatgtgctttcacttcatgtttttgctgattatttcggctcgaagaagctgcatcaggttactaaagggtctacttctactgcaactatgtatcaagctactggtgaagcaccaggaaccgctggatatgtccacattactgatgtgaagggaggcaaagtccggttcacaccagaagacaatccttcccaaacagacaccacatacgttaaatcgatcctcgagatgccgtacaacatctcagtcattcaaatcagcgccattttgaactcgccagaagccgaagcccccacagcagccccagatctaaacttaacttcccttctacagcgcgaaggttgccaggccttttacgaccttttgacaagctcaggcgcgataggaactttcctaagttccgcggatggcggcgtcactgttttctgtcccactgacgacgccatcacaaaattcgcgcccaagtacaaaaacttgacggcttctgagaaaacgtcccttttgttataccacggtgtcccagtttacaactccatgggaatgttgaggtctagtaatggtatgatgaacactctagctaccgaaggcgcgaaaaagaagtacgatttcgacgtgcaaaacgacggaaatgatgttactttaaagactaaagttgtgactgctactattagtggtacagttgtggatgacgagccaattgcgatttacacaattgacaaagtgcttcaaccgcgcgagctttttaaagggaccgtggttgaagctgatgagccggctgcagcgccggctccagcaaaaaagaaaaagaaggccgctaagaaaggcgcggccgcagatgaggacgcggccgcgcctggccccgacggggagggcgattacagcgatgacgaaaccgcggattcgacaaacggtggtggaagattggtggctcctttgatggctatggtggcttgtttttcatggttgatttttgtttaaattatttatttttgtaatttttttttttttttttaatttttatttttgtcggtgtgataaagtaacagcgggtatcatgggtctaccacgagatattgctcatgcaaaaaatcgaatggtcctttttttctattttttatttttgtttttaatttatgatttaaaagggtacttatttggaaagaaaataataatgagattgttgttattgtaattatatttattttgtttcatgaaatagaaaatatttgtatgatattttggaat

SEQ ID NO: 5838 - DNA, 1271 bp, Chrysanthemum coronarium
cctccaccaccaccaccatcgtcgcaaagcgcgcgacaatgtcgccactttccctcgccttcctcgtccttctcgcgctctcttcgacagttaacagccacaacattaccaaaatcctagccaaacaccctgaattctccacatttaaccattaccttactgtcacacacttggcaaatgaaatcaaccgcaggcagactatcactgtctgtgctgttgacaatgccgctatgtccgacttgattgctaaaggcttatcacttcagactattaaaaatgtgctttcacttcatgtttttgctgattatttcggctccaagaagctgcatcaggttactaaagggtctacttctactgcaactatgtatcaagctactggtgaagcaccaggtactgccggatatgtccacattactgatgtgaagggaggcaaagtccggttcacaccagaagacaatccttcccaaacagacaccacatacgttaaatcgatcctcgagatgccgtacaacatctcagtcatccaaatcagcgccatattgaactcaccagaagccgaagcccccacagcagccccagatctaaacttaacttcccttctacagcgcgaaggttgccaggccttttacgaccttttgacaagctcaggcgcgataggaactttcctaagttccgcggatggcggcgtcactgttttctgtcccactgacgacgccatcactaaattcgcgcccaagtataaaaacttgacggcttctgagaaaacgtcccttttgttataccacggtgtcccagtttacaactccatgggaatgttgaggtctagtaatggtatgatgaacactctagctaccgaaggcgcgaaaaagaagtacgatttcgacgtgcaaaacgacggaaatgatgttactttaaagactaaagttgtgactgctactattagtggtacagttgtggatgacgagccaattgcgatttacacaattgacaaagtgcttcaaccgcgcgagctttttaaagggaccgcggttgaagctgatgagccggctgcagcgccggctccagcaaaaaagaaaaagaaggccgctaagaaaggcgcggctgcagacgaagatgcggccgcgcctggccccgacggggagggcgattacagcgatgacgaaaccgcggattcgacaaacggtggcgggagattggtggctcctttgatggcggctatggtggcttgtttttcatggttgatttttgtttaaattatttatttttttgta

SEQ ID NO: 5839 - DNA, 1271 bp, Chrysanthemum coronarium
ctaccaccaccaccaccatcgtcgcaaagcgcgcgacaatgtcgccactttccctcgcctttctcgtcctcctcgcgctctcttcgacagttcagagccacaacattaccaaaatcctagctaaacaccctgaattctccacatttaaccattacctcactgtcacacacttggcaaatgaaatcaaccgtaggcagactattactgtctgcgctgttgacaatgccgcaatgtccgacttgattgctaaaggcttatcacttcagactattaaaaatgtgctctcacttcatgtttttgctgattatttcggctcgaagaagctgcatcaggttactaaagggtctacttctactgcaactatgtatcaagctactggtgaagcaccaggtactgccggatatgtccacattactgatgtgaagggaggcaaagtccggttcacaccagaagacaacccttcccaaacagacaccacatacgtcaaatcgatcctcgagatgccgtacaacatctcagtcatccaaatcagcgccatattgaactcaccagaagccgaagcccccacagcagccccagatctaaatttaacttcccttctacagcgcgaaggttgtcaagccttttacgaccttttgacaagctcaggcgcgataggaactttcctaagttccgcggatggcggcgtcactgttttctgtcccactgacgacgccatcactaaattcgcgcccaagtacaaaaacttgacggcttctgagaaaacgtcccttttgttataccacggtgtcccagtttacaactccatgggaatgttgaggtctagtaatggtatgatgaacactctagctaccgaaggcgcgaaaaagaagtacgatttcgacgtgcaaaacgacggaaatgatgttactttaaagactaaagttgtgactgctactattagtggtacagttgtggatgacgagccaattgcgatttacacaattgacaaagtgcttcaaccgcgcgagctttttaaagggaccgtggttgaagctgatgagccggctgcagcgccggctccagcaaaaaagaaaaagaaggccgctaagaaaggcgcggccgcagatgaggacgcggccgcgcctggccccgacggggagggcgattacagcgatgacgaaaccgcggattcgacaaacggtggcgggagattggtggctcctttgatggcggctatggtggcttgtttttcatggttgatttttgtttaaattatttatttttttgta

SEQ ID NO: 5840 - DNA, 1602 bp, Arnica chamissonis
aaatcaatctccgatctcaaattcacgacacacataaacacactctagataactgaaacgccgaatctcgtcaatgccaatggatcaagccgaactcaattccgatcaggttttgaggagggatatcccatgggagacctatatgacaactaagctgatcacgggaacagcccttcagctattaaggcgctatgacaaaaagactgaaaacgaaagggcaccactgcttgagaatgatggtccatcttatatccgtgtttttgtcaacatcttgcgtgacatacagaaagaggacactgtagaatatgtgttggctttaattgatgagatgcttacagcaaatcccaaaagagcaaagttgtttcatgacaaatctcttgaagatgaagatatttatgaacctttcttgagattgttatggaaaggtagctggttcattcaagagaagagctctaagatacttactttggtagtgagtgccaggtcaaaaaaaaatggtctgactgcaaatggagaaggcacaaagaagaaaatcacatcaagtgatgatgttttgaaaggattagtggagtggctttgtattcagcttaaaaagccctcccacccacaccgtagcattccatcttctataaactgcctagcaactttgttaaaggagcctgttgttaggtcttcatttgttcaagcagatgggttaaagctgcttgtgccactaatttctccagcgtccacccagcagtcaattcagcttctgtatgaaacatgcttctgtgtttggctcttgtcctactatgaacctgcaattgaatacttggctacatctagagccctgccacggttgttggaggttgtcaaaggttcaacaaaagagaaggttgtgaggttgatagtgttgactttcaaaaacttgctttcaaaaggaacctttggagctcagatggtaaatcttggacttccacaaattgttcaaagtttgaaagggcaggcctggagtgacgaggacctcttggacgccctaaatcatatggaggaggggctgaaagataatatcaagaaattaagctcttttgacaagtacaagcaagaagtccttcttggtcatcttgattggtctccaatgcataaagatcctaatttctggcgagataatattacaaattttgaagagaatgatttccagactttacgggtcctgctcacaatattggaaacatcaagcgacccaagggcactagccgttgcttgctttgatctgtcccagtttattcagtaccatcctgcaggccgcgtcatagtcaccgacctcaaagcgaaagagcgggtaatgaaactgatgaaccatgagaacgccgaggtcaccaaaaacgccttactctgcatccaaaggcttttccttggagccaagtatgcaagctttttgcaggcttaattaatcatgtgcccttttatgttcactggtttcctttatgaataaagatgcattttctgtattttttatgtttatgaataaaaaattgagggatattagtattttattattattatttttattactgtaaattaaacttaatctatgtatttagtttggtgttgggtgatgca

SEQ ID NO: 5841 - DNA, 1761 bp, Chrysanthemum coronarium
aaatgaggttaatcaaacaaaccaaatccttgatctcaaactcaccacaaaacacacacatcacacaactagatttataactaactcatcatcataatcattatcaataatgccgatggatcaagcagagctcaattccgatcaggttctgaggagggacatccaatgggagacatacatgacaactaagctgataacagggacatcccttcagctattaaggcgctatgacaaaaagactgaaaccgaaagggcatcactgcttgagaatgacggtccatcttatatccgtgtttttatcagcatcttgcgtgatatacagaaagaagacacggtcgaatatgtgttggctttaattgatgagatgctaacagccgacccaaaaagagcgaagctgtttcatgacaagtctcttgcagatgaagatatttatgaacctttcttgagattgttatggaaaggcagctggtttattcaagagaagagctccaagatacttactttggtagtgagtgctaggccaaagcagtatggttcgagcgccaatggtgaatccgcagattcaaagaagaaaatcaccgcaagtagtgatgttttgaaaggattggtggagtggctttgtattcagctgaaaaagccttctcatccgagccgtagcattccagcttcggtcaactgcctatcaactttgttgaaggaacctatcgttaggtcttcatttgttcaagcagatggggttaagctacttgtgccacttattgtaccagcatccactcagcagtcgattcagcttctctatgaaacatgcctctgtgtttggctcctatcctactatgaacctgcaattgagtacttggctacatctagagccctgccacggttgttggaggttgttaaagcttcaacaaaagagaaggttgtgaggttgatagtgttgactttcaagaacttgcttgtgaaaggaaccttcggagctcaaatggtagatcttggacttccacaaattgttcaaagtttgaaagcacaggcatggagtgacgaggacctcttggacgctctaaataatctggaagaagcgctgaaagataatattaagagattgagttcttttgataagtacaagcaggaagtccttcttggtcatcttgattggtctccaatgcataaagatcccaatttttggagagagaatatcacagccttcgaagagaatgatttccagacgctacgggtcctgctcacgatactggacacatcgagtgatccaagggcactagcagttgcttgctatgatctttcccagttcattcagtaccatcctgctggtcgggtcattgtcacagacctcaaggcaaaggagcgggtcatgaaactgatgaaccacgagaacgctgaggtcaccaaaaatgccctactctgtatccaaaggctcttccttggcgccaagtatgcaagctttttgcaggtttaatatacacgtatggatcaaatcgtctctgcacgagttagtggacttcatttgtcaaaatgtttgagcatatgcgtctcttgggcacttctctgttaaggcttgttattattcgttttaacggtttctttttgaataaaagttgaagtctgtaatttttttatgctgtttatggatggtgaataaaataaaggttgaggggtattcatatttatatttattaatatttatattgttgtaaatcactaaagtgaattcggttgatgtgataaatttgtttattgggcgatgca

SEQ ID NO: 5842 - DNA, 1751 bp, Tabernaemontana elegans
ggtcgaccatagacgcgatctcagattgattgccactgcctagtggattggatccgacgacgattttatacacgaaatgacgatggatcacgccgaactcacaaccgagcaggttttgaggagagacattccatgggagacatacatgacaactaaactgatcactggaactggtcttcagctgttaaggcgatatgataaaaagactgagagttacaaagcccagttgctggacgatgatggtccagcttatgttcgtgtatttgttagcattttacgagacatattcaaggaagaaacggtagagtatgttctagctttaattgatgaaatgctcactgcaaacccaaaaagagcaagattgtttcatgacaagtctcttgcaaatgaagacacttacgaaccattcctaagactgctctggaaaggtaactggtttatacaagagaagagctgtaagatactgtctcttatagtaagtgctagaccaaaggttcaggatggtatcactgcaaatggaggagcatcagattcaaaaaagacatctacttccattgatgatgttttaaagggcctagtggagtggctttgtgctcagctgaagaagccttctcatcccattcgtggcattcccactgccattaattgcttagcaactctccttagagagccaatggttcgatcttcatttgttcaggcagatggagtgaagttgcttgttcctctaatatcaccagcatccactcagcagtccatccagctcctgtatgaaacatgcctgtgtgtatggcttttatcttactatgaacctgcagttgagtacttggctacttctagggctctgccgcgattaacggaagttgttaaaggttcaacaaaggaaaaagtagtaagggttgtgatcttaactcttagaaacttgctccaaaaggggaattttggtgctcagatggtggacttgggactgctacaagttgttcaaagtttgaaagcacaagcatggagtgatgaggatttattggaggctctgaatcaactggaagaaggactgaaagacaacattaagaaattaagttctttcgataaatacaagcaggaggtccttcttggccatcttgattggtccccaatgcacaaagatcctgtattctggagggagaacattaagaactttgaagagaatgattttcagatcctgcgagtcctcctcacaattttggagacatccacagatccaagaacactcgctgttgcttgctttgatctctcacaattcattcaaaaccatcctgctggtcgggtcatcgtgactgatctgaaagccaaggaacgggtgatgaagttgatgaaccacgagaacactgaggttaccaaaaatgccctgctctgcatccaaaggcttttcctgggcgccaagtatgccagctttttgcaggtataagtctcaaagtttcccagattgatcttgaggatatcgatcgagaaattggaaattggctgtgcagtagtttgtggtttaatttgtttcgagtattgtagctaaggcccatatttcatccagtgtctgtatggttgagtttgaagagctatttatttattttggcattatgtcccaattaaataaatgtttgaaatctaccctgtcgtttggttctacgccatggcctaataagacgagtggaaaatcttctctgccatttttcggttgtcagaggaatattttggagcaattcattcttttgtaatttgct

SEQ ID NO: 5843 - DNA, 1749 bp, Catharanthus roseus
agagacgaaggaacgtggagaagtgccattaataagagaagaaggtccgaccatagacgcgatctgagattgattgccattcccacagtggattggatccgacgacgaatttcacctacaaaatgacgatggatcacgccgaactcactaccgaccaggttttgaggagagatattccatgggagacatacatgacaactaaactgatcactggaactggtctgcagctgttaaggcgatatgataaaaaagctgaaagttacaaagcccaattgctggatgatgatggtccatcttacattcgcgtatttgtcagcattttacgggacatattcaaggaagaaacagtagagtatgttctagctttgattgatgagatgctcactgctaacccaaaaagggcaagattatttcatgataagtctcttgcaaatgaagacacatatgaaccattcttaagactgctctggaaaggtaactggtttatacaagaaaagagctgtaagatactctctcttatagtgagtgctaggccaaaagttcaggatggtgtcactgcaaatggagaagcatccgtttcaaaaaagacatctacttccattgacgatgtcttgaagggcctggtggagtggctttgtgctcagctgaagaagccttctcatcctatacggggcattcctagtgccattaattgcctcgcaactcttcttagagagccaatggttcgatcatcatttgttcaagcagatggagtgaagttgcttgttcccctaatatcaccagcatccactcagcagtccatccagctcctgtatgaaacatgtctatgtgtatggctcttatcttactatgaaccagcagtcgagtatttggctacttctagggctctaccgcgattaactgaagttgtaaaaggttcaacgaaggaaaaagtagtcagggttgtaatcttaactcttagaaacttgctccaaagggggaattttggcgctcagatggtggatttgggacttctacaaattgttcaaagtttgaaagcacaagcgtggagtgatgaggatttattggaggctctgaatcaactggaaggaggactgaaagaaaacattaagaaattaagttctttcgacaaatacaagcaggagatccttctcgggcatcttgattggtcccctatgcacaaagatcctgtattctggagggagaatattaacaactttgaagagaatgatttccagatccttcgagtcctcctcacgattttggagacatccactgatccaagaacactggctgttgcctgctttgatctctcacaattcattcaaatccatcctgctggtcgggtcatagtgaccgatcttaaagccaaggaacgggtgatgaagttaatgaaccatgagaactcagaggttacaaagaatgccctgctttgcatccaaaggcttttcctaggtgccaagtatgccagctttttgcaggtctaaactgttggaagttttcgagattgactttaaatggaagcaggctgtgcagtaatgcgcggtattaatttgtttccagtattgtatcttaaggcgcatgttttatttgtccgcttgagttaaaagagttatttatcttggcattatttccaagtaaataattgtttgaaaatctacccttttgtttggttctgctctatggcctaataagatggaggggaaatctttgtctgcctttcctcagttgtcagagaattatttattt

SEQ ID NO: 5844 - DNA, 1812 bp, Amsonia hubrichtii
gggcgaccgtagacgcgatctcagattgattgccaccgcaaaggggattggatccgacgacgaatttacctacaaagtgacgatggatcacgccgaattcacaaccgagcaggttctgagaagagatattccatgggagacatacatgacaactaaactgatcactggaactggtcttcagctgttaaggcgatatgataaaaaggctgagagttacaaagcccaattgctggatgatgatggtccagcttatgttcgcgtatttgtcagcattttacgagacatattcaaggaagaaacagtagaatatgtcctagctttgattgatgaaatgctcactgcaaacccaaaaagagcaagattgtttcatgacaagtctgttgcaagcgaagacacctatgaaccattcctaagactgctctggaaaggtaactggtttattcaagagaagagctgtaagatactctctcttatagtaagtgctagaccaaagcttgacggtggtatcaccgcgaatggagaagcatcttcaaagcagaaatctacttccatagatgatgttttgaaaggccttgtggagtggctttgtgctcagttgaagaaaccttctcatcctattcggggcattccctctgccattaattgccttgcaactctccttagagagcctgtggttcgatcttcatttgttcaagcagatggagtaaagttgcttgttcctctaatatcaccagcatccactcagcagtccatccagctcctgtatgaaacctgtctatgtgtctggcttttatcttactatgaaccagcagttgagtatttggctacttctagggctctaccacgattgactgaagttgttaaaggctcaacaaaggaaaaagtagtccgggttgtcatcttaactcttaagaacttgctccagaaggggaattttggtcctcaaatgatggacttgggactgcttcaaattgttcaaagtttgaaagcacaagcatggagtgatgaggatttgttggagtctctgaaccaactggaagaaggactgaaagaaaacattaagaaattaagttctttcgataaatacaagcaggaggtccttcttggccatcttgattggtctccaatgcacaaagatcctatattctggagggaaaacattaccaacttcgaagaaaatgatttccagatcctgcgtgtcctcctcacaattttggagacatcaactgatccaaggacgctcgcagttgcctgctttgatctctcacagttcattcaaaaccatcctgcaggtcgggtcataatgactgatctgaaagccaaggaacgggtgatgaagttgatgaaccacgagaacactgaggttaccaaaaatgccctgctctgcatccaaaggcttttcctgggtgccaaatatgccagctttttgcaggtttagtctcaaaagttttggagatggatggaaagtggaaattggctgtgcagtagtttgtggtttagtttgtctggagtattgtatctaaggggcatatctcatccggtgtctgtatgatcgactttgaagagctatttattttggcagtctggcctaattaaataaaaatgtttgaaatctacctttctgtttgtttctgcactacagccaaataagacgagggaaaatcttttctctgccttttttttgtcagttgtcagagaataattcattcttttgttgtttgcttttctggatctagtgtatgtaaaatcattgtaatgaattcggaatgctatttagaactctcttcgaatgtactaagaccctttttgcaa

SEQ ID NO: 5845 - DNA, 1727 bp, Vitis vinifera
tctctctctctaaaaatctttattctctctctagattttcactgaattcactgtgtggaagaagccgaaccctaaattcttagcttcaattctcaatggaccgtgccgagctcactactgaccaggttctgaagagggacatcccatgggagacttacatgactacgaagctaataactggaacatgtcttcagctgttgaggcgttacgataacagatctgagagtcaaagagctgtattgcttgatgatgatggtcctgcttatgttagggtgtttgtgagcattttacgtgatatattcaaggaagaaacagttgaatatgtgctggcactgattgatgaaatgctaactgcaaatccaaaaagagccaaactattccatgataagtctcttgctaatgaagatacttatgaacctttcttaagattgctttggaaaggtaattggttcgtacaagagaagagctgtaagatactggctctgatagtgagtgcgaggcccaaaacccaggatggtgttctttctaatggggaatcctcaaactcaaagaagaaattcgttactattgacgatgtgttgagaggattggtggaatggctttgtgcacagctaaagaagccttcacatcctacccgtggcattgccattgctatcagttgccttgcaacattactgaaggaacccttggtcagatcttcctttgttcaagcagatggggtgaagttgcttatccctttaatttctccagcatccactcagcaatctatccagctactttatgaaacttgtctttgtgtttggctcttatcttattatgaacctgcaatcgagtacttggctacttctagaaccctaccacgactagtagaggttgttaagagttcaacaaaagaaaaggttgtcagggttgttgtcttgacccttaagaacttgctttcaaagggggcgtttggtgctcagatggtagaccttggactgctgcaaattgttcagagtctgaaagcacaggcatggagtgatgaggacctgttggaggctctgaatcaactagatgaagggctgaaagctaacattaagaaattgagctcgtttgataagtacaaacaagaagtcctccttggccatcttgactggacccctgttcacaaagatcccatgttctggcgtgataacattagtaactttgaagagaatgatttccagattcttagggtcctcattacaattttggacacgtccagtgacccaagggcgctggctgtagcgtgctttgatctgtcacagttcattcagtaccatccagcagggagggtcattgtaaacgatctcaaggcgaaggagcgggtgatgaaactgatgaaccatgagaatgcagaggttaccaaaaactccctcctctgtatccaaaggctcttcctaggtgccaagtacgcgagctttttgcaggcttaatcatataaataaattaaattaaattcttggggtatatccttctccagaaattacttttttatgtaattttatcaaagaaatgatgcagaagtcaagctgcttagtattttaggtggtttcggttatgttgttatctgagtaattcatcatcatcatcgtccatcgggtgatccgatcttacctgaactggtgacagatttgtttgtttcattttcttgggaagtattttccttttctttttcttttgaactgaatggaggaataaaatctcgg

SEQ ID NO: 5846 - DNA, 1718 bp, Rhizophora mangle
aacgaaaacgagagaagagcacttggcgcagatttcaatcaggtcttgaaattgggcgtaaggcggtgccgttttgtgtttgagttgtttcagtgagcaatggaccatgccgaactaacaacggagcaggtactgaagagggacatcccgtgggagacttacatgactactaggctgatatctggaacggaccttcagcttttaaggcgttacgataatagatctgaaatttacagggcacagttgctagatgatgatggtccggcttatgttcgagtatttgtgagcattctgcgtgatatatttaaggaggagacggttgaatatgttctggctttaattgatgaaatgctaacggcaaatccaaaaagagccagactattccatgataaatctcttgcaaatgaagacccttatgaacctttcttaagattgttgtggaaaggtaactggttcattcaagaaaagagctgcaagacactagcttcggtggtaagtgctaggccaaaagctcatgatggtgtgctttcaaacggtgaagcctctaactccaagagaaaagttactagcattgatgatgtgttgaaaggattggttgaatggctttgtgctcagctgaggaagctgtcacatcctagtcgtgctatcccaattgctgttaattgtctagcaacattacttaaggaacctgttgtcagatcatcatttgttcaagcagatggggtgaagttgctagttcctttaatctcacctgcaaccacccagcaatccatccagcttctgtatgaaacatgtctgtgtgtgtggctattgtcttattatgaacctgcaattgaatacttggctacttctagagccttgccacgacttattgaggtcgtaaagacttctacaaaagagaaggttgtcagggtgattgtcctgacctttaggaacttgctttcaaaaggtacctttggtgctcagatggtagactttggactgccacaaattgtgcaaagtttgaaggcacaagcatggagtgatgaggacctactggacgctctaagccagctggaagatggactgagggacaacatcaagaaattgagttcttttgataagtacaagcaagaagtcctccttgggcagcttgactggtctcctatgcacaaagatcctacattttggcgtgagactattacaaattttgaagataatgatttccagattcttagggtccttataacaattttggaaacatctagcgacccaagagcactggcagttgcttgttttgacctctcgcagtttatccagtatcatcctgctggacggattatagtgacggaccttaaggctaaagaaagagtgatgaagctgatgaaccatgaaaatgctgaagtcacgaaaaatgccctactctgtatccagaggcttttcctaggtgccaagtatgcaagcttcttgcaggcttgaacggtgtatccgggtgtgtaataatgcttcatactgcacttgctgctgtcgactattggaacaagaatgattatgacggttggtcaatttttggtaatttattaccatatgagctgaaaatcaatttaaatcaaccttgttacctgaggttgactaaagatttatgtgaagattatttgctcaacgaaattgcctatattatttttcaagaccaggaggcttggactagaaaacaatggttgtacattcttttgttgtat

SEQ ID NO: 5847 - DNA, 1654 bp, Platanus occidentalis
tcaggcagagttaacgatggaacaggttctcaagagggacattccatgggagacttacatgacaactaagctgattacaggaacatgccttcagctcttaaggcgttatgataacagatctgaaagttaccgagcaacactacttgatgatgatggtccagcttatgttcgggtatttgttaacattttgcgtgacatattcaaggaagaaacagtggaatatgttctagctcttattgatgaaatgctcacagcaaacccgaaacgggcccgacttttccacgacaaatctctggcaaatgaagatacttatgaacctttcttaagattgctttggaagggtaactggttcatacaagagaagagctgtaagatattatcattgattgtaagtgctagacgaaaccccaggatggttttattgcaaatggagcttcacattcaaagaacaagtttacatccattgacgatgtgttgaaaggattggtggaatggctctgtgcgcagctgaagaagccttcccatcctacccgtggcatcccaactgctatcaattgcctagcaactttgctgaaggaacccttggttagatcttcttttgttcaagcagatggggtgaagctgctcattcctttgatatctccagcatccacccagcaatctattcagctcctttatgagacatgcctttgtgtgtggctgttgtcctactatgagcctgcagtggagtacctggcaacttctaggacgctgccacgactaatagaggttgttaaaggttccactaaggagaaggttgtgagggttgttgtcttaacccttaagaacttgctcccaaaagggacatttggggcacaaatggtagaccttggattgccgcaaattgttcagagcctgaaagctcaagcatggagtgatgaggatctgttggtggctctgaatcaattggaagaggcgcttaaagataatattaagaaactgagttcttttgataagtacaaacaagaagttcttcttgggcatctagactggtcacctatgcacaaagatccaattttttggcgtgaaaacatcatgaactttgaagagaatgatttccagattttacgggtcctcatcacaatccttgacacatctgctgattcaagggcactggcagttgcttgttatgatctctcacaattcattcagtaccatccggctggaaggatcatagtgactgatctcaaggcgaaggagcgggtgatgaagctgatgaatcacgagaatgcagaggtaacaaagaatgcccttctatgtgttcagaggcttttcctgggtgcaaagtatgcaagctttttgcagggttaactccatgttgtgatgcgtgggtgtacaactctgaaagttccaagtgtgttatgaatttgtggacatcaaggtactgcagaacattatctggttatagtagggagtactgagatggtctctgttaccattcgagtaatttatcattggaggcttgtattagcgaggatcttctatactcaatttatgttgaaggaaaattgcattcatagaataataatttgtttctgtacttctcttttcttgagatggttaactatgaataagatcatttaacatcttgtaattttatgtacttataaatatc

SEQ ID NO: 5848 - DNA, 1701 bp, Vinca minor
attaatagaagaggaaggaacgtcgaccaccatagacgcgatctcagattgtgatttccactccagtgtgaaattggatccgaccacgaatcacgatggatcatgccgaactcacttccgagcaggttttgaggagagatattccatgggaaacatacatgacaactaaactgatcactggaactggtctgcagcttttaaggcgatatgataaaaaatctgagagttacaaggcccaattgctggatgatgatggtccagcttatattattgtacttgtcagcattttacgagacatattcaaggaagaaacagtagagtatgttcttgctttgattgatgaaatgctcactgcaaaccccaaaagagcaagattatttcatgacaagtctcttgcaaatgaagacacttatgaaccgttcttaagacttctttggaaaggtaactggttcatacaagaaaaaagctgtaagattctctctcttatagtgagtgcaaggccaaaggttcaggctggtatcactgcgaatggagaagcatcagtttcaaaaaagacctctacatccattgatgatgttctcaaaggactggtggaatggctttgtgctcagctgaagaagccttctcatccggtacggggcattcccagtgccattaattgccttgcaactctccttaaacagccaatggttcgatcatcctttgttcaagcagatggtgtaaagttgcttgttcccctaataataccagcatccactcagcagtctatccagcttctgtatgaaacgtgtctctgtgtatggcttctatcttactatgaaccagcggttgagtatttggctacttctagggctctaccgcgattaagtgatgttgtaaaaggttcaacaaaggaaaaagtagtgagggttgtaatcttaactctcaggaacttgctccaaaaggggaactttggcccccagatggtagacttgggactgctacaaattgttcaaagtttgaaagcacacgcgtggagtgatgaggatttattggaggctctggatcaactggaaggaggactgaaagacaacattaagaaactaagttctttcgacaaatacaagcaggaggtccttcttggccatcttgattggtccccaatgcacaaggatcctatattttggagggagaatattaacaactttgaagagaatgatttccagatcctgcgagtcctcctgacaattttggagacatcaactgatccaagaacacttgcagttgcttgctttgatctctcacagtttattcaaacccatcctgctggccgggtcattgtgactgatctcaaagccaaggaaagggtgatgaagttgatgaaccacgagaacaccgaggttaccaaaaatgcccttctctgcattcaaaggcttttcctaggtgccaagtatgccagctttttgcaggtataatctcaaaagttttcgagattgatcgaaaatggaagtcatctgtgcagtagtttgttgttttgagtattgtatctaaggcgcaaattcatctggtgtctgtatgatcgagtagaaagggctatttattttggcattatgtcccaattaaataaatgtttgaaattctaacactaattttgtttgattctgcactatggcctaataagaggaggggaaaatattttctctgtttttttttgtggttgtc

SEQ ID NO: 5849 - DNA, 1396 bp, Manihot esculenta
tatcaatggcccaagccgaactgactacagagcaggttcttaagagggatatcccatgggagacttacatggcgacaaagctgatctcaggaactgaccttcagctgttgaggcgctatgataatcgatctgaaagttacagggcacagttgttagatgatgatggcccagcttatgttcgggtatttgttaacatcttacgggatatatttaaggaagaaacagttgaatatgttctggctttagttgacgaaatgctaacagctaatccaaaaagagctagactattccatgataggtctcttgcaaatgaggatacttatgaacctttcttaaattgctttggaaaggtaactggtatgtacaagaaaagagctgcaagattcttgctctgatagtaagtgctaggcctaaaactcatgatggcattactgcaaatggacaagcctcaaattcaaagagtaaagtcactttcattgatgatgtgttaaaaggattggttgaatggctttgtgctcagctgaagaagccttcacatccgagtcggggtgttccaactgctattagttgcttagcaacattactcaaggaacctgtagtgagggcctcatttgttcaagcagatggagtgaagctgttgattcctttaatttctcctgcatctacccagcaatctatccagcttctctatgaaacatgtctctgtgtctggctattatcttactatgaaccagcaattgaatacttggctacttctagatccttgccgcgactaatagaggttgtaaagagttccactaaagaaaaggttgtcagggtgattgtcttgacctttaggaacttgctttccaaaggtacatttggtgcacagatggtagaccttggtctaccacaaattgttcaaagtttgaaagctcaagcatggagtgatgaggacttgttggaggcgctgaaccaactggaagatggcctgaaggataacattaagaaactgagttctttcgacaagtataagcaagaagtcctccttgggcatcttgactggtcccctatgcacaaagatcctgtattctggcgtgaaaatattaacaattttgaagagaatgatttccagattctgagggtccttattacaattttggacacatctaatgacccaagagctttagctgttgcttgctttgatctctcccaatttattcagcaccaccctgctgggcggattatagtgacagacctcaaggccaaagaacgggtaatgaaactgatgaaccatgaaaatgctgaagttaccaaaaatgccctcctctgcattcaaaggcttttcctaggggcaaaatatgccagctttttgcaggcatgattcaacggtgcagtgcgcaataatagtgtaatg

SEQ ID NO: 5850 - DNA, 1791 bp, Citrus clementina
ctgtattgttttcatttgattcaaagctcttcacgagcactgtcttctcgccagaattaacgagacggtggtggaagaaagagaaataaacaaaattcaggtatttgaattggagtaattttgtgaggttttgagtattttagtatcaatggaccatgctgaacttaccacagagcaggttctgaagagggacatcccatgggagacttacatgacaacgaagctgatttcaggaacagggcttcagctgttaagacgatatgataacagatcagaaagtcaccgggctcaattgctggatgatgatggtccatcttatgtccgggtgtttgttagcattttaagagacatatataaggaagaaacagtggaatatgttctggctttaattgatgagatgctgacagccaatccaaagagagccagattattccatgataaatctcttgcaagtgaagatacttacgaacctttcttaaattgctgtggaaaggtaattggttcatacaagaaaagagctgtaagatattagcttcgattgtaagtgctaggccaaaaccacaggatcgcttttttgctaatggggaagcctcaaattcaaaaagcaaatccactaccattgatgatgttttaaaattattggttgaatggctttgtgcacagctgaagaagccttcccatcctagtcgtggcgttccagttgctatcaattgccttgcagcattactgaaggaacctatggtgagatcttcctttgttcaagcagatggggtgaagttgttgacccctttaatttcacctgcatccacacagcaatctatccagcttctttatgaaacatgtctctgcgtctggctcttgtcttactatgaacctgcagtggagtacttggcaactactagaaccctgccacgactaatagatgttgttaagagttccacaaaggagaaggttgtcagggtggtggtcttgatccttaggaacttgcttcccaaaggtaattttgctgctcagatgatagaccttggactacctcaagttgttcaaagtttaaaagcacaagcatggagtgatgaggatttactagagggtctgaatcaactggaagaaggtttgaaggataatattaagagattgagttctttcgacaagtacaagcaagaagtcctccttggccatctcgactggtcccctatgcacaaagatcccctattctggcgtgataatatcacaaactttgaagaaaatgatttccagattctaagggtcctcttaacaattttggatacatccagtgatccacgagctcttgctgtcgcttgctttgatctctcacagtttatccagtaccatccagctgggcgggtcattgtgacagacctcaaagccaaggaacgggtgatgaaattgatgaaccatgagaataccgaggttaccaagagcgccttactctgcatccaaaggcttttcctaggcgcaaagtacgcgagctttttgcaggcctgaattctctttctatggggtccagtattgtttacaaaggaaatgcttgtaatgatttgattccagtttggctggttaggttgtttatttatttatcaatcattggaggaatttatgaatcaggggaactcgtctgttggatttttttaagtactgtgaagaattagttgattttttaccatattttggaaatttattttgtttgtgagatgaggaataaattgataccatctgtactgacctttgatatgaaaactactcgagcgcatgacatatatctgtttttgt

SEQ ID NO: 5851 - DNA, 1871 bp, Panax ginseng
aagcagtggtatcaacgcagagtacgcggggactcccgatccactaaataactatcgaacgaaaaactcagattatctctctcttcttttctcgtctgaagcacttcgattccaaaccctgtaaatgccgatggatcaagccgagctcactagcgaacagattctgaagagggatatcccgtgggagtcgtacatgacaactaagctgatctcggggacaggacttcagctgttaaggcgttatgataaaaaacctgaaagttccaaggcacagttgctggatgatgatggtccagcttatgttcgtgtgtttttcaccattttacgtgacatattcaaggaagaaacagtagaatatgttctagctttgattgatgaaatgctaacaggaaaccccaaaagagccagattattccatgacaagtctgttgcaagtgaagatacttatgaacctttcctaagattgctctggaatggaaattggtttattcaagagaaaagctgtaagatcctttccttgataataagtgctagattaaaaactcaggatggtgtcaccatgaatggagaagcctccaattcaaagaagacattcactacagttgatgatgttttgaaaggactggtggagtggctttgtgctcagctcaaacagccttcccatcctagccgtggcattcctacaactatcagttgcctggcaactttactgaaagaacctgttgttagatcttcatttgttaaagcagattgggtgaagctgcttgttcctctgatttctccagcttccactcagcagtccatgcagctcctttatgaaacatgtctctgtgtttggcttttgtcatactatgaacctgcaattgaatacttggctacttctagaagcttgcagcgattaatcgaggttgttaaaggttccacaaaagaaaaagttgtccgggtgattgtcttgacactcaaaaacctgctttccaaaggtagttttggagctcaaatggtagaccttggactgccacaggttgttcagagtttgaaagcacaagcatggagtgacgaggatctgttggaagctctgaatcaactagaagaaggactgaaagaaaaaattaagaagttgagttcttttgaaaagtacaagcaggaagtccttcttggtcatcttgactggtcccccatgcacaaagatccaatattctggcgtgataacattacaaactttgaagagaatgatttccagatcctaagggtcctcattacaattttggacacatccggtgatccaagggctctttctgttgcttgctttgatctctcacaattcattcagtaccaccctgctggtcggattatagtgactgacctgaaagcaaaggagcgggtcatgaaattgatgaaccatgagaatgcagaggttaccaaaaacgccttgctctgcatccaaaggcttttccttggtgccaagtacgcaagctttttgcttgcttaagttgtttttcttgaacttgttgctctaccaaatcaaaattttaaaatgaaataatgtgagggttggttgtgcagtagcaataatctaggacctttctttcataggctactccaatgctttggttcagagttgatatttgttttgtaaaattatgcaataaaacaaacatttgtatttataattgttctagctagcccagagatttccacctggccaataattaaatgtatttgtattgaacaataattatttttagtaatgatgcatttggcagctttggaataaagaaaaaaaaaaaaaaagaaaaaaaaagaaaaaaaaaagaaaaaaaaaagaaaaaaaaagaaaaaaaagaaaaaaagaaaaaagaaagaagaagaag

SEQ ID NO: 5852 - DNA, 1824 bp, Prunus persica
gtcctctcccttctctaattcatctctttcctgcgtgcgtcctgagtcctgacgaagccacacagatacagacacagacacagaggtacccgaattggtaaaattgggagataattttggacttgtttttgtgttatcagagcagcaatggaccatgctgagctcaccactgaacaggttttgaaaagggacatcccttgggagacatacatgaccactaagctcatcactggaacgtgccttcagctgttaaggcgttacgataaaagatccgagagtcacagatcacagttgctcgatgatgacggccctgcttatgttcaagtgtttgttggcattttacgtgatattttcaaggaagaaacagtagaatatgtccttgctttaattgatgaaatgcttgcggctaacccaaaaagagcaagattgttccatgatggtactattgtcgataaagatatttatgagcctttcttgaggttgctttggaagggtaattggttcatacaagagaagagctgtaagatacttgccctaatagtgagtgccaggccaaaaccccaagatggcactgttgcaaatggggaagcctcaaattcaaagagaaaaattactactattgatgatgtgttgaaaggattggtggaatggctttgtgcacagctgaagaagccttcccatcctagtcgcggcatcccaactgctgtcaattgccttgcaaccttattaaaggaacctgtggttagatcttcctttgttcaattagatggggtgaagttgcttgttcccttaatttctccagcttccacccaacaatccattcagcttctttatgaaacatgtctatgtatctggctcctatcctattatgaacctgcgattgagtacttggccacttctagaactcttccacgactcatagaagttgtcaagagttccacaaaggaaaaggttgtcagagttgttgttttgaccctgaggaacttgctctccaaagggacgtttggtgctcaaatggtggaccttggactgccacaaatggttcagagtttgaaagcacaagcatggagtgatgaggatcttctggagggattaaatcaactggaagagggtctgaaggataacatcaagaaactgagttcttttgataagtataagcaagaagtcctccttggccatcttgactggtcacccatgcacaaggatccaatattctggcgcgagaatgttaccaattttgaagagaatgattttcagattctaagagtcttgattactattttggacacatccagtgaccctagggctttggctgttgcctgctttgatatctcacagtttgtccagcagcatccggctggaagaatcatagtgacggacctcaaggccaaggaacgtgtgatgaaactgatgaatcatgagaatgccgaggttacgaaaaatgcattactatgtatacagaggcttttcctaggtgccaagtatgcgagctttttacaggcttagatcgtttcaatggtggagcaatgatgcaccgaatgagtcataatcttattgtccaaaagtggtgttaatgaatgggtgacactgtcatagtagtggtttacatattattattatttcagtaattcattttatacgactcttggttatgaacagcgtttggaaatttgatttgttgctatgtgttagctgtggaatattattcttgctaatgaggtatggaataaaataaattatgtaatcccattggtaaaatatatattttgtgagcctgtcagtgtctatcaatcagaatcagtagagcgatgtttgttggagtaa

SEQ ID NO: 5853 - DNA, 1818 bp, Actinidia deliciosa
tacccacttcgctcaatgattcggactatttgcaatgggatgatacactgaaaggcctaatgggcttccaatgtgcccacacattattgtacacggggagagagagagtgggatctcgttactgattcgaggttgagagtaatctcagatccgatttgatcttcaaatattgatcttgtttcctcagctcctcaaattctacaatgccgacggaacatgctgagttaaccacagagcaggttctgaggagggatatcccatgggagacatacatgacgactaaattgatcacaggaactggccttcagcttttaaggcgttatgataacagatcagaaagtgaccgagcagccttgctggacgatgatggtcccgcctatgttcatgtgttcgtaagcatattatgtgacatattcaaggaagaaacagtagaatatgttcttgctttaattgatgaaatgcttacagcaaaccccaaaagagccagattattttatgacaagtctcttgcaagtgaggatacttacgaacctttcttaagattgctttggaaaggtaactggttcatacaagaaaagagctgtacgatactttctatgatagtgagtgctaggtctaaaaaccaaggaggtgtcactgcaaatggagaatcatcaaattcgaagaaacagttgactaccattgatgatgttttgaaagggctggtggaatggctttgtgtacagctgaagaatccttcccaccctagccgtggtatcccaacagccatcacttgtctggtgacattattgaaggaacctgtggcaaggtcattatttgttcaagcagatggagtgaagttgctccttcctctaatttctccagcatccactcagcagtccatccagctcctttacgaaacctgtctgtgtgtttggctcttatcttactatgaacctgcaattgagtacttggctacttctagaacccttcaacgattaatcgaagtcgtgaagggttccacaaaggagaaggttgtcagggtggttattttaaccctccggaacttgcttccgaaagggacttttggtgctcagatggtagaccttgggctgccccaaattgttcagagtttgaaagcacaggcatggagtgatgaggacctgttggaggctctaaatcaactggaagatggcttgaaagctaacattaagaaaatgagttcttttgacaagtacaagcaggaagtcctccttggccatcttgactggtcccccatgcacaaagatcctatattctggcgtgagaacattacaaaatttgaagaaaacgacttccagatcttgagggtccttattacaatcttggacacatctggagatcccagggcactggctgttgcttgctttgatctgtcacagtttatccagtaccatcctgctgggcgggtcattgtgaccgatttgaaggccaaagagcgggtgatgaaattgatgaaccatgagaatccagaggtcaccaaaaacgccttactctgtatccaaaggcttttccttggtgccaagtatgcgagctttttgcaggcttaaatcttttctattctatgatatttgtttcataatggcttcttagatgagcaaacgtgagagacggctctgtactggttaaatggttttgttgtcggaactctagttgtgtgtcgtctaggcccatcttgtatcaggtatttgttgtgaatgaattgacaataattattttttcctgtcaagttgtggaagggaataaatgtttgtattctcgtgcttgatcgaatggggaataaatatttgatttttgtgc

SEQ ID NO: 5854 - DNA, 1802 bp, Sesamum indicum
ctctctcttccttcccctgtctctctctagatttcgatctgtcgcaaacaactttgttaatttggaattcgcaattttcgccaatgactatggatcaagccgagctttccaccgaacaggttttgaggagggatattccgtgggaaacttatatgactacgaagctgatcacagggacagggcttcagctgctgcggcgatatgataagaaacccgagaattacaaggctcagttgctggatgatgatggtccagcttatgtacgtgtctttgttagcattttgcgtgacatattcaaggaagaaacagtagagtatgttttagcattaattgatgaaatgctgtcagcaaaccctaaacgagcaagattattccatgataagtctctgaaagatgaggacgtatacgagcctttcctaagattgctttggaaaggaaactggtttacacaagagaagagctgtaagatactttctttgatcgtaagtggaaggccaaaatctcaggatggtgccgttgctaatggagcatcaaattctaagaaggagatcactactattaatgatgtgttgaaagggctggttgagtggttgtgcacacagctgaagaagccatctcatcctagccgtggtgttccaacagctattaattcccttgcaactctactgaaagagcctctggtgcgatcttcatttgttcaatcagatggagtgaagttgctcattcctctaatttctccagcatccactcaacagtccatccagctcctctatgagacctgtctttgtgtatggctcctctcgtactatgagcctgcaattgagtacttggctacttctagatccttgccacggttgattgaagttgttaaaggatccacgaaggagaaagttgtccgggttgttatcttgactcttaggaatttgctacacaaagggacatttggtgctcagatggtagacctgggattgccacagcttgttcagaatttaaaagctcaggcatggagtgatgaggatctgctggaatctctgaatcaattggaagaaggactgaaagttaacatcaagaaactaagttcttttgagaagtataaacaggaagtcctccttggacatctcgattggtcacccatgcataaagaccctgtattctggcgggagaacatcacgaactttgaagaacatgatttccagattctaagggtcctgatcacaattttggacacggcaagtgatcctagaacacttgctgttgcctgctatgatatctcacagttcattcagtaccatcctgctgggcgtatcatcgtgactgacctcaaagccaaggagcgggtcatgaaattgatgaaccatgagaatgcagaggttactaaaaatgccttgctctgcatccaaaggctgttcctaggtgccaaatatgcaagctttttgcaggcttaataattgattgtagaaatttatcgggccaggtttttcaggtttgatttatgaggatttttccgaacaagtactgcttgggttgtgtgtattacttaattttttctgatcggagcattgcacatctagtgcttatttcaacagatgttcataatgatcgatgtgtgaacaattacttgtattttgccatacaccatccaataagttggcagtgtttgtatttttatgtttggcctaccatcaccgatgttattctttgggccaacatttgacctgaatatttcgaattttattgtattgagggaatttttacccaaatttggttacatgttccatttaagggaaatgccacaagttctg

SEQ ID NO: 5855 - DNA, 1653 bp, Triphysaria pusilla
gtataattctggtttctgctgatcacgctctatctccaatctccagagtcgggcattctctatctagatttcgatctgtttgatcaattattcgattactcagtctcccttctctccaatgccgacggatcaagccgagctctctaccgaccaggttttgaggagggatattccatgggaaacctatatgactactaagctgataacggggacagggcttcagcttttgcggcgctatgataagaaacccgagaattacaaggctcagctgcttgatgatgatggcccagcttacattcgtgtttttgtgagcatcttgcgcgacatattcaaggaagaaactgtagagtatgttttagctctgattgatgaaacactttcagcaaaccccaaacgagcaagactatttcatgataagtctctcactgatgtggatacatacgagcctttcctaagattgctctggaaaggtaactggtttattcaagagaagagctgtaagatactttctttgattgtaagtggaaggccaaagtctcatgatagcgtgtcggccaatggggaatcaaattcaaagaaggaaataactactataaatgatgttttaaagggacttgttgagtggctgtgcgggcagttgaagaatccatcccatcctagccgtggcattccctccgccattaattgccttgcaaccttactgaaagagcctgtggtacgatcgtcatttgttgaagcggatggagtgaagctgctcattcctctaatttctccagcatccactcaacaatccatccagctcctatatgaaacttgcctttgcgtatggctcctttcatactacgaacctgcaattgagtacttggccacttctagatccctgccacggttgatagaagttgttaaaggatccacaaaggaaaaggttgtcagggtagttatcttgaccctgaagaatctgctacacaaaggaacatttggtgctcagatggttcccctgggattgccacaacttgttcagaatctaaaagctcaggcatggagtgacgaggatctgctagaatctctgaatcaactggaagaaggactgaaagataacatcaagcagctaagttcttttgataagtacaagcaggaagtccttcttggacatcttgattggtcacctatgcataaggatcctatattctggcgggacaacactaccaactttgaagaacatgattttcagatcctaagggtcctgatcacgattttggacacatcatcggatcctagaacacttgctgtggcttgctatgatctctcgcagtttgttcagtaccatccagctgggcgtatcattgtaaccgacctcaaagcaaaagagcgcgtgatgaaattgatgaaccatgagaatccagaggttaccaagaatgccttgctctgcatccagaggctatttctaggtgccaaatatgcaagctttttgcaagcttaagtattttccaggttttatttatgagagcatttctttttaaaacaaggacgggcaagttaagttgtgtgtattatttatttactttgtatgttctcttatacacaatccaataaactgacagtgagtgtatcatatctgttggtctgtaataaaataattgtcatgttattttt

SEQ ID NO: 5856 - DNA, 1879 bp, Vinca minor
cgtggcctctgagcagttcggttaatgtaattttgcatatctcaagggtctattaataattgaatatagaaaaagaaactacttttaatatttacaaatctgagtggtccaaatttgtaattaagcaattcaattatctccacatctatcgttcctggaagaagataactgccattaatatagtagaggaaggaacgtcgatcgtaggctcgatctcagatagtgatttccactccgcagtgaattgaatccggcggcgacacaatgacgatggatcacgccgaactcacaactgatgaggttttaaggagagatattccatgggagacatacatgacaactaaactgatcactggaactggtctgcagcttttaaggagatatgataagaaagctgagagttacaaggcccaattgctggatgatgatggtccagcttatattcacgtatttgtcagcattttacgagatatattcaaggaagaaaccgtagagtatgttctagctttgattgatgaaatgctcactgcaaatcccaaaagagcaagattatttcatgacaagtctcttgcaaatgaagacacttatgaaccattcttaagacttctctggaaaggtaactggtttatacaagaaaaaggttgtaagattctatcccttatagtgagtgctaggccaaagtttcaggatggtatcactgcaaatggagaagcatcagtttcaaaaaagacatcgacttccatcgatgacgttctcaaaggactggtggagtggctttgttctcagctgaagaagccttctcatccggtacggggcattcccagtgctattaattgccttgcaactctccttagagagccaacagttcgatcatcgtttgttcaagcagatggggtaaagttgcttgttcccctaataacaccagcatccactcagcagtctatccagcttctgtatgaaacatgtctctgtgtatggcttttatcttactatgaaccagcggttgagtatttggctacttctagggctctacctcgattaactgaagttgtaaaaggttcaacaaaggaaaaagtagtgagggttgcaatcttaaccctgagaaacttgctccaaaaggggaactttggcccccagatggtggatgtgggactgctacaaattgttcaaagtttgaaagcacaagcgtggagtgatgaggatttgttggaggctctggatcaactggaaggaggactgaaagacaacattaagaaattaagttctttcgacaaatacaagcaggagatccttcttggccatcttgactggtccccgatgcacaaggatcctatattttggagggagaacattaacaactttgaagagaatgatttccagatcctgcgagtcctcctgacaattttggagacatccactgatccaagaacgcttgcagttgcttgctttgatctctcacaattcattcaaactcatcctgctggtcgggtcatcgtgactgatctcaaagctaaggaacgggtgatgaagttgatgaaccacgagaacactgaggttaccaaaaatgccctgctctgcattcaaaggcttttcctaggtgccaagtattccagctttttgcaggtataaatcttgcaacttttcgagattgatcttgaggatattgatcgaaattggaagtcacctgtgcagtagtttgttggttcggttatttgtatctaaggagcaagttttatacggtatctaggaagcgagtttaaagggctatttattttggcattatgtccccaattaaataaatgtttgaaaatctaacctaatattgattctgcactatggcctaataagaggatggccacattactttctccagtagggg

SEQ ID NO: 5857 - DNA, 1800 bp, Euonymus alatus
gaatcaaaatcgcgttgtgcttcgttaacgatcacagaacagaacagcacttgcagagattacattctcgggtatttgaattggtaaagaaaactgttaagagcgcttagggatttcggttagcaatggaccaagctgaactgacaacagaacaggttctaagaagagacataccatgggaggcttacatgacaactaagctgatttcgggaacaggtcttcagctgttaagacgttatgataaaaaacctgaaagttacaaggcgcagttgctggaagatgatggtccagcttatgttcgggtatttgttagcattttgcgggatatattcaaagaggaaacggtagaatatgttctagctttaattgatggaatgctcacggcaaacccaaaaagagccagactgttccatgacaaatctctcaccgacgaagatacctatgaacctttcttaagattgctttggaaaggtaattggttcatacaagaaaagagctgcaagatacttgctttgatagtaagtgctaggccaaaaaaccatggtggcgctgtttcaaatggggaagttgccagttctaaaagtaaagttactagcatcaatgatgtgttgaaaggattagttgaatggctttgtgtgcagctaaagaaaccttctcatcctagtcgtggcattccagcagctattaattgccttgcaacgttgctcaaggaacctatcgttaggtcttcctttgttcaagcagatggggtgaagttgctgatcccttttatctctcctgcatcaacccaacaatctatccagcttctttatgaaacatgtctctgtatctggctcttgtcttactatgaaccggcaattgaatacttggctacctctagaacccttccacgtttgctagaggttgttaagagttccacgaaagagaaggtggtccgggtggttgtcttgatctttaggaacgtgctccacaaaggaacgtttggtgctcagatggtggaccttggactgccacaaattgttcaaagtttgaaaacacaagcatggagcgatgaggacctgttggaaactctgaaccagctggaagaagggttgaaggataacattaagaagttgagttcttttgacaagtacaagcaagaagtgctccttggccatcttgactggtctcctatgcacaaagaccctatattttggcgtgagaatatcacaaatttcgaggagaatgattttcagattcttagggtccttataacaattttggacacctctagtgatccaagagccttggctgtttcttgctttgatctctcccagtttgtccagcaccatgcagctggtcgcgtcatattgacagacctcaaggtcaaggagcgggttatgaagctgatgaaccatgaaaatgctgaagttaccaaaaatgcccttctatgcattcagaggcttttccttggtgcaaagtatgcgagctttttgcaggcttgactccatcccattagggttcggaacgggttcaacaattgaagtacttttgacaaaaggttacagtttgttcattcttaggtggttcatctattatcatattcgcaatttagcaatccgggactcgtcgtttcgtcagcttatgatgtttgtgatcaaaactcttgaagaataaattcttatttatttaaggaatatttagtttagatggggagatgcagaataaagtatgcacaagtgtgcttcttgaaatttgtttgtatacatattatctgtctattgaacgacatttaaacattgaaggttgttggactttgtt

SEQ ID NO: 5858 - DNA, 1528 bp, Olea europaea
cgataacagcagttgattgtctctctagattccgatctgttcctaaagaaatcattcacaattccaccaatgaccatggatcaatccgacctcacaaccgagcaggttttgaggagggatattccgtgggagacttacatgaacactaagttgataacgggaacagggcttcagctgttgaggcgttacgataagaaacctgagaattacaaggctcagttgctggatgatgatggtccatcctacattcgtgtacttgttagcattttgcgtgacatattcaaggaagaaactgtagaatatgttcttgccttgattgacgagatgcttactgcaaactcgaaaagagcaaggctgtttcatgatacgtctcttgcaaacgaagatacatacgaacctttcttgagattgctgtggaaaggtaactggtttattcaagagaagagctgtaagatactttctctgatagtaagtggaagaccgaaggctcaggatgcactcattgcaaatggggcatcaaaatcgaaggaatttactactattgatgacgttctaaaaggacttgtggagtggctttgcgcacagctgaagaagccttctcatcctagccgtggcattccaacagcaatcaattgtcttgccactctacttaaagagcctgttgtgcgatcttcatttgttcaatcagatggagtgaagcttctagttcctctaatttctccagcatccactcaacagtccattcagctcctctacgaaacatgtctatgtgtatggcttttgtcttactatgaacctgcaattgagtacttgggtacttctagatccttgccacgtttgattgaagttgttaaaggttccacaaaagaaaaggtcgtcagggtagttgtgttgactcttaggaacttgcttcaaaaggggacatatggtgctctgatgatagatctgggattgcctcagcttgtccagagtttgaaagcacaggcatggagtgatgaggatctgctggaggcactgacccaacttgaagaaggactgaaggataacattaagaagctaagttctttcgataagtacaaacaggaagtccttcttggacatcttgattggtctcctatgcacaaagatcctatattttggcgggaaaatattacgaacttcgaagaaaatgatttccagattttaagggtcctgatcacaatcttggatacgtccactaatcctcgaacactagctgttgcttgctttgatatctcgcagttcattcagtaccatcctgctggtcgtatcatagtgactgacctgaaagcaaaggagcgggtgatgaaattgttgaaccatgaaaacgcagaggtcactaaaaatgctttgctctgcatccaaaggcttttcctaggtgccaaatatgcaagctttttacaagcctgagtattgtttggttcaaattataataattttaggatgaagattgaagaatttgtatacagtcatgtactattgtgtttaagaagtatttcatgcacttcat

SEQ ID NO: 5859 - DNA, 1861 bp, Populus trichocarpa
gaatcacaaaaccaagaatcatcaattgaagagcacatttatttacgaaaatttgagtagaaatggagcaggccgaactgactacagagcaggttcttaagagggatatcccatgggagacttacatgatgacaaagctaatctctgggacggatcttcaactgttgaggcgttatgataatagaccggaaagttacagggcacaattgttagatgatgatggcccagcttatgttcgggtttttgttaccattttacgtgacatttttaaggaagaaacagtcgaatatgttctggctttgattgatgaaatgcttgcagcaaacccgaaaagagccagattgttccatgataagtctcttgcaaatgatgatccttatgaacctttcctaagattgctttggaaaggtaactggttcatacaagaaaagagctgcaagatacttgctttgattgtaagtgctaggccaaaaactcaagatggccttctttcaaatggagaggcctcaaattcaaagagcaaaattacttgcattgatgatgtgctgaagggattggttgaatggctttgtgcccagctgaagaagccttcacatcctagtcgttccattccaactgcaattagttgtctagcaacattgcttaaggagcctgtggtcagatctttgtttgtacggttagatggcgtgaagttgctgattccatcaatttgtccagcatctactcagcaatccattcagcttctttatgaaacaagtctctgtgtctggctactgtcttactatgaacctgcaattgagtacttggctacttcaagaaccttgccgcgactagttgacgttgtgaagagttccacaaaagagaaggttgtcagagtggttgtcttgacctttaaaaacttgctttccaaaggtgcatttggtgctcagatggtagaccttggattgccacaaattgttcaaaatttgaaagcacaagcatggagtgatgaggacctactggaggctctgaaccaactagaagaggggttaaaggataacattaagaaattgagttcttttgacaagtacaagcaagaagttctcctcggccatcttgattggtctcctatgcacaaagatcctgctttctggcgtgaaaatataactaattttgaagagaatgatttccagattctgagggtcctcatcacaattttggacacatccaatgatccaagagctctggctgttgcttgctttgatctctcgcagtttatccagcaccatcctgctgggagggtcatagtgacggatcttaagaccaaggaaagggtgatgaaactgatgaaccatgaaaatgctgaagttaccaaaaatgctctcctctgtattcaaaggctctttctaggtgcaaagtatgcaagctttctgcaggtctgattctctcctcgtgaggcatccaattacaccgtatggttgtacatcacctgcttccggactgcttccatgagcagatactgaactctgcgccttttatttttattagatgttggaaaactgcgaagaattaatttattctaccgaaggagactttgagacttggaagagaataattgtatcatgttttgttttgggtgtatatacatttcaagagtttgttaatcgatcaataatgtatgaatacttgattcagggagttgcacacaaatatttttctttgtatctgtggttctgtggatgtatgctttctgtggatttggtctaaaaattggcattaaccgaaagcggcagaaggtttttcacatttgaagtccggtgtcagatttgtgctgtatgatgattttcttggccacaagcaaggagggttttgtggtggcttg

SEQ ID NO: 5860 - DNA, 1889 bp, Solanum tuberosum
gtttgatctcaccttcgtgaacccccaccccaagatttgtagcctacttgcaccctcttatactggaagattactttttgggttctaatcacatttggtcacttccacgtgatacggatagaggaagaacaatccgtattctgtctatttggtaagaagaaaacaaattttggatttgaagggcatactcacaatgacaacggagaacgcggagcttactacggaggaggttttgaggagggatatcccatgggagacatacatgactacaaagctgatcactggaacaggtttgcagctgttgaggcgctatgacaagaaggcagaaagttacaaagcccagttgctggatgatgatggtccaggttatgtccgcgtctttgttaccattttacgtgacatcttcaaggaagaaaccgtggaatatgttttggctttgattgatgaaatgcttacagcaaacccaaaaagagcaagactattccatgatgagagtcttgcagacgaagatacctatgaacctttcctcagattgctgtggaaaggtaattggttcatacaagagaagagctgtaagattctatctttgacagtgagtgctaggtcaaaagttcagaatggtgctgatgcaaatggagatgcctcaagttcaaagaagaaaatcactaccattgacgatgttctggcaggcgtggtggagtggctttgtgcacagctgaaaaagcctactcatcctacccgcagcattcctagcacaatcaactgcctatcaactctgttgaaagagccagttgttcgatcttcatttgttcgagctgatggagtgaagttgcttgttcctttaatttcaccagcatccacccagcagtctatccagcttctctatgagacatgcctttgtgtgtggcttttgtcatactatgaacctgcaatagagtatttagctacttcaagggccctccctcgattgatagaagttgttaaaggttcaacaaaagagaaggttgtacgggttgtcatcttgactcttcggaatttgctttccaaaggaacatttagtgctcatatggtagacttgggagtgctgcaaattgttcagagtttgaaagcacaggcttggagtgatgaggatcttttggacgctctgaatcaactagaacaaggattgaaggaaaacatcaaaaaactgagttcgtttgacaagtacaagcaggaagtccttcttggccatcttgattggtccccaatgcacaaagatcctatattctggcgggagaacataaataattttgaggagaatgatttccagatcttgagggtgctcattacaattttggacacatcaagtgatgcaaggacacttgctgttgcttgctatgatctgtcacagttcattcagtgccattctgctgggagaattatagtgaatgacctcaaagctaaggagcgcgtaatgagactgttgaaccatgagaatgctgaggtcacgaaaaatgccttgctctgtatccaaaggcttttcctaggtgccaagtatgctagctttttgcaggcttaagtcttgtcgaatggtttcattccattgttcagacgacaggtactagactcatctcgttatttcgttggacacaaggagtttgtggtcgtggtcttgttaatttatttgttgtatcactattcgagtattgtatctaaggcgtcctcttggtgagattttcattccaaataaagtctacgagtttaattttaatttcccctccaataaaaggcagtttgtattgacatgtttatcgaactggggaattgttttgtggtatatactatctggagattgctgttcaaacaacttattaatacgatgattttgtatgatcggtatggttttatgt

SEQ ID NO: 5861 - DNA, 1975 bp, Solanum phureja
gtccctttgtaattttcctttttctatggtcttcctcatccatcgagtttgatctcaccttcgtgaacccccacccccaccccaccccaagatttgtagcctacttgcaccctcttatactggaagattactttttgggttctaatcacatttggtcacttccacgtgatacggatagaggaagaacaatccgtattctgtctatttggtaagaagaaaacaaattttggatttgaagggcatactcacaatgacaacggagaacgcggagcttactacggaggaggttttgaggagggatatcccatgggagacatacatgactacaaagctgatcactggaacaggtttgcagctgttgaggcgctatgacaagaaggcagaaagttacaaagcccagttgctggatgatgatggtccaggttatgtccgcgtctttgttaccattttacgtgacatcttcaaggaagaaaccgtggaatatgttttggctttgattgatgaaatgcttacagcaaacccaaaaagagcaagactattccatgatgagagtcttgcagacgaagatacctatgaacctttcctcagattgctgtggaaaggtaattggttcatacaagagaagagctgtaagattctatctttgacagtgagtgctaggtcaaaagttcagaatggtgctgatgcaaatggagatgcctcaagttcaaagaagaaaatcactaccattgacgatgttctggcaggcgtggtggagtggctttgtgcacagctgaaaaagcctactcatcctacccgcagcattcctagcacaatcaactgcctatcaactctgttgaaagagccagttgttcgatcttcatttgttcgagctgatggagtgaagttgcttgttcctttaatttcaccagcatccacccagcagtctatccagcttctctatgagacatgcctttgtgtgtggcttttgtcatactatgaacctgcaatagagtatttagctacttcaagggccctccctcgattgatagaagttgttaaaggttcaacaaaagagaaggttgtacgggttgtcatcttgactcttcggaatttgctttccaaaggaacatttagtgctcatatggtagacttgggagtgctgcaaattgttcagagtttgaaagcacaggcttggagtgatgaggatcttttggacgctctgaatcaactagaacaaggattgaaggaaaacatcaaaaaactgagttcgtttgacaagtacaagcaggaagtccttcttggccatcttgattggtccccaatgcacaaagatcctatattctggcgggagaacataaataattttgaggagaatgatttccagatcttgagggtgctcattacaattttggacacatcaagtgatgcaaggacacttgctgttgcttgctatgatctgtcacagttcattcagtgccattctgctgggagaattatagtgaatgacctcaaagctaaggagcgcgtaatgagactgttgaaccatgagaatgctgaggtcacgaaaaatgccttgctctgtatccaaaggcttttcctaggtgccaagtatgctagctttttgcaggcttaagtcttgtcgaatggtttcattccattgttcagacgacaggtactagactcatctcgttatttcgttggacacaaggagtttgtggtcgtggtcttgttaatttatttgttgtatcactattcgagtattgtatctaaggcgtcctcttggtgagattttcattccaaataaagtctacgagtttaattttaatttcccctccaataaaaggcagtttgtattgacatgtttatcgaactggggaattgttttgtggtatatactatctggagattgctgttcaaacaacttattaatacgatgattttgtatgatcggtatggttttatgtatcgaggcgtatagtctagtgatatcatc

SEQ ID NO: 5862 - DNA, 1800 bp, Fragaria vesca
cgtggacagatcaacataattgcggttgtccttctctcattcatctctttcccgagtcctgacgaagccacacacacagacagcgagacagagagaggtactcgaattggtgaaattggctgggtgtgatcacagcaatggaccatgctgagctcaccactgagcaggtcttgaaaagagacatcccatgggagcaatacatgactaccaagctcatcactggcacctgtcttcagctgttacgccgttatgataaaagatccgagacttacagatcacagctgcttgatgatgatggccctgcttatgttcaagtgtttgttggcattttgcgtgatattttcaaggaagagacggtagaatacgttcttgctttaattgatgagctgcttacagccaacccaaaaagagcaagactgttccatgatacttctcttgtcgataaagatgtttatgagcctttcttgagattgctttggaagggtaattggttcatacaagagaagagctgcaagattcttggtttaatagtgagtgcaaggacaaaaccccaaggaactgtcgcaaatggagaagcctcaaattcaaagagtaaaatcactagtattgatgatgtgttgaaaggattggtagaatggctttgtgcacagctgaagaagccctcccatcctagtcgtggcatcccaactgccatcagttgccttgcaaccctactaaaggaaccagtggttagatcttcttttgttcaagcagatggggtgaagttacttgttcccttaatttctccggcttccacccaacaatctatgcagcttctgtatgaaacatgtctatgtgtctggctcctatcctattacgaacctgcaattgagtacttggctacttccagaacacttccccggctcatagaagttatcaggagttcgacaaaggagaaggttgtcagagttgttgttttgaccctgaggaacttgctctccaagggaacatttggtgctcaaatggttgaccttggactgcctcaaattgttcagagtttgaaagcacaagcatggagtgatgaggatctcctggagggattaaatcagctggaagagggtttgaaggataacatcaagaaattaagttcttttgataaatataagcaagaagtcctccttggccatcttgactggtcacccatgcacaaagatgcaatattctggcgtgagaatattactaacttcgaggagaacgactttcagattctaagagtgctgattactattttagacacgtccagtgatccgagagctttggctgttgcttgctttgatatctcacagtttgtccagcaccatccggctggaagaatcatagtaacagacctcaaggccaaggagcgtgtcatgaaactgatgaatcatgagagtgccgaggttaccaaaaatgctctgctatgcattcagaggcttttcctaggtgccaagtatgctagttttttgcaggcttgaactattatgacgagcggtttaaatccctatatgttgaaggattagtgtcaatgacacagtagtgtttcatatataatttgttggggcaattcattatctaaggcctttggttatgagacagatttcggaaatttaatttgttgttttaatgtttagctttggaatgtcattcctgcattattattgaataaaaataaataatgttgtcccattgggtaaagtatttgctttgtgagcctatccttctgggttgtttgctaataggttctattctatccgtcctttgatattgatcagaggatgtatc

SEQ ID NO: 5863 - DNA, 1790 bp, Theobroma cacao
cacaccagagaaacaaaaaaaaaaaataataaagaacaaaatttcaggggttggaattcgtgtggaatttgaactagtttttgagtatcaatggaccatgctgaactaaacactgagcaggttctgaagagggacatcccatgggaaacttacatgacgactaagctgatttcaggaacaggccttcagctgttaaggcgttatgataatagagctgaaagttacagggcacaattgttggatgatgatggtccagcctatgttcgagtgtttgttagtatattgcgtgatatatttaaggaagaaacagtggagtatgttctggctttaattgatgaaatgctcacagccaatcctaaacgagccagattatttcatgacaagtctcttgcaaatgaagatacttatgaacctttcttaaaatcggaagaatacaagcatgtattgctctggaaaggtaactggttcatacaagaaaagagctgcaagatacttgccctgatagtaagtgcccgcccaaaaacccaggatggtgttgttgcaaatggtgaagcctcaaattcaaagaaaaagttcactaccattgatgatgtgcttaaaggtttggttgaatggctttgcacacagctgagaaagccttcccatcccagtcgtggtattccgactgccatcaattgccttgcatcattgctgaaggaacctgttgtcagatcttcctttgttcaagcagatggggtgaagttactgattcctttaatttctccagcatcaactcagcagtctatccagcttctttatgagacatgtctctgtctatggcttttatcttactatgaacctgcacttgagtatttggcaacgtctagaactctaccacgactggttgatgttgttaagagttccacaaaggagaaggttgtcagggttattatcttgacctttaggaacttgttgtccaaaggcacatttggtgctcagatggtagaccttggactgccacaaattgttcagagtttgaaagcacaagcatggagtgacgaggatttgttggaggcactcaatcaacttgaagatgggctgaaggataacattaagaaattgagttcctttgacaaatataaacaggaagttctccttggtcatcttgattggtctcccatgcataaagatccattattttggcgtgataatataacatgctttgaagagaatgatttccagattctaagggtcctcattacaatcatggactcatcgaatgattcaagagctctggctgttgcttgctttgatctctcacaatttattcagcaccatcctgctgggagggtgatagtgactgacctaaaggccaaagagcgggtgatgaagttgatgaaccatgagagtgccgaggttaccaagaatgctttactctgcattcaaaggcttttcctaggtgccaagtatgctagctttttgcaggtgtagtttgccttaacaatggtgcatggtcatcatgtgtcatctacactgtggaagtaatacggcgagtggatagtaaattcggctccttaggtgttctattgtgatttttgagtaaattatgagttggggggctggtcttccatcagacatttgattgtctaaatgtcaaggaagaattaattttcgttttattaaacttgagaatatcattattactattgataatttttttagattttgagctgaatttaataaagtgtttgtatcctttatttatcttgttcctttgaacgttttggtgaattgtcattcaataagtgaga

SEQ ID NO: 5864 - DNA, 1675 bp, Euphorbia peplus
acttctcacaggcccatccagctcttcttcccttccaaaaacaccatcagattacgcaggaaaaatttcagtatcgatggaccaagcggagctgagtactgagcaggtgcttaagagggacattccatgggagacttatacgataacgaagctgatctcggggacagaccttcaactgttgaggcgatatgataatcaatctgaaagtcacagggcgcagttgttggatgatgatggtccagcatatgttagggtatttgttagcatcttacgggatatattcaaggaagaaacagttgaatatgttttggcattagttgatgaactgctaacaggtaaccccaaaagagccaaattctttcatgatcagtctcttacaaatgaagatacttatgaaccttttttaagattgctttggaagggtaactggttcattcaagaaaagagctgcaagatacttgctctgatagtaagtgctaggccgaaaaatcaagatggaattactgcaaatggagaagcttcaaattcaaagagcaaagtcactaccattgatgatgtgctgaaaggattagttgaatggctttgtgcccagcttaagaagccttcacatccttctcggggtgttccaactgctatcagttgcctttcaacactactgaaggaacctgtggtcaggtcatcatttgtaaaagcagatggagtgaagctgttgattcccttgataactcctgcatctacacagcaatccatccagcttctttatgagacatgtctctgtgtctggctattatcatactatgaaccagcaatagaatacttggcgacatctagaaccttgccccgattagcagatgtcgtaaagagttccacaaaggagaaggttgtcagggtgattgtcttgacatttaggaacttgcttgcaagaggtacttttggtgcacaaatggtagacattggactgccacaaattgttcagaatttgaaatcgcaagcatggagtgacgaggatctgttggaggctctaaaccaactcgaagaaggcctcagagataacattaagaaacttagttcttttgataagtacaagcaggaagtcctccttggccatttggactggactcctatgcacaaagatcctacattctggcgtgaaaatattaaattttttgaagaaaatgacttccagattctgagagtcctcataacaattttggacacatctagtgacccaagagctatggcggttgcttgctttgatctgtcacagtttatccagatccatccagctggacggattattgtgacagacctcaaagcgaaagaaagggtgatgaagctgatgaatcatgaaaatgcagaagtcaccaaaaatgccctactctgcattcaaaggcttttcctaggtgccaagtatgcaagctttttgcaggcttgattctaagcttgtgggtgtgtaataatagtgtattggttttattttaatatgtttttgggatcgcttggattttcattatgaagattaatactgatgagagccggtgcagctgtggagatgctgaagagatagtgcaagcgttgaacattagcagatttcgagcattatttattaatttattggtatccttttctggggtgtacatactgttaatgtgatcatttttgcttcaataatatg

SEQ ID NO: 5865 - DNA, 1717 bp, Panax ginseng
aagcagtggtatcaacgcagagtacatggggccactaaataactaccactatcgttgccgaacgaaaaactcagattatctctctcttcttttctcgtctgaagcacttcgattccaaaccctgtaaatgccgatggatcaagccgagctcactagcgaacagattctgaagagggatatcccgtgggagtcgtacatgacaactaagctgatctcggggacaggacttcagctgttaaggcgttatgataaaaaacctgaaagttccaaggcacagttgctggatgatgatggtccagcttatgttcgtgtgtttttcaccattttacgtgacatattcaaggaagaaacagtagaatatgttctagctttgattgatgaaatgctaacaggaaaccccaaaagagccagattattccatgacaagtctgttgcaagtgaagatacttatgaacctttcctaagattgctctggaatggaaattggtttattcaagagaaaagctgtaagatcctttccttgataataagtgctagattaaaaactcaggatggtgtcaccatgaatggagaagcctccaattcaaagaagacattcactacagttgatgatgttttgaaaggactggtggagtggctttgtgctcagctcaaacagccttcccatcctagccgtggcattcctacagctatcagttgccttgcaactttactgaaagaacctgttgttagatcttcatttgttaaagcagatggggtgaagctgcttgttcctctgatttctccagcttccactcagcagtccatgcaggtcctttatgaaacatgtctcagtgtttggcttttgtcatactatgaacctgcaattgaatacttggctacttctagaagcttgcagcgattaatcgaggttgttaaggtttccacaaaagaaaaagttgtccgggtgattgtcttgacactcaaaaacctgctttccaaaggtagttttggagctcaaatggtagaccttggactgccacaggttgttcagagtttgaaagcacaagcatggagtgacgaggatctattggaagctctgaatcaactagaagaaggactgaaagaaaaaattaagaagttgagttcttttgaaaagtacaagcatgaagtccttcttggtcatcttgactggtcccccatgcacaaagatccaattttctggcgtgataacattacaaactttgaagataatgatttccagatcctaagggtcctcgttacaattttggacacatccggtgatccaagggctctttctgttgcttgctttgatctctcgcaattcattcagtaccaccctgctggtcggattatagtgactgacctgaaagcaaaggagcgggtcatgaaattgatgaaccatgagaatgcagaggttaccaaaaacgccttgctctgcatccaaaggcttttccttggtgccaagtacgcaagctttttgctggcttaagttgtttttgttgctctaccaaatcaaaattttaaaatgaaataatgttagggttggttgcgcagtagcaataatctaggacctttctttcataggctgctccaatgctttggttcagagttaatatttgttttgtaaaattatgcaataaaacaaacatttgtatttataattgttctagctagcccagagatttccacctggccaataattaaatgtatttgt

SEQ ID NO: 5866 - DNA, 1668 bp, Tropaeolum majus
ggtattggtatatgtcggtatcaatggcacaggctgaattaacaacagaacaggttttgaaaagggacattccatgggagacttacatgacaacaaagctgatttcaggaacaggccttcagctgttgaggcgctatgataataggtccggaagccaaagggcacagttactggaagatgatggtccagcttatgttcgagtgtttgttagcattatacgtgatatacttaaggaagaaactgtagaatatgttctggcattgattgatgaattgcttacagaaaatccaaacagagccagattcttccatgacaagtctcttgcaagtgaagacacatatgaacctttcttaagattgctttggaaaggtaactggtttctacaagaaaagagctgcaagatacttgctttgatagtgagtgctaggccaaaagcacaagataatgttgttgcaaatggggaatcctcaaattcgaaaagcaagtttaccaccatcgatgatgttctgaaaggattggttgaatggctttgtgcgcagctgaagaagccttcccatccaactcgtgctgttccaactgctataaattgcctggcagcattgcttaaagaacctgtggtcagatcttcttttgttcaggcagatggagtgaaattactggtcattttaatttccccagcatcgacccaacaatctatccagattctttatgaaacatgtttgtgtgtctggcttttatcttattatgagcctgcagttgaatacttggcgacttctagaacactgcagagattagtagaagtcgtaaagagttccacaaaggagaaggttgtcagggtggttatcttaaccctgaggaacttacttcctaaaggtacttttggtgctcagatggtagatcttggactgccacaaattgttcaaaatttgaaaacacaagcatggagtgatgaggacctgttggatgctctgaatcaactagaagaaggtctgagagataacatcaagaagctgagctcatttgataagtacaagcaagaagtcctccttggccatcttgactggactcccatgcacaaggatgcaattttctggcgtgacaatattaccaacttcgaagaaagtgatttccaggttctaagggtcctcattaccattctagacacctcgagtgacccaagagctttggctgttgcctgctttgatctgtcgcagtttgtccagcatcatccagcaggacgggtcattgtgacagatttaaaggcaaaagaaagagtgatgaaactgatgaaccacgagaatgccgaggtaaccaaaaatgctctactttgtattcaaaggcttttccttggtgccaaatatgcaagcttttgcaagtttgatcttatgaataaaatttatgctatactggatgggtgttagattggtttatttattattgatttcttctcgttattattattattccgagtaacttgtttaccaaggttctgctttcttgttcacaatcaggctgtaaaactttgtgtacagcgaatttcattttgctaactctggagaatagctctattttttccctttttgggttgtttaataaagtgtttgtttcagtaattacattttggatttaggaaaatatattttattgaatttgttacccagcgttgcc

SEQ ID NO: 5867 - DNA, 1673 bp, Panax ginseng
aagcagtggtatcaacgcagagtacgcggggaccactatcgttgccgaacgaaaaactcagattatctctctctccttttctcgtctgaagcacttcgattccaaaccctgtaaatgccgatgggtcaagccgagctcactagcgaacagattctgaagagggatatcccgtgggagtcgtacatgacaactaagctgatctcggggacaggacttcagctgttaaggcgttatgataaaaaacctgaaagttccaaggcacagttgctggatgatgatggtccagcttatgttcgtgtgtttttcaccattttgcgtgacatattcaaggaagaaacagtagaatatgttctagctttgattgatgaaatgctaacaggaaaccccaaaagagccagattattccatgacaagtctgttgcaagtgaagatacttatgaacctttcctaagattgctctggaatggaaattggtttattcaagagaaaagctgtaagattctttccttgataataagtgctagattaaaaactcaggatggtgtcaccatgaatggagaatcctccaattcaaagaagacattcactacagttgatgatgttatgaaaggactggtggagtggctttgtgctcagctcaaacagccttcccatcctagccgtggcattcctacaactatcagttgcctggcaactttactgaaagaacctgttgttagatcttcatttgttaaagcagattgggtgaagctgcttgttcctctgatttctccagcttccactcagcagtccatgcagctcctttatgaaacatgtctctgtgtttggcttttgtcatactatgaacctgcaattgaatacttggctacttctagaagcttgcagcgattaatcgaggttgttaaaggttccacaaaagaaaaagttagtccgggtgattgtcttgacactcaaaaacctgctttccaaaggtagttttggagctcaaatggtagaccttggactgccacaggttgttcagagtttgaaagcacaagcatggagcgatgaggacctgttggaggctctgaatcaactggaagaaggactgaaagacaacataaagaaattgagttcttttgaaaaatacaagcaggaagtccttcttggtgatcttggctggtcccctatgcacaaagatcctatattctggcgtgataacattacaagatttgaagagaatgatttccagatcttaagggtcctcgttacaattttggacaaatccggtgatccaaggtcgctcgctgttgcttgctttgatctctcgcagttcattcagtaccatcccgctggtcggagtatagtgactgacctgaaagcaaaggagcgggtgatgaaattgatgaaccatgagaatgcagaggttaccaagagttccttgctccgcatacaaaggcttttccttggtgccaagtacgcaagctttttgcaggcttaactaactttattttcttaaactagttgctctcccaaattaaatatgctgcgttttctttataaatgaaatatcgtgagagttgggtgcagtagatatgagattctaatgatcataatgtgagtaatgtaccttctagggcctttatttcatttcatccgctacctcttcgaatgttaaaagttatttgtttttt

SEQ ID NO: 5868 - DNA, 1646 bp, Castanea mollissima
acaggtgttggaattggtgaagttgtggtataattccaagtgggtattcagtaattatggaccaagctgagttaaacacagaacaggtcttgaagagggacataccatgggagacgtacatgacaactaagctcatctcaggaacaagccttcagctgctaaggcgttatgataatagaccggaaagctatagagcacaacttctggatgatgatggtccagcttatgttcgggtgttcgttagcattttacgtgacatttataaggaggaaactgtagaatatgttctggcgttagttgatgaaatgcttacagcaaacccaaaaagagcaagattgttccatgacaagtctcttgccagtgaagatacttatgaacctttcttaagattgctttggaagggtaattggttcatacaagagaagagctgtaagatagttgctttaatagtaagtgctaggccaaaaatccaggatggcaacattgcaaatggagaagcctcaaattcaaagaaaaaatccacttctattgatgatgtattgcaaggattggtagactggctttgtgaacagctgaagaagccttcccatcctagtcgtggtgtcccaactgccatcagttgcctcgctacgttacttaaggaacccatggtcagatcctcctttgttcaagcagatggggtgaagttgctcgttcctttaatttctccagcatccacccagcaatcaattcagctactgtatgaaacttgtctctgtgtttggcttttgtcatactatgaacctgcggttgagtacttggctacttcaagagccctgcctcgcctcatagatgttgttaagagttccacaaaggagaaggttgtcagagttgttgtcttgacccttaggaacttgctttccaaagcggcatttggtgctcaaatgatagaccttggtctgccacaaattgttcaaagcttgaaagcacaagcatggagtgatgaggacctgttggaggctttgaatcaactagaggaagggctgaaggacaagattaagaaattgagttcctttgataagtacaagcaagaagtcctccttggtcaacttgactggtctcctatgcacaaagataacttgttttggcgcgataacattaagaactttgaagagaatgatttccagattttgagggtcctcattacaattttggatacatcaaatgatccaaggactctggctgttgcttgctatgatctctcacagttcattcagcatcatccagctgggcggatcattgtgacagacctcaaggccaaggaaagggtgatgaaattgatgaaccatgagaatcctgaggttaccaaaaatgctctgctctgtattcaaaggcttttcctgggtgccaagtatgcaagctttttgcaggtttaattcagttttcttggggaataatgatgtatatttctgagcccatatactgagtattttggctcccgtatcatatatggttcatttgttgttgtttgagtaatttatcatctagggcccttctcttgtcggagttttcggttgtggaagagtttgaagaattaatttgttctcctatacagtggaatattatttttaggaataatattaaataaaagagtttagttttttggt

SEQ ID NO: 5869 - DNA, 1802 bp, Vaccinium corymbosum
ccagaatcgagccagctcctcaaattctccaatgccaatggatcatgctgagttgagtatggagcaggttctgaagagggatatcccatgggagacatacatgacgactaagttgatcacaggaactggtcttcagctgttaaggcgttatgataacagatcagaaagtcaacgagcagtattgctggatgatgatggtccagcttatgttcgtgtgtttgttagcatattgcgcgacatattcaaggaagaaacagtagaatatgttctagctttaattgatgaaatgctcacagcaaacccaaaaagagccagattgtttcatgataaatctcttgcaagtgaagatatttacgaacctttcttaagattgctttggaaaggtaactggttcatacaggaaaagagctgtaagatactttctatgatagtgagtggaaggccagaaaaccaggagagggtcacttctaatggagaagcatcaaattcgaagagtcagatgactgctactgatgatgttctgaagggcctggtggaatggctttgtgcgcagctaaaaaagccttcccatcctagccgagcagtcccgacttccataaattgtctggcaacattattgaaggaacccatggtgaggtcattatttgttcaagctgatggagtgaagttgctaattcctctaatttcgccagcatccactcagcagtcaatgcagctcctttatgaaacatgtctctgtctttggctcttatcgtattatgaacctgcaattgattacttcgctacgactagaggtctggcacgattaattgaggttgtgaagggttccacaaaggagaaggttgtaagggtggttgttttgacacttcggaacttgcttcccaaggggacttttggtgctcagatggtagaccttgggctgccacagattgttcagagtttgaaagcacaggcatggagtgatgaggatttattggaggctctaaatcaactggaagatgggctgaaagacaacattaagaaaatgagttcttttgacaagtacaagcaggaggtcctccttggccatcttgactggtcccccatgcacaaagatcccatattttggcgtgagaacatcacgaagtttgaagaaaatgatttccagattctgagggtccttattacgatattggacacatctagagatccaagggctatagctgttgcttgctttgatctgtcgcagtttattcagtgccatcctgctgggagggtcattgtgaccgatctgaaggctaaagatcgggtgatgaaattgatgaaccatgagaatgctgaggtcaccaaaaatgctttgctctgtatccaaaggctttttcttggtgccaagtatgcgagctttttgcaggtttagatgttccagaatcacaatggaacttatcgttctacgggaagtcattttatgaaggcgaattcttaaataagcaaatgcaggagtcgggctgtggtatattcttttgttgtggtcattttatgaaggcggattcttaaataagcaaatgcaggagttgggctgtggtatattcttttgttgttgaatgttttttgttgttcgagactcaggttaaagtttgtattaagtaattgttgcgaaagatcttagaataatcatctattttcaatgttcttgtcgagtgaaatagatgttcgtaattctatgctttgtcaaatgtttacatattagttgtggggctttgttgtttttctaacatcgatatttgaacgatggctgaatagaaaaaatggattggtttctaccc

SEQ ID NO: 5870 - DNA, 1647 bp, Castanea mollissima
agaaacagcaccacacaaaacacaggtgttggaattggtgaagttgtggtataattccaagtgggtattcagtaattatggaccaagctgagttaaacacagaacaggtcttgaagagggacataccatgggagacgtacatgacaactaagctcatctcaggaacaagccttcagctgctaaggcgttatgataatagaccggaaagctatagagcacaacttctggatgatgatggtccagcttatgttcgggtgttcgttagcattttacgtgacatttataaggaggaaactgtagaatatgttctggcgttagttgatgaaatgcttacagcaaacccaaaaagagcaagattgttccatgacaagtctcttgccagtgaagatacttatgaacctttcttaagattgctttggaagggtaattggttcatacaagagaagagctgtaagatagttgctttaatagtaagtgctaggccaaaaatccaggatggcaacattgcaaatggagaagcctcaaattcaaagaaaaaatccacttctattgatgatgtattgcaaggattggtagactggctttgtgaacagctgaagaagccttcccatcctagtcgtggtgtcccaactgccatcagttgcctcgctacgttacttaaggaacccatggtcagatcctcctttgttcaagcagatggggtgaagttgctcgttcctttaatttctccagcatccacccagcaatcaattcagctactgtatgaaacttgtctctgtgtttggcttttgtcatactatgaacctgcggttgagtacttggctacttcaagagccctgcctcgcctcatagatgttgttaagagttccacaaaggagaaggttgtcagagttgttgtcttgacccttaggaacttgctttccaaagcggcatttggtgctcaaatgatagaccttggtctgccacaaattgttcaaagcttgaaagcacaagcatggagtgatgaggacctgttggaggctttgaatcaactagaggaagggctgaaggacaagattaagaaattgagttcctttgataagtacaagcaagaagtcctccttggtcaacttgactggtctcctatgcacaaagataacttgttttggcgcgataacattaagaactttgaagagaatgatttccagattttgagggtcctcattacaattttggatacatcaaatgatccaaggactctggctgttgcttgctatgatctctcacagttcattcagcatcatccagctgggcggatcattgtgacagacctcaaggccaaggaaagggtgatgaaattgatgaaccatgagaatcctgaggttaccaaaaatgctctgctctgtattcaaaggcttttcctgggtgccaagtatgcaagctttttgcaggtttaattcagttttcttggggaataatgatgtatatttctgagcccatatactgagtattttggctcccgtatcatatatggttcatttgttgttgtttgagtaatttatcatctagggcccttctcttgtcggagttttcggttgtggaagagtttgaagaattaatttgttctcctatacagtggaatattattttaggaataatattaaataa

SEQ ID NO: 5871 - DNA, 1736 bp, Gossypium raimondii
gaagaacagagccacaccagtggaagaaaaagaaaccgtagtattcaggctagtgatccaacaacgttttaatccctctctctctctttctattagttttataatatttcttccaatttttcatcaatttcctctgaattttcatccaaggggcattaattttcgtggaatttgaagtatattcttttggcaccaatggagcgtgcggaactaacaactgagcaggttctgaagagagacatcccatgggaaacatacatgacaactaagctgatttcaggaacaggccttcagctgttaaggcgttttgataatagagctgaaagtgtcagggcacagttgttggatgatgatggtccagcctatgttcaagtgtttgttagcatattacgtgatatatttaaagaagaaacagtggaatatgttctggctctaattgatgaaatgcttacagccaatccgaaaagagccagattatttcatgacaagtctcttgcaaatgaagatacttatgaacctttcctaagattgctctggaaaggtaactggttcatacaagaaaagagctgcaagatacttgccttgatagtaagtgccaggccaaaaacccagaatggtgttgttgcaaatggagaagcctcaaactcgaagacaaagctcactaccattgatgatgtactaagaggattggttgaatggctttgcacacagctgaagaagccttaccatcctagtcgtggtattccaactgctattaactgtcttgcagcattgctgaaggaacctgttgtcagatcctcctttgttcaagcagatggagtgaagttgttgattcctttaatttgtccagcatccacacagcaatctatccagcttctttacgaaacatgtctctgtgtgtggcttttatcttactatgaaccggtaatcgagtacttggcaacatctagggctctaccccgactggttgatgttgttaggagttccacgaaggagaaggttgtcagggttgttgtattgacctttaggaacttgttgtccaaaggcacatgtggtgctcagatggttgaccttggattgccacaaattattcagagtttgaaagcacaagcatggagtgatgaggatctgttggaggctctcaatcaacttgaagatgggctgaaagataacattaagaaattgagttccttcgacaaatacaagcaggaagttcttcttggtcatcttgattggtcacccatgcataaagatccattgttttggcgtgataatattacgtgctttgaggagaatgatttccagattctaagggtcctcattacaattatggactcgtccaacgatccaagacctctggctgttgcttgctttgatatttcacagtttattcagcaccatcctgctggtagggtgatagtgaatgacctcaaggccaaggaacgggtgatgaagttgatgaaccacgagagtgcggaggttaccaagaatgccttactctgcatccagaggcttttcctcggcgccaaatacgccagctttttgcaggtatagtttcgtgttgttgtgtgcatggtcatgtctcattctacaatgcagctagtgaatatatcgtaagtaaattcggcttcggctttgttgggtgttatattttcatttgagtaaattatctttctaccggatatatactacttctttgattctgagatgtgcaatagaaaatactactttttaat

SEQ ID NO: 5872 - DNA, 1665 bp, Momordica charantia
gagctaatacgatcctctttcttcagaattgcgcaaagatcgtaagtttaatttcgaggcctttctgtattcttcttgctgcattggtgttgcctggagtataattgcacgcggaagttgtgatggcaatagaccagggtgagcttaccactgagcaggttcttacaagggatattccatgggagacatacatgaccacaaaacttatcagtggaacaagccttcagctgttaaggcgttatgataacagacaagagagttacagggcacagttgttggacgatgatggtccagcatatgtacgagtatttgttagcattctacgtgatatatttaaggaagaaacagtggaatatgttctagcattaattgatgaaatgcttacagcaaacccgaaaagagcaagattgttccatgatcactctcttgcaaacgaagatgcttatgagcctttcctaagattgctttggaagggcaattggtttgtacaggagaaaagctgtaaaatacttgctctgattgtgagtgctagaaaacaaaatcatgatggcagtttttcaaatggtgatgcctcaaactccaagaggcaaattactgccattgatgatgttttggatggactggtgaaatggctttgtgcacagttgaagaatccttcacatcctagtcgtgccgtacagacttctatcaattgtcttgcaactctgttgaaggaaccaaaggtcagatcctcatttgtccaagcagatggagtgaaattgcttattcctttgatttctcctgcatcgacccaacaatctattcagcttctatatgaaacatgtctttgtgtttggctcttatcatattatgaaccggcaattgaattcttggccacttctagaacccttccaagacttatcgaagttgtcaagagttccacaaaagagaaggttgttcgagttgttattttgaccttgaggaacttactccacaaggggacatttggagctcaaatggtgggtctcggactaccacaaattgttcagagtttgaaatcacaagcatggagtgatgaggaccttttggaggctttgaatcaactggaagaggggctgaaagataatatcaagaaactaagttctttcgacaagtataagcaagaagtccttctcggccatcttgactggtctcctatgcacaaagatgtaaatttctggcgtgaaaatattacaagctttgaagagaacgacttcaagatattgagggtcctaatcaccatcctggacacttcaagtgatccaagggctctggcagttgcctgctttgatatttcccagttcattcaacaccatccggctgggagagttatagtgacagacctcaaggccaaagaaagagtgatgaaactgatgaatcatgagcatgctgaggttaccaagtatgccctcctttgcatccaaaggctcttcctaggtgccaagtatgccagttttctgcaagcttaattcagttttttggtgagacacacttgtgtaagttataataaacccatctacttaattttattaagtaattatcttaattttttgggttttttggtgtgaatcatgagagattttattcctttcttgcattcccagaatattcttggactcgttgaataaagtcaccaggttttcctac

SEQ ID NO: 5873 - DNA, 1860 bp, Carica papaya
acagctctctgtctccgtccctcctctccttccccctcttcctcctctctctctctccggtacaaaacaaaatcacattgagataaaaaaaattttaaggtacgcgatcgatctctaatccaatttcctcttcgtctttgtctgattcgttgcttcaacgtgttttcaaggtctttggcttgttacaaatccgtgtggtctcaagttgtcgcagtatcaatggaccacgctgaactatcaacagaacaggtcttgaagagggacattccatgggagacgtacatgacaactaaactaatttctggaactggccttcagctattaaggcgttatgataacagatctgaaagctaccgggcccagttgctggatgatgatggcccagcttatgttaaagtgtttgttagcatcttgagggatatatttaaggaagaaacagtagaatatgttttggctttgatggatgaaatgcttacagcaaatccgaagagagccagattgttccatgacaagtctcttgcaaatgaagatacttatgaacctttcttgagattgctctggaagggtaactggttcatacaggaaaagagctgcaagatactttctcttatagtaagtgctaggccaagagctctggatggtgttatcgcaaatggagaagcctcaaattcaaagaaaaatattacatgcattggtgatgtactgaaagggttggtggaatggctttgtgcacagctgaagaacccttctcatccaactcgtggcgttccaactgctgtcaattgcttggctgcattgctgaaggaacctgtggtcagatcttcttttgttcgggcagatggtgtgaagttgctaatccctttaatttctcctgcatccactcaacagtccatccagcttctttacgaaacatgtctctgcatctggcttctatcttactatgaaccagctattgaatttttggcaacttctagagcactgcagcggttagtagaagtcgtaaaaagttccacaaaagagaaggttgtcagggtgattgtcttgactcttaggaacttgcttccaaaaggtacatttggtgctcagatggtagatcttagcctgccacaaattgtccaaagtttgaaaacacaagcatggagtgacgaggacctgctggaggccctgaatcagctggaagaaggtctgaaggataacattaagaagttgagttcctttgataagtataagcaagaagttcttctgggccatcttgattggactccagtgcacaaagaccctctattttggcgtgataatattacaagctttgaagagaatgacttccagattctaagggtcctgattacaattctggacacttctaatgacccgagatctttggcagttgcctgctatgatctgtcacagtttatccagtatcatccggctggacggatcatagtcacagacctcaaagcaaaagaacgagcaatgaaattaatgaaccacgagaatgctgaagtcactaaaaatgccctactatgcatccagaggcttttcctgggttccaagtatgcaagctttttgcaagcttgatgcttttttttttttttttttggttgggaaatctccatgagatgtgtaggtgtatgcttctgtgctattctactacaggagaataaagtacgctcctcctccttccgagtagatcggtttatttattaattgttgcctgaggaactttccgatcagggctgctcttgttttgctaacgcacaattggagggtgaaaaatttgtttagaattaatttgtttattactgagttgctgaattttgattctgctccttgaggtgttggaataacgtgtttgtatca

SEQ ID NO: 5874 - DNA, 1585 bp, Lippia dulcis
agattccgatctgtttcagacaattttcaccaatgcctacggatcaagcggagctctcgaccgagcaggttttgaggagagatattccatgggagacttatatgacgactaagttgattaacgggactgggcttcagttgctgcggcgatatgataagaaagctgagaaggacaaggctcagttgttggatgatgatggtccagcttacgtacgtgtttttgtgagcattctgcgtgacatattcaaagaagaaactgtcgaatatgttctagccctgattgatgaaatggtctcagcaaacccctcaagagcaagattatttcatgatcattcacttggtgacgaggacatatatgagcccttcttaagattgctatggaagggtaactggtttatacaagaaaagagctgcaagatactttctttgatactaagtggaaggccaaaaactcatgagagtgccactgctggggcatcaaattcaaagaaggaacgcagcactgtcgatgatgttttgaagggactggttgagtggttgtgcactcagctcaagaagccatcacatccaagcaaaggaattccaacagcaataagttgccttgcaaccctactaaaagaatctgtggtgagatcttcatttgttcaagcagatggagtaaagttggtcattcctctaatttcaccagcttccactcaacaatccatccagctcctatatgaaacatgcctttgtgtgtggctcctgtcttactatgaaccagcacatgagtacttggctacttcaagatccttgccacggttgattgaggttgtcaagggttctacaaaggaaaaagtcgtcagagtagttgtcttgactctcagaaatttgttgcacaaagggacatttggtgcccagatggtagaccttggattgccacagcttgttcagagtttgaaagctcaagcatggagtgatgaggatcttctggaagctttgaaccagctggaagaaggaatgaaagttaacatcaagaagctaagctctttcgataagtataaacaggaagtcctcctcggacaacttgactggtcacccatgcataaagatcctatattctggagggagaacattacaagctttgaggaacacgatttccagatcctaagggttctgatcacaattctggagacatctacagattcaagaacacttgctgttgcttgttatgacctctcacagttcattcagtgccaccctgctggaagagtcatcgtgaatgacctcaaagcaaaggaacgcgtcatgaaactgatgaaccatgagaacgccgaggtcactaaaaatgccttgctgtgcatccagaggctatttctaggcgccaaatatgcaagctttttgcaggtctgaagtcttgttgttcataataagctatttattttcagaaatctcaattactattactattattattattattatttatttattttaaatgtgcaatgcgcgccgtggtcagtgtttggagagtttttcatattttgtcattcgcaatccaataagatgaatatgtttgtattctgtattcccaatatttgtatttc

SEQ ID NO: 5875 - DNA, 1756 bp, Orobanche aegyptiaca
acacgaatgacccgataactcgacccgtaaagcatccttcttcttgtacaaattgtttgtatatttcttttttctgcttcacgctccatctccagagtctgactttctctctgtagatttcgatctgtcgcaacaattattcctttacacagtatccatcctccccaatgcccatggatcaagccgagctctccaccgaccaggttttgaggagggatattccgtgggaaacttatatgactactaagctgatcaggggaacagggctccagctgctgcgtcgctatgataagaaacccgagaattacaaggctcagttgcttgatgatgacggtccagcttatattcgtgtttttgttagcattttgcgtgacatattcaaagaagaaactgtggaatatgttttagctctgattgatgaaatgctttcagcaaacccaaaagagcaagattatttcatgataagactcttgctgatgaagatacatacgagcctttcctaagattgctctggagaggtaactggtttatacaggagaagagctgtaaggtactttctttgatagtaagtggaaggccaaaatctcaggatgctgtgtttgccaatggggaatcagatcctaagaagcaaatcactactataaatgatgttttagagggactggttgagtggttgtgcactcagctgaggaatccatctcatccaagccgtggcattgccaccgctattaattgccttgcaactttactaaaaatgcccgtggtacgatcttcatttgttcaagcaggtggagttaaattgctcattcctctaatttctccagcatccactcaacaatccatccagctactatatgaaacctgcctttgtgtatggctcctctcattctatgaacctgcaattgagtacttggccacttctagatccttgccgcggttgattgaagttgtcaaaagatccacaaaggaaaaagttgtcagggtagttatcttgactctaaaaaatttgctgcacaaagggacatttggtgctcagatggtaaacctagaattgccacagcttgttcagaacataaaagcacaggcatggagtgatgaggatcttttggaagctctgagtcaactggaagaaggattgaaagataacatcaagcagctaagttcttttgataagtataagcaggaagtcctccttggacatcttgattggtcgcctatgcataaagatccgatattctggcgtgacaacattaccaattttgaagaacatgattttcagatcttaagggtcctgatcacgattttggacacatcctcggatcctaggacacttgctgttgcttgctatgatctctcacagttcattcagtaccatcctgctggtcgtataattgtgacagacctcaaagcaaaagagcgcgtgatgaaattgatgaaccatgagaatgcagaggttaccaagaatgccttgctctgcatccagaggctatttctaggtgccaaatatgcaagcttcttgcaagcttaagtactttccaggttctatgttatgagcattttctacgaaccaggatgggcaagttgtgtgtattattttacttagttctgaggtgtactgtactgctgtttttttatagggttcacattgatgaatgggtgagcaaattgcttttgtatttttttctcatgccgttcaataaattaacaacgattgtatcacatatttgttgatctgtaataatcatgttctctgttt

SEQ ID NO: 5876 - DNA, 1793 bp, Eschscholzia californica
ctctctttctctctacactttttacttgcttgtagattgatcgataccgatatataagtatctgcgaaaaagtttgaaatcatagatcttactatttcatgtttctctctattcaaaaccctagcattacctaaatatttttcaacgtccaattttcttaatttatattctgttttttttttcttttccgatctgtagttaatcgagttatttgacgaacttcgatttcaatggatcaagctgagttaactacggagaatgtacttaagagggacatcccatgggagacttacatgaacactaagctaatcacagggacatgtcttcagcttttaaggcgttatgataacaaatctgaaagctacagggcttctctgctcgatgatgatgggtctgcttatatcagggtatttgttaaccttttacgtgacgtatttaaggaagatacagtggaatatgttctagcacttattgatgaaatgctcacagccaacccaaaacgagctagattattccatgacaagtctcttgcagacgaagatacttatgaacctttcttaaggttgctttggaaaggtaactggtttatacaagagaagagctgtaaaatattgtctttgatagtaagtgctagaccgaaaggcaagaatggtgtaactgcaaatggagaatcctcgaaaagcaagtctacttctattgacgatgttttgaaagggctggtagagtggctctgtgctcagctgaagaagccttcccatccttctcgtggtattcccacttctatcagttgcctatctaatttgctgaaggagccattggtcagatcttcttttgtacaagtagacggagtgaagttgctcattccattgatttctccagcatccactcagcaatcaatccagcttctctatgagacatgcctctgcatctggctcctgtcttactacgaaccagcaattgaatacctcgctacttctagggccctgccgcgtctagtcgaagtagtcaaaggttccaccaaggagaaggttgtcagggttgttgtcttaacctttaagaatttgctcggcaaagggacatttggtgccgaaatggtagacctagggctaccacaaattgttcagagtttgaagggtcaggcatggagtgacgaggatctgttggaggcactgaatcaactagaagatgggcttaaagataatatcaagaaaatgagttctttcgataaatacaagcaagaaatccttctcggccatcttgactggtctcccatgcacaaagatccgatattttggcgtgaaaatatcacaaacttcgaagagaacaatttccagatcctgcgtgtcctaataacaatccttgagacatctggcgattctaaatcactagctgttgcttgctacgatctttcacaattcatccagtatcattcatctgggaggctaataatgaatgacctcaaggctaaggagcgagtaatgaagttgatgaatcacgataattccgaagttaccaaaaacgctcttctctgtattcagaggcttttcctcggtgcaaagtacgcaagctttttgcaggcgtaaatcggtatgttgttatttttttattgaaaagtttcgagcattcgggtttctccatgattatttcgatgtcaatttggaatattttgtttgttttaaatgaccatcttttgccctattatttgattacttaataaagagtcgaactctactgcactactaaaactttgtataacaatgtagaatgaatttgtgttgttaaaacaattgaat

SEQ ID NO: 5877 - DNA, 2078 bp, Cajanus cajan
gtcgcggagatgaacacgactgtggaagttgtggagcgagggatgctcatcatgtgcttccaaaactgatctatttcccttctccttcttacttctgtctttctttctccctgctacaaatccaaaatccaccaaatcccgggtaaaataaacctcttctcgatccatcactctcttcctcttcctttctcactttccctcctttcaatttcacttctgcctccgccactggcattcatttcactcgatttcacttcttcttccgcagcgccaaacagttaatttctcgatcgaactccgccacttctagggttccccgctgccatggaccaggccgaattaacctccgaacaggttctgaggagggacatcccatgggagacctatatgtccacgaagcttatctcaggcacgagccttcagctcttgaggcgttacgatcaccgaccagaaagtcacaaagcacagttgctcgatgatgatggtccctcttatgttcgcgtgtttgttcgtgttttgcgtgacattttcaaggaggatactgtagagtatgttttggccctgatagatgaaatgcttgcagcaaacccgaagagagcaagactgtttcatgacagtgcccttgcggatgaagatacttatgagcctttcctaagattgctctggaaaggaaattggttcatacaagagaaaagttgtaagatccttgctttaattgttagtgtcaggccaaaaagtcagaatggtactgtgtcaaatggagaagcatcaaatggaaagaagtctcttacaactattgatgatgttttgataggattggtaaaatggctctgtgaacagttaaagaaaccttctcatcctattcgtggagtcccaactgctatcaattgcctagcaacactactcaaggaacctgtggttaggtcttcctttgttcaggcggatggggtcaagttacttgtgccattgatttcaccagcatccactcaacaatctattcagcttctttatgaaacatgtctttgcatatggctcttatcctattatgagccagcaattgagtatttggctacttcaaggacccttccacgacttattgatgttgttaagagttctacaaaagagaaggtggttagagttgttgtcttgactcttaagaacttgatgtcaaaagggacattgggtgctcagatggttgaccttcagctgccacaagttgtccagagtttaaaagcccaagcatggagtgatgaggacttgttggaggcactgaattccctggaagaagggcttaaggataatattaagaaactaagttcttttgataagtacaagcaagaagttctccttggccatctggattggtctcccatgcacaaagatcccatattctggcgagaaaatataaccaactttgaagaaagtgatttccagatcctaagggtcctaataacaattttggacacctccaatgatcctagatctctggctgttgcttgctttgacctttcacagtttatccagatccatcctgcaggacgtatcattgtgacggaccttaaggccaaggaacgagtgatgaaacttatgaaccatgaaaatgctgaagttactaaaaatgcacttctctgcatccagcggcttctcttaggtgcaaagtatgcaagcttcttgcaggtttaattctacttctgtatggtggggcctagtgtatgcacttaattccatcaacttcagggcaatctcaaattgaatcggccctcgtgtactcggctattcattgttttagtgattaatttattgtgtatggctattaagatttcggtttcaacagtgcagaagaaattatatgtgagaaataagtatgcatgatattctgctgctgaataaaacaagttttgtaactatctcgaagttgtgcttgtaggtatgttgaagttgttagacaacaaaatttatcgttaatatggatatgtaatttcttgaaaaattagctacttgaatgagctacttttagaagaatactgacttgagggatgagaaaattattaatctatttcttccggattgcaagcttt

SEQ ID NO: 5878 - DNA, 1756 bp, Gossypium hirsutum
gaagaacagagccacaccagtgggaagaaaaagaaaccgtagtattcaggctagtgatccaacaacgttttaatccctctctctctctttctattagttttataatatttcttccaatttttcatcaatttcctctgaattttcatccaaggggcattaattttcgtggaatttgaagtatattcttttggcaccaatggagcgtgcggaactaacaactgagcaggttctgaagagagacatcccatgggaaacatacatgacaactaagctgatttcaggaacaggccttcagctgttaaggcgttttgataatagagctgaaagtgtcagggcacagttgttggatgatgatggtccagcctatgttcaagtgtttgttagcatattacgtgatatatttaaagaagaaacagtggaatatgttctggctctaattgatgaaatgcttacagccaatccgaaaagagccagattatttcatgacaagtctcttgcaaatgaagatacttatgaacctttcctaagattgctctggaaaggtaactggttcatacaagaaaagagctgcaagatacttgccttgatagtaagtgccaggccaaaaacccagaatggtgttgttgcaaatggagaagcctcaaactcgaagacaaagctcactaccattgatgctgtactaagaggattggttgaatggctttgcacacagctgaagaagccttaccatcctagtcgtggtattccaactgctattaactgtcttgcagcattgctgaaggaacctgttgtcagatcctcctttgttcaagcagatggagtgaagttgttgattcctttaatttgtccagcatccacacagcaatctatccagcttctttacgaaacatgtctctgtgtgtggcttttatcttactatgaaccggtaatcgagtacttggcaacatctagggctctaccccgactggttgatgttgttaggagttccacgaaggagaaggttgtcagggttgttgtattgacctttaggaacttgttgtccaaaggtacatgtggtgctcagatggttgaccttggattgccacaaattattcagagtttgaaagcacaagcatggagtgatgaggatctgttggaggctctcaatcaacttgaagatgggctgaaagataacattaagaaattgagttccttcgacaaatacaagcaggaagttcttcttggtcatcttgattggtcacccatgcataaagatccattgttttggcgtgataatattacgtgctttgaggagaatgatttccagattctaagggtcctcattacaattatggactcgtccaatgatccaagacctctggctgttgcttgctttgatatttcacagtttattcagcaccatcctgctggtagggtgatagtgaatgacctcaaggccaaggaacgggtgatgaagttgatgaaccacgagagtgcggaggttaccaagaatgccttactctgcatccagaggcttttcctcggcgccaaatacgccagctttttgcaggtatagtttcgtgttgttgtgtgcatggtcatgtctcattctacaatgcagctagtgaatatatcgtaagtaaattcggcttcggctttgttgggtgttatattttcatcggatatatttgataatgtcaaaaggaagatttattttcctttctgtcaaaaacttaaaaatgctactttgattctgagatgtgcaatagaaaatact

SEQ ID NO: 5879 - DNA, 1778 bp, Cucumis sativus
gcgtaggaaattaaaaaggaagagttaattcagttcgattctctcccatcttcatcataatttgcgaaaggatccgttgctggaagttgcgatggcaattgaccaggccgagcttagcactgagcaggttcttagaagggacattccatgggagacatacatgactactaaacttatcagtggaacaagccttcagttgttaaggcgttatgataacagaccagagagttacagggcgcagctgttggatgatgatggtccagcatatgttcgggtattcgttagcattttacgcgatatatttaaggaagaaacagtggaatatgttctagcattaatcgatgaaatgcttacagcgaacccaaaaagagcaagattgttccatgatccttctcttgcaagtgaagatgcttatgaacctttcctaagattgctttggaaaggaaattggttcatacaggagaagagctgtaaaatacttgcgctgatagtgagtgctagaccgaaaactcatgatggaagttttgcaaatgatgattcctcgaactccaagaacaaaaatactaccattgatgatgttttggatggactggtgaaatggctttgtgcacagctgaagaatccttcacatcctagtcgtgctgtacagacttcgatcaattgccttgcaactctgctgaaggaaccaaaggtcagatcctccttcgttcagacagatggagtgaaattgcttattcctttgatttctcctgcatcgacccaacaatctattcagcttctatacgaaacttgtctgtgtgtttggctcttgtcatattatgagccggcaattgaattcttggccacctctaggacccttccaagactcatcgatgttgtcaagagttctacaaaagagaaggttgtccgagttattattttgaccttgaggaacctactccacaaggggacatttggagctcaaatggtgggtcttggactaccacaagttgttcaaagtttgaaatcacaagcatggagtgatgaggaccttttggaggctttgaatcaactagaagagggactgaaagataacatcaagaaactaagttctttcgacaagtataagcaagaagtcctcctcgggcatcttgactggtctcctatgcacaaagatgtcaatttctggcgagaaaacattacaagctttgaagagaacgacttgaagatattgagggtcctaatcacaattctggatagttccactgatccaagggctttggcagttgcttgttttgatctttctcagttcattcaacaccatccagctgggagagttatagtgacagatctcaaggccaaagaaagagtgatgaaattgatgaatcatgagaatgctgaggttaccaaatatgccctcctttgcattcaaaggctctttcttggtgccaagtatgctagctttctacaggcttaactccctcctctctccatttgtgtgtaagttataataaaatccatctacttgaacacacccacccccagttgctggagctaaaaggggtttttattaattttatttaagtaattatcttcttaaatttttggtgtgattcaactagagattttattcgtttctttgcattcccagaatgttatttgggcatattgaataaagtcaccaggttctcataccttgtattttaccttttgttgtgtattgatttgaagaaaaaactgaagagatctctttgagataatgagttgaaagctaagtagaaatttctttgatcttctct

SEQ ID NO: 5880 - DNA, 1752 bp, Humulus lupulus
gattcgatttcaatccaatgacgatggaccatgccgaactctccactgaacaggttctgaaaagggatatcccatgggagacctacatgaccaccaagctcatcactggaacatgtcttcaactgctgaggcgttatgataacagatcagagagttacagagcccaattgctcgatgatgatggaccagcttatgttcgggtgtttgtgagcattttgcgcgatattcacaaggaagaaactgtagaatatgtactggcattgattgatgaaatgcttgcagcaaatccaaaaagagctagattattccatgacagttcactttctggtgcggatacttacaatcctttcttaagattgctctgggatggtaattggtttgcacaagagaagagctgtaagatacttgcttccatagtgagtgcaaggccaaaatcccatgatggaattattgcaaatgggggagcctcaaattcgaagagaacaacagctactattgatgatgtgctgaaaggcttggtggattggctttgtgcacagctgaagaggccctcccatcctagccgtggcattccaattgctgttaactgtctagcaaccttactgaaggaacctgtggttaggtcatcctttgtccaagctgacggagttaagttgcttgttcccttgattaccccagcatccactcagcaatctattcagcttctttatgaaacgtgcctttgtgtgtggcttttatcctattatgaacctgccatcgagtacttggctacttctagaactcttccacgactcatagacgtggtgaagagctccacaaaggaaaaggttgttagggttgttgtcttgaccatccggaacttgctctccaaagggacttttggtgcacaaatggtagatcttggcctaccacaaattgttcagagtttgaaagcacaagcttggagtgacgaggatctattggacgctctgaatcaactagacgagggcctgaaggataagataaaaaaattgagctcctttgataaatataagcaagaagtactccttggccatcttgattggtctccaatgcacaaagatgctgcattctggcgtgaaaatattacgaattttgaagagagtgattttcagattctgagggtgttgattactattttggacacatccagcgatccgagagctctggctgttgcttgctttgatctgtcgcagttcatccaacaccacgccgctggccgaatcatagtgacagacctgaaggcgaaggaacgagtgatgaaactgatgaatcacgagaatgcagaggttaccaaaaatgcattgctatgcattcagcggcttttcctgggcgccaagtacgccagctttttgcaggtttgagtacatttttgtggtgcctctgctcttctgttagatgactgaatctgaagggtctggtctatatatctatacacatatttttatatatatatatttattataattattggagaagagttgattatccaaatgggagtggagtggaccagttcctcttcctagctgtgaaatatttcatttgttctttttaagctctggaaggaaggaatattaaatattttggtggaaattgtagctgtggaataaaataaatcttccgggagtaactatttgtttgattttagtttaatcccataaaatgattatgagagcagaagtgatatctgcgtaaaaaaaaaaacaaaatacgcggccgccgtcgcgtgagact

SEQ ID NO: 5881 - DNA, 2182 bp, Cucumis melo
tttgcgaaaggatcgtaagttgtatacttctctccttgctgcttttcgaatcgggataagaatattttctttttgtcttccccattcctactcttcaaaattctctgcattttctacccatcacttttacttcaaccatttttgttgttgggagttccatattttgatttcctctacaacgcctaaactcttcttcttcttcttattcttcttcttcttcttcttggagtgatttttcagttcaattttggggatttcatctatttctttgatctgcagcgttgctggaagttgcgatggcaattgaccaggccgagcttagcactgagcaggttcttacaagggacattccatgggagacatacatgtctactaaacttatcagtggaacaagccttcagttgttaaggcgttatgataacagaccagaaagttacagggcacagctgttggatgatgatggtccagcatatgttcgggtatttgttagcattttacgtgatatatttaaggaagaaacagtggaatatgttctagcattaatcgatgaaatgcttacagcgaacccaaaaagagcaagattgttccatgatccttctcttgcaagtgaagatgcttatgaacctttcctaagattgctttggaaaggaaattggttcatacaggagaagagctgtaaaatacttgcgctgatagtgagtgctagaccgaaaactcatgatggaagttttgcaaatgatgatgcctcgaactccaagaacaaaaatactaccattgatgatgttttggatggactggtgaaatggctttgtgcacagctgaagaatccttcacatcctagtcgtgctgtacagacttctatcaattgccttgcaactctgctgaaggaaccaaaggtcagatcctccttcgttcagacagatggagtgaaattgcttattcctttgatttctcctgcatcgacccaacaatctattcagcttctatacgaaacttgtctgtgtgtttggctcttgtcatattatgagccggcaattgaattcttggccacctctaggacccttccaagactcatcgatgttgtcaagagttctacaaaagagaaggttgtccgagttattattttgaccttgaggaacctactccacaaggggacatttggagctcaaatggtgggtcttggactaccacaaattgttcaaagtttgaaatcacaagcatggagtgatgaggaccttttggaggctttgaatcaactagaagaggggctgaaagataacatcaagaaactaagttctttcgacaagtataagcaagaagtccttcttgggcatcttgactggtctcctatgcacaaagatgtcaacttctggcgagaaaacataatgagctttgaagagaacgatttgaagatattgagggttctaatcacaattctggatagttccagtgatccaagggctttggcagttgcttgttttgatctttctcagttcattcaacaccatccagctgggagagttatagtgacagatctcaaggccaaagaaagagtgatgaaactgatgaatcatgagaatgctgaggttaccaaatatgctctcctttgcattcaaaggctctttctaggtgccaagtatgcgagctttctacaggcttaactccgtcctctctccatttgcgtgtaagttataataaaatccatctacttgaacacacccacccccagttgctggagctaaaaggggttcttattaattctatttaagtaattatcttcttaaaatttttggtgtgattcaactagagattttattcgtttctttgcattcccagattgttatttgggtatattgaataaagtcaccaggttttcataccttgtattttaccttttgttgtgtattgatttgaagaaaactgaagagatctctttgagatagtgagttgaaagctaagtagaaatttctttgatcttctctctcactctactctaaattgtggaaattctattacatttttgtgaaattatttggatacatgttcgaacatcaattatgtcattctttctaaatacattgtgatcttagaatttggattttctttttctttcaagtttcatttgtaaaaatagggtctacaaaaaaacatgctttcccgaggctccaacgtcggaaaaaaa

SEQ ID NO: 5882 - DNA, 1676 bp, Triphysaria pusilla
ccggaacatttgctcgttattttataattctggtttctgctgattacgctctatctctagagtcggactttctctctctagatttcgatctgttgcaaccattatctgattactcagctccattctcccatgccgatggatcaagccgagctctctgccgaccaggttttgaggagggatattccatgggaaacttatatgactactaagttgataacggggacagggcttcagcttttgcggcgctatgataagaaaccagagaattacaaggcccagttgcttgacgatgatggcccagcttacattcacgtttttgttagcatcttgcgtgacatattcaaggaagacactgtagagtatgttttagcactgattgatgaaatgctttcagcaaatcccaaacgagcaagactatttcatgataactctcttactgatgaggatatatacgagcctttcctaagattgctctggaaaggtaactggtttattcaagaaaagagctgtaagatactttctttgatcgtaagtggaaggccaaagtctcaggataggccattagccaatggggtatcaaattcaggaaagaaaatcaccaatataaatgatgttttaaagggacaggttgagtggctgtgcacacagctgaggaatccgtcccatcctagccgtggcattccctccgccattaattgccttgcaactttactgaaagagcctgtggtacgatcgtcctttgttcaagcggatggagtgaagctgcttattcctctaatttctccagcatcgactcaacaatccatccagctcctctatgaaacctgcatttgtgtatggctcctttcgtactatgaacctgtaattgagtacttagccacttccagattgctgccacggttgatagaagttgttaaaggatccacaaaggaaaaggttgtcagggtagttatcttgaccctaaagaatctgctacacaaaggaacatttggtgctcagatggttcccctgggattgccgcagcttgttcagaatctgaaaggtcaggcatggagtgacgaggatctgctggaatctctgaatcaactggaagaaggattgaaagataacatcaagcagctaagttcttttgataagtacaagcaggaagtcctccttggacatcttgattggtcacctatgcataaagatcctatattctggcgggacaacattaccaactttgaagaacatgattttcagatcctaagggtcctgatcaccattttggacacaagctcagatccaagaacacttggtgttgcttgctatgatctatcacagtttgttcagtatcatccagctgggcgtatcattgtgaccgacctcaaagcaaaagagcgtgtgatgaaattgatgaaccacgagaatgcagaggttactaagaatgccttgctctgcatccagaggctatttttaggtgccaaatatgctagctttttgcaaccttaagtattttacaggttctgttgacgtgatcatttttattttttcacaaaacatggacgggcaaattatgttgtgtattatttatttatttctgcccctttttgttgggtgttcatgttgttttttggagaaattattttgtatgttctctcatacaccataatgagtgcatcatatctgtaggctgt

SEQ ID NO: 5883 - DNA, 2183 bp, Tripterygium wilfordii
agatttctagatctggattttaatttcggaacggagatccgagtatttgaattggtagacaaaaactgataagagcatttagggatttccgttatcaatggaccaagctgaactgacgacagaacaggttctaagaagagacatcccatgggaggcttacatgacaactaagctgatttcgggaacaggccttcagctgttaagacgttatgataaaaaacctgaaagttacaaggcacagttgctggaagatgatggtccggcttatgttcgggtatttgttagcattttgcgggatatattcaaagaggaaacggtagaatatgttctagctttaattgatgaaatgctcacagcaaacccaaaaagagccagacttttccatgaaaaatctctcgccaatgaagatacttatgaacctttcttaagattgctttggaaaggtaattggttcgtacaagaaaatagctgcaagattcttgctttgatagtaagtgctaggccaaaacaccatggtggtgctgtttcaaatggggaagttgccagttctaaaagtaaagtcactagcatcgatgatgtgttgaaaggattagttgaatggctctgtgtgcagctaaagaatccttctcatcctattcgtggcattccagcagctattaattgccttgcaacattgcttaaggaacctattgttaggtcttcctttgttcaagcagacggggtgaagttgctgatcccttttatctctcctgcatcaacccaacaatctattcagcttctttatgaaacatgtctctgtatctggctcttatcttactatgaacctgcatttgaatacttggctacctctagaacccttccgcgtctgctagaggttgttaagagttccacaaaagagaaggtggtcagggtggttgtcttgaccttcagaaacttgctccacaaaggaacgtttggtgctcagatggtggaccttggactgccgcaaattgttcagagtttgaaaacacaagcatggagcgatgaggacctgttggaagctctgaaccaactggaagaagggttgagggataacattaagaagttaagttcttttgacaagtacaagcaagaagtgctccttggccatcttgactggtctcctatgcacaaagaccctatgttttggcgtgagaatattaaaattttcgaggagaatgattttcagattcttagggtccttatcacaattttggacacctcgagtgatccaagagccctggctgttgcttgctttgacctctcccggtttgtccagcaccatccagctggtcgcgtcatattgacagacctcagggccaaggaacgggttatgaaactgatgaaccatgaaaatgccgaagttaccaaaaatgctcttgtatgcattcagaggcttttccttggtgcaaaatatgcgagctttttgcaaggttgattccaacccatttgggtttgtaatggtaaatcgttcatacattctacatttgatcggtacacgggactttgtcatttcaatcagcttataatgtttggcaggtggtaatagaaaaagagagaatggccgtagaaccagtttatggtgtccacactgttgattcctggacccagcacctcaataatgcgaaggagtccaaacaactggttgccgtggactttacagctacttggtgtggcccttgtcgtatcatttccccaatcttttcagagttggccaagaaattcactaatgtcattttcttgaaggttgatgtggatgaactgaggagtgttgctgaggagtggtccgtggaggcaatgcctacatttattttcttgaaagaaggcaaattagtgcacaagattgtgggtgccaggaaggaggaactagtgcagacggttgaaaagcttgcaactgaaactgcagctgcttgatgcatgagaattgctatggctttctagctgcttctaataagaactttaatgttatctaaaacgtatgcttatatgttcccgtgtattgctacatattaatcttatggatttgggtgatgttggataactagaatgaatgccttgtgaacagtggttccagtaacattttggcaaccaatttatggtgaatttgccttgtatggctttgttatgttaaaagcttgacccgctattatattagattgggtgaa

SEQ ID NO: 5884 - DNA, 1526 bp, Capsicum annuum
tgatcacctatttttgctctaatcgcatttggtcacttccaagtaataataataaaggatagaggaagactaatccatattctggctatttggtaagaggataataaatttcggatttgaagggcataatcgcaatgacaatggagaactctgagcttactacagagcaggttttgaggagggatatcccatgggagacatacatgactacgaagctgatcactggaacaggttttcagctgttgaggcgctatgacaagaaggcagaaagttacaaagcccagttgctggatgacgatggtccaggttatgtccgcgtctttgtcaccattttacgtgacatcttcaaggaagaaaccgtggaatatgttttggctttgattgatgaaatgcttacagcaaacccaaaaagagcaagactattccatcatgacagtcttgcggacgaagatacctatgaacctttcctcagattgctgtggaaaggtaattggttcatacaagagaagagctgtaagattctatctttgatagcgagtgcccggtcaaaaggtcagaatggtgttgatgcaaatggagatgcctcaagttcaaagaagaaacacactaccattgacgatgttctggcaggcttggtggagtggctttgtgcacagttgaaaaagcctactcatcctacccgcagcattcctagcacaatcaactgcctatcaactctgttgaaagagccagtggttcgatcttcatttgttcgagctgatggagtgaagttgcttgttcctttaatttcaccagcatccacgcagcagtctatccagcttctctatgagacatgcctatgtgtctggcttttgtcttattatgaacctgcaatagattacttggctacttccagagccctccctcgattgatagaagttgttaaaggttcaacaaaagagaaggttgtacgggtcgtcatcttgactcttcggaatttgctttccaaagggacatttagtgctcagatggtagacttgggagtgctgcaaattgttcagagcttgaaagcacaggcttggagtgatgaggaccttttggacgctctgaatcaactagaacaaggattgaaggagaacatcaaaaaactgagttcgtttgacaagtacaagcaggaagtacttcttggccatcttgattggtccccaatgcacaaagatcctatattctggcgggagaacataaacaatttcgaggagaatgatttccagatcttgagggtgctcattacaattttggacacatcgactgatgcaaggacacttgctgttgcttgctatgatctatcacagttcattcagtgccattctgccggacgaattatagtgaacgacctcaaagctaaggagcgcgtaatgaaactgctgaaccaccagaatgcagaagtcaccaaaaacgctttgctctgtatccaaaggcttttcctaggtgccaagtatgctagttttttgcaagtttaagcctcgtcgaatggtttcattacattg

SEQ ID NO: 5885 - DNA, 1983 bp, Solanum lycopersicum
gttattttcctttttctatggtcttcctcatccatcgagtttgatctcaccttcgtgaacccccacccccaccccaccccaccccaagatttgtagcctacgtgcaccctcatatactggaagattagtttttgggttctaatcacatttggttacttccacgtgatacggatagaggaagaacgatccatattctggctatttggtaagaagaaaacaaattttggatttgaagggcataatcacaatgacaacggagagcgtggagcttactacggaggaggttttgaggagggatatcccatgggagacatacatgactacaaagctgatcactggaactggtttgcagctgttgaggcgctatgacaagaaggcagaaagttacaaagcccagttgctggatgatgatggtccaggttatgtccgcgtctttgttaccattttacgtgacatcttcaaggaagaaaccgtggaatatgttttggctttgattgatgaaatgcttacagcaaacccaaaaagagcaagactattccatgatgagagtcttgcagacgaagatacctatgaacctttcctcagattgctgtggaaaggtaattggttcatacaagagaagagctgtaagattctatctttgacagtgagtgctaggtcaaaagttcagaatggtgctgatgccaatggagatgcctcaagttcaaagaagaaaatcactaccattgacgatgttctggcaggcgtggtggagtggctttgtgcacagctgagaaagcctactcatcctacacgcagcattgctagcacaatcaactgcctatcaactctgttgaaagagccagttgttcgatcttcatttgttcgagctgatggagtgaagttgcttgtccctttaatttcaccagcatcgacccagcagtctatccagcttctctatgagacatgcctttgtgtgtggcttttgtcatactatgaacctgcaatagagtatttagctacttcaagggccctcaatcgattgatagaagttgttaaaggttcaacaaaagagaaggttgtacgggttgtcatcttgactcttcggaatttgctttccaaaggaacatttagtgctcatatggttgacctgggagtgctgcaaattgttcagagtttgaaagcacaggcttggagtgatgaggatcttttggacgctctgaatcaactagaacaaggattgaaggaaaacatcaaaaagctgagttcgtttgacaagtacaagcaggaagtcctccttggccatcttgattggtccccaatgcacaaagatcctatattctggcgggagaacataaataattttgaggagaatgatttccagatcttgagggtgctcattacaattctggacacatcaagtgatgcaaggacacttgctgttgcttgctatgatctatcacagttcattcagtgccattctgctgggcgaattatagtgaatgacctcaaagctaaggagcgcgtaatgagactgttgaaccacgataatgctgaggtcacgaaaaacgctttgctctgtatccaaaggcttttcctcggtgccaagtatgctagctttttgcaggcttaagtcttttcgaatggtttcattccattgttcagacgacaggaactagactcatctcgttatttccttggacacaaggagtttgtggtcgtggtcatggtcgtggtcttgttaatttatttgttgtatcctattcgagtactgtatctaaggcgtcttcttggtgagattttcattccaaataaggtctacgagttaattaaatttcccctccaataaaaggaagtttgtgttgacatgtttatcgaaccggggaattgttttgtggtatatactatctggaattactgttcaaacaacttattaatccgatgattttgtattatcggtatggttttatgtatggaggcttatagcctagtgatatcatcgag

SEQ ID NO: 5886 - DNA, 1650 bp, Aquilegia formosa
atcaccatcatcatcatatattcattcattcataatcttcacatttgactcactactactctggctcaggcggaggattggattggattcacaagtcataattcataattcatggatcagcatgctactgcagcagaattaaatacggaccaggttcttaagagagacatcccatgggagacatacatgacaaccaagctaattactgggacatgccttcagctattaaggcgctacgataacagatctcaaacctatcgagcagcacttcttgatgatgatggtccagcttatgttggtgtgtttgttaatattctgcgagatatattcaaagaagaaacagtggaatatgtgcttgctcttattgatgaaatgctcacagctaacccaaagcaagcaacactattccatgaccaatctcttgcagatgaagatatttatgaaccattcttaaattgttgtggaaaggcaactggttcatacaagagaagagctgtaagatattgtcagtggttgtaagtgccaggcccaaatccaaggatggaatgattgcaaacggagaagagttgcgttcgaagaacaaactcacaactattgatgaagttctgaatggattagttgagtggctttgtgctcagctgaagaagccttctcatcctactcatggcatcccaactgctgtcagttgcttagcaactttgctgaaggaaccaattgtcagatcctcatttgttaaagcggatggggtgaagctgctcattccattgatttctccggcatcaacgcaacaatctatccagcttctctacgaaacatgtctcagcatttggctcctgtcttactatgagcctgcagttgaataccttgctacttctaggactctaccccgacttgtagaggttgtcaagagttccactaaagaaaaggttgtgagggtgattatcttaaccctaaaaaacttgctttccaaagggacatttggagcgcaaatggtagaccttggactgcctcaagttgttcagagtttgaaagcgcaggcatggagtgatgaggatttgttggaggctctgaatcaactggaggagggaatgaaagacaatatcaagaaattgagttcttttgataagtacaagcaggaaatccttttaggtcatctcgactggtcgcccatgcacaaagatccaattttctggcgagaaaatcattcaaactttgaagacaatgatttccagattctacgagtactcatcactatcctggaaacctcaagtgatcctaaagcgcttgcagttgcttgttacgatctctctcagtttattcagtaccatccggctggacgaatcattgtgacggatctgaaggcgaaggagcgagtgatgaaattgatgaatcatgagaatgtagaggtgacaaagaatgctcttctctgtatacagaggctatttcttggtgcaaagtacgcaagctttttgcaggcttaagcttggaattatgtactttctgcaggcttaagcttggaattatgtaattttgatgtcattgactgcaaatgctaataatatatttattgttgtccaagagccttaaaaatgttgttattaaggtctactgtgaccagattttgtgttgtaatgtgtattaaattattaa

SEQ ID NO: 5887 - DNA, 1698 bp, Panax ginseng
tactcccgatccactaaataactaccactatcgttgccgaacgaaaaactcagattatctctctctccttttctcgtctgaagcacttcgattccaaaccctgtaaatgccgatggatcaagccgagctcactagcgaacagattctgaagagggatatcccgtgggagtcgtacatgacaactaagctgatctcggggacaggacttcagctgttaaggcgttatgataaaaaacctgaaagttccaaggcacagttgctggatgatgatggtccagcttatgttcgtgtgtttttcaccattttgcgtgacatattcaaggaagaaacagtagaatatgttctagctttgattgatgaaatgctaacaggaaaccccaaaagagccagattattccatgacaagtctgttgcaggtgaagatccctatgagccttttctaagattgctctggaaaggaaattggtttatacaagagaaattctgtaagatactttctttgatagtaagttcaagaccaaaaactcaagatgttgtcatcatgaatggagaggcctccaattcaaataagaaagtcaccagtatcgatgatgttttgaaagggctggtggagtggctttgcactcagctgaagcagccttcccatcctagccgtggaattcctacagctatcaattgcctgacaacgttattaaaagaacctgcagttagatcttcatttgttcaagcagatggggttaagctacttgttcctctgatttctccagcttccactcagcagtccgtgcaactcctctatgaaacatgtctctgtgtttggctgttgtcatactatgaacctgcaattgattactttgctacttctagaagccttccgcgattaattgaggttgtcaaaggatccaaaaggaaaaggttatccgggtgattgtcttgacattcaagaatttgctttccaaaggtacttttgatgctcaattggtataccttggattaccacaagttgtccagagtttgaaagcacaagcatggagcgatgaggacctgttggaggctctgaatcaactggaagaaggactgaaagacaacataaagaaattgagttcttttgaaaaatacaagcaggaagtccttcttggtgatcttgactggtcccctatgcacaaagatcctatattctggcgtgataacattacaagatttgaagagaatgatttccagatcttaagggtcctcgttacaattttggacaaatccggtgatccaaggtcgctcgctgttgcttgctttgatctctcgcagttcattcagtaccatcccgctggtcggagtatagtgactgacctgaaagcaaaggagcgggtgatgaaattgatgaaccatgagaatgcagaggttaccaagagttccttgctctgcatacaaaggcttttccttggtgccaagtacgcaagctttttgcaggcttaactaactttattttcttaaactagttgctctcccaaattaaatatgctgcgttttctttataaatgaaatatcgtgagagttgggtgcagtagatatgagattctaatgatcataatgtgagtaatgtaccatctagggcctttatttcatttcatccgctacctcttcgaatgttaaaagttatttgttttttgggacatcatgctataaaataaacaaatttaattc

SEQ ID NO: 5888 - DNA, 2818 bp, Quercus alba
aaaacaccaccacacaaacacacaggtgttggaattggtgaagttgtggtataattccaagtgggtattcagtaattatggaccaagctgagttaaacacagaacaggtcttgaagagggacataccatgggagacgtacatgacaactaagctcatctcaggaacaagccttcagctgctaaggcgttatgataatagaccggaaagctatagagcacaacttctggatgatgatggtccagcttatgttcgagtgtttgttagcattttacgtgacatttataaggaggaaactgtagaatatgttctggcgttagttgatgaaatgcttacagcaaacccaaaaagagcaagattgttccatgacaagtctcttgccagtgaagatacttatgaacctttcttaagattgctttggaagggtaattggttcatacaagagaagagctgtaagatagttgctttaatagtaagtgctaggccaaaaatccaggatggcataattgcaaatggagaagcctcaaattcaaagaaaaatccacttctattgatgatgtattgcaagcattggtagaatggctttgtgaacagctgaagaagccttcccatcctagtcgtggtgtcccaactgccatcagttgccttgctacgttacttaaggaacccatggtcagatcctcctttgttcaagcagatggggtgaagttgctcattcctttaatttctccagcatccacccagcaatcaattcagcttctgtatgaaacttgtctctgtgtttggcttttgtcatactatgaacctgcggttgagtacttggctacttcaagagccctgcctcgcctcatagaagttgttaagagttccacaaaggagaaggttgtcagagttgttgtcttgacccttaggaacttgctttccaaagcagcatttggtgctcaaatgatagaccatggtctgccacaaattgttcaaagcttgaaagcacaagcatggagtgatgaggacctgttggaggctctgaatcaactagaggaagggctgaaggacaagattaagaaattgagttcctttgataagtacaagcaagaagtcctcctcggtcaacttgactggtctcctatgcacaaagataacttgttttggcgtgataacattaagaactttgaagagaatgatttccagattttgagggtcctcattacaattttggatacatcaaatgatccaaggactctggctgttgcttgctacgatctctcacagttcatccagcatcatccggctgggcggatcattgtgacagacctcaaggccaaggaaagggtgatgaaattaatgaaccatgagactcctgaggttaccaaaaacgccctgctctgtattcaacggcttttcctgggtgccaagtatgcaagctttttgcaggtttagttcagttttcttggggaataatggtgtatatttctgagcccatatactcttgagtattttggctcccgtatcatatatggttcatttgttgttgtttgagtaatttatcatctagcgcccttctcttgtcagagatttcagttgtggaagagtttgaagaattaatttgttctcctatacagtggaatattatttttaggcataatattaaataaaaaaagtttagtttttggtttcaacccatctcagtctctgtgtgtgtgcgagtgtgtgtgtaaattctcagcaatgcatcgaatagtttcaaaattagcttcatcgatcacttcatctacttcaagaaaagttgtgtgtagcagagttgtctgcaatagaaattatggtgccaaggctattaattttggggtcggggctcgggctgcaatgctgcaaggcgtttctgaggttgcagaagctgtaaaagtcacaatgggaccaaagggccgcaatgtgataattgagcgaagtcataaggatcctcaagtcacaaaggatggtgttactgttgccaaaagtatcagcttcaaggaaaaagccaaaaatgttggtgcagatcttgtaaagcaggttgcaattgctactaatactgctgctggagatggtactacttgtgcaactgtcctaactcaggcaatactcatggaagggtgcaagtcagtagctgctggtgtgaatgtgatggatttgcggagtggtattaatatggcagtcgatgctgttttatctgatctgaaaagcaaagcattgatgataagcacatcagaagaaattaaacaggttgcaactatttcagcaaatggtgaaagtgagattggagatcttatagctagagcaatggagaaagttggaaaggaaggagtcattactgtcgctgatgggaatacgatggataatgagttagaagtggtggaaggaatgaagctagccagaggctacatatctccttattttgttactgatcataagacccagaaatgtgaactagagaaccccctgatcctcatttatgacaagaaaatttcagacatgaattcacttgttagaatattggagctagcagtacagaaaaaaagagcactacttgttgtggctgaggatgttgaaagtgatgcactttctatgcttgtactcaataagcatcatgctgggcttaaggtttgtgcgatcaaagctcctggttttggggaaaatagaagagcaaacttagatgatcttgccattcttactgggggagaggttatcactgaagaccgtggtttaacccttgacaaagtgcaatttgaaatgcttggaactgcaaaaaggtgtctgtctctcttgatgacacaataattcgtgtctgat

SEQ ID NO: 5889 - DNA, 1512 bp, Ricinus communis
ctctcctcacgagcagagctccttccttccatttaacagaaccagagactacagagatacaaagttaatcagtggcaaatggaccaagccgaacttactactgagcaggttcttaagagggacatcccatgggagacttatatgatgacaaagctgatctcagggacagaccttcaacttttgaggcgttatgataatcgatctgagagtcaacgagctcaattgctagacgatgatggtccggcttatgttcgggtgtttgttaacatcttacgagatatatttaaagatgaaacagttgaatatgttctggctttaattgatgaaatgctagcagctaacccaaaaagagccagattattccatgataagtctctcacaaatgaggatacttatgagcctttcttaagattgctgtggaaaggtaactggtatatacaagaaaagagctgcaagatacttgccttgatcataagtgataggccaaaaactcaagatggcaccattgcaaatggagaagcctcaaattcaaagagaaaaggtactaccatcagtgacgtgttgaaaggattggttgaatggctttgtgctcagctgaagaagccttcacatcctagtcggggcgttccgagtgctattagttgcctagcaacattacttaaggaacctgtagtcaggtcttcctttgttcaagcagatggagtgaaactgctgattcctttaatttctcctgcttctacccagcaatctatgcagcttctttatgaaacttgcctctgtgtctggctattatcttactatgaaccggcaattgaatacttggctacttctagaaccttgccgcgactaatagatgttgttaaaagttccacaaaagagaaggttgtcagggttattgtcttgaccttcaagaacttgctctccagaggtacttttggtgcgcagatggtagaccttggcctaccacaagttgttcaaagcttgaaaacacgagcgtggagtgatgaggacttgttggaggctctgaaccaactggaagaaggcctaagggataatattaagaaactgagttcttttgataagtataagcaagaagtcctccttgggcatcttgactggactcctatgcacaaagatcctatattctggcgtgaaaacttaaacaactttgaagagaatgatttccagattctgagggtcctcattacaattttggatacatctaatgactcaagagccttggcggttgcttgctttgatctctcacagtttatccagaaccaccctgctggacggattatagtgacagatctcaaggctaaggaaagggtgatgaagctcatgaaccatgaaaatgctgaagtcaccaaaaatgccctactgtgtatccaaaggctattcctaggcgccaagtatgcaagctttttgcaggcctgattttctggttgcaagcgtgtaataatagtttaatgctgattgtgccatccgcaaatgagactgcttaaattgaat

SEQ ID NO: 5890 - DNA, 1751 bp, Phaseolus vulgaris
gtctctctgctacaaatccaaaaacctccaaattgcgagttcaaaattcaagagcgagttctagggttccccactgccatggaccaggccgaattaaccaccgaacaggttctgagtagggacattccatgggagacctacatgtccacgaagctcatctctagcacgagccttcagctcttaaggcgctatgatcaccgatcagagagtcacagagcacagttgctcgatgatgatggtccctcttatgttcgcgtgtttgttcgtgttctgcgtgatattttcaaggaagatactgtagagtatgttttggcactgatagatgaaatgcttgcagcaaaccctaagagaggaagactttttcatgacagtacccttgcagatgaagatacttacgagcctttcctaagattgctctggaaaggaaattggttcatacaagagaaaagttgtaagatccttgctttaattgttagtgtcaggccaaaaaatcagaatggtgttgtgtctaatggagatgcatcagatggaaagaagccatttaccactattgatgatgttttgataggattggtaaaatggctatgtgaacagttgaagaaaccttttcatcctactcgtggagtcccaactgctatcaattgcctatcaacactgcttaaggaacctgtggttaggtcttcctttgttcaggcagacggggtcaagttacttgtgccattgatttcaccagcatccacacagcagtccattcagcttctttatgaaacatgtctctgtatatggctcttatcctattatgagccagcaattgaatatttggctacttcaaggacccttcctcgacttattgatgttgttaagagttctacaaaagaaaaggtggttagagttattgtcttgactcttaagaacttgatgtcaaaagggacattgggtgctcagatggttgatcttcagctgccacaagttgtccagagtttaaaagcacaagcatggagtgatgaggacttgttggaggcactgaattctctggaagaagggcttaaggataatattaagaaactaagttcttttgatatgtacaagcaagaagttctccttggccatctagattggtctcccatgcacaaagatcccatattctggcgagaaaatataaccaactttgaagaaaatgatttccagatcccaagggtcctaattacaattttggacacttccagtgatccaaggactctggcagttgcttgttatgacatttcacagtttatccagcaccatcctgctggacggataattgtgacagacctcaaagccaaggaacgggttatgaaacttatgaaccatgaaaatgctgaagttactaagaatgcactactctgcatccagcggcttttcttaggtgcaaagtatgcgagtttcttgcaggtttaattctgttttgttgggtggtggcctgctggatgcccttatttccatcaacttgactgctatctaaaaaattgggtcggttctcgtgtacaaggcttattcattgctttagtaattaatttattgttgtgtatggcatattaagatttcggtttcaacagtagaagaaattttatgtgagaaataagtatgcatgatattctgctgccgaataaaacaagttttgtaattaaatactggaagttgtgcttgtagtaatgttgaatttgttagaaaacaaaatttattatttaatatgagctatcagattgagccaa

SEQ ID NO: 5891 - DNA, 1795 bp, Vigna unguiculata
gggaacatgattgtagcatggtcgtggcgagggatgcttaccaatatgtgattccaaaactgatctatttcccttctccttctcacttctgtctctctgctacaaatccaaaaaccaacaaatcgcggtaccaaatttaagtttcccgagcgagttctagggttcccgctgccatggaccaggccgaattaaccaccgaacaggttctgagtagggacattccatgggagacctatatgtccacgaagctcatctctagcaccagccttcagcttttgaggcgctatgatcaccgatcagagagtcacagagcacagttgctcgatgatgatggtccctcgtatgttcgcgtgtttgttcgtgttctgcgcgatattttcaaggaagatactatagagtatgttttggcactgatagatgaaatgcttgcagcaaaccccaagagagcaagactgtttcatgacagtacccttgcagatgaagatacttatgagcctttcctaagattgctctggaaaggaaattggtacatacaagagaaaagctgtaagatccttgctttgattgttagtgtcaggccaaaaaatcagaatggcgttgtgtctaatggagaagcatcaaatggaaagaaaccatttacaactattgatgatgttttgataggattagtaaaatggctttgtgaacagttgaagaaaccttttcatcctactcgtggagtcccaactgctatcaattgcctagcaacactgcttaaggaacctgtggttaggtcttcctttgttcaggcagatggggtcaagttacttgtgccattgatttcaccagcatccacacaacagtccattcagcttctttatgaaacatgtctctgcatatggctcttatcctattatgagccagcaattgaatatttggctacttcaaggacccttcctcgacttattgatgttgttaagagttctacaaaagagaaggtggttagagttattgtcctgactcttaagaacttgatgtcaaaagggacattgggtgctcagatggttgatcttcagctgccacaagttgtccagagtttaaaggcacaagcatggagtgatgaggacttgttggaggcactgaattctctggaagaagggcttaaggataatattaggaaactaagttctttcgatatgtacaagcaagaagttcttcttggtcatctagattggtctcccatgcacaaagatcccttattctggagagaaaatataaccaactttgaagaaaatgatttccagatcctaagggtcctaataacaattttggacacttctagtgatccaaggactctggcagttgcttgttatgatctttcacagtttattcagaaccatcctgctggacggataattgtgacagacctgaaggccaaggaacgagtgatgaagcttatgaaccatgaaaatgctgaagttactaagaatgcactactctgcatccagcggcttttcctaggtgccaagtatgcaagtttcttgcaggtttaattctgtttagtgagatggtggcctactggatgcacttaattccttcaacttcactgctgtctcgtgtacaaggcttattcattgctttagtaattaatttattgttgtgtatggcatattaaaatttcggtttcaacagtagaagaaattttatgtgagaaataagtattctgctgccgaataaaacaagttttgtaattaaatactcgaacttgttcttgtagttacgttgaatttgttagagaacaacatttattgttaaa

SEQ ID NO: 5892 - DNA, 1680 bp, Fagus grandifolia
gaccccgcaaaaaaccaccacacacacacaaacaaacaatctaacaggtattggagttcgtgaagttctggtataattccaagtggagattcagtattcatggaccaagccgagctaaacacggaacaggtcttgaagagggacattccatgggagacatacatgacgactaagcttatctcaggaacgagccttcagctgctaaggcgttatgataatagaccggaaagttatagagcacaacttctggatgatgatggtccagcttatgttcgggtgtttgttagcattttacgtgacatttttaaggaggaaactgtagaatatgttctagcattagttgatgaaatgcttacagcaaaccccaaaagagcaagattgttccatgacaagtctattgccaatgaagatacttatgaacctttcttaagattgctttggaagggtaattggttcatacaagagaagagctgtaagatccttgctttaattgtaagtgctaggccaaaaatccaggatggcatcattgcaaatggagaagcctcaaactcaaagaaaaaattcacttctattgatgatatattgcaaggattggtagaatggctttgtgcacagctgaagaagccttcccatcccagtcgtggtgtaccttcagctatcagttgccttgctacattacttaaggaacctatggtcagatcctcttttgttaaagcagatggggcgaagttgctcattcctttaatttctcctgcatccacacagcaatcaattcagcttctgtatgaaacttgtctctgtgtttggcttttgtcatactatgaacctgcggttgagtacttggctactacaagaaccctgccacgcctcatagaggttgttaagagttccacaaaggagaaggttgttagagttgttgtcttgacacttaggaacttcatttccaatgtggcgtttggtgctcaaatggtagagcttggtctgccgcaaattgttcaaagcttgaaagcacaagcatggagtgacgaggacctgttggaggctctgaatcaactagaggaagggctgaaggacaacattaagaaattgagttccttcgataagtacaagcaagcagtcctccttggtcaacttgactggactcctatgcacaaagatcccttattttggcgtgataacattacgtgctttgaagagaatgatttccagattttgagggtcctcattacaattttagatacatccaatgatccaagggctctggctgttgcttgctttgatctctcacagttcattcagtatcatccagctgggcggatcattttgacagacctcaaggccaaggaaagggtgatgaaactgatgaaccatgagaatgctgaggttaccaaaaatgccctactctgtattcaaaggcttttcctgggtgccaagtatgcaagctttttgcaggcttagttcagtcttcttggggaataatggtgcatgtttctacgcccatatgcaaagtatttggctcccgtatcatatatggttcatctattgttgtttgagtaatttattatctggggctcttctcttatcagaatttttggttgtggaagagtgtgaagaattaatttgttctcctataaagtggaatattatttgtagactaaaaatattaaataaattttcaag

SEQ ID NO: 5893 - DNA, 1966 bp, Ricinus communis
tgttaattcaatatttcgattgataaaagaaaataattaagaagacgacaaaagattttagaaatttaccgtgataccgtccgataaacaagatgcagccccacagataagtgacgtgaatggttgagattagaagtaacgagtagaccacaataaagaaaggactaccaaatcggggctcaccaatcacaaatctctttcaaaggaagctctcctcacgagcagagctccttccttccatttaacagaaccagagactacagagatacaaagttaatcagtggcaaatggaccaagccgaacttactactgagcaggttcttaagagggacatcccatgggagacttatatgatgacaaagctgatctcagggacagaccttcaacttttgaggcgttatgataatcgatctgagagtcaacgagctcaattgctagacgatgatggtccggcttatgttcgggtgtttgttaacatcttacgagatatatttaaagatgaaacagttgaatatgttctggctttaattgatgaaatgctagcagctaacccaaaaagagccagattattccatgataagtctctcacaaatgaggatacttatgagcctttcttaagattgctgtggaaaggtaactggtatatacaagaaaagagctgcaagatacttgccttgatcataagtgataggccaaaaactcaagatggcaccattgcaaatggagaagcctcaaattcaaagagaaaaggtactaccatcagtgacgtgttgaaaggattggttgaatggctttgtgctcagctgaagaagccttcacatcctagtcggggcgttccgagtgctattagttgcctagcaacattacttaaggaacctgtagtcaggtcttcctttgttcaagcagatggagtgaaactgctgattcctttaatttctcctgcttctacccagcaatctatgcagcttctttatgaaacttgcctctgtgtctggctattatcttactatgaaccggcaattgaatacttggctacttctagaaccttgccgcgactaatagatgttgttaaaagttccacaaaagagaaggttgtcagggttattgtcttgaccttcaagaacttgctctccagaggtacttttggtgcgcagatggtagaccttggcctaccacaagttgttcaaagcttgaaaacacgagcgtggagtgatgaggacttgttggaggctctgaaccaactggaagaaggcctaagggataatattaagaaactgagttcttttgataagtataagcaagaagtcctccttgggcatcttgactggactcctatgcacaaagatcctatattctggcgtgaaaacttaaacaactttgaagagaatgatttccagattctgagggtcctcattacaattttggatacatctaatgactcaagagccttggcggttgcttgctttgatctctcacagtttatccagaaccaccctgctggacggattatagtgacagatctcaaggctaaggaaagggtgatgaagctcatgaaccatgaaaatgctgaagtcaccaaaaatgccctactgtgtatccaaaggctattcctaggcgccaagtatgcaagctttttgcaggcctgattttctggttgcaagcgtgtaataatagtttaatgctgattgtgccatccgcaaatgagactgcttaaattgaatggaccccggagtcggctactcggttctttggtagtgattattgataagagctctttgttagacatgcagtcgtggaaaaactgaagagttagcccatctgaatcgttgaatattatttacattctgaggtatatttaattatttatttcttttttcttggggtgtatatacgctttgtgatttcctcgattgattaataaggccatcttgcaatgggaaaattaccttagctttgtatctacttc

SEQ ID NO: 5894 - DNA, 1564 bp, Olea europaea
gaaaggtctgcgactctattaaaataattggttcctactgcttacgcccttcggtcgtaactctctagattccgatctgttccaaaagaaataattcacaattccaccaatgaccatggatcactccgacctcacaaccgagcaggttttaaggagggatattccatgggagacttacatgagtactaagttgataactggaacagggcttcagctgttgaggcgatatgataagaaacccgagaattacaaggctcagttgctggacgatgatggtccatcatacattcgggtacttgttagcattttgcgcgacatattcaaggaagaaactgtagaatatgttctggccttgatagatgaaatgcttactgcaaacccaacaagagcaaggctgtttcatgacacatctcttgcaaacgaagatacatacgagcctttcctaagattgctttggaaaggtaactggtttattcaagagaagagctgtaagatactttctctgatagtaagtgcaaggcccaagcctcaggatgcagccattgcaaatgggtcctcaaaatcgaaggaactcactactattgatgatgtcctaaaaggacttgtggagtggctttgcacacagctgaagaagccttctcatcctagccgtggcattccaacagcaatcagttgtcttgcaactctacttaaagagcctgttgtgcgatctttgtttgttcaagcagatggagtgaagctgctcgttcctctaatttctccagtttccagtcaacaatccattcagctcctctacgaaacatgtctatgtgtatggcttttgtcttactatgaacctgcaatcgagcaattgggtgcttctagagctctgccacatttgattgaagttgttaagggttccacaaaagaaaaggttgtcagggtagttgtgttgacccttaggaacttgcttcaaaaggggacatttggtgctctgatgatagatctaggacttccccagcttgtccagagtttgaaagcacaggcatggagtgatgaggatctgctggaagctctgaatcagctggaaggaggactgcaagataacattaagaagctgagttcttttgataagtacaagcaggaagtcctccttggacatctggattggtcccctatgcacaaagatcctatgttttggcgggaaaatattacgaagtttgaagaaaatgatttccagattttaagggtcttgatcacaatcctggacacatctactgatcctcgaacactagccgttgcttgctttgatctctcacagttcattcagtaccatcctgctgggcgcatcatagtgactgacctcaaagcaaaagaacgggtgatgaaactgatgaaccatgaaaacccggaggtcaccaaaaatgccttgctttgcatccaaaggcttttcctaggtgccaaatatgcaagctttttacaagcttaaggttcgaccaggtttaaaattataataattttaggatgaaaattgaagaatttgtatgcgggagtcatgtacttctgtttgtctgagtaattaatg

SEQ ID NO: 5895 - DNA, 2096 bp, Aristolochia fimbriata
ttccattcagaaactccaacccaatcgacccggttcgagctcgtattttttggacgaactcgaactagaatacattttttaggttcgagttggagctcgaacccgaactcgagccttcaattacgtaaccgagatcggttcggctcgatgccacccctcaccgtacagtcagtctattagatgtctccgtgttctctctctcactcacaagtcgcaacaataatttttcgtatatcatttttattcaacccatccgcatcgtctcgaagctgggaggggtcagcacagtggagcagggagatttttaatcttcggtctctgctgggtttcggatcggagcttggaaaatactagtggtgaagagaagttattcgtgttttaatttatccgtgcgatggatcaggctgagttgacgacagaacaggttctcaagagggacatcccatgggagacttacatgacaacgaagctgatcactggaacgtgccttcagctcttaagacgctatgataacagatctgagagctacagagcacagttgcttgatgatgatggtcccgcttatgttcgtgtctttgtgagcattttacgagacatacttaaagaagatactgtagaatatgttcttgctcttattgatgaaatgcttacagcaaacccaaagcgagccagattatttcatgacaaatctcttgcaaatgaggatacatatgaacctttcttaagattgctctggaagggcaattggtttatacaggagaagagctgcaaaattttgtcaatgatagtaagtgctcgaccaaaagcgcatgatagtgttgttgtgaatggagatgcctcatattccaaaagcaagtttactacccttgatgatgtactgaagggcttggtggactggctttgtggtcagttgagaaagccttcccatcccacacgtggtgttccaacagctgtcaatagcctggcaacattacttagagaaccattggtcaggtcatcatttgttcaagcagaaggtgtgaagctgcttgtgcctttgatttctcctgcatccacgcagcagtctattcagctcctttatgaagcttgtctctgcctttggcttttgtcatactatgaaccagctgttgaatacatagctacgaccagagctctgccacgattggcagaggttgttaaaagttctaccaaagagaaagtagtgagggttgctgttttaaccttaaggaacttgctctctaaaggaactcttggggctcagatggtggatctgggtttgccccaaattgttgtaagtttgaaagcacaggcatggagtgacgaggatctgttggaagccctggatcagctggaagagggactcaaagataatatcaagaagttgagctcttttgataagtacaagcaggaagtactcctggggcacctggactggtcacccatgcataaagatcctgttttctggcgtgataacattacaaattttgaagagaatgatttccagattcttcgggttttaataacaatcttggacacatcagtggacccaaggacactgtctgtggcatgttatgatttgtcacagttcattcaataccatccagcaggccgtggcattgtgaatgatcttaaggcaaaggacagggtcatgaaactcatgaatcatgagaacgctgaagtaacaaagaatgctctgctatgcatccagaggcttttccttggcaccaaatatgccagctttttgcaatcttagaccgtctgcacctttgtagttgtgagggttctcttttcgtgccaccgtatcatgtggttctttgacagatttgagagtgcaaaatagttgctcttagtgttaagtttcaagctcttggtggttacccttcaagcagagatggatagtatcattatcattctttctggcttccttgtgggtatattttataatgtggtgatgaggatgaacatacttgcttcgttgtagaataagaatcgttgtactattttggtggaatcaatgtcctacgatgtattttgctctcctgtgttttgtattggaaaaccccctccccccgcgtaaggagctttgcatactaaaa

SEQ ID NO: 5896 - DNA, 1846 bp, Trifolium pratense
tttctcttcttcaaatccaaaaaccaccaattcaccgacgctacttacaacaaacagtaacagtttctcaaccgaactctccgagttctagggttcgttctctactatcatggaccaagccgaattaaccaccgatcaggttctgaatagggatatcccatgggaaacctacatgtccaccaagctgatttctggaacaagccttcagctcttaaggcgttacgatcatcgatcagaaagtcagagagcacagttgctcgatgatgatggtccggcttatgttcgcgtgtttgttcgtgttttgcgcgatattttcaaggaagatactgttgagtatgttttggctttgatagatgaaatgctgacagcgaacccgaaaagagctagactgtttcatgacaatgcccttgcggatgatgatacttatgagcctttcctaagattgctccggaaaggaaattggttcgtacaagagaaaagttgtaagatccttgctttaatagttagtgtcaggccaaaaaatcagagtggcgttgcatcaaatggagaagcttcaagtgaaaagaaaccatttaccagcattgatgatgttttgataggattggtaaaatggctttgtgagcagctgaagaaaccttctcatcctactcgtggagttccaactgctatcaattgcctatcaactctacttaaggaacctgtagttaggtcttcctttgttcaagctgatggggtcaagttgcttgtgccactgatttgtccagcatccactcaacaatctattcagcttctttatgaaacatgtctctgcatatggctcttatcatattatgagcccgcaattgaatatttggctacttcaaggacccttccaagactgattgatgttgttaagagttctacaaaagaaaaggttgttagagtcgtcgtcttgacacttaaaaacttgttgtcaaaagggacattgggtgctcagatggttgatcttcagctgccacaagttgttcaaagtttgaaagcacaagcatggagtgatgaggacttgttggatgcactgaactctttggaagaagggcttaaggataatatcaagaaactaagctcttttgataagtacaagcaagaagttcttctcggcaatctggattggtctcccatgcacaaagatccgatattttggcgggaaaatataaccaattttgaagagcatgatttccagattctaagggtcctattaacaattttggacacgtccaatgatccaaggactctagctgttgcttgctttgacatttcacagttcatccagtgccatccggctgggcggatcattgtgacagaccttaaagccaaggaacgagtgatgaaactaatgaatcatgagagtgctgaggtaactaaaaatgcactgctctgcatccaacgacttttcttgggtgcaaagtatgcgagcttcttgcaggtctagttctattttggtggggtggccgattattgtatgcacttaatgccttgaactctcctgctatctcacaaataggatcgactctcctatgtacaaggcttattcattgttttaataatttattgtctatggtcattaagatttcggtttggagcccatgagaaataagtatccttgatattctgctattgaataaatcaagttttgtaactttatactcggttgtgctttctggacatgttgaatacagattttagaaatcaaaatttattgttagcatggatatataatttcttgaaaaattagctacttaaatatgctcttttctaaagaataatgatttgagtggtaagaaattgttgacatgtttcttgccagaac

SEQ ID NO: 5897 - DNA, 1730 bp, Arachis hypogaea
taccgaattctgctgcagtgaaccaaaccttgtgttttctaggttttcaaactgcaatggaccatgccgaattaaccaccgaccaggttctgaggagggacattccatgggagacgtacatgtctaccaagctcatctctggcacaagccttcagctcttaaggcgttatgatcaccgatcagagagtcacagagcacagttgctcgatgatgatggtccggcttatgttcgcgtgtttgttcatgtcttgcgtgatattttcaaagaagatactgtagaatatgttttggctctaattgatgagatgctggctgcgaacccgaaaagagcaagattgtttcatgatagctccctttcagatgaagatacctatgagcctttcttaaggttgctttggaaaggaaactggttcatacaagagaaaagttgtaagatccttgctttgatagttagtgccaggcctaaaaatcagaatggtgttgtttcaaatggagatacatcaaagaaacccttcaccactattgatgatgttttgagagcattggtaaaatggctttgtgaacagctcaagaagccatctcatcccaatcgtggagtcccaactgctgtcaattgcttagcaactctgcttaaggaacatctggttaggtcttcctttgttcaagcagatggagtgaagttgcttgtgccattgatttcaccagcatccacccaacaatctattcagattctgtatgaagcatgtctctgcatatggctgctatcctattatgagccggcaattgaatatttggctacttcgagggcccttccacgacttattgacgttgttaagacttctacaaaagaaaaggttgttagagtagtggtcttgactcttagaaacttgctgtcaaaagggagtttgggtgctcagatggttgactttcagctgccacaagttgttcagagtttaaaagctcaagcttggagtgatgaggacttgctggaggcattgaattctcttgaagaagggctaaaagataacattaagaaacttagttcttttgataagtacaagcaagaagtcctgcttggtcatctggattggtccccgatgcacaaagatccattgttttggcgagaaaatattaatcactttgaagaaaatgacttccagattctaagggtcctagttacaattcttgatacgtctagtgatccaagaactctggctgttgcttgctttgacatttcacagttcatccagcaccatccttctggccggatcattgtggcggaccttaaagccaaggaacgagtaatgaaactaatgaatcatgagaataccgaggttactaaaaatgcactgctctgcatccaacggcttttcttaggggcaaagtatgcaagctttttgcaagcctagttcggtgcttctgttgcttatccatggtggcctagtatatatggcacattccatcctcttagaagttgtcacaagttgggatcggctgtcttgtgcacaagatcattgtttggtttagtgagtaatttattgtctatggccattaagatttcgatttcaagcagtgcaagaaatttgatgtgagaaataagtttccttgatattctgctatttgaataataaatcaagttttgtaactaaatactcaaggttgtgatgtgtaggtatgttgagtatctaaaactaggagttaataatatggatatgtaattttttaggaaa

SEQ ID NO: 5898 - DNA, 1611 bp, Tragopogon dubius
aaaacataggttatgaccgtcgtctttgacctcccgcgctgaaatgcaaatgcccggtaattaatcactgtgcctccgtgtctcctttccacactcacagtcacactttcccttccaaaatccaaatcaacagcttcactcagagaatcgagagaataggaattgaagttatcctgagttcaacggtgtacttgtggttcaatggcactagttgcacttgcatcttcattcattcctcaacacacacaacatgaccatgcccatctcaagagtttgagtgccaagtgtcaacatcaacggtctcggtggtttggattttcttgggagaaaatatgtaatttaaaagcttcagatcgcacattgaggatgatttcaaatggttatgctgggagagatacgtacaggatgaagaaggacattgatgataagatatataggcggcttgattcttgtttagtcattcctccacctaaaggaaagaagccaaaagcaatcattaaattccttggtggcgcatttattggagcagttcccgaagttacctatagctatcttcttgggctactggcaaacgaagggtatcttataatttctgtgccatataatgtgacttttgatcattcacaagctgctacagaagtttatgagaggtttcattcgtgcttgagttcaattctaacatctggattgcctaatgatgacgtgtcagcagctgaacttgttgatcttcctctttattctgttggtcatagcaatggagccttactccaagtacttgcaggaagctatttctctgagaagataccaaaggctaatgcgataatatcatacaacaacagaccagcaacagaggcagtaccctactttgagcagttgggtcctttggtaagccagttgatgcctgttgtggaagcatcacctgtatcttccatggctaagggtgctgcagatgcgtggaaagcactgcttgataccgcggaagcaatggcacctgattatgaccctgaagctagggtttcactaaacaaatttgttgatcagttgccatcggtttttaatcaggttgctcaagggatatctgaatttaagccgacaccaagtgagaaccgcgagtgttgcaagaacttgtataatgtgaagaaaacacttttggtgaagtttaattctgatgcgattgatgagacggatcttcttgaggagacattgagaccgcgtgtggaagctattggtggaagacttgataaagtctcattaagtggtaaccatatcacaccatgcatccaggaaccaaaactgcaagtggggatgtatatactccagcagatgcgattgcacaaggactcaagactctttcacttaatgagaccaagattcttgctagaaccatctctgagtggttcagcaacattaactaaaggtacaggaggtttgaaccaatttggtgaatcttgtgtttgtgatattaagttgtatataaaactagcagtcagtgattattttgtgaacgtctaaatatacaaatatgtatgattagttacaaacatacttacttgatttcaataacatagaaaagaaaactttatatgtataacaaaaaaaaaaaaaaaaaaa

SEQ ID NO: 5899 - DNA, 1741 bp, Arnica chamissonis
tcaatttgttggttgtggtggtgcaccatcatctccctctcgccggcaccgccaaaacctagagagagaaacaaccagcatttctagagagagaaactacaatccaggaatacacatatccagatcatcatctttttcttctgattcgtgtccagcttttgattctccctcttctgatctctttttcagattagcatcatgagttctctgaactatgatgcattgaagcttatattcataacgattcttcttacatccattaatgctagtactgcattgccgcatcaaaaccccaaatctaactccactcagatcaattccaactcggtactcgttgcgcttctcgattcgcactacactgagctatcggaactcgttgagaaagctcttcttttacaaaccctagaagaagaggtttcgagtcacaatatcaccatttttgcacccaacaatgaagctctcgagaggcagatggatccggagttcaagcggtttttacttgagcctggcaatctaaaatcgctacagaatctgttgctgtttcatattattccgcatcgggtcgggtcgaaagaatggccaggtgaggatgtcggagcagtagctcatcataaaacgctttgtgtcggtgaagctgacaatcatttgccgttgacccgtggaaataccggcgagaaaatagtaggcggtgtcgcaagagtgacccgacccgatgatgttattcgacccgacggattgatccatggaattgagcggttgttggtgcctcgatctgtgcaagaagatttcaaccggagaaggagtttgacttccatttctgctgttttaccggaaggtgctccggttgtggatccgagaacccaccgtttgaaaaaaccggccagtccggttcctgcaggtgcttcaccggttctccctgtatacgacgcaatggcacctggtccttccttagctcctgctccagctccgggacccggtggccctcaccaccacttcgacggcgaaagccaggtaaaagatttcatccaaacacttctacattacggcggatacaacgaattagcagacattttggtaaatttaacgtcgttagcgacggagatgggaaaattagtatcggagggttatgttttaacggtgttggcaccgaacgacgaagctatggctaaactcaccaccgatcaattaagtgatcctggtgcaccggagcagataatgtactatcatttgataccggaatatcaaaccgaagagagtatgtataattcagtacggcggttcgggaaggttcagtatgatactcttcggttgccgcataaggttgtggcggaggaggccgatgggtcggttaaattcgggcaaggtgagggatcggcatatttgtttgacccggatatctacaccgatgggaggatatcagtacagggtattgatggggtactatttcccgtggaagagacaaaggaaaaaccggctagcaaggtttcgccggcgacggtgccaaaggtcgttgctaatcaaagaagagggaaattattggaagtagcatgttggattggtggatcattggggcattttacaagttgttattgatatatacatacatatatataatgcaaaaaagtttaaattttaggaaaagtgtgtggaaataggacataaagggaagcgaatggtgcagttgggcattgaaggaagtttccccagagaatcagattcagaccccttcacatgagaacaa

SEQ ID NO: 5900 - DNA, 1500 bp, Helianthus annuus
accaccaccaccgcattaccgattcaaaacccgagttccaactcgactcactcaactcagatcaactccaactcagtactagtcgccctcctcgactcacactacaccgagttatccgaactcgttgaaaaagcccttcttttacagacactagaacaaacagtttcgggtcaaaacatcaccatattcgccccgaacaatgaagctcttgaacgccaaatggatcccgaattcaaacggttcttactggagccccgaaatctcaaatccctacaaaagctcctactttttcacatcatcccgggtcgggtcggttcagaacaatggccgggtcacggtaccggaaccggatccgtttctcatcatcaaactctttgtgtggatgaaccggataatcacttaccgttgacccgaggaaacaccggcgagagaatcgtaaacggtgtggcaaaagttacccgacccgacgacgttatccgacccgacggtgttatccacggaatcgagcggttgttagtgccccgatccgtacaagaagacttcaaccggagaagaagtttggcttccatttccgccgtgctaccggaaggtgctccggtggtggatccgagaactcaccggttgaaaaaaccggcagctccggttccggcaggtgctccaccggttcttccggtgtacgaggcgatggctccaggtccgtccctagctccggcaccggctccgggacccggaaccggccaccgacacttcgacggcgaaagtcaggtcaaagacttcatccaaacgttactacattacggcggatacaatgaactggctgacattttggttaatctaacgtcgttagcgacggaaatggggaaattagtgtctgagggttatgtgttaacggtgttagccccgaacgatgaagcgatggcgaaattgactactgatcagttgagtgatccgggtgcaccggagcagataatgtattatcatttggtgccggagtatcaaaccgaagagagtatgtataattcggttaggcggtttggaaaggttgagtatgataccttaaggttgccgcataaggtggtggcggaggaggcggatgggtcggttaagttcgggtcgggtgaggggtctgcgtatttgttcgacccggatatttatacggatgggcggatatcggtgcaggggattgatggggtgttgtttccggtggaagaggtgaaggagaaaccggtgggtaaggttgcgccggcgacggtgggtaaggtggttgctacgcaaagaagagggaaattattggaagtagcatgttcaattgctggatcatttgggcattttacaagttgttattgatgtatacatacatatattttatgcataaaagtttaatttttaggaaaagtgtgtgcaaaataggacataaagggaagcaaatgatgcagtttggcattgaaggaagtttccccagagaatcagattcagacccccttcacatgagaacaaact

SEQ ID NO: 5901 - DNA, 2609 bp, Solanum phureja
ggtgactagaacaacatccacaatagtgtagagttattcttttggaattctcttcaaatttcaactatggaagaatctctgttgcccggagagagtagcagcaacagttggggtcggattcggaatcggaggagggttggttccatgtttgatcccagagacgctattgctcatggatctgcttatcaaaaagctgctgctttagttgatcttgctgaagatggtgttggtctacctgaggaaattcttgagggaacgagctttgaaaaggcagcacagttgtacttcatgtttactcgttttgacttcctctggtcacttaattatcttgcactaatacttataaacttctttgagaaaccattgtggtgctccaggcatttagctgagtcatgcaataatagagactactactatctaggacagctgccatttttgactggtgctgagtcccttatatatgagggtgttactcttctacttcttgtaatacacattttatttccaatatcatatgaaggcttccatctctactggagaagtcttctcaacagactgaagatcgttctgctgttaatcttggttgcggatattgtggtctacattctctttctagcagacttctattatcttccattccgtattgcatcctatctccgtgtggtgttctttattttgaacattagggaattacgagatagcttcttcatccttgcaggaatgtttcggacctaccttaatgttgtggctttaactgcgttatttcttctgttctcgagctggttagcatatgtcttctttgaagacacacagcaggggaaaacgatgtttacttcgtatggcactacgttgtaccaaatgtttgttttattcaccacatcaaacaacccagatgtctggattcctgcatacaaggaatcacggtggtattgcttgttctttgttctgtacgtgctattgggcgtttactttgttaccaatttagttcttgctgttgtatatgatagcttcaaaagtgagcttgtaaaacaagtggctgaaaaagatcgtaggaagctaaggactttgaagaaagcatttagcttgattgatgacagcaacactggggtcctcgacaagaagcaatgtatccttctgtttgaggaacttaacaaatacaggacattgccaaaaatatcaggagatgattttgagtcaatattcaatgagctggatgatactggtgactttaagataaatttggaagaatttgccgatctgtgcactgcaatcggactaagatttcagaaggaagattcattgccaatcttcgaagcatgtccaaatttctatcattcagcagcatctgagaagttgagagacttcgtccgtggcgatatgtttgagtacataatagtgtccgttctccttgtcaatcttgttgctgttattattgaaactacgcttgatatacagaacaactcaggtcaaaccttttggcagaaggtggagttcacatttggctggctatatgttatcgagatggcactaaaagtgtacacttacggttttgagaactattggagggatggtcaaaatcaatttgattttatcgtcacttgggtcattgttattggagaaacagctacttttgtagcccctgatgatctgacctttttgtccaatggagaatggattcgttatcttcttatcgcaagaatgttacgattaatgagactcttgctgcatgtagagcgatatcgtgcttttgttgccacatttttgaccctcataccaagtctgatgccatacttggggaccatattctgcatcttgtgcttttattgctctcttggtttacagatctttggggggattgtcaacgctggaaaccccaatttagcccaaactgagctttctgataatgactatttgctttttaacttcaatgactacccaagcggcatggtcacagttttcaacatattggtgatgggaaattggcaagtgtggatgcagagctacaaggaactaacggggactgcctggacttatgtctactttgtcagcttctatcttatctcagttttgtggctgttaaatttgattgtagcatttgtcttggaagcttttcaagcagaaatggatcttgaggctgcagcaaactgtgtggatggtgatgacaaggaatcaagtgagcggagacgtaatgttggcactaagactcggagccagcgagtagatttcctcctccatcacatgttgagttctgaactaacagaatgctcccatgacaatccataagtttgctccttctccatgctgctttatgcagtcctgtgatcatcagaagttgagttattttggtggtgaagcgaaattgcactgtacatttccaactaattatgtgtatgtatcgtgaattttcatgtgttgtgtacgtagtataaattccatcgagcctacgacaacattgtagctgttcatgtaatttatcagcacctttcttgtggcacatatggaaacctcacacgctgctgtattactcagatattgtacgatgatttgcttgtagttttttcactctgcttctcaagcattcaaatgcaaacatgaggaatgaatttaaa

SEQ ID NO: 5902 - DNA, 2557 bp, Capsicum annuum
acatttctgctctgcttcagtttcaacaatggatgaatctctgctgcctggagagagtagcagcagttggggtcgggttcggaataggaggtggagtggttccaactatgatcgtagagaggctattgctcatggatctgcttatcagaaagctgctgctttagttgatcttgctgaagatggcgttggtctacctgaggaaattcttgagggatcgagctttggaaaggcagcacaattgtacttcgtgtttactcgttttgacttcctctggtcaattaattatctcgcactagtagttctaaacttccttgagaaaccattgtggtgttccaagcatttagtcgagtcatgcaataatagaggctactactatttaggacagctgccatttttgactggtgctgagtcccttatatatgagggtgttactttcctacttcttgcaatacacgttttatttccaatatcatatgaaggcttccatctctactggagaagtcttctcaacagactgaaggtcattttgcttttaatcttggttgcggatattgtggtctacattctctttctagcggacttctattatctgccattccgtattgcaccctatctccgcgtggtgttctttattttgaacattagggaattacgagatagcttcttcatccttgcaggaatgctccgtacctaccttaatgttgtggctttaactgctttatttcttctgttctcgagctggttaggatatgtcctctttgaagacacacaacaggggaaaaagaagtttacttcgtatggcactacgttgtaccaaatgtttgttttattcaccacatcaaacaatccagatgtctggattcctgcctacaaggaatcacgttggttttgcttgttttttgttctgtacgtgttattgggcgtttactttgtcaccaacttagttcttgctgttgtttatgatagcttcaaaagtgagcttgtaaaacaagtggctgaaaaagatcgtagaaagctgaggactttgaagaaagcatttaccttgattgatgacagtaacaatgggttcctagacaagaagcaatgtatccgactgtttgaggaacttaataaatacaggacattgccgaaaatatcaggagatgattttgaggcaatattcactgagctggatgatactggtgactttaagataaatttggaggaatttgctgatttgtgcactgcaattggactaagatttcagaaggaagattcactgccaatctttgaagcatgtccaaatttctatcattcaccagcatcagagtcgttaaggaacttcgtccgtggcaatacatttgagtacataatagtgttcattctccttgtcaatcttgttgctgttattattgaaactacgcttgatatacagaacaactcaggtcaaaccttttggcagaaggtggagttcatctttggttggctgtatgttgttgagatggcactaaaagtgtacacttacggttttgagaactattggagggatggtcaaaatcgatttgattttgtcatcacttgggtcattgttattggagaaacggctacttttgtagcccctaatgatctgactttcttgtccaacggagaatggattcgctatcttcttattgcaagaatgctacggttaataagactcttgctgcatgttgaccaatatcgtggttttgttgctacatttttgactctcataccaagtctgatgccgtatttggggacaatattctgcatcttgtgcttttattgctctattggtttacagatctttggggggatggtcaacgctggaaaccccaatttagcttcaactgatcttgctgataatgactattatctttttaacttcaatgactatccaagtggcatggtcacacttttcaatatattggtgatgggtaactggcaagtgtggatgcagacctacaaggaattaacggggactgcctggagttatgtctacttcgtcagcttctatcttatctcagttttgtggctgttaaatttgattgtagcatttgtcttggaagctttccaagctgagatggctctagaggcttcagcaagctgtgtggatgatgaggacaaggaatcaagaagtgagcggcgacgtaatgttggtactaagactcgaagccagcgagtagacttcctcctccatcacatgttgagttctgaactaacagaatgctccaatgacaacaacaatccataagtttgctcctttctccatgctgctttctgcagtcctgtgaacatcagaagttgagttattttggtggtgaagagaagttacaatgtacatttccaattagttatgtgtatgtatcgtgaattgtcgtgtgttttgtacatagtataaattccatcgagcctacgacaacattgtagctgttccactccactcatagatgtaatagccagagtaatgtagtttcatttatctgcaccttgcttgtggcacatatggaaacctcacacactgctgtgttactcgatattgtacgttgattgcttgtag

SEQ ID NO: 5903 - DNA, 2991 bp, Triticum aestivum
cccgcggtacagcatagtatatctagctaggtcgaagaaaacaaacgcgaaggcccagtaaaaattcttcatcatcagcggagcggtgccggtggtgctcatgccactcatcacctctcgtcactagcaggaggcggtagagtagggtagggtagggtagagagagcgagcgagagggggcggcggggaggcagatgcgggagatcccacggggggtcgccgcagccggaggaggaggaagaagaagagatggacacgcccgataggccccgcgccggcgccgccgccggattcgaggactcccccgtcttcaattttatcaataatctatctcctataccacctcctaaacctcaagactcatcacataatgtgcacctattcaagtcgtctgacttggctcctgtttcttcaatctttgcctcaccccatgtcaatccaccaaaggaatctaaacttctgataagggatgattctgttcaactttctcaagattcaaactctcctaatagtgtcagaactcgattagggagtgctattaggttgatcaaatgcaaaaacattgtttcggagaattgcagtttcacctgccacctaaatcagggacctattgattcttctgccaatagatcaaactctacaagtaaattgcctcaaaccatccagtttgttggtgacagttcagaatgtggtaagaatcaaagtgctgatggtaaaaaagatcttgctagagatcaggagagcatagaactagaaggcgtcctccttgatcacactggcccagataaaatcgactcatcacaacctggaagaatcgttcatgaaaaccaacaatgtgaacaacaaaaggatggatttacagcatatgatggggattacttgattacacacgaatcaagtatggatatgctgagattagccccaccatgtgaggcagatacacagttagtgaacgagacactaaacgctgataatgtgttctctggcaattccttgctgaccgatgggccaagtggctcttacatcaacaatgctgcacatgatccaaatctttactgggatggaacggttgaagggcccacgacagattataccccacaattgctctctggtgcttgtcaaagtcagtcagtgtcaaatgatcaaatctgtaatgcagttgaagagcccagtgatcacataccaatcgaccaaagtgccttgtcacagaatatgcgtggtatgcgcaggcgttgcctttttaatgaaaaggctggggctgttaacaaagctgccaagaagacctcagatcgccattctgcaaatacaactacccccagatgcaaaactaattctggtgataagcctgtgagaacccctccatgtgcattgcctggtattggcttgcatctgaatgcccttgccccaatatcaacagacaaaatagtcccccaagctgctcaatctaccataaatcaagccagcaacttcccctgtgctgtcagttcttcaacagctgaaccaaatattgtaaatgaagattcctctcaggcaatcgtggttgcaaatgctgatgagtctggtcagggcagtcccaagaagaaaagacacaagtttgatgatggtgatgggacttcatgcaagcgttgtagctgtaagaagtcaaaatgcttgaaactttactgtgagtgttttcatgctggagtcttctgttcagaaccctgttcatgtcaaggctgtctgaataagcctagcaacatggagatagttctatctactcgagagcagattgaatctcgtaatccactagcatttgctcctaaagtgattcgcacatctgagcctggtcaggaattaggggagtactctaacaaaactcctgcctcggctcgtcacaaaaggggctgcaactgtaagaagtcatcgtgtctaaaaaagtactgcgaatgctatcagggtggcgtgggatgctccataagttgcagatgcgagggatgcaagaatgcttttggtagaagggagggactcggaccgttaagcattgaggaagctaagcagggaaatgaggaaaatagtgcttgtgtgaaggaagaaaaaaggaagatgataataatcagctcgttatctgcccagctgctaatccagctcctgctgagaatgtactgacaacaccttcagctatggatgtcagacccttggcttctcgtccaccttcaagctctaagaggccacggtctacgacaaaggccctcggacatccttctcgactatgcaactctcaagctcctctgaagacggacactctgctctccccatttgaaaactatgcagaaattatgtttggggtgggtacatcagacagcctgaaaggagggttatctcctcaaacttctgttaaggtggtgtcaccgaataaaaagagggtatctcccccgcgcattggtaccgggttgtctccaatctgcaagagcggcaggaagttgatcctgaaatccatcccttcattcccttctctctgtggtgatgtaaataacgtggataccaagaccacctcaccagctccttgaattcatcaagcatttgtcactgaggtcatttcattagttccttgttgattccccagatggccaatgcctcgtagctgcaccagctccttcatccttgagagtttaatgaacatccaagggacttttatttctccagttcattttagagcctgataagtatcccatgatcatcctatagtggaccgttgaatagtaatgtaccaaaataccccctcgagagccttcggcatgctagtaattatatccacacctgtggagacaagagtccttgttgagttgcacatccatgttcatctgtataattaatttatatatttttgaatctatgtaactgtaactgagatcaaatcatcgagcattagatgtacttatggtcagaaaccttttaagatttatatgtaagaactctgggtattttggaccttggagtatgtgtttgccaatg

SEQ ID NO: 5904 - DNA, 1052 bp, Pseudoroegneria spicata
caaaatccttatcccaagcttagcagccccggtctcctcggtttctcctcctccccgaaccctcgctccatcactctctccctctctcactccggcgcgcgctcagctgaatctcgccgcaggagccatggcgtcggtgcatctgtgcggcccgaaggtggcgtccgcggccatggcgaagccagcgttggcggacggactccgcatccccccttcgtcgtcggcgcgtcccgtgccgacggcgcggaggctccggggcctcgtcgtcagggccgccacggtcgtgtcccccaagtatacttctgtgaaaccattgggagatagggtactagtgaagaccaagactactgaggataaaactgctggagggatattgcttccaacaacagctcagtcaagaccacaagcaggggaggttgttgcagttggagaggggagaagcttaggcagcaacatcgtcgagatcagtgttccggttggtgccaaagttatttactctaaatacgctggcaccgagttggaattcaatgatactacccacctcattatgaaagaagatgacatcattggtattcttgacactgatgacgtgaaagatctgaagccactgagtgaccgtattctcattaaggttgcagagtctgaagaggaaactgctggcggtttgctattgacacaggcgtcgaaagagaagccttctgttggaacagtggtcgctgttggccctggggggttgggtgatgatggcagcaggacgccattgtcgatcactcctggaagcagcgtgctctactccaagtatgcaggaagcgagttcaagggttcggaaggcgagtacatcgtcctcaggtcatccgacgtgatagccgtgctgtcatcataagctcgtcctgccctactcatgtgaactaggaattttgatatttagtccaaaacattgtttggttactctcgcttgggatcaaattggtgaattgcttgcttctttgctctatcctgttatggtggaaaatactgcctggtagtttaataagatgacggcttagatttca

SEQ ID NO: 5905 - DNA, 891 bp, Leymus cinereus x Leymus triticoides
ctccggcgcgcgctcagctgaatcctgccgcaggagccatggcgtcggtgcatctgtgcggccccaaggtggcgtccgcggcgatggcgaagccagcgttggcggacgggctccgtgtccccccttcgtcgtcggcgcgtcccgtgccgacggggcggaggttccggggtctcgtcgtcagggccgccacggtcgtgtcgcccaagtatacttctgtgaaaccattgggagatagggtactagtgaagaccaagacttctgaggataaaactgctggagggatattgcttccaacaacagctcagtcaagaccacaagcaggggaggttgttgcagttggagaggggagaagcttaggcagcaacatcgtcgagatcagtgttccggttggtgccaaagttatttactctaaatacgctggcaccgagttggaattcaacgatactacccacctcattatgaaagaagatgacatcattggtattcttgacactgatgacgtgaaagatctgaagccgctgagtgaccgtattctcattaaggttgcagagtctgaacaggaaactgctggcggtttgttattgacacaggcgtcgaaagagaagccttctgttggaacagtggtcgctgttggccctggggggttgggcgaggatggcggcaggacgcccttgtcgatcaatcctggaagcagcgtgctgtactccaagtatgcgggaagcgagttcaagggttccgaaggcgagtacatcgttctcaggtcatctgacgtgatagctgtgctgtcatcataagcttatcctgtcctgctcatgtgaactaggaattttgatatttagtccaaaacattgtttggttactctcgcttgggatcaatttggtgaattgctt

SEQ ID NO: 5906 - DNA, 1016 bp, Leymus cinereus x Leymus triticoides
ccaacccccgccttagcccccgtctcctcggtttctcctcctccctcgctccatcactctctctctctccggcgcgcgctcagctgaatcttgccgtaggagccatggcgtcggtgcatctgtgcggcccgaaggtggcgtccgcggcgatggcgaagccagcgttggcggacgggctccgtatccccccttcgtcgtcggcgcgtcctgtgccgacggggcggaggttccggggcctcgtcgtgagggccgccacggtcgtgtcgcccaagtatacttccgtgaaaccattgggagatagggtactagtgaagaccaagacttctgaggataaaactgctggagggatattgcttccaacaacagctcagtcaagaccacaagcaggggaagttgttgcagttggagaggggagaagcataggcagcaacattgtcgagatcagtgttccggttggtgccaaagttatttactctaaatacgctggcaccgagttggaattcaacgatactacccacctcattatgaaagaagatgacatcattggtattcttgacactgatgacgtgaaagatctgaagccgctgagtgaccgtattctcattaaggttgcagagtctgaacaggaaactgctggcggtttgctattgacacaggcgtcgaaagagaagccttctgttggaacagtggtcgctgttggccccgggccattgggcgatgatggcagcaggacgccattgtcaatcactcctggaagcagcgtgctgtactccaagtatgcaggaagcgagttcaagggttcggaaggcgagtacattgttctcagggcatccgacgtgatagccgtgctttcatcataagcttgtcctgtcctgctcacgtgaactaggaattttgatatttagtcccaaaccttgtttggttattgctcttgcttgggattggtgaattgcttcttcgctctattgtggaaatgctgcctgatagtttaataagatgacggcttagatttcaga

SEQ ID NO: 5907 - DNA, 986 bp, Avena sativa
gcaacccctgtctcgatttctccgaaccctcgctccaccactctctcactctcgagcgcgctcagctgaatcctgccgtaggagccatggcgtcggtgcatctgtgcgggccgcaggtggcgtcggcggcgatggtgaagccagcgtccgcggacgggctgcgcattccggcctcgtcgtcgcgtgctgcgccgacggggcggaggttccgaggcctcgtcgtgagggccgccacggtcgtgtcgccgaagtatacatccgtcaaaccattgggagatagggtactagtgaagaccaagaccaccgaggataaaaccgcgggagggatattgcttccaacaacagctcagtcaagaccacaaggaggggaggttgttgcagttggagaggggagaagcttaggcagcaacatcgtcgagatcagtgttccggttggtgccaaagttatttactctaaatacgctggcaccgagttggaattcaatgataccacccacctcattatgaaagaagatgacatcattggtattcttgacactgatgacgtgaaagatctgaagccactgagtgatcgtattctcattaaggttgcagagtctgaagaggaaactgctggtggcttgttactgacacaggcgacgaaagagaagccttctgttggaacagttgtagctgttggccctgggccattgggcgatgatggcagcaggactcccctgacaatcactcctggaagcagcgtgctgtactccaaatacgcaggaagcgagttcaagggctctgaaggcgagtacatcgttctcagggtctccgacgtgatagccgtgttgtggtcgtaagcatatgcttgttgttcacgtgaaataggaattttgatatcgagtctgtaactttgtttcattacccttgcctggaattggtgaaccgctcgtctcactgtacggtcttacggttcaaatgctgtttcttataatataagaggactg

SEQ ID NO: 5908 - DNA, 1143 bp, Avena sativa
tcccaaagcttagcaacccctgtctcgatttctccgaaccctcgctccaccactctcccactctctcacgcgcgctcagctgaatcctgccgtaggagccatggcgtcggtgcatctgtgcgggccgcaggtggcgtcggcggcgatggtgaagccagcgtccgcggacgggctgcgcattccgcagtcatcggcgcgtgctgtgccgacggggcggaggttccgaggcctcgtcgttagggccgccacggtcgtgtcgcccaagtatacatctgtcaaaccgttgggagatagggtactggtgaagacaaagaccactgaggataaaactgccggagggatattgcttccaacaacagctcagtcaagaccacagggaggggaggttgttgcagttggagaggggagaagcataggcagcaacgtcgttgagatcagtgttccggttggtgccaaagttatttactccaagtatgctggcacagagttggaattcaatgatactaaccatctcattatgaaagaagatgacatcattggtattcttgacactgatgacgtgaaagatctgaagccactgagtgatcgtattctcattaaggttgcagagtctgaagaggaaactgctggtggtttgttactgacacaggcgacgaaagagaagccttctgttggaacagtagtagctgttggccctgggccattgggcgatgatgggagcaggactcccctgacaatcactcctggaagcagcgtgctgtactccaaatacgcaggaagcgagttcaagggctctgaaggcgagtacatcgttctcagggtgtctgacgtgatagccgtgctgtcgtcgtaagcatatgcttgttgttcacgtgaaaaataggaattttgatatcgagtctgtaactttgtttcttgcaattggtgaactgctcgtctcactgtaccgtcttgtggttcaaatgctgtttcttataataagaggactgcttagatttcagacgtggttgtgttgtgctatactccctctatgcacggtcaggttctactttgaccatcgatttgaccattataacttggaatcttggatcgtttgctatagaaaaataatactagtatttgaatatgctgtgaaatgttgtt

SEQ ID NO: 5909 - DNA, 1162 bp, Avena sativa
aacccaaatccttatcccaaagcttagcaacccctgtctcgatttctccgaaccctcgctccaccactctcccactctctcacgcgcgctcagctgaatcctgccgtaggagccatggcgtcggtgcatctgtgcgggccgcaggtggcgtcggcggcgatggtgaagccagcgtccgcggacgggctgcgcattccgcagtcatcggcgcgtgctgtgccgacggggcggaggttccgaggcctcgtcgttagggccgccacggtcgtgtcgcccaagtatacatctgtcaaaccgttgggagatagggtactggtgaagaccaagaccaccgaggataaaactgccggagggatattgcttccaacaacagctcagtcaagaccacagggaggggaggttgttgcagttggagaggggagaagcataggcagcaacgtcgttgagatcagtgttccggttggtgccaaagttatttactccaagtatgctggcacagagttggaattcaatgatactaaccatctcattatgaaagaagatgacatcattggtattcttgacactgatgacgtgaaagatctgaagccactgagtgatcgtattctcattaaggttgcagagtctgaagaggaaactgctggtggtttgttactgacacaggcgacgaaagagaagccttctgttggaacagtagtagctgttggccctgggccattgggcgatgatgggagcaggactcccctgacaatcactcctggaagcagcgtgctgtactccaaatacgcaggaagcgagttcaagggctctgaaggcgagtacatcgttctcagggtgtctgacgtgatagccgtgctgtcgtcgtaagcatatgcttgttgttcacgtgaaaaataggaattttgatatcgagtctgtaactttgtttcttgcaattggtgaactgctcgtctcactgtaccgtcttgtggttcaaatgctgtttcttataataagaggactgcttagatttcagacgtggttgtgttgtgctatactccctctatgcacggtcaggttctactttgaccatcgatttgaccattataacttggaatcttggatcgtttgctatagaaaaataatactagtatttgaatatgctgtgaaatgttgtttcgta

SEQ ID NO: 5910 - DNA, 1016 bp, Avena sativa
cccaaatccttatcccaaagcttagcaacccctgtctcgatttctccgaaccctcgctccaccactctcccactctctcgcgcgcgctcagctgaatcctgccgtaggagccatggcgtcggtgcatctgtgcgggccgcaggtggcctcggcggcgatggtgaagccagcgtccgcggacggactgcgcattccggcgtcgtcgtcgcgtgccgcgccgacggggcggaggttccgaggcctcgtcgtgagggccgccacggtcgtgtcgcccaagtatacatccgtcaaaccgctgggagatagggtactggtgaagacaaagaccaccgaggataaaactgccggagggatattgcttccaacaacagctcagtcaagaccacagggaggggaggttgttgcagttggagaggggagaagcataggcagcaacatcgttgagatcagtgttccggttggtgccaaagttatttactccaagtatgccggcacagagttggaattcaatgatactaaccatctcattatgaaagaagatgacatcattggtattcttgacactgatgacgtgaaagatctgaagccactgagtgatcgtattctcattaaggttgcagagtctgaagaggaaactgctggcggtctgttactgacacaggcgacaaaagagaagccttctgttggaacagttgtagctgttggccctgggccattgggcgatgatgggagcaggactcccctgacaatcactcctggaagcagcgtgctgtactccaaattcgcaggaagcgagttcaagggctctgaaggcgagtacatcgttctcagggtgtctgacgtgatagccgtgttgtcgtcgtaagcatatatgcttgttgttcacgtgaaataggaattttgatatggagtctgtaactttgtttcgttacccttgcaactggtgaaccgctcgtctcactgtaccatcttgtggttcaaatgctgtttcttataataagaggactgcttagatt

SEQ ID NO: 5911 - DNA, 1112 bp, Avena sativa
cccaaatccttatcccaaagcttagcaacccctgtctcgatttctccgaaccctcgctccaccactctcccactctctcgcgcgcgctcagctgaatcctgccgtaggagccatggcgtcggtgcatctgtgcgggccgcaggtggcctcggcggcgatggtgaagccagcgtccgcggacggactgcgcattccggcgtcgtcgtcgcgtgccgcgccgacggggcggaggttccgaggcctcgtcgtgagggccgccacggtcgtgtcgcccaagtatacatccgtcaaaccgctgggagatagggtactggtgaagacaaagaccaccgaggataaaactgccggagggatattgcttccaacaacagctcagtcaagaccacagggaggggaggttgttgcagttggagaggggagaagcataggcagcaacatcgttgagatcagtgttccggttggtgccaaagttatttactccaagtatgctggcacagagttggaattcaatgatactaaccatctcattatgaaagaagatgacatcattggtattcttgacactgatgacgtgaaagatctgaagccactgagtgatcgtattctcattaaggttgcagagtctgaagaggaaactgctggtggcttgttactgacacaggcgacgaaagagaagccttctgttggaacagttgtagctgttggccctgggccattgggcgatgatggcagcaggactcccctgacaatcactcctggaagcagcgtgctgtactccaaatacgcaggaagcgagttcaagggctctgaaggcgagtacatcgttctcagggtctccgacgtgatagccgtgttgtggtcgtaagcatatgcttgttgttcacgtgaaataggaattttgatatcgagtctgtaactttgtttcattacccttgcctggaattggtgaaccgctcgtctcactgtacggtcttacggttcaaatgctgtttcttataatataagaggactgcttagatttcggacgtggttgtgttgtgctatactccctcaatgcacagtcaggttctactttgaccattaataacttggaatcttggattgtttgctac

SEQ ID NO: 5912 - DNA, 1077 bp, Avena sativa
tctcgatttctccgaaccctcgctccaccactctcccactctctcgcgcgcgctcagctgaatcctgccgtaggagccatggcgtcggtgcatctgtgcgggccgcaggtggcgtcggcggcgatggtgaagccagcgtccgcggacgggctgcgcattccggcctcgtcgtcgcgtgctgcgccgactgggcggaggttccgaggcctcgtcgtgagggccgccacggtcgtgtcgccgaagtatacatccgtcaaaccattgggagatagggtactagtgaagaccaagaccaccgaggataaaaccgcgggagggatattgcttccaacaacagctcagtcaagaccacagggaggggaggttgttgcagttggagaggggagaagcataggcagcaacatcgttgagatcagtgttccggttggtgccaaagttatttactctaagtatgccggcacagagttggaattcaatgatactaaccatctcattatgaaagaagatgacatcattggtattcttgacaccgatgacgtgaaagatctgaagccactgggtgatcgtattctcattaaggttgcagagtctgaagaggaaactgctggcggtctgttactgacacaggcgacaaaagagaagccttctgttggaacagttgtagctgttggccctgggccattgggcgatgatggcagcaggactcccctgacaatcactcctggaagcagcgtgctgtactccaaattcgcaggaagcgagttcaagggctctgaaggcgagtacatcgttctcagggtgtctgacgtgatagccgtgttgtcgtcgtaagcatatgcttgttgttcacgtgaaataggaattttgatatcgagtctgtaacttgtttcattacccttgcctggaattggtgaaccgctcgtctcactgtacggtcttacggttcaaatgctgtttcttataatataagaggactgcttagatttcggacgtggttgtgttgtgctatactccctcaatgcacagtcaggttctactttgaccattaataacttggaatcttggattgtttgctac

SEQ ID NO: 5913 - DNA, 1011 bp, Avena sativa
caaatccttatcccaaagcttagcaacccctgtctcgatttctccgaaccctcgctccgccactctcccactctctcgcgcgcgctcagctgaatccttccctaggagccatggcgtcggtgcatctgtgcgggccgcaggtggcgtcggcggcgatggtgaagccagcgtccgcggacgggctgcgcattccgcagtcatcggcgcgtgctgtgccgacggggcggaggttccgaggcctcgtcgttagggccgccactgtcgtgtcgcccaagtatacatccgtcaaaccgttgggagatagggtactggtgaagacaaagaccactgaggataaaactgccggagggatattgcttccaacaacagctcagtcaagaccacagggaggggaggttgttgcagttggagaggggagaagcataggcagcaacgtcgttgagatcagtgttccggttggtgccaaagttatttactccaagtatgctggcacagagttggaattcaatgatactaaccatctcatcatgaaagaagatgacatcattggtattcttgacaccgatgacgtgaaagatctgaagccactgggtgatcgtattctcattaaggttgcagagtctgaagaggaaactgctggcggtctgttactgacacaggccacgaaagagaagccttctgttggaacagttgtagctgttggccctgggccgttgggcgatgatggcagcaggactcccctgtcaatcactcctggaagcagcgtgctgtactccaaatatgcaggaagcgagttcaagggctctgaaggcgagtacattgttctgagggtgtccgagttgatagccgtgttgtcgtcgtaagcatatgttgttgttcacgtgaaataggaattttgatatcgatcgagtctgtaactttgtttcattacccttgcatggagttggtgaactgctggctcttctggctgtaccgtgttatggtttgaaatgctgtttcgtataataagag

SEQ ID NO: 5914 - DNA, 1009 bp, Avena sativa
acccaaaatccttatcccaaagcttagcaacccctgtctcgatttctccgaaccctcgctcttccactctcccactctctcgcgcgcgctcagctgaatcctgccgtaggagccatggcgtcggtgcatctgtgcgggccgcaggtggcgtcggcggcgatggtgaagccagcgtccgcggacgggctgcgcattccggcctcgtcgtcgcgtgctgtgccgacggggcggagtttccgaggcctcgtcgtgagggccgccacggtcgtgtcgcccaagtacacatccgtacaaaccagttgggagatagggtactagtgaagaccaagaccaccgaggataaaaccgcgggaggatattgcttccaacaacagctcagtcaagaccacagggaggggaggttgttgcagttggagaggggagaagcataggcagcaacatcgttgagatcagtgttccggttggtgccaaagttatttactcaagtatgctggcacagagttggaattcaatgatactaaccatctcattatgaaagaagatgacatcattggtattcttgtacactgatgacgtgaaagatctgaagccactgagtgatcgtattctcattaaggttgcagagtctgaagaggaaactgctggtggtttgttactgacacaggcgacgaaagagaagccttctgttggaacagttgtagctgttggccctgggccattgggcgatgatggcagcaggactcccctgacaatcactcctggaagcagcgtgctgtactccaaatacgcaggaagcgagttcaagggctctgaaggcgagtacatcgttctcagggtgtccgacgtgatagccgtgttgtcgtcgtaagcctatgcttgttgttcacgtgaaaaataggaattttgatatcgagtctgtaactttgtttcattacccttgcctggaattggtgaactgctcgtctcagtgtaccgtcttatggttcaaatgctgtttcatataataaga

SEQ ID NO: 5915 - DNA, 1013 bp, Avena sativa
caaagcttagcaacccctgtctcgatttctccgaaccctcgctccaccactctcccactctctcgcgcgcgctcagctgaatcctgccgtaggagccatggcgtcggtgcatctgtgcgggccgcaggtggcgtcggcggcgatggtgaagccagcgtccgcggacgggctgcgcattccggcctcgtcgtcgcgtgctgcgccgacggggcggaggttccgaggcctcgtcgtgagggccgccacggtcgtgtcgccgaagtatacatccgtcaaaccattgggagatagggtactagtgaagaccaagaccactgaggataaaactgccggagggatattgcttccaacaacagctcagtcaagaccacagggaggggaggttgttgcagttggagaggggagaagcataggcagcaacgtcgttgagatcagtgttccggttggtgccaaagttatttactccaagtatgctggcacagagttggaattcaatgatactaaccatctcatcatgaaagaagatgacatcattggtattcttgacaccgatgacgtgaaagatctgaagccactgggtgatcgtattctcattaaggttgcagagtctgaagaggaaactgctggcggtctgttactgacacaggcgacaaaagagaagccttctgttggaacagttgtagctgttggccctgggccgttgggcgatgatggcagcaggactcccctgtcaatcactcctggaagcagcgtgctgtactccaaatatgcaggaagcgagttcaagggctctgaaggcgagtacattgttctgagggtgtccgagttgatagccgtgttgtcgtcgtaagcatatgttgttgttcacgtgaaataggaattttgatatcgatcgagtctgtaactttgtttcattacccttgcatggagttggtgaactgctggctcttctggctgtaccgtgttatggtttgaaatgctgtttcgtataataagaggactgcttagatttc

SEQ ID NO: 5916 - DNA, 1063 bp, Lolium multiflorum
ctccctgtctcgattcctcctcctctcctcaccctcactctcgcgcgtgctcagctgattcctgccgtaggagccatggcgtcgctgcatctgtgcgggcagcaaatggcgtcggcggccatggtgaagccggcgtccgcggacgggctccgcgtcgcggcctcgtcgccgcgtgccgtgccggcgcggcggaggttccgaggcctcgtcgtgagggccgccacggtcgtgtcgcccaagtatacatctgtcaagccattgggagatagggtactagtgaagaccaagaccacggaggacaaaactgccggagggatattgcttccaactacagcccagtcaagaccacaaggaggggaggttgttgcagttggagaggggagaaccataggcagcaacaccgttgagatcagtgttccggttggtgctaaagttgtctactctaaatatgctggcacagacttagaattcaatgatgctaaccatctcattatgaaagaagatgacatcattggtgttcttgacactgatgacgtgaaagatctgaagccactgggtgaccgtattctcattaaggttgcagagtctgaagaggaaactgctggtggtttgctattgacacaggcgacgaaagagaagccttctgttggaacggtcgtagctgttggccctgggccattgggcgatgatggcagcaggactcccttgtcactcactcccggaagcagcgtgctgtactccaagtatgcaggaagcgagttcaagggctctgaaggcgattacatcgttctcagggtgtccgacgtgatagccgtgttgtcatcgtaagcatatgatgtgtcacgtgagataggaattttgatattgagtcgataactttgtttcattacccactatctggaattggtgaattgctcttcttgctgtgccgtcttatggttgaaatgctgtctcataataagatgactgcttagatttcagacatgaatgtgtttgtgctgcctgtacttagcttcgtggttggtgggtgtgttgagctttggccgattggcagggttcggtt

SEQ ID NO: 5917 - DNA, 1138 bp, Lolium multiflorum
acccaaatccttatcccaaagctcagcaccctccctgtctcgattcctcctccgctccctcactctcccactctcgcgcgcgtgctcagctgaatcctgccgtaggagccatggcgtcgctgcatctgtgcgggcagcaaatggcgtcggcggcgatggtgaagccagcgtccgcggacgggctccgcgtcgcggcctcgtcgccacgtgccgtgccggcgcggcggaggttccgaggcctcgtcgtcagggccgccacggtcgtgtcgccaaagtatacatctgtcaagccattgggagatagggtactagtgaagaccaagaccactgaggacaaaactgctggagggatattgcttccaacaacagctcagtcaagaccacagggaggggaggttgttgcagttggagaggggagaaccataggcagcaacaccgtcgagatcagtgttccggttggtgctaaagttgtctactctaaatatgctggcacagacttagaattcaatgatgctaaccatctcatcatgaaagaagatgacatcattggtgttcttgacactgatgatgtgaaagatctgaagccactgggtgaccgtattctcattaaggttgcagagtctgaagaggaaactgctggtggtttgctattgacacaggcgacgaaagagaagccttctgttggaacggtcgtagctgttggccctgggccattgggcgatgatggcagcaggacgcccccgtcactcactccgggaagcagcgtgctgtactccaagtatgcaggaagcgagttcaagggctccgaaggcgattacatcgttctcagggtgtccgacgtgatagccgtgttgtcatcgtaagcatatgatgtgtcacgtgagataggaattttgatatcgagtcgataactttgtttcattacccactatctggaattttcttgctgtgctgtcttatggttgaaatgctgtctcataataaggtgactgcttagatttcagacatgaatgtctttgtgctgcctgtacttagcttcgtggttggtgggtgtgttgagctttggccgattggcaaggttcggttctgctgttcagttgttgtacttgatggcgaggtcagcgtatctgcacgaaga

SEQ ID NO: 5918 - DNA, 899 bp, Festuca arundinacea
gcaaatggcgtcggcggcgatggtgaagccagcgtccgcggacgggctccgcgtggcggcctcgtcgccgcgtgctgtgccgacggggcggaggttccgaggcctcgtcgcgagggccgctacggtcgtgtcgccaaagtatacatccgtcaaacccttgggagatagggtactagtgaagaccaagaccacggaggacaaaactgccggagggatattgcttccaacaacagctcagtcaagaccacaaggaggggaggttgttgcagttggagaggggagaaccataggcagcaacatcgttgagatcagtgttccggttggtgctaaagttgtctactctaaatatgctggcacagacttagaattcaatgatactaaccatctcattatgaaagaagatgacatcattggtgttcttgacactgatgacgtgaaagatctgaagccactgggtgaccgtgttctgattaaggttgcagagtctgaagaggaaactgctggtggtttgctactgacacaggcgacgaaagagaagccttctgttggaacggtcgtagctgttggccctgggccattgggcgatgatggcagcaggacgcccttgtcactcactcccggaagcagcgtgctgtactccaagtatgcaggaagcgagttcaagggcgcggaaggcgagtacatcgttctcaaggtgtctgacgtgatagccgtgctgtcgtcgtaagcatatcctgccacacgtgaaataggagttttgatattgagtcgataactttgtttcgttacccactacctggagttggtgaattgctcttctcgctgtacccgtcgtgtggtcgaaatgctgtctcatataataagatgactgcttatatttcaaaaaaaaaaaaaaaaaa

SEQ ID NO: 5919 - DNA, 999 bp, Festuca arundinacea
ggcacgaggccaaacctttgcaccctccctgtctcgattcctccttcgctccctcactctcccactctcgcctcgcgcgagctcagctgaatcctgccgtactgccgtaggagccatggcgtcgctgcaaatggcgtcggcggccatggtgaagccagcgtccgcggacgggctccgcgtcgcggcctcgtcgccgcgtgccgtgcccacgcggcggaggttccgaggcctcgtcgtgagggccgccacggtcgtgtcgcccaagtatacatccatcaaacccttgggagacagggtactagtgaagaccaagaccaccgaggataaaactgccggagggatattgcttccaacaacagctcagtcaagaccacaaggaggggaggttgttgcagttggagaggggagaaccataggaagcaacaccgtcgagatcagtgttccggttggtgctaaagtcgtctactctaaatatgctggcacagacttagaattcaatgatgctaaccatctcattatgaaagaagatgacatcattggtgttcttgacactgatgacgtgaaagatctgaagccactgggtgaccgtattctcattaaggttgcagagtctgaagaggaaactgctggtggtttgctattgacacaggcgacgaaagagaagccttctgttggaacggttgtagctgttggcccggggccattgggcgatgatggcagcaggacgcccctgtcactcactcccggaagcagcgtgctgtactccaagtatgcaggaagcgagttcaagggctccgaaggcgactacatcgttctcagggtgtccgacgtgatagccgtgttgtcgtcgtaagcatattccgcttcacgtgaaataggaattttgatattgagtccataactttgtttcattattacccttgcctggaattggtgaactgttcttgctgtacctgtcttatggttgaaatgctgtctcaaataataagatgactgctt

SEQ ID NO: 5920 - DNA, 1005 bp, Brachypodium distachyon
cgacaatcctaattcttatcccaagcttaaccctctcctcctcctcctcctcctcctcctcctctccgaaccctcactgcatcactctctcttgcgagctcgcggttaccggaatcttaaggcaggagccatggcgtcagtgcatctgtgcgggccgcaagtagcgttggcgccggtggcgaagccagcctcggtggatggtctccgtatcccgcaattgtcctcgcacgctgtgtcgaggagccggaagttccgtggcctcgtcgtgagggccgccacggttgtgtcacccaagtatacttccgtcaaaccattgggagatagggtactcgtgaagaccaagatctctgaggaaaagactccaggagggatattacttccaacatcagttaagccaaaaccacaaggaggggaagttgttgcagttggagaggggagaagcataggcagcaacaccgtagaaatcagtgttccggttggcgtccaagttgtgtactctaaatatgctggcacagagttggaattcaacgattctaaccatctcattttgaaagaagatgacatcattggtattcttgacactgatgatgtgaaagatctgaagccactgagtgatcgtattctcattaaggttgcagaggctgaagaggaaacttctggtggtttgctattgacgcaggcgaccaaagagaaaccttctgttggaacagtcatagctgttggcccagggcccttgggcgaggatggcagcaggacacccctatcgatcactcctggaagcagcgtgttgtactccaagtacgcaggaagtgagttcaagggtgctgacggcgagtacatcgttcttagggtatctgacgtgatagctgttatctcctaagcataccctgctcatttgaaataggaattttgataattagtccaaaactttgttttgttactgtcgcttggaattggtgaacttcttgaatatcttctcattccacggtgttatgatggaaagaa

SEQ ID NO: 5921 - DNA, 1023 bp, Brachypodium distachyon
cgacaatcctaattcttatcccaagcttaaccctctcctcctcctcctcctcctcctcctcctctccgaaccctcactgcatcactctctcttgcgagctcgcggttaccggaatcttaaggcaggagccatggcgtcagtgcatctgtgcgggccgcaagtagcgttggcgccggtggcgaagccagcctcggtggatggtctccgtatcccgcaattgtcctcgcacgctgtgtcgaggagccggaagttccgtggcctcgtcgtgagggccgccacggttgtgtcacccaagtatacttccgtcaaaccattgggagatagggtactcgtgaagaccaagatctctgaggaaaagactccaggagggatattacttccaacatcagttaagccaaaaccacaaggaggggaagttgttgcagttggagaggggagaagcataggcagcaacaccgtagaaatcagtgttccggttggcgtccaagttgtgtactctaaatatgctggcacagagttggaattcaacgattctaaccatctcattttgaaagaagatgacatcattggtattcttgacactgatgatgtgaaagatctgaagccactgagtgatcgtattctcattaaggttgcagaggctgaagaggaaacttctggtggtttgctattgacgcaggcgaccaaagagaaaccttctgttggaacagtcatagctgttggcccagggcccttgggcgaggatggcagcaggacacccctatcgatcactcctggaagcagcgtgttgtactccaagtacgcaggaagtgagttcaagggtgctgacggcgagtacatcgttcttagggtatctgacgtgatagctgttatctcctaagcataccctgctcatttgaaataggaattttgataattagtccaaaactttgttttgttactgtcgcttggaattggtgaacttcttgaatatcttctcattccacggtgttatgatggaaagaaacgctgtctggattgctt

SEQ ID NO: 5922 - DNA, 1378 bp, Hordeum vulgare
acagtaccaaacccgtagaccgaacccaagcaactcattcttctttctcgagatctcccactccgcctccccgcgtcgccgtcgaacccaccccgtcgccggcagcgcccccactccccgcgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtgatcagcgagatcgactcgtcggcggcgacgtcgctgcaggccgtcaagctgctcgcgctctacctcaccggagacaaggaaggtgcgatctccagcttgaaggaatggttgagtgattcagccataggaagcaatcctgttctgcgattgattgctggaattatatttatgcatgagcaagactacaacgaggctctcaagcacacacatactgggggaactctggacctgcatgcactgaacgtccagatcttccttaagatgcaccgctcagattatgctgacaagcaactgaagatcatgcaacaaactgacgaggaccatacactgacacaactagcaaatgcttggcttgatatcgctgttggcggctctaagatccgggaagcttatctcatattccaggactttgctgagaagtaccctatgacaggaatggttcttaatggcaaggcagtttgctgtatgcatatggggagctttgaggaggctgaaactctattgcttgaagccctaaacaaggacgcaaaggatcctgaaactcttgccaatcttattgtatgtaatctccaccttggcaaaccgtcgtcccgatacttcagccagctgaagctgtcgcaccctgatcacgtgctagttaagaccaccacgtcggcggaggataacttcgaaagggcgctccaagctgtcgcctgaaacatccttgcctgattgcagttagcgcgttgagcctcccctgttccgttttgaagtgccttaacagagtgaattgtattggtttttgctttatattgttctatatggtaacacactggtctgccaaccctgtactcaaaacatccgctgtatgaacggatatatatgtagaatctccaatcgtggcatttgttgtcagcatccatatcttgttacgttctgctggattttgtggactgccagtatttgctgccagtgagagccacgtgtcgtggacatgtaaaacatcgtgctctctgtgatgcctgcatggacgttgcagatctgttttacattctttattgccgtatctacgtgctggctcagcccgatcttgttgaatgaaaagtttg

SEQ ID NO: 5923 - DNA, 1199 bp, Secale cereale
ccgaacccaagcaactcattcttctttctcgagatctcccactcgcctccccgcgtcgccgtcgaacccactccgccgccccgtcgcccctcccccgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtgatcagcgagatcgactcgtcggcggcgacctcgctgcaggccgtcaagctgctcgcgctctacctcaccggcgacaaggaaggcgcgatctctagcctgaaggaatggttgagtgattcagctataggaagcaatcctgttctgcggttgattgctggaattatatttatgcatgagcaagactacaacgaggctctcaagcacacgcacactggggggactctggacctgcatgcactgaacgtccagatcttccttaagatgcaccggtcagattatgctgacaagcaactgaagatcatgcaacaaactgacgaggaccatacactgacacaactagcaaatgcttggcttgatatcgctgttggtggctctaagatccgggaagcttatcttatattccaggactttgctgagaagtaccctatgacaggaatggttcttaatggcaaggcagtttgctgtatgcatatggggagctttgaggaggctgaaactctattgcttgaagccctaaacaaggatgcaaaggatcctgaaactcttgccaatcttattgtatgtaatctccaccttggcaagccgtcatcacgatacttcagccagctgaaactgtcgcaccctgatcacgtgctagttaagaccaccacatcagcggaggataactttgagagggcgctccaagccgtcgcctgaaacctccctgcctgattgcagttagagcggtgtgcctcccctgttccattttgaagtgctttaacagagtcaattgtattggtttttgctttatatattgttctatgtaacacagtgctcggccagcttctgtactcaaatcatccgccgtatgaacggatatatatgtagaatctccaatcatggcatttgttgtcagctctattgctatgttctgctggattttgtgcactatcag

SEQ ID NO: 5924 - DNA, 1245 bp, Triticum aestivum
accgaacccaagcaactcattcttctttctcgagatctcccactcgcctccccgcgtcgccgtcgaacccactcctccgccccgtcgccggcagcgcccccctcccccgatggccacccccgacctcctcttcaacctgcgcaacctcttctacctcggcgcctaccagtccgccatcaacaacagcgacgtgccgggcctcgacgccgacgccgcggccgagcgcgacgtcatcgtcttccgctcctacatcgccctcggatcctaccagctggtgatcagcgagatcgactcgtcggcggcgacgtcgctgcaggccgtcaagctgctcgcgctctacctcaccggcgacaaggaaggtgcgatctccagcctgaaggaatggttgagtgattcagctataggaagcaatcctgttctgcgattgattgctggaattatatttatgcatgagcaagactacaatgaggctctcaagcacacacacactggggggactctggacctgcatgcactgaacgtccaaatcttccttaagatgcaccggtcagattatgctgacaaacaactgaagatcatgcaacaaactgacgaggaccatacactgacacaactagcaaatgcttggctcgatattgctgttggtggctctaagatccgggaagcttatctcatattccaggactttgctgaaaagtaccctatgaccggaatggttcttaatggcaaggcagtttgctgtatgcatatggggagctttgaggaggctgaaactctattgcttgaagccctaaacaaggatgcaaaggatcctgaaactcttgccaatcttattgtatgtaatctccaccttggcaaaccgtcgtcacgatacttcagccagctgaagctgtcgcaccctgatcacgtgctagttaagaccaccacgtcagcggagggcaacttcgagagggcgctccaagccgtcgcctgaaacatccctgcctcattcgagttagcgcattgagcatcccctgttccattttgaagtgctttaacagagtgaattgtattggttttgcattatattgttctgtgtaacacaccgctcagccaaccctgtactcaaacacaaacacccgctgtatgaacggatatatatgtagaatctccaatcatggcatttgttgtcaacatcggtatcttgttatgttgtgctgggctggctaattcttccgccagtgacgtgtctggatcatgtaaaac

SEQ ID NO: 5925 - DNA, 1134 bp, Pseudoroegneria spicata
ctccccctcgcctccccgcgtcgccgtcgaacccactcctccgccccgtcgccggcagcgcccccctcccccgatggccacccccgacctccttttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtgatcagcgagatcgactcgtcggcggcgacttcgctgcaggccgtcaagctgctcgcgctctacctcaccggagacaaggaaggtgtgatctccagccttaaggaatggttgagtgattcagctataggaagcaatcctgttctgcgattgattgctggaattatatttatgcatgagcaagactacaacgaggctctcaagcacacacacactggggggactctggacctgcatgcactgaacgtccagatcttccttaagatgcaccggtcagattatgctgacaagcaactgaagatcatgcaacaaactgacgaggaccatacactgacacaactagcaaatgcttggctcgatattgctgttggtggctctaagatccgggaagcttatctcatattccaggactttgctgaaaagtaccctatgacaggaatggttcttaatggcaaggcagtttgctgtatgcatatggggagctttgaggaagctgaaactctattgcttgaagccctaaacaaggatgcaaaggatcctgaaactcttgccaatcttattgtatgtaatctccaccttggcaaaccgtcgtcacgatacttcagccagctgaagctgtcgcaccctgatcacgtgctagttaagaccaccacatcagcggaggataacttcgagagggcgctccaagccgtcgcttgaaacacccctgcttgattgcagttagcgcattgagcatcccctgttccattttgaagtgctttaacagtgaattgtattggttttgctttatattgttctgtggtaacacaccgctcggccaaccctgtactcaaacacaaacacccgccgtatgaagggatatatatgtagaatctccaatcgtggcatttgttcta

SEQ ID NO: 5926 - DNA, 1220 bp, Avena sativa
cccacgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtcatcagcgagatcgactcctcggcggcgacgtcgctgcaggccgtgaagctgctcgcgctgtacctcaccggcgacaaggaaggtgcaattgccagcctgaaggaatggttgagtgattcggctataggaagcaatcccgttctgcgattgattgctggaattatattcatgcatgagcaagactacaatgaggctctcaagcacacacacactggaggaactctggacctgcatgcattgaacgtccagatcttccttaagatgcaccgctcagactatgctgacaagcaactgaagatcatgcaacaaactgatgaggaccatacactgacacaactagcaaatgcatggctcgatattgctgttggtggctctaagatccgtgaagcttatctcatattccaagactttgcggaaaaatatcctatgacaggaatggttcttaatggcaaggcagtttgctgtatgcacatggggagctttgaggaggctgaaactctattgcttgaagccctgaacaaggatgccaaggatcctgaaactcttgccaatcttattgtatgtaatctccaccttggcaaagcgtcgtcacgatacttcagccagctgaaactgtcgcaccctgaccacgtgctagttaagtccaccgcatcggcggaggataactttgagagggctctccaagccgtcgcttgagaccctcctgcctgattgcagttagcgcattgagcctccccatgccccattttgaagtgctttaacacagtgaaaatgtattggttttactttatatattgttctatggtaacgctgctcgtcccaatcctgtactcggaacacctgctgtatgaaaggatatatatgtagaatctcagagtgttacatttgttgccagaatggctgctttgttgtatcctgcttcttctgtacattatcaattcgtgctactggcgatgtgccgtgaatcgtataaaacaccctgcggcctgtgatagctgatggcactatgtgatggtgagtgcgtgttaacaaaaaaaaaaacaaag

SEQ ID NO: 5927 - DNA, 1122 bp, Avena sativa
gagagatctcccactcgcctcccggcctcgccgacgaacaccgtcgccggaagcgagcaccgcgccctcccacgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtcatcagcgagatcgactcctcggcggcgacgtcgctgcaggccgtgaagctgctcgcgctgtacctcaccggcgacaaggaaggtgcaatcgccagcctcaaggaatggttgagtgactcagctataggtagcaatcctgttctgcgattgattgctggaatcatatttatgcatgagcaagattacaatgaggctctcaagcacacacacactggaggaacactggacctgcatgcattgaacgtccagatcttccttaagatgcaccgctcagactatgctgacaagcaactgaaggtcatgcaacaaactgatgaggaccatacactgacacaactagcaaatgcatggctcgatattgctgttggtggctctaagatccgtgaagcttatctcatattccaggactttgcggaaaaatatcctatgacaggaatggttcttaatggcaaggcagtttgctgtatgcacatggggagctttgaggaggctgaaactctattgcttgaagccctgaacaaggatgccaaggatcctgaaactcttgccaatcttattgtatgtaatcttcacctcggcaaagcgtcgtcacgatacttcagccagctgaagctgtcgcaccctgaccacgtgctagttaagtccaccgcatcggcggaggataactttgagagggctctccaagccgtcgcttgagaccctcctgcctgattgcagttagcgcattgagcctccccatgccccattttgaagtgctttaacacagtgaaaatgtattggttttactttatatattgttctatggtaacgctgctcgtccagtccaatcctgtactcggaacacctgctgtatgaaaggatatatatgtagaatctcaga

SEQ ID NO: 5928 - DNA, 1170 bp, Avena sativa
gaccaaacccagagacccgacgagcagttcttcccccgagagatctcccactcgcctccccgcctcaccgacgaaccccgtcgccggaagcgagcaccgcgcactcccacgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtgatcagcgagatcgactcctcggcggcgacgtcgctgcaggccgtgaagctgctcgcgctgtacctaaccggcgacaaggaaggtgcaatcgcgagcctgaaggaatggttgagtgactcagctataggaagcaatcctgtactgcgattgattgctggaattatatttatgcatgagcaagactacaatgaggctctcaagcacacgcacactggaggaactctggacctgcatgcattgaatgtccagatcttccttaagatgcaccgctcagactatgctgacaagcaactgaagatcatgcaacaaactgatgaggaccatacactgacacaattagcaaatgcatggcttgatatttctgttggtggctctaagatccgtgaagcttatctcatattccaggactttgcggaaaaatatcctatgacagggatggttcttaatggcaaggcagtttgctgtatgcacatggggagctttgaggaggctgaaactctattgcttgaagccctgaacaaggatgccaaggatcctgaaactcttgccaatcttattgtatgtaatctccaccttggcaaagcatcgtcacgatacttcagccagctgaaactgtcgcaccctgaccatgtgctagttaagtccaccgcatcagccgaggataacttcgagagggctctccaagccgtcgcttgagacacccctgcctgattacagttagcgcattgagcctccccatgtcccatttgaagtgctttaacccagggaaattgtattggttttcccttatattgttctatggtaacactgctcgtccaatcctgtactcggaacccctgctgtatgaaaggatatatatgtagaatttcagagtgtgatatttgttgcccg

SEQ ID NO: 5929 - DNA, 1261 bp, Avena sativa
accaaacccagagacccgacgagcaattcttcccccgagagatctcccactcgcctcccggcctcgccgacgaacaccgtcgccggaagcgagcaccgcgccctcccacgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtcatcagcgagatcgactcctcggcggcgacgtcgctgcaggccgtgaagctgctcgcgctgtacctaaccggcgacaaggaaggtgcaatcgcgagcctgaaggaatggttgagtgactcagctataggaagcaatcctgtactgcgattgattgctggaattatatttatgcatgagcaagactacaatgaggctctcaagcacacgcacactggaggaactctggacctgcatgcattgaatgtccagatcttccttaagatgcaccgctcagactatgctgacaagcaactgaaggtcatgcaacaaactgatgaggaccatacactgacacaactagcaaatgcatggctcgatattgctgttggtggctctaagatccgtgaagcttatctcatattccaggactttgcggaaaaatatcctatgacaggaatggttcttaatggcaaggcagtttgctgtatgcacatggggagctttgaggaggctgaaactctattgcttgaagccctgaacaaggatgccaaggatcctgaaactcttgccaatcttattgtatgtaatctccaccttggcaaagcgtcatcacgatactttagccagctgaaactgtcgcatcctgaccacgtgctagttaagtccaccgcatcagcggaggataacttcgagagggctctccaagccgttgcttgagaccccactgcctgattgcagttagcgcattgagcctccccatgtcccatttgaagtgctttaacacagtgaaattgtattggttttaccttatattgttctatggtaacactgctcgtccaatcctgtactcggaacacctgctgtatgaaaggatatatatgtagaatctcagagtgtgatatttgttgccagaatggctgctttgttgtatcctgcttgttctgtacattatcactttgtgctgcgggcgatgtgtgaatcgtgtaaaacaccctgcttgagat

SEQ ID NO: 5930 - DNA, 1250 bp, Avena sativa
ccagtaccaaacccagagacccgacgagcagttcttcccccgagagatctcccactcgcctccccgcctcaccgacgaaccccgtcgccggaagcgagcaccgcgcactcccacgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtcatcagcgagatcgactcctcggcggcgacgtcgctgcaggccgtgaagctgctcgcgctgtacctcaccggcgacaaggaaggtgcaatcgccagcctgaaggaatggttgagtgactcagctataggaagcaatcctgttctgcgattgattgctggaattatattcatgcatgagcaagactacaatgaggctctcaagcacacacacactggaggaactctggacctgcatgcattgaatgtccagatcttccttaagatgcaccgctcagactatgctgacaagcaactgaaggtcatgcaacaaactgatgaggaccatacactgacacaactagcaaatgcatggctcgatattgctgttggtggctctaagatccgtgaagcttatctcatatttcaggactttgcggaaaaatatcctatgacaggaatggttcttaatggcaaggcagtttgctgtatgcacatggggagctttgaggaggctgaaactctattgcttgaagccctgaacaaggatgccaaggatcctgaaactcttgccaatcttattgtatgtaatctccaccttggcaaagcatcgtcacgatacttcagccagctgaaactgtcgcaccctgaccatgtgctagttaagtccaccgcatcagccgaggataacttcgagagggctctccaagccgtcgcttgagacacccctgcctgattacagttagcgcattgagcctccccatgtcccattttgaagtgctttaacacagtgaaattgtattggttttactttatatattgttctatggtaacgctgctcgcccaatcctgtactcaaaacaccttctgtatgaaaggatatacatgtagaatctcagagtgtaacatttgttgccagaatggctgctttgttgttatcctgcttcttctgtacattatcaattcgtgctactggtgatgtgccgtgaatc

SEQ ID NO: 5931 - DNA, 1299 bp, Leymus cinereus x Leymus triticoides
agagaccgaacccaaacaattcattcttctttctcgagatctcccactcgcctccccgcgtcgccgtcgaacccactcctcctccccgtcgccgccagcgcccctcccccgatggccacccccgacctcctcttcaacctgcgcaacctcttctacctcggcgcctaccagtccgccatcaacaacagcgacgtcccgggcctcgacgccgacgccgcggccgagcgtgatgtcatcgtcttccgctcctacatcgccctcggatcctaccagctggtgatcagcgagatcgactcgtcggcggcgacgtcgctgcaggccgtcaagctgctcgcgctctacctcaccggagacaaggaaggtgcgatctccagcctgagggaatggctgaatgattcagctataggaaacaatcctgttctgcgattgattgctggaattatatttatgcatgagcaagactacaacgaggctctcaagcacacgcacactgggggtactctggacctgcatgcattgaacgtccagatcttccttaagatgcaccggtcagattatgctgacaagcaactgaagatcatgcaacaaactgatgaggaccatacactgactcaactagcaaatgcttggctggatattgctgttggtggctctaagatccgtgaagcttatctcatattccaggactttgctgaaaactaccccatgacaggaatggtccttaatggcaaggcagtttgctgcatgcatatggggagctttgaggaggctgaaacattattccttgaagccctgaacaaggatgcaaaggatcctgaaactcttgccaatcttattgtatgtaatctccaccttggcaaaccgtcctcccgatacttcagccagctgaagctgtcgcaccctgatcacgtgctagttaagaccaccacgtcagcggaggataacttcgagagggcgctccaagccgtcgcctgaaacacccctgcctcgttgcagttagcgcattgagcaccccctgttccattttgaagtgctttaacagagtgaattgtattggtttttgctttatattgttctatggtaacacactggtccgccaaccctgtactcaaaacatccgccgtatgaacggatatatatgtagaatcgtggcatttgttgtcaacatcggtatcttgttatgttgtgctggctaattcttcccgccagagcggcgtgtcgtggatcatgtaaaacatcgtgctctctgtgatgcctgtgtctgtatgcgcgcgttatgtgatttatgcgtgcctgcca

SEQ ID NO: 5932 - DNA, 1105 bp, Festuca arundinacea
gcagttcttctcccgagagatctccccactcgcctcgcctcgccgtcgagcccacccccgccaccgtcgccggcaacccgcccacgatggccacccccgacctcctcttcaacctgcgcaacctcttctacctcggcgcctaccagtctgccatcaacaacagcgacgtcccgggcctcgacgccgacgcggcggccgagcgcgacgtcatcgtcttccgctcctacatcgcgctcggatcctaccagctggtgatcagcgagatcgactcctcggcggcgacgtcgctgcaggccgtgaagctgctcgcactgtacctcaccggcgacaaggaaggcgcaatctccagcctgaaggaatggttgagtgattcggctattggaagcaatcctgttctgcgattggttgctggaattatatttatgcatgaacaagactacaatgaggctctcaagcacacacacactggaggaactctagacctacatgcattgaatgtccagatcttccttaagatgcaccgttcagactatgctgacaagcaactgaagatgatgcaacaaactgatgaggaccatacactgacacaactagcgaatgcatggctagatattgctgttggtggctctaagatccgtgaagcttatctcatattccaggactttgctgaaaaatatcctatgacaggaatggttcttaatggcaaggcagtttgctgtatgcacatggggagctttgaggaagctgaaactctattgcttgaagccttgaacaaggatgcaaaggatcctgaaactcttgccaatctcattgtatgtaatctccaccttggaaaggcttcatcacgctacttcagccagctgaaactgtcgcaccctgaccacgtgctagttaagtccaccgcatcagcagaagataacttcgagagggctctccaagccgtcgcttgagaccccccatgcctgattgcagttagggcattgagtctccccctgttccattttgaagtgctttaacacagtgaaattgtattggttttgctttatattgttctatggtaacactgctcgaccaaccctgtactcaaagcacctgctgtatgaac

SEQ ID NO: 5933 - DNA, 1320 bp, Lolium multiflorum
gcccccgccaccgtcgccggcgacccgcccacgatggccaccccggacctcctcttcaacctgcgcaacctcttctacctcggcgcctaccagtccgccatcaacaacagcgacgtcccgggcctcgacgccgacgccgccgccgagcgcgacgtcatcgtcttccgctcctacatcgcgctcggatcctaccagctggtgatcagcgagatcgactcctccgcggccacgtcgctgcaggccgtcaagctgctcgcgctctacctcaccggcgacaaggaaggcgcaatctccagcctgaaggaatggttgagtgattcggctattggaagcaatcctgttctgcgattggttgctggaattatatttatgcatgaacaagactacaatgaggctctcaagcacacacacactggaggaactctggacctacatgcattgaatgtccagatcttccttaagatgcaccgttcagactatgctgacaagcaactgaagatcatgcaacaaactgatgaggaccataccctgacacaactagcgaatgcatggctagatattgctgttggtggctctaagatccgtgaagcttatctcatattccaggacttcgctgaaaaatatcctatgacgggaatggttcttaatggcaaggcagtttgctgtatgcacatggggagctttgaggaggctgaaactctattgcttgaagccctgaacaaggatgcaaaggatcctgaaactcttgccaatctcattgtgtgtaatctccaccttggcaaggcgtcatcacgatacttcaaccagctgaaactgtcgcatcctgaccacgtgctagttaagtccaccgcatcagctgaagataactttgagagggctctccaagccgtcgcttgagaccccccatgcctgattgcagttagcgcattgagcctccccctgttccattttgaagtgctttaacacagtgaaattgtattggttttgctttatattgttctatacactgctcgaccaaccatgtactcaaaacacctgctgtatgaatggatggatatatatgtagaatctcagtgtggcatctgttgctgaaatcgcttttttgttgtgttctgctggttgcggttacttgacctgaatcatgtattacaacgaacctgtgatagctgatgacactatgctgatgcgtgagtacacactcagttctgtctcctgtacctacacgactgttcaatttatcgtttacattttttagtgtgcatttatctgtacatttttcttagattttcctcggtgcatttttcttagcgttgttggtgg

SEQ ID NO: 5934 - DNA, 1270 bp, Avena sativa
accaaacccagagacccgacgagcaattcttcccccgagagatctcccactcgcctcccggcctcgccgacgaacaccgtcgccggaagctagcaccgcgccctcccacgatggccacccccgacctcctcttcaacctgcgcaacctcttctacctcggcgcctaccagtccgccatcaacaacagcgacgtcccgggcctcgacgccgacgcagcggccgagcgcgacgtcatcgtcttccgctcctacatcgcgctcggatcctaccagctggtcatcagcgagatcgactcctcggcggcgacttcgctgcaggccgtgaagctgctcgcgctctacctcaccggcgacaaggaaggtgcaattgccagcctgaaggaatggttgagtgattcggctataggaagcaatcccgttctgcgattgattgctggaattatattcatgcatgagcaagactacaatgaggctctcaagcacacacacactggaggaactctggacctgcatgcattgaacgtccagatcttccttaagatgcaccgctcagactatgctgacaagcaactgaagatcatgcaacaaactgatgaggaccatacactgacacaactagcaaatgcatggctcgatattgctgttggtggctctaagatccgtgaagcttatctcatattccaagactttgacggaaaaatatcctatgacaggaatggttcttaatggcaaggcagtttgctgtatgcacatggggagctttgaggaggctgaaactctattgcttgaagccctgaacaaggatgccaaggatcctgaaactcttgccaatcttattgtatgtaatctccaccttggcaaagcgtcgtcacgatacttcagccagctgaaactgtcgcaccctgaccacgtgctagttaagtccaccgcatcggcggaggataactttgagagggctctccaagccgtcgcttgagaccctcctgcctgattgcagttagcgcattgagcctccccatgccccattttgaagtgctttaacacagtgaaaatgtattggttttactttatatattgttctatggtaacgctgctcgtccaatcctgtactcggaacacctgctgtatgaaaggatatatatgcagaatctcagagagttacatttgttgccagaatggctgctttgttgtatcctgcttcttctgtacattatcaattcgtgctactggcgatgtgccgtgaatcgtataaaacaccctgcggcctgtga

SEQ ID NO: 5935 - DNA, 1241 bp, Brachypodium distachyon
gccaaacccaaagaccgaacagaaacagggcagcgaccagcgagagatctgcccactcgtcgccgttgagtcgcaccagcccggtagccggcagcgcccgccctcccgcgatggccactcccgacctcctcttcaacctgcgcaacctcttctacctcggcgcctaccagtccgccatcaacaacagcgacgtcccgggcctcgacgccgacgctgcggccgagcgcgacgtcatcgtcttccgctcctacatagccctcggatcctaccagttggtgatcagcgagatcgactcgtcggcggcgacgtcgctgcaggccgtgaagctgctcgcgctgtacctctccggtgacaaggagggtgcaatatccagtctcaaggaatggctgagcgattcagctataggaagcaaccctgttctgcgattgattgctggaattatatttatgcatgagcaagactacaatgaggctctcaagcacacacacactggaggaactctggacctacatgcattaaacgtccagatctttcttaagatgcaccgttcagactatgctgataagcaattgaagatcatgcaacaaactgatgaggatcatacactgacacaacttgcaaatgcatggctggacattgctgttggtggctctaagattcgtgaagcttatctcatattccaggacttcgctgaaaagtaccctatgacagcaatggttcttaatggcaaggcagtttgctgtatgcacatggggagctttgaggaggctgaaacactattgcttgaagccctgaacaaggatgcaaaagatcctgaaaccctcgccaaccttattgtatgtaatctccaccttggcaagccgtcatcccgattcttcagccagctgaaactgtcacaccctgaccacgtgctagttaagtctgctgcatcagcagaagataacttcgagagggctctccaatctgtcgcttgaaaaccccctgcttgattgcagttagcacattaaggccctgcgctgttacatttcgtagtgctttcaacacagagaattgtattgttttgttttatgatgtttatggtaacagtgctcggccaatcttgtactcaaacatacaccgaatgaacggatatatgtagaatctccaatggtggcatctgtccttaccattgacgttttagtatattctgctggatttgtacactgtcaaaattcttgctatgggcgacgtgttctgaatcg

SEQ ID NO: 5936 - DNA, 1244 bp, Brachypodium distachyon
gccaaacccaaagaccgaacagaaacagggcagcgaccagcgagagatctgcccactcgtcgccgttgagtcgcaccagcccggtagccggcagcgcccgccctcccgcgatggccactcccgacctcctcttcaacctgcgcaacctcttctacctcggcgcctaccagtccgccatcaacaacagcgacgtcccgggcctcgacgccgacgctgcggccgagcgcgacgtcatcgtcttccgctcctacatagccctcggatcctaccagttggtgatcagcgagatcgactcgtcggcggcgacgtcgctgcaggccgtgaagctgctcgcgctgtacctctccggtgacaaggagggtgcaatatccagtctcaaggaatggctgagcgattcagctataggaagcaaccctgttctgcgattgattgctggaattatatttatgcatgagcaagactacaatgaggctctcaagcacacacacactggaggaactctggacctacatgcattaaacgtccagatctttcttaagatgcaccgttcagactatgctgataagcaattgaagatcatgcaacaaactgatgaggatcatacactgacacaacttgcaaatgcatggctggacattgctgttggtggctctaagattcgtgaagcttatctcatattccaggacttcgctgaaaagtaccctatgacagcaatggttcttaatggcaaggcagtttgctgtatgcacatggggagctttgaggaggctgaaacactattgcttgaagccctgaacaaggatgcaaaagatcctgaaaccctcgccaaccttattgtatgtaatctccaccttggcaagccgtcatcccgattcttcagccagctgaaactgtcacaccctgaccacgtgctagttaagtctgctgcatcagcagaagataacttcgagagggctctccaatctgtcgcttgaaaaccccctgcttgattgcagttagcacattaaggccctgcgctgttacatttcgtagtgctttcaacacagagaattgtattgttttgttttatgatgtttatggtaacagtgctcggccaatcttgtactcaaacatacaccgaatgaacggatatatgtagaatctccaatggtggcatctgtccttaccattgacgttttagtatattctgctggatttgtacactgtcaaaattcttgctatgggcgacgtgttctgaatcgtgt

SEQ ID NO: 5937 - DNA, 1100 bp, Festuca arundinacea
gcagttcttctcccgagagatctccccactcgcctcgcctcgccgtcgaacccgccaccgtcgccgtcgccggcgacacgcccacgatggccaccccggacctcctcttcaacctgcgcaaccccttctacctcggcgcctaccagtccgccatcaacaacagcgacgtcccgggcctcgacgccgacgccgccgccgagcgcgacgtcatcgtcttccgctcctacatcgcgctcggatcctaccagctggtgatcagcgagatcgactcctcggcggccacgtcgctgcaggccgtcaagctgctcgggctctacctcaccggcgacaaggaaggcgccatctccagcctcaaggaatggttgagtgattcggctattggaagcaatcctgttctgcgattggttgctggaattatatttatgcatgaacaagactacaatgaggctctcaagcacacacacaccggaggaactctggacctacatgcattgaatgtccagatcttccttaagatgcaccgttcagactatgctgacaagcaactgaagatcatgcaacaaactgatgaggaccataccctgacacaactagccaatgcatggctagatattgctgttggtggctctaagatccgtgaagcttatctcatattccaggacttcgctgaaaaatatcctatgacgggaatggttcttaatggcaaggcagtttgctgtatgcacatggggagctttgaggaggctgaaactctattgcttgaagccctgaacaaggatgcaaaggatcctgaaactcttgccaatctcattgtgtgtaatctccaccttggcaaggcgtcatcacgatacttcaaccagctgaaactgtcgaatcctgaccacgtgctagttaagtccaccgcatcagctgaagataacttcgagagggctctccaagccgtcgcttgagaccccccatgcctgattgcagttagcgcattgagcctccccctgttccattttgaagtgctttaacacagtgaaattgtattggttttgctttatattgttctatacactgctcgaccaaccctgtactcaaaacacctgctgtatgaa

SEQ ID NO: 5938 - DNA, 1159 bp, Echinochloa colona
agaccaaacaggcggagttgaagagcacccaccctgccggatctccctcccactcgccgcgtcgccgccgtcgagcgccgcaacgatggccaccccggacctgctcttcaacctgcggaacctcttccacctcggcgcctaccaggcggccatcaacaacagcgacgtcccgggcctcgacgccgacgccgccgccgagcgcgacgtcatcgtcttccgctcctacatcgccctcggctcctaccagctggtgatcagcgagatcgactcgtccgcggcgacgtcgctgcaggccgtgaagctgctcgcgctgtacctcaccggggacaaggaaggtgcaatctccagtctcaaggaatggttgagcgattcagcaattggaagcaatcctgttctgcgattgattgctggcattatttttatgcatgagcaggactacaatgaggctctcaagcacacacactctggaggaactctggatttgcatgcattgaatgtccagatcttcattaagatgcatcgttcagactatgctgagaagcaactgaagatcatgcaacaaattgacgaagaccataccctgacacagcttgcaaacgcatggttggacattgctgttggtggctctaagatccgtgaagcttatcttatattccaagactttgctgaaaaatacccaatgacagggatggttctgaatggaaaagcagtttgctgtatgcacatgggaagctttgaggaggctgagactctattgcttgaagcattgaacaaggatgcaaaagatcctgaaactcttgccaatctcattgtatgtaatctccaccttggcaaaccatcatcacgattcctcagccagctgaagctatcacatcctgatcatgtactagttaagaacgcggcatcgtcagaagcaaactttgagagggccctccaagctgttgcttgagcacaaaccccatccagattacagaaagcagcacattgatcccaattttcatttgatgtgtgttaacacagtggagtgtggtggttctgtttgtctaatttcctcgatggtaatagtaaagttacttggccgatcctgtacctgaacaactgctgtataaacggatatgtagaatatcaaattgttacgttttgtcgtcaacatcagcat

SEQ ID NO: 5939 - DNA, 1307 bp, Setaria italica
aactcgaatcaccaaaccggagagatcaaacgggcggagtcgacgagcaccctcacctccccggatctcttcccactcgccgcagaaccgcctccgccgcgccgcgtcgccgccgccgaccgccgcaacgatggccaccccggacctgctcttcaacctgcggaacctcttctacctgggcgcctaccaggcggccatcaacaacagcgacgtcccgggcctcgacgccgacgccgccgccgagcgcgacgccatcgtcttccgctcctacatcgccctcggctcctaccagctggtgatcagcgagatcgactcgtccgccgcgacgtcgctgcaggccgtgaagctgctcgcgctgtaccttaccggggacaaggaaggtgcaatctccagcctcaaagaatggttgagtgattcagcaattgggagcaatcctgttctgcgattgattgctggaattatatttatgcatgagcaggactacaatgaggctctcaagcacacgcactctggaggaaccttggatttgcatgcattgaatgtccagatcttcattaagatgcatcgttcagactatgctgagaagcaactgaagatcatgcaacaaattgatgaagaccatacactgacacaactagcaaacgcatggttggacattgctgttggtggctctaagatccgtgaagcttatctcatattccaagacttcgctgaaaagtacccaatgacggggatggttctgaatgggaaagcagtttgctgtatgcacatgggaagctttgaggaggccgagactctattgcttgaagcattgaacaaggatgcaaaagaccctgaaactcttgccaatctcattgtatgtaatctccaccttggcaaaccatcatcacgattcctcagccagctgaagctatcacatcctgatcatgtgctagttaaaaacgcggcatcgtcagaagcaaacttcgagagggccctccaagcagttgcttgagcatgacaaaccccatccagattactgaaagcagcagcacatcgatcccgttttccatttgaacagtggagtgtggtggttctgtttgtctaatttcctcgatagtaatggtaaagttacttggccaatcttgtacctgtaccggaacaacgccgtataaacggatatgtagaatatcgatatgttacattttgtcgtcaacatcagcattttgttatgttcttccagattagcaaaactgtcaacccttgtaggcggcgatatgaacaacttgcttgtgcgtctttctggacctctcgctgatctcccgtgc

SEQ ID NO: 5940 - DNA, 1241 bp, Setaria italica
caaaccggagagatcaaacgggcggagtcgacgagcaccctcacctccccggatctcttcccactcgccgcagaaccgcctccgccgcgccgcgtcgccgccgccgaccgccgcaacgatggccaccccggacctgctcttcaacctgcggaacctcttctacctgggcgcctaccaggcggccatcaacaacagcgacgtcccgggcctcgacgccgacgccgccgccgagcgcgacgccatcgtcttccgctcctacatcgccctcggctcctaccagctggtgatcagcgagatcgactcgtccgccgcgacgtcgctgcaggccgtgaagctgctcgcgctgtaccttaccggggacaaggaaggtgcaatctccagcctcaaagaatggttgagtgattcagcaattgggagcaatcctgttctgcgattgattgctggaattatatttatgcatgagcaggactacaatgaggctctcaagcacacgcactctggaggaaccttggatttgcatgcattgaatgtccagatcttcattaagatgcatcgttcagactatgctgagaagcaactgaagatcatgcaacaaattgatgaagaccatacactgacacaactagcaaacgcatggttggacattgctgttggtggctctaagatccgtgaagcttatctcatattccaagacttcgctgaaaagtacccaatgacggggatggttctgaatgggaaagcagtttgctgtatgcacatgggaagctttgaggaggccgagactctattgcttgaagcattgaacaaggatgcaaaagaccctgaaactcttgccaatctcattgtatgtaatctccaccttggcaaaccatcatcacgattcctcagccagctgaagctatcacatcctgatcatgtgctagttaaaaacgcggcatcgtcagaagcaaacttcgagagggccctccaagcagttgcttgagcatgacaaaccccatccagattactgaaagcagcagcacatcgatcccgttttccatttgaacagtggagtgtggtggttctgtttgtctaatttcctcgatagtaatggtaaagttacttggccaatcttgtacctgtaccggaacaacgccgtataaacggatatgtagaatatcgatatgttacattttgtcgtcaacatcagcattttgttatgttcttccagattagcaaaactgtcaacccttgtaggcggc

SEQ ID NO: 5941 - DNA, 1635 bp, Panicum virgatum
gagacccaacaactatctcaggcccagctgcctccgattgaggcccaattagagcccatttataaatatagctccattctcctcctctctcccccagcaactcgaatcaccaaaccgaggagaccaaacaggcggggttgagcaacctcccggatctccagccagcctcctccgcgtcgccgccgccgcagcgatggccaccccggacctgctcttcaacctgcggaacctcttctacctgggcgcctaccaggcggccatcaacaacagcgacgtcccgggcctcgacgccgacgccgccgccgagcgcgacgccatcgtcttccgctcctacatcgccctcggctcctaccagctggtgatcagcgagatcgactcctccgccgcgacgtcgctgcaggccgtgaagctgctcgcgctgtacctcaccggggacaaggaaggtgcaatctccagtctcaaggaatggttgagcgattcagcaattgggagcaatcctgttcttcgattgattgctggaattatatttatgcatgagcaggactataatgaggccctcaagcacacacactctggaggaactctggatttgcatgcattgaatgtgcagatcttcattaagatgcatcgttcagactatgctgagaagcaattgaagatcatgcaacaaattgatgaagaccatacactgacacaacttgcaaacgcatggttggacattgctgttggtggctctaagatccgtgaagcttacctcatattccaagactttgctgaaaagtacccaatgacagggatggttctgaatgggaaagcagtttgctgtatgcacatgggaagctttgaggaggctgaaactctattgcttgaagcattaaacaaggatgcaaaagatccagaaactcttgccaatctcattgtatgtaatctccaccttggcaaaccatcatcacggttcctcagccagctgaagctatcgcatcctgatcatgtgctagtgaagaactcagcatcgtcggaagcaaacttcgagagggccctccaagccgttgcttgagcacgacaaactgcatccagattacagaaagcagcacattgatcccgtttcccatttgttgtgtgttaacgcagtggagtggtggttctgtttgtctaatttcctcggtggtaattagtaaagttacttggccaatcctgtaccggaacaactgctgtataaacagatatgtagaatatggatttgttactttttgtcatcaacgtcagcattttgctatgtggccagatgaacaatactgccaacccctgttgtgggcgaggctataagcagcttgctcatgcgtcctggacctcacgctgattgtcttctgtgctgcctgaattctgacgtttttcgtggtggtggtctgcttatgcttgtcggacaagcttagccagccgtacgcttgttactagaggaacactgaagctgagggcagacgattggcctctgcttcttattgtgtcttattaacatatcgttgatttggccctgctgcttgatcctgccgttgattgttcttggcttcttggagccaatggatggttgttacgcatttatttgcattgctaatggatcttgaataatgttgtgtg

SEQ ID NO: 5942 - DNA, 1130 bp, Sorghum bicolor
accgacgagacgacagagcggagtcgaggactcgagagcaccctcccggatctctctaccaccagcgcctcgtcgccgccgtccactgccgcagcgatggcctcccccgacctgctcttcaatctgcggaacctcttctacctgggcgcctaccaggcggccatcaacaacagcgacgtcccgggcctcgacgccgacgcagccgccgagcgcgacgccatcgtcttccgctcctacatcgccctcggctcctaccagctggtgatcagcgagatcgactcgtcggccgcgacctcgctgcaggccgtgaagctgctcgcgctgtacctcaccggagacaaggaaggtgctatctccagtctcaaggaatggttgagcgattcagcaattggaagcaatcctgttttgcgattgattgctggaattatatttatgcatgagcaggactacaatgaggctctcaagcacacacactctggaggaactctggatttgcatgcattgaatgtacagatcttcatcaagatgcatcgttcagactatgctgagaagcaattgaagatcatgcaacaaattgatgaagaccacacactgacacaacttgcaaatgcatggctgggcattgctgttggtggctctaagatccgtgaagcttatctcatattccaagacttcgctgaaaagtacccaatgacagggatggttctaaatgggaaggcagtctgctgtatgcacatgggaagctttgaggaggccgagactctattgcttgaagcgctgaacaaggatgcaaaagatcctgaaactcttgccaatctaattgtatgcaatctccaccttggcaaaccatcatcacgattcctcagccaactgaagctatcgcatcctgatcatgtgctcgttaagaacgcggcatcatcagaagcaaccttcgagagggccctccaagctgtcgcttgagctcgacaaaacccccaccagattacagaaaagcagcacattgatctctttttccccatttcgagtgtgttaacccagtaagtatggtggttttggttgtctatcgtcgctattaatgcgactcggccagtcttgtactacaacaactactgtataaacggatatgtaga

SEQ ID NO: 5943 - DNA, 1220 bp, Saccharum officinarum
ccgcagcaactcgaatcaccaaaccgaagagaccacagggcggagtcgagagcagacctcccggatctctctgccacccgcacctcgtcgccgccgtcgactgccgcagcgatggcctcccccgacctgctcttcaatctgcggaacctcttctacctgggcgcctaccaggcggccatcaacaacagcgacgtcccgggcctcgacgccgacgccgccgccgagcgcgacgccatcgtcttccgctcctacatcgccctcggctcctaccagctggtgatcagcgagatcgactcgtcggccgcgacctcgctgcaggctgtgaagctgctcgcgctgtatctcaccggagacaaggaaggtgctatctccagtctcaaggaatggttgagcgattcagcaattggaagcaatcctgttttgcgattgattgctggaattatatttatgcatgagcaggactacaatgaggctctcaagcacacacactctggaggaactctggatttgcatgcattgaatgtccagatcttcatcaagatgcatcgttcagactatgctgagaagcagttgaagatcatgcaacaaattgatgaagaccatacactgacacaacttgcaaacgcatggcttggcattgctgttggtggctctaagatccgtgaagcttatctcatattccaagacttcgctgaaaagtacccaatgacagggatggttctaaatgggaaggcagtctgctgtatgcacatgggaagctttgaggaggccgagactctattgcttgaagcgctgaacaaggatgcaaaggatcctgaaactcttgccaatctaattgtatgcaatctccaccttggcaaaccatcatcacgattcctcagccagctgaagctatcgcatcctgatcatgtgctcgttaagaacgcagcatcatcagaagcgaccttcgagagggccctccaagccgtcgcttgagctcgacaaatcccaaccagattacagaaagcagcacattgatatctttttttcccatttcgagtgtgttaacccagaaaagtatggtggttttggttgtctatcgtcgctgttaatgcgactaggtcagtcttgtactacaactgctgtataaacggatatgtagaatgttgaaccgttacatctattgccaacatcagtattttgttttgttctagtagatatatgcaatactgtcaagtgtc

SEQ ID NO: 5944 - DNA, 1190 bp, Zea mays
gcatcaactcgaaccgaagggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattggaagcaatcctgttctgcggttgattgctggaattgtatttatgcatgagcaggactacaatgaggctctcaagcacacacactctggaggaactctggatttgcatgcattgaatgtccagatcttcatcaagatgcatcgttcagactatgctgagaagcaattgaagatcatgcaacaaattgatgaagaccatacacttacacaacttgcaaacgcatggctgggcattgctgttggcggctctaagatccgtgaagcttatctcatattccaagactttgctgaaaagtacccaatgacagggatggttttaaacgggaaggcagtctgctgtatgcacatgggaagctttgaggaggctgagactctgttgcttgaagcgttgaacaaggacgcaaaagatcctgaaactcttgcgaatctaattgtatgtaatctccacttaggcaaaccatcatcacgatacctcagccagctgaagctatcgcatcctgaccatgtgctagttaagaatgcggcagcatcagaagcgaccttcgagagggccctccaagccgttgcttgagctcgacacaccccacccagccagattgcaggaatcagcacattctggtctcttctccaattacgagtgtattaacccagagtatggtggttttggttgcctgtatcgtcgctgttaatgcgactccgccagtcttgtactacaaactgctgtataaacggatatgtcgaatattgaatccttacatctgttgccaataccagtattttgtta

SEQ ID NO: 5945 - DNA, 1328 bp, Pennisetum glaucum
gctcgctcggctcgactcagactcccgcaaggcagcaactcgaatcaccaaaccgaagagaccaaaccaaacaggcggagtcgagaccctccgccggatctccctcccactcgccgcggaaccgcctccaccgccgccgagcgccgtaagcgatggccaccccggacctgctcttcaacctgcggaatctcttctacctgggcgcctaccaggcggccatcaacaacagcgacgtcccgggcctcgacgccgacgccgccgccgagcgcgacgccatcgtcttccgctcctacatcgccctcggctcctaccagctggtgatcaacgagatcgactcctccgccgcgacgtcgctgcaggccgtgaagctgctcgcgttgtacctcaccggggacaaggaaggtgcaatctccagcctcaaagaatggttgagtgattcagcaattgggagcaatcctgttctgcgattgattgctggaattgtatatatgcatgagcaggactacaatgaggctctcaagcacacgcactctggaggaaccttggatttgcatgcattgaatgtccagatcttcattaagatgcatcgttcagactatgctgagaagcaactgaagatcatgcaacaaattgacgaagaccatacactgacacaacttgcaaacgcatggttggacattgctgttggtggctctaagatccgtgaagcttatctcatattccaagacttcgctgaaaagtacccaatgacggggatggttctgaatgggaaagcagtttgctgtatgcacatgggaagcttcgacgaggctgagactctattgcttgaagcattgaacaaggatgcaaaagaccctgaaactcttgccaatcttattgtatgtaatctccaccttggtaaaccatcatcacgattcctcagccagctgaagctatctcatcctgatcatgtgctagttaagaacgcggtatcgtccgaagcaaacttcgagagggccctccaagctgttgcttgaacatgacaaaccccatccggattacagaaagcagcagcacattgatcctgttttccatttggtgtgtgttaacacagtggagtgtggtggttccgtttgtctaattttcccgatagtaatggtaaagttacttggccaatcttgtacctgtaccggaacaacgatgtataaacgcatatgtagaatatcgatttgttacattttgtcgtcaacatcagcattttgttatgttcttccagattagcagaactgtcaacccttgtaggcagtgatatgagcaacttgcttgtgcgtctttctggacctcagctg

SEQ ID NO: 5946 - DNA, 1350 bp, Oryza sativa
acagagaccaaacgggccaaggagagaggagcagcagcagcgccaccgctcgcgagatctcctactcctcgtcgccgacgagccgcctcctcctcgtcgtcgccggcggcagagcaccggagcagccaccccatggcgtccccggacctcctcttcaacctgcgcaacctcttctacctcggcgcctaccaggccgccatcaacaacagcgacgtcccgggcctcgacgccgacgccgccgccgagcgcgacgccatcgtcttccgctcctacgtcgcgctcggctcctaccagttggtgatcagcgagatcgactcgtccgcggcgacgtcgctgcaggccgtgaagctgctcgcgctgtacctctccggagacaaggaaagtgcgattgtcagtctgaaggaatggttgagtgattcggcggttggaagcaatcctgttctacgattgattgctggaattatatttatgcatgagcaagactacactgaagctctcaagcacacacactctggtggaactctggacctgcatgcattgaatgtccagatcttcattaagatgcaccgttcagactatgccgagaagcaattaaagatcatgcaacagattgatgaggaccatacactgacacaacttgcaaacgcatggctggacattgctgttggtggctctaagatccgtgaagcttacctcatattccaagactttgctgaaaaatacccgatgacaggaatggttctaaatggcaaggcagtttgctgtatgcacatggggagctttgatgaggctgagactcttttactcgaagcattgaacaaggatgcaaaagatcctgaaactcttgctaatcttattgtgtgtaatctccaccttggcaaaccgtcatcaagatacctcagccagctgaaactatcacaccccgatcatgtgctagtaaagcgtgccgtatcagcagaagataacttcgagagagctctccaagccgtcgcttgaacacgtccgcggaaaacgcttgccagattgcagataacacaattgatcccccatgttccattttgagtgccttaacacagcgaaaattatgttgcatttgctcagtctgttttgctcaaatggtgatatactacccggccaatcttgtactctgaacccctgctgtataaacaaatataatgtagaatcttgaatggtgacgtttgtggtcagcatcgacattttgttatattctgctggattgttgttacatcgctcgattctttgtattcgtttgtgcgccgtgctgcacctcgcagattttcttgtgctagaaagtgtggtcctcgcgtggaacctgacgttatgtagcgc

SEQ ID NO: 5947 - DNA, 965 bp, Musa acuminata
gctgaagcgagaacaaagcgcctcttcgttttccgtgctccggatctcgattggcgaaaccaccacgaagccgcggtgatggcggcggcgaccacccccgaccttctcttcggcctccgcaacagtttctacttgggcgcctatcaggccgccatcaacagcagcgacatccccaacctccccgccgacgacgccctcgagcgcgatgtcctcgtccaccgctcctacatcgcccttggctcctaccagcttgtcatcagtgagatcgattcgtcggctcctactgccctccaggccgtcaaattgctcgccctatacctctccggcgacaaggaatctgctatttcaagtctccaagagtggttaagtgatgctgcaataagcaacaatcccgttcttcgactgattgctgggatcatatacatgcatgaacaagactacaatgaggcacttaagcatactaattctgggggaactatggaactgcatgctttgaatgttcagatattcattaagatgcacagatcagactatgctgagaaacagcttaagatcatgcaacagattgatgaggaccacacacttacgcaacttgcaaatgcatggttggatctggcagtgggcggttccaagatacaggaagcatatcttattttccaagacttctctgaaaagtatcagatgactggaatgattttgaatggcaaggccgtctgttgtatgcacatgggtcgctttgatgaggctgagtccttgttgcttgaagcactgaacaaagatgcaaaggatgcagaaactctggccaaccttgctgtgtgcagtcttcacctaggcaaaccatcatcacgatatctcaatcagttgaagttgtcacatccagaccatgttctcgttgctcgtatggcatccgctgaagataattttgatagagctcttcaatccattgcatgaggtctcagatggag

SEQ ID NO: 5948 - DNA, 976 bp, Chelidonium majus
agatctaaacgcgaactgaaagaagaaatcaaatcatggcttctccagatcatctctttggccttcgaaacaacttctacttgggtgcttaccaggccgccattaacaacagtgaagttccaaatctctctcaagaagactctgtcgaaagagattgcctcgtttacagatcttacattgcccttggaagctatcagcttgtgatcaacgagatcgattcgtctgcagctacgcctctccaagcagtgaaattgctcgctttgtatctttccggtcctgaaaacaaggaaacaacaatttcgagtctcaaggagtggttgggtgatgcagccattggaaacaatcctgttttgcggctgattgcagggatcatattcatgcacgagcaagactacaatgaggctctgaaacatactaatactggaggcactatggaactgcatgctttaaatgttcagatattccttaagatgtacaggtcagattacgctgagaaacagctaaagatcatgcaacagattgatgaggaccacacactcacccaacttgcaaatgcatggctaaacttggcagtgggtggttccaagattcaggaggcgtatcttattttccaagatttctccgagaaatatcagatgaccgggctggtcctcaatgggaaagctgtctgctgtatgcatatgggtcactttgatgaagccgaatcattgctgctcgaagcactgaacaaggatgcaaaggatgctgaaactttggctaatctagtcgtatgcaatcttcaccttggtaaaccatcatctcgttacctcagccaattgaagctgtcacatcctgatcacatgctcgttaaacgtacatctgctgctgaagagagctttgacagagctcttcaaaccgtcgcttgaatgcctcgtggaggtcattattagattgttaacagggtgcattattcctgctttctcttatttgagatcca

SEQ ID NO: 5949 - DNA, 1152 bp, Musa acuminata
aagagacgaagctgaagcgagaacaaagcgcctcttccttttccgtgctccggatctcgattggcgaaacgaccacgaagccgcggtgatggcggcggcgaccacccccgaccttctcttcggcctccgcaacagtttctacttgggtgcctatcaggccgccatcaacagcagcgacatccccaacctccccgccgacgacgccctcgagcgcgatgtcctcgtccaccgctcctacatcgcccttggctcctaccagctcgtcgtcagtgagatcgattcgtcggctcctactgccctccaggccgtcaaattgctcgccctatacctctccggcgacaaggaatctgctatttcaagtctccaagagtggttaagtgatgctgcaataagcaacaatcccgttcttcgactgattgctgggatcatatacatgcatgaacaagactacaatgaggcacttaagcatactaattctgggggaactatggaactgcatgctttgaatgttcagatattcattaagatgcacagatcagactatgctgagaaacagcttaagatcatgcaacagattgatgaggaccacacacttacgcaacttgcaaatgcatggttggatctggcagtgggcggttccaagatacaggaagcatatcttattttccaagacttctctgaaaagtatcagatgactggaatgattttgaatggcaaggccgtctgttgtatgcacatgggtcgctttgatgaggctgagtccttgttgcttgaagcactgaacaaagatgcaaaggatgcagaaactctggccaaccttgctgtgtgcagtcttcacctaggcaaaccatcatcacgatatctcaatcagttgaagttgtcacatccagaccatgttctcgttgctcgtatggcatccgctgaagataattttgatagagctcttcaatccattgcatgaggtctcagatggaggtttgcgaggagtaacagtagtatctgctttattgtcgtcgagcattcattatcttgttttgtgattgtattgttagggttcacaagagtatccagtaatatctttatcatgtagaaccatgtattttggaatatgcattgtcatgccttcttagacttgacgttcataaatagttg

SEQ ID NO: 5950 - DNA, 1131 bp, Zingiber officinale
gcgaaatccacgtccacttgcctcgactccgatctccgatctcggtctccgccggcagtagtatttccaggcgacgctgatggcgaccactcccgacctcctatttggcctccgcaacagcttctacttgggcgcctaccaggccgccatcaacagcagcgacatcccaaacctccccgccgacgacgccatcgagcgcgatgtcatcgtccaccgctcctacatcgccatcggatcctaccagcttgtcataaatgagatcgattcgtcggcgcctacccctctccaagccgtcaaattacttgctctttacctctccggaagcaaggaagctgctatttcgagcatccaagagtggttaagtgatgctgcaataggaaacaatcctgtccttcgtttgattgccgggatcatatacatgcatgaacaagactacaatgaggcactgaaacataccaatgctggtggaaccatggaactccatgcactgaatgttcaaatattcattaagatgcataggtcagactatgcagagaaacaacttaaaatcatgcaacaaattgatgaggatcatacgctgacccaacttgcaaatgcatggttagatttggcagtgggtggttctaagatacaggaagcttatctgatttttcaagacttctctgagaaataccagatgactggaatggttttaaatggtaaggctgtttgttgtattcacatgggtcactttgatgaagctgagtccttactgctggaagcactaaacaaggatgcaaaggatgcagagactttggccaaccttgttgtatgcagtcttcacctaggcaagccttccacaagatttctcaaccagttgaagctgtcacatccggaccatatgcttgttaaacgccttgcaacagctgaagataacttcgatagagctcttcaatccctcgcctgattctatcctttgccccagtggaattctactcgatcactgctctgttgtcgccttctttttgttcttgttcttgttttgtgattgtaatgctcgttctctcccagtcagatatcttaaagcgtattattatatgtccttgaatatttttccctgatatattgaaccattgaactgcctactgactt

SEQ ID NO: 5951 - DNA, 1247 bp, Papaver somniferum
tttgaaattctctcagatctgaactccaaaccaaataatcaaaatggcaactcctgatcatctttttagccttcgtaacaacttctatttgggtgcttatcaagctgccattaacaacagtgatgtccctaatctctctcaagaagattcaattgaaagagattctcttgtttacagatcttacattgctcttggtagttatcagcttgtgatcagtgagattgattcttctgcacctacggccctccaggcagttaaattgcttgcgtcatatctttgtggtcctgagcaaaaggaaacacgatttcaagtttgaaagagtggttgggtgattcggcaattggaaacaatcctgtattgaggctgattgctggaatcatattcatgcatgaacaagactacaatgaggctcttaaacataccaacactggaggcactatggagctgcatgcgctgaatgttcagatattccttaagatgtataggtcggatttcgcagagaaacagctaaaaatcatgcaacagattgatgaggatcacactctgacccagcttgctaatgcatggttgaaccttgcagtgggtggatcaaagatacaggaagcatatcttattttccaagatttctctgagaagtatcccatgacaggactgatcctcaacgggaaggctgtgtgttgcatgcatatgggtcactttgacgaagcagagtcattgctgctggaagcactgaacaaggatgcaaaggacgctgaaactctggccaacctcattgtctgcagtcttcacctagggaaacaatcatctcgttacctaagccaactgaagctgtctcatcctgatcacatgcttgttaaacgcacgtctgctgatgaagagagcttcgatagggcccttcaaactgtcgcttaaatgcctcgtgcacgccattttttatagtttgttaagaaggtgcatgcttctatcttttattcgaaaatccaggttcttgtgtttttctcgtaactttttcacgagatatctcttaaagaaagactagattgtacttttcatattttgtagtaagattggtctctttttctgctttgggtttccagccctgtgatatgatgatgattcgaagattcaatctaataggatatatatgagtttagtgagaattgtttttttatcagaagagcaataatattgtttggtatcctctagtttggggatatgtcgggcttaggaataaatatataattatg

SEQ ID NO: 5952 - DNA, 1322 bp, Ananas comosus
ctctctctgcgttctcgggagctctctcttcgttctcgagagctcggcaatggcgtcgtcgtccccggacctcctcttcggccttcgcaatagcttctacctcggcgcctaccaaggcgcgatcaacaacagcgatatccccaacctcggccctgacgacgccatcgagcgcgactccatcgtctaccgctcctacatagccctcggatcctaccagctcgtgatcagcgagatcgactcgtccgcgcccaccgcgcttcaggccgtgaagcttctcgcgctctacttcgccggagacaaggaagctgcaatttccggtctccaagagtacttgagtgattcggccataggaaacaatcctgttctgcgactaattgcagggattatatatatgcatgagcaagactacaatgaggctctcaagcataccaattctggaggaactatggaattgcatgcgttgaatgtacaaatttacattaagatgtatcggtcagactatgcagagaaacaacttaaggtcatgcaacaaattgatgaagaccatacactgactcaacttgcaaatgcatggctagacctagctgtgggtggatctaagatacaggaagcatatcttatcttcgaagacttctctgaaaagtatcagatgactgggatgatactcaatgggaaggcagtttgctgtatgcacatggggcgatttgatgaagctgaaactctattgcttgaagcgctaaacaaagatgcgaaagatgcagaaactctcgcgaacctaattgtgtgcagtctccaccttggcaaatcctcatctcgatacttcaaccagctgaagctgtcgcatcccgatcatacgctcgtcaagcgtgccgcctctgccgaagatagctttgacagagctcttcaagctgtcgcataaagcctttgttatttcagctcctcaaggggatgcaacatagcttctgcttttttaatgcaccattttgaatccgccttacactgttgctttcttaatcatgtcgcgtaatgttacattgaattgaaaagatgtagtctgtttgtccttttcgacatttcttatgcctttgttagatcattatgtccaagtcatggagcttaaagtgttttttttttttttcctgtattagaaaattatcccccttttttaatgagtctctctgaaaattgtattctttgtaatccgtcactgctgctgctgatcaaggtagctgtaagttggcctataattagtcatggtttggtctgatttttatttcttggtgttttacaactggccaaagagaatctggtgaagcagttct

SEQ ID NO: 5953 - DNA, 1180 bp, Papaver somniferum
tttctctttgaaattctctcagatctgaactccgtaccaaataatcaaaatggcaactcctgatcatctctttagccttcgtaacaacttctatttgggtgcttatcaagctgccattaacaacagtgatgttcctaatctctctcaagaagattcaattgaaagagattctattgtttacagatcttacattgctcttggtagttatcagcttgtgatcagtgagattgattcttctgcacctacgccactccaggcagttaaattgctagcgacatatctttctggtcctgagcaaaaggaaaacacgatctcaagtttgaaagagtggttgggtgattcggcaattggaaacaatcctgtgttgaggctgattgctggaatcatattcatgcatgaacaagactacaatgaggctcttaaacattccaacactggaggcactatggagctgcatgcgctgaatgttcagatattccttaagatgaataggtcggatttcgcagagaaacagctaaaaatcatgcaacagattgatgaggaccacactctgacccaacttgcaaatgcctggttgaaccttgcagtgggtggatcaaagatacaggaagcatatcttattttccaagatttctctgagaagtatcccatgacaggactgatcctcaacgggaaggctgtctgttgcatgcatatgggtcactttgacgaagcagagtcattgctgctggaagcactgaacaaggatgcaaaggatgctgaaactctggccaacctcattgtctgcagtcttcacctagggaaacaatcatctcgttaccttagccaactgaagctgtctcatcctgatcacatgcttgttaaacgtacgtctgctgatgaagagagcttcgatagagcccttcaaactgtcgcttaaatgccttgtgcacgtcattttttatagtttgttaagaaggtgcatgcttctatcttttattcgaagatctaggttcttattcctttttcatgagatattatctctcttaaagaaaagactagattgtactattcatattttgtagtaagattggtctctttttgtgctttgggtttccatccctgtgatatgatgatgattcgaagattcaatctaacaggatatgtaggagttcaatgagagagaaaaattgatcagaag

SEQ ID NO: 5954 - DNA, 1229 bp, Carica papaya
tgatttttaaataataacagttgaaggagtatttgtctcgctgatacaaagtggaagagaagaagacgaaggttgctttggggaatcaaagagatctacaccggaggaaaaatggcagcagcggcagcagcagcagcggggccagatcacttgttcaaccttcgaaacaacttctacttgggagcctaccaggccgccattaacaacagtgacctccctcatctatccgcggacgacgccgtcgagcgcgactgcatcgtgttccgctcttacatcgctctcggcagctaccagctcgtgatcaatgagatcgatgcctctgccgctactcctctacaggcggtgaaattgctggctttgtatctctcaagccccggaaacaaggaatccaccatttcaagcttgaaggagtggttgtcagatccagccattggaaataatgctactttacggttgattgctgggatcatattcatgcatgaggaggattataatgaagctctgaaacacaccaatgctggaggaaccatggaactgcatgcactcaatgtccaaatattcctgaagatgcacagatcggactatggtgagagacagctgagagtcatgcagcagattgatgaggaccacacactgactcaacttgcaaatgcatggttgaatctggctgtgggaggttcgaagatacaggaagcatatctcatcttccaggacttctctgagaagtatccaatgaccagcttaatcctgaatgggaaggctgtttgctgcatgcacatgggaaacttcgatgaagctgagacactattgcttgaagcactaaacaaggatgcaaaagatccagaaacccttgcaaatctagttgtttgcagtcttcatctcggtaaatcatcgtcacgttacctcagccaattgaaactttcccatccggaccacatgctcgtcaagcgagcatcatctgcagaagaaaattttgaaagagctgttcaatcggttgcttgagaaatcaatacatgtagttgaagagatgaatggtgcttgcattatttagcgaatcactgtttctgactgcaaatcttttgagttttttgtaatctacaagaacatatgaactaatggtggaggagaggaaatggtgattgttacaaagttcatcatgttcaattagaactggcatatcatttgtattgtttcgtttataatggatttggtgattacttttcttgaga

SEQ ID NO: 5955 - DNA, 1111 bp, Curcuma longa
gcaccatgcttgcctcgactccgatctccgatctcggtctccgccggcagtagtatttccaggcgacgatgatggcgaccactcccgacctcctatttggcctccgcaacagcttctacttgggcgcctaccaggccgccatcaacagcagcgacatcccaaacctccccgccgacgacgccatcgagcgcgatgtcatcgtccaccgctcctacatcgccatcggatcctaccagcttgtcataaatgagatcgattcgtcggcgcctacccctctccaagccgtcaaattactgctctttacctctccggaagcaaggaagctgctatttcgagcatccaagagtggttaagtgatgctgcaataggaaacaatcctgtccttcgtttgattgccgggatcatatacatgcatgaacaagactacaatgaggcactgaaacataccaatgctggtggaaccatggaactccatgcactgaatgttcaaatattcattaagatgcataggtcagactatgcagagaaacaacttaaaatcatgcaacaaattgatgaggatcatacgctgacccaacttgcaaatgcatggttagatttggcagtgggtggttctaagatacaggaagcttatctgatttttcaagacttctctgagaaataccagatgactggaatggttttaaatggtaaggctgtttgttgtattcacatgggtcactttgatgaagctgagtccttactgctggaagcactaaacaaggatgcaaaggatgcagagactttggccaaccttgttgtatgcagtcttcacctaggcaagccttccacaagatttctcaaccagttgaagctgtcacatccggatcatatgcttgttaaacgccttgcaacagctgaagataacttcgatagagctattcaatcggtcgcttgattctataatttgcccaagtggaattctactcgatcactgctctgttgtcgccttctttttgttcttgttcttgttttgtgattgtaatgcttgttctcttccagtcagatatcttaaagggtattattatatgtacgggaatatttttccctgatatatgaaccattgaactgc

SEQ ID NO: 5956 - DNA, 1152 bp, Cenchrus ciliaris
tcttcaacctgcggaacctcttctacttgggcgcctaccaggcggccatcaacaacagcgacgtcccgggcctcgatgccgacgccgccgccgagcgcgacgccatcgtcttccgactcctacatcgccctcggctcctaccagctggtaatcaacgagatcgactcctccgccgcgacgtcgctgcaggccgtgaagctgctcgcgctgtacctcaccggcgacaaggaaggtgcaatctccagcctcaaagaatggttgagtgattcagcaattgggagcaatcctgttctgcgattgattgctggaattatatatatgcatgagcaggactacaatgaggctctcaagcacacgcactctggaggaaccttggatttgcatgcattgaatgtccagatcttcattaagatgcatcgttcagactatgctgagaagcaactgaagatcatgcaacaaattgacgaagaccatacactgacacaacttgcaaacgcatggttggacattgctgttggtggctctaagatccgggaagcttatctcatattccaagacttcgctgaaaagtacccaatgacagggatggttctgaatgggaaagcagtttgctgtatgcacatgggaagctttgaggaggctgagactctattgcttgaagcattgaacaaggatgcaaaagaccctgaaactcttgccaatcttattgtatgtaatctccaccttggtaaaccatcatcacgattcctcagccagctgaagctatctcatcctgatcatgtgctagttaagaacgcggtatcgtccgaagcaaacttcgagagggccctccaagctgttgcttgaacatgacaaaccccatccggattacagaaagcagcagcacattgatcctgttttccatttggtgtgtgttaacacagtggagtgtggtggttctgtttgtctaatttcctcgatagtaatggtaaagttacttggccaatcttgtacctgtaccggaacaacgatgtataaacgcatatgtagaatatcgatttgttacattttgtcgtcaacatcagcattttgttatgttcttccagattagcagaactgtcaacccttgtaggcgctgatatgagcaacttgcttgtgctgtctttctggacc

SEQ ID NO: 5957 - DNA, 1021 bp, Allium cepa
atggctacaccagatctactctttaatttgcgcaacaacttctacataggagcttaccaagcagccatcaacaacagcgacgtgagcaacctttccagtgacgagatcatcgaacgcgactccctcgtctacagatcttacattgctctcgggtcttatgagttggtgattagcgagatagattcttcggcgccgactgcgttgcaggctgtcaagctacttgcaatctatctttccggtgataaggaaggtgctaaatccagtctccaagagtggctaagtgatgctgcgatagcaagcaatcctgtcctccggttgattggagggattatatatatgcatgaacaagactacaatgaggctctcaagcacactaatgcaggtggatcaatggagctgcttgcattgaatgttcagatatttataaagatgcatagatcagattatgcagagaaacaactaaaaatcatgcaacaaactgatgaagaccatactttaactcaactagctaacgcatggctgaatctagcagtcggtggttcgaagattcaagaagcttatcttattttccaagattttgctgagaagtatcagatgactgggatgattctcaatgggcaggctgtttgctgtatgcacatgggacgctttgatgaagctgaatccttactatttgaagctttaaacaaggatggtaaggatgcagaaactcttgccaacttagttgtgtgtagtcttcatgttggaaaaccttcatcacgttacctcagccaactgaaactctcgcatcctgatcatttgctggtgaagcgtgcaactgctgcagaagagaacttcgacaaagctctccagtcagttgcttgagaaccgatatttttgaaatttgcatccaagtgtttgtaacttgactcttttcaaatttttacctctctttctgaattgtagggcatacttcagtaatcaaagtaacatgcgttctgtaatgtacggaaatttgtcatcttatagtatttttcaagca

SEQ ID NO: 5958 - DNA, 1596 bp, Eschscholzia californica
tctcagatctaaaaactactgaataatggcttctcccgatcatctcttcggccttcgaaacaacttctacttgggagcttaccaggccgccatcaacaacagcgaagttccaaatctgtcttcagaagacacaatcgaaagggattcactcgtttacagatcttatattgcccttggcagctaccagcttgtgatcaacgagatcgattcatcggcacctacgtctctccaagcagttaaattacttgccttgtatctttccggtaccgaaaataaggaaacaacaatttcgactctcaaagagtggttgggtgatgctaccattgcaaacaatcctgttttacggttgattgctggtatcgtattcatgcacgagcaagactacaacgaggctctgaaacatactaacgctggaggaacaatggaattgcatgcattgaatgttcaaatattccttaagatgtacaggtcagattatgctgagaaacagctaaagatcatgcaacaaattgacgaggatcacaccctcacccaactagcgaatgcatggctaaacttggcagtgggtggttccaagatacaggaagcatatcttatttttcaagatttctccgagaagtatcagatgacaggacttgtcctcaatggaaaggcagtctgctgcatgcacatgggccactttgatgaagccgagtcgttgctgctcgaagctctgaacaaggatgctaaggatgcagaaactctggccaatctcattgtatgcaatctacaccttggtaaaccgtcatctcgttacctcagtcaattgaagctgtcgcatcctgatcacatgctcgttaagcgtacagctgctgctgaagaaagcttcgatagagctcttcaaaccgttgcttgaatagcgatacaacctctgttattttaaagtgcatgagtccttagtagtctcttggtatgaaagctaggttttttcttcactctttttttttctcttcacaaacaatatccccctcccctacccccacccccacttctttctcctattttgtatcttggagtttccagccctgccatatgatggcttgaatataaaatttgagataattgggacaacatattggaattgttagaaaaagaagtttgttttttaatttgtgattgtacaagacttcatgattaaattttataagtctcttgatttactctgatttcaatttatagaatttttttttcctaatttcgattctcaagttttaattgcaacagaaagtaaataaattcttaagctttccgcgttgcagtccaaggtgaagggtgtttggcaacacaccaatgtggctgcataagtttgtatcaacaccaagaagaccgcctactgtgtttgttgatgtgttgactaaaacctaatatttttatgggggtaatcttaatatagctaaataagtggggggcatttactaaatccctcgtaatacagttctaccggcatcgtcgctcaccatgaagtgcagttagtctctctctctctctctctctctctctctctactactacgtacgtcggtaggacgacggacgacgagacggagaggagcccccc

SEQ ID NO: 5959 - DNA, 1010 bp, Allium cepa
catatttttgccaaaattttgctcttttcttctagcttcattctctttgggaaatagacgccatggctacaccagatctgctatttaatctgcgcaacaacttctacataggtgcttaccaagcagccatcaacaacagcgacgttagcaacctttccagtgatgagataatcgaacgcgactccctcgtctacagatcttacattgctctcgggtcttatgagttggtgatcagcgagatagattcttcggcaccgaccgcgttgcaggctgtcaagctactcgcaatctatctttccggtgataaggaaggtgctaaatccagtctccaagagtggctaagtgatgctgcaatagcaaacaatcccgtcctccggttgattggaggaattatatacatgcacgaacaagactacaatgaggctctaaagcacactaatgcaggcggaacaatggagctgcttgcgttgaatgttcagatatttatcaagatgcatagatcagattatgcagagaaacaactaaaaatcatgcaacaaactgatgaagaccatactttaactcaactagctagcgcgtggctgaatctagcagtcggtggttcgaagattcaagaagcttaccttattttccaagattttgctgagaagtatcagatgactgggatgattctcaatgggcaggctgtttgctgtatgcacatgggacgctttgatgaagctgaatccttactatttgaagctttaaacaaggatggtaaggatgcagaaactcttgccaacttagttgtgtgtagtcttcatgttggaaaaccttcatcacgttacctcagccaactgaaactctcgcatcctgatcatttgctggtgaagcgtgcaactgctgcagaagagaacttcgacaaagctctccagtcagttgcttgagaaccgatatttttgaaatttgcatccaagtgtttgtaacttgactcttttcaaatttttacctctctttctgaattgtagggc

SEQ ID NO: 5960 - DNA, 1740 bp, Hordeum vulgare
tgagcccagagcagagcagcggacgccggccacaccacgctcacgccaccatcataacgccactcccacgctccactcagacttccgtcgcgttccatttcaaatacgccacctttcgccccctgcatttccaccaaagcctacatgtctcagaccaccaccgcgtcccccgcgcccgcgccggcgccggcaaccgacgcgccgccgaagccttcggcaggcgcgaagcgcagcctgatggggtccctcatcgacgccacagcgctgctccgggcggcctccttcaaggaggactcgtacgtggcggcggcgctcccgtcctcggacctccgcgcgctcgccgacctcagggcgctcctggccacccacccggaccaaatctccatctggggcgtgccgctcaacccgcccagcgactcccccgccgacgagcgcaccgacgtcgtgctcctcaagttcctccgcgccagggacttccgcgtccgcgacgcgcacgccatgctgctccgctgcgccgcctggcgggccgagttccgcgccgacgccgtgctggacgaggaccttgggttcaaggacctcgagggcatcgtcgcctacatgcacggctgggaccgcgaaggccaccccgtctgctacaacgcctacggcgtcttcaaggaccgggacatgtacgaccgggtgttcggcgacggcgaccgcctctcccggttcctccggtggcgcgtccagatcatggagcgcggcgtgcgcgcgctccagctccgccccggcggcgtcaacgccatcatacaggtcaccgacctcaaggacatgccgaagcgagagctccgcgccgcgtccaaccagatactctccctcttccaggacaactaccccgagatggtcgcccgcaaggtgttcgtgaacgtgccgtggtacttctccgtgctgttctccatgatctcgcccttcctcacggagcgcaccaagagcaagttcgtcatcgcgcgcgagggcaacgtcgcggagacgctcttcaagttcatccggccggagctggtgccggtgcagtacggcgggctgagccgcgccagcgagctggagaacgggccgcccaagccggcgtccgagttcaccatcaagggcggcgagaaggtcttcctagagatcgacggcatcgaggccggtgcgacaataacgtgggacctggtcgtcggcggctgggagctcgagtacggcgcggagtacgtgccggcggcggagggcgggtacacgctgtgcgtggagaggacaaggaaggtcccggccgccgccgacgagcccgtgcacaacaccttcacggccaaggagcccggcaagatggtgctctccatcgacaactccggctcacggaagcggaaggtcgccgcctaccgctacttcgtgcgcaagccgtcggcgtaggctagccgctagcctggcctgctgctcggctagtgctttgctttgcttggcgtcgctggtgtcggagaggaggttaatttaggtctacttaattggtgttataatatgagatgcatgtattatgccatgtgtagaatataatgtatgagccgtgagatcctactacttgtcttcatcgttataaaagctaatgtgttagtaagttttttgagggcaactccaatattcgtatgatcatcattggtaaaattgttacgtagatgttacgtagatgattttgatgacatgtcacatcataaaaagaagaaagagaatgaa

SEQ ID NO: 5961 - DNA, 1650 bp, Oryza sativa
gagcaagcgcgcccccgccacgcctccatcataacaccaccgccacgctcgccacgcctcccatccgctccactccatttcaaattctcgccacctcccccccgcatttcgacgaacaccttcgccgcccagcatgtctccgaccgccaccccatcccccgcgcccgccgaggtggcggcagcgcccaagccgccgccgtcggggacgggggcgaagcgcagcctgatgtcgtcgctgatggaggccaccgcgctgctcaggtcgtcgtcgttcaaggaggactcgtacgtggcgtccgcgctcccggcgtccgacctccgcgcgctcgccgacctcagggcgctgctgtccacgcacccggacccaatctccatctggggcgtgccgctcaacccggcgccgccccagggcggggagggggccccggccccggccgccgccgccgacgagcgcgccgacgtcgtgctgctcaagttcctccgcgcgcgggacttccgcgtccgcgacgcgcacgccatgctgctccgctgcgccgcgtggcgggccgagttccgcgccgacgccgtgctggacgaggacctcgggttcaaggacctggagggggtcgtcgcctacatgcacggctgggaccgggagggccacccggtctgctacaacgcctacggcgtcttcaaggacagggacatgtacgaccgcgtcttcggcgacggcgagcgcctcgcccgcttcctccgctggcgcgtccaggtcatggagcgcggcgtccgcgcgctccacctccgccccggcggcgtcaacgccatcatccaggtcaccgacctcaaggacatgcccaagcgcgagctccgcgccgcgtccaaccagatcctctccctcttccaggacaactaccctgagatggtcgcgcgcaaggtgttcatcaacgtgccctggtacttctcggtgctgttctccatgatctcgccgttcctcacggagcgcaccaagagcaagttcgtcatcgcgcgcgagggcaacgtcgccgagacgctcttcaagttcatccggccggagctggtgccggtgcagtacggcgggctgagccgcgccggcgacctggagaacggcccgccgaagccggcgtccgagttcaccatcaagggcggcgagaaggtcttcctagagatcgacggcatcgaggccggcgcgacgataacgtgggacctggtggtgggcgggtgggagctggagtacggcgcggagtacgtgccggcggcggaggacagctacacgctgtgcgtggagcggacgaggaaggtgccggccgccgccgacgagccggtgcacaacgccttcacggcgagggaggccggcaagatggtgctctccatcgacaactccggctcccggaagcggaaggtcgccgcctaccggtacttcgtgcgcaagccgtcggcgtagaaggcggcggcggcggcggccagtggagtgctttgcatcgttgcttggctttgaagagggagaggtttaatttaatttaggggctacttaattagtgctataacgacgtgcatgtattaatgccatatgtagaatataaattgtaagagctgtcacaacgaacttatcatcatccttataaagcttcgagttcactgttttttttggct

SEQ ID NO: 5962 - DNA, 1835 bp, Triticum aestivum
gaaggcatcactcagccacagcacttgcatcatcatcagcgtacctgcccggtcaggttcgatcccaatggagcttcctcagctagcgtccttcctcggcgtggtgctcgccacggtgctcttcctcaaggccgtcctccgccgccgccgccagtacaacctcccgccgggccccaagccgtggccgatcatcggcaacctcaacctcatcggcacgctcccgcaccgctccatccacgcgctgtccaagaagtacggcccgctcatgcaactccagttcgggtccttccccgtcgttgtcggctcctccgtggagatggccaagttcttcctcaagacccacgacgtggtgttcaccgaccgccccaagaccgccgccggcaggtacaccacctacaactacagcgacatcacctggtccccctacggcgcctactggcgccaggcccgcaagatgtgcctcaccgagctcttcagcgccaagcgcctcgagtcgtacgagtacatccgcagggaggaggtgctcgccctcctcggcgacctgtaccgcggcggcgccggtgccggccgcgtggtggtgctcaaggactacctgtccacggtgagcctgaacgtgatcacgcgcatggtgatgggcaagaagtacctggagaaggaggtgagggacgaggcaggggcggtgatcacgacgcctgaggagttcaagtggatgatcgacgagctgttcctgctcaacggcgtgctcaacatcggcgactccatcccgtggctggactggatggacctgcaggggtacatcaagaggatgaagaagctgagcaagatgttcgaccggttcctggagcacgtcgtggacgagcacagcgagcggcgtcggcgcgagggggagagcttcgtggtgaaggacatggtggacgtgctgctgcagttcgccagcgatcccggtcttgaggtcaagctcaacagagaaggcgtcaaggctttcactcaggacctcattgccggcggcacggagagctccgcggtgacagtggaatgggccctctcagagctcctgaagaagccagaggtgctcgccaaagccacagaggagttggaccgtgtggtggggcgaggccgatgggtcaccgaaaaggacatgtcgagccttccctatgtggatgccatcgtcaaagagaccatgcggttgcacccggtagcgccgatgcttgtaccccgcctttcacgtgaggacacgtccatcaacggctacgacatccccgccggcacacgggtgctagtcatggtgtggtctattggccgtgacccggagttgtgggaagcgccggaggagttcatgccagaacgcttcctcggcagcaggctcgacgtcaaggggcaggattatgagctgcttccattcgggtcgggacgcaggatgtgcccggggtatagtcttgggctgaaggtgatccaagtaagtctggcgaacctcctgcacgggttcacgtggaggctccctgatggcgtggagctgagcatggaggagatctttggactgtcaacaccacgcaagtacccactggaggccgtcgtggagcccaagctcccggctcacctctacgccgaggcttgaatatttgatattgtgccctcgtgtgttgagtaattattactacttgtgttgttttttttttgttttttttctagtattatatatttgatacatgtgtgccctcgtgtgttgagtaattattattacttgtgttgttatattatgcatcgtagatctgtaaagaaaagtgtaaaagatggtcgacaattgctaatttagcaagtgaaataatggaaatttt

SEQ ID NO: 5963 - DNA, 1761 bp, Secale cereale
agacaccactcagccacagccacctgcatcgagctcatcacccggcccgcggcccgcctcgatcccaatggagcttcctcagtgggcgaccttcctcggcgtcgtgctcgccacggtgctcttcttcaaggctgtcctccgccgccgccgccagtacaacctcccgccgggccccaagccttggccgatcatcggcaacctcaacctcatcggcacgctcccacaccgctccatccacgcgctctccaagaagtacggcccgctcatgcaactccagttcggctccttccccgtcgtcgtcggctcctccgtcgagatggccaagttcttcctcaagacccacgacgtggtcttcaccgaccgccccaagaccgccgccggcaggtacaccacctacaactacagcgacatcacctggtccccctacggcgcctactggcgccaggcccgcaagatgtgcctcaccgagcttttcagcgccaagcggctcgagtcgtacgagtacatccgcagggaggaggtgctcgccctcctcggcgacctgtatcgcggcggcgccggtgccggccgcgtggtggtgctcaaggactacctgtccacggtgagcctgaacgtgatcacgcgcatggtgatgggcaagaagtacctggagaaggaggtgagggacgaggccggggcggtgatcacgacgcccgaggagttcaagtggatgatcgacgagctgttcctgctcaacggcgtgctcaacatcggcgactccatcccgtggctggactggatggatttgcaggggtacatcaagaggatgaagaagctgagcaagatgttcgacaggttcctggagcacgtcgtggacgagcacagcgagcgccgtggccgcgagggggagagcttcgtggtgaaggacatggtggacgtgctcctgcagttcgccagcgatcccggtcttgaggtcaagctcaacagagagggcgtcaaggctttcactcaggacctcattgccggcggcacggagagctcggctgtgacggtggaatgggccctctcagagctcttgaagaagccagaggtgctcgccaaagccacagaggagctggatcgtgtggtggggcgaggccgatgggtcaccgaaaaggacatgacgagccttccatatgtggatgccatcgtcaaagagaccatgcggttgcacccagtagcgcccatgcttgtaccccgcctttcccgtgaggacacgtccatcaacggctacgacatccccgccgggacacgggtgctagtcatggtgtggtctattggccgcgacccggagttgtgggaagctccagaggagttcatgccagagcggttcctcggcagcaggctcgatgtcaaggggcaggattatgagctgcttccattcgggtcgggtcgcagaatgtgccccgggtatagtcttgggttgaaggtgatccaggtaagcctggcgaacctcctgcatgggttcacgtggaggctccctgatggcgtggagttgagtatggaggagatcttcggactatccacgccacgcaagttcccgctggaggctgttctggagcccaagctcccagctcacctctacgccgaggcttgaatatttgatacatgtgtgccctcgcgtgttgagtaattattattacttgtatttttgcattttctgtattttttctagtattttatatattatgtatagtggactcaagtgaaataatgagatttataaaggaaagtgtagaaggt

SEQ ID NO: 5964 - DNA, 1908 bp, Triticum aestivum
gccagctcaagcttgaagacttcacttagccacagccacctgcatcgatctgatcacccggccggcggctcgcctcgatccaatggagcttcctcagctggcgtccttcctcggcgtggtgctcgccacggtgctcttcttcaaggctgtcctgcgccgccgccgccagtacaacctcccgccgggccccaagccttggccgatcatcggcaacctcaacctcatcggcacgctcccgcaccgctccatccacgcgctctccaagaagtacggcccgctcatgcaactccagttcggctccttcccggtcgtcgtcggctcctccgtggagatggccaagttcttcctcaagacccacgacgtggtgttcaccgaccgccccaagaccgccgccggcaggtacaccacctacaactacagcgacatcacctggtccccctacggcgcctactggcgccaggcccgcaagatgtgcctcaccgagctcttcagcgccaagcgcctcgagtcgtacgagtacatccgcagggaggaggtgctcgccctcctcggcgacctgtatcgcggcggcgccggtgccggccgcgtggtggtgctcaaggactacctgtccacggtgagcctgaacgtgatcacgcgcatggtgatgggcaagaagtacctggagaaggaggtgagggacgaggcaggggcggtgatcacgacgcccgaggagttcaagtggatgatcgacgagctgttcctgctcaacggcgtgctcaacatcggcgactccatcccgtggctggactggatggacctgcaggggtacatcaagaggatgaagaagctgagcaagatgttcgaccggttcctggagcacgtggtggacgagcacagcgagaggcgtgggcgcgagggggagagcttcgtggtgaaggacatggtggacgtgctgctgcagttcgccagcgatcccggtcttgaggtcaagctcaacagagagggcgtcaaggctttcactcaggacctcattgccggcggtacggagagctccgcggtgacagtggaatgggccctctcagagctcctgaagaagccagaggtgctcgccaaagccaccgaggagttggaccgtgtggtggggcgaggccgatgggtcaccgaaaaggacatgctgaaccttccttatgtggatgccattgtcaaagagacaatgcgcttgcacccggtagcgccgatgcttgtaccccgcctttcacgcgaggacacgtccatcaacggctacgacatccccgccggcacacgggtgctagtcatggtgtggtctattggccgcgacccagagttgtggaaagcgccggaggagttcatgccagaacgcttcctcggtagcaggctcgacgtcaaggggcaggattatgagctgcttccattcgggtcaggacgcaggatgtgccccgggtatagtttgggactaaaggtgatccaggtaagcctggcaaacctgctgcatgggttcacatggagactccctgacggtgtagagctgagcatggaggagatcttcggcttgtccacaccacgtaagttcccgctggaggccgttgtggagcccaagctaccagctcacctctatgccgaggcttgaatatatgatacatgtgtgcactcgtgtgttgagtacttattattacttgtgttgttgtattttttttataacttttttctagtattgtatcgtctgcggtacagactcaagtgatggggatgtgtaaggaagggtgtaaaaaatgtatggtaattgctaatacaataagtgaaataatgtgaattcccctctttaaagacgtctatcaaagcatcgcctcatttgaagttttgttaatgctgctaggttgttgatcatttcaggtgtgtccacctggg

SEQ ID NO: 5965 - DNA, 1714 bp, Secale cereale
gcctcctgcatcgagctgaccacccggcccacggccagcttcgatcccaatggagcttcctcagttggcttccttcctcggcgtcgtgctcgccacggtgctcttcttcaaggctgtcctccgccgccgccgccagtacaacctcccgccgggccccaagccttggccgatcatcggcaacctcaacctcatcggcacgctcccgcaccgctccatccacgcactctccaagcagtacggcccgctcatgcaactccagttcggctccttccccgtcgtcgtcggctcctccgtcgagatggccaagttcttcctcaagacccacgacgtggtcttcaccgaccgccccaagaccgccgccggcaggtacaccacctacaactacagcgacatcacctggtccccctacggcgcctactggcgccaggcccgcaagatgtgcctcaccgagctcttcagcgccaagcggctcgagtcgtacgagtacatccgcagggaggaggtgctcgccctcctcggcgacctgtatcgcggcggcgccggtgccggccgcgtggtggtgctcaaggactacctgtccacggtgagcctgaacgtgatcacgcgcatggtgatgggcaagaagtacctggagaaggaggtgagggacgaggccggggcggtgatcacgacgcccgaggagttcaagtggatgatcgacgagctgttcctgctcaacggcgttctcaacatcggcgactccatcccgtggctggactggatggatttgcaggggtacatcaagaggatgaagaagctgagcaagatgttcgacaggttcctggagcacgtcgtggacgagcacagcgagcgccgtggccgcgagggggagagcttcgtggtcaaggacatggtggacgtgctgctgcagttcgccagcgaccccggtcttgaggtcaagctcaacagagagggcgtcaaggcgttcactcaggacctcattgccggcggcacggagagctcggctgtgacggtggaatgggccctctcggagctcttgaagaagccagaggtgctcgccaaagccacagaggagctggatcgcgtggtggggcgaggtcgatgggtcaccgaaaaggacatgccgagccttccatatgtggatgccatcgtcaaagagaccatgcggttgcacccagtagcgccgatgcttgtaccccgcctttcccgtgaggacacgtccatcaacggctacgacatccccgccgggacacgggtgctagtcatggtgtggtctattggccgcgacccggagttgtgggaagctccggaggagttcatgccagagcggttcctcgacagcaagctcgatgtcaaggggcaggattatgagctgcttccattcgggtcgggacgcaggatgtgccccgggtatagtcttgggttgaaggtgatccaggtaagcctggcgaacctcctgcacgggttcacgtggaggctccctgatggcgtggagctgaacatggaggagatcttcggactgtccacgccacgcaagttcccgcttgaggctgtcctggagcccaagctcccagctcacctctacgccgaggcttgaatatttgatacatgtgtgccctcgcttgttgagtaattattattacttgtattgttgcattttctgtattttttctagtattttatatattatgtatagtggactcaagtgaaataa

SEQ ID NO: 5966 - DNA, 1734 bp, Secale cereale
gactgcttgaaggcatcacacagccacagccacctgcatcgagctcatcacccggcccgcggcccgcctcgattccaatggagcttcctcagttggcgtccttcctcggcgtcgtgctcgccacggtgctcttcttcaaggctgtcctccgccgccgccgccagtacaacctcccaccgggccccaagccttggccgatcattggcaacctcaacctcatcggcacgctcccgcaccgctccatccacgcgctctccaagcagtacggcccgctcatgcaactccagttcggctccttccccgtcgtcgtcggctcctccgttgagatggccaagttcttcctcaagacccacgacgtggtcttcaccgaccgccccaagaccgccgccggcaggtataccacctacaactacagcgacatcacctggtccccctacggcgcctattggcgccaggcccgcaagatgtgcctcaccgagctcttcagcgccaagcggctcgagtcgtacgagtacatccgcagggaggaggtgctcgccctcctcggcgacctgtatcgcggtggcgccggtgccggccgcgtggtggtgctcaaggactacctgtccacggtgagcctgaacgtgatcacgcgcatggtgatgggcaagaagtacctggagaaggaggtgagggacgaggctggggcggtgatcacgacgcccgaggagttcaagtggatgatcgacgagctgttcctgctcaacggcgtgctcaacatcggcgactccatcccgtggctggactggatggacctgcaggggtacatcaagaggatgaagaagctgagcaagatgttcgaccggttcctggagcacgtcgtggacgagcacaccgagcgccgtggccgcgagggggagagcttcgtggtcaaggacatggtcgacgtgctgctgcagttcgccagcgaccccggtctcgaggtcaagctcaacagagagggcgtcaaggctttcactcaggacctcattgccggtggcacggagagctcggctgtgacggtggaatgggccctctcagagctcttgaagaagccacaggtgctcgccaaagccacagaggagctggatcgcgtggtggggcgaggtcgatgggtcaccgaaaaggacatgccgagccttccatatgtggatgccatcgtcaaagagaccatgcggttgcacccagtagcgccgatgcttgtaccccgcctttcccgtgaggacacgaccatcaacggctacgacatccccgccggcacacgggtgctagtcatggtgtggtctattggccgcgacccggagttgtgggaagctccagaggagttcatgccagagcggttcctcggcagcaggctcgatgtcaaggggcaggattatgagctgcttccattcgggtcgggacgcaggatgtgccccgggtatagtcttggattgaaggtgatccaggtaagcctggcgaacctcctgcatgggttcacgtggaggctccctgatagcgtggagctgagcatggaggagatcttcggattgtccacgccacgcaagttcccactggaggctgtcgtggagccaaagctcccagctcatctctacacctaggcttgaatatttgatacatgtgtgccctcgtgtgttgagtaattattactatttgtgttgttatattttctgtattattttctagtgttatatattatgtatagtagagtcaagt

SEQ ID NO: 5967 - DNA, 1746 bp, Secale cereale
cttgaagacaccactcagccacagcctcctgcatcgagctgaccacccggcccgcggcccgcctcgatcccaatggagcttcctcagtgggcgaccttcctcggcgtcgtgctcgccacggtgctcttcttcaaggctgtcctccgccgccgccgccagtacaacctcccgccgggccccaagccttggccgatcatcggcaacctcaacctcatcggcacgctcccgcaccgctccatccacgcgctctccaagaagtacggcccgctcatgcaactccagttcggctccttccccgtcgtcgtcggctcctccgtcgagatggccaagttcttcctcaagacccacgacgtggtgttcaccgaccgccccaagaccgccgccggcaggtacaccacctacaactacagcgacatcacctggtccccctacggcgcctactggcgccaggcccgcaagatgtgcctcaccgagctcttcagcgccaagcggctcgagtcgtacgagtacatccgcagggaggaggtgctcgccctcctcggcgacctgtatcgcggcggcgccggtgccggccgcgtggtggtgctcaaggactacctgtccacggtgagcctgaacgtgatcacgcgcatggtgatgggcaagaagtacctggagaaggaggtgagggacgatgccggggcggtgatcacgacgcccgaggagttcaagtggatgatcgacgagctgttcctgctcaacggcgtgctcaacatcggcgactccatcccgtggctggactggatggacctgcaggggtacatcaagaggatgaagaagctgagcaagatgttcgaccggttcctggagcacgtcgtggacgagcacaccgagcgccgtcgcggcgaggggaagagcttcgtggtcaaggacatggtggatgtgctgctgcagttcgccagcgaccccggtctcgaggtcaagctcaacagagagggcgtcaaggctttcactcaggacctcattgctggcggcacggagagctcggcggtgacagtggaatgggccctctcagagctcctgaagaagccagaggtgcttgccaaagccacagaggagttggaccgtgtggtggggcgaggccgatgggtcaccgaaaaggacatgtcgagccttccctatgtggatgccatcgtcaaagagaccatgcggttgcacccggtagcgccgatgcttgtaccccgcctttcacgtgaggacacgtccatcaatggctacgacatccctgccggcacacgggtgctagtcatggtgtggtctattggtcgcgacccggagttgtgggaagctccggaggagttcatgccagagcggttcctcggcagcaggctcgatgtcaaagggcaggattatgagctacttccattcgggtcgggacgcaggatgtgtcccggctatagtcttgggttgaaagtgatccaggtaagcctggcgaacctcctgcatgggttcacgtggaggctccctgatggcgtggagctgagcatggaggagatcttcggattgtccacgccacgcaagttcccgctggaggttgtcctagagcccaagctcccagctcacctctacgccgaggcttgaatatttgatacatgtgtgccctcgtgtcttgagtaattattactacttgtgttgttgtattttctgtattttttctagtattatatattatgtatagtagagtcaagtgaaataatgagatttata

SEQ ID NO: 5968 - DNA, 1833 bp, Avena sativa
ccagccacagctcacaagacatcactcagccacacccacttgcatcaatcacctgctcggcgagccagccgaatcttcgattccaaaatccaatggagcttcctcagttggcgtccttcctggccgtcgtgcttgccacggcgctcttcctcaaggccgtcatccgccaccgcagcagccgcaagtacaacctcccgccgggtcccaaggcttggccgatcatcggcaacctgaacctcatcggcacgctcccgcaccgctccatccacgcgctggccaagcagtacggcccgctcgtgcagctccagttcggctccttccccgtcgtcgtcggctcctccgtcgagatggccgagttcttcctcaagacacacgacgttgtcttcaccgacaggcccaagaccgccgccggcaagcacaccacctacaactactgcgacatcacctggtccccctacggcgcctactggcggcaggcccgcaagatgtgcctcaccgagctcttcagcgccaagcgtctcgagtcgtacgagtacatccgcagggaggaggtgctctccctcctccgcgacctgaatcgtggcgccgccgccgcaggcggacgccctctggtgctcaaggactacctttccacggtgagcctgaacgtgatcacgcgcatggtgatgggcaagaaatacctggagaaggaggtgagggacgagagcggcgcggtgatcacgacgccggacgagttcaagtggatgatcgacgagctgttcctgctcaacggcgtgctaaacatcggcgactccatcccgtggctcgactggctggacctgcaggggtacattaagaggatgaagaagctgagcaagatgttcgatcggttcctggagcacgtggtggacgagcacagcgaacggcgccgcctcgacggggagagcttcgtggccaaggacatggtcgacgtgctgctgcagttcgccagcaaccccgatctcgaggtcaagctcaacagggagggcgtcaaggctttcactcaggatctcattgccgggggcacggaaagctcggccgtgacagtggagtgggccctctcggagttgctgaagaagcccgaggtgttagcgaaggcgacggaggagctggaccgcgtcgtcggacgaggccgctgggtaaccgagaaggacatgccgagcctcccctacgttgacgccatcgtgaaggaaacaatgcgactgcaccctgtggcgccgatgctggtgccccgactgtcccgcgaggacacatccattggcggctacgacatccccgctggaacgcgggtgctcgtcagcgtatggaccatcggccgcgacccggagctctgggaggcgccggaggagtttatgccagaacggttcctcggcagtaagctcgacgttaaagggcaggactacgagctgctgccgttcgggtcaggacgcaggatgtgcccagggtacagcctggggcttaaggtgatccaggttagcctggcgaatctactgcacgggtttgagtggaggctctccgatggtgtggagctgagcatggaggagatcttcgggctgtccacgccgcgcaagttcccgctagaggccgtagtggagcccaaactaccggctcacctatacgtcgaggcttgatgcatacacacaccaacaaataatcgaccaatattgcgttgagtgatcaataatgttattactagttgtgttgctataatttcctgtattttttatctcctagtagtggctactgcttaaagttttctagaggaaattgtaactctataataaatagttcaaaataagctccccaacttctccc

SEQ ID NO: 5969 - DNA, 1720 bp, Avena sativa
agcttcctgagtgggcgtccttcctgggcatcgtggtcgccacagtgctcttcctcaaggccgtcctccgccaccgcagcagccgccagtacaacctcccgccgggtcccaaggcatggccgatcataggcaacctgaacctcatcggcacactcccgcaccgctccatccacgcgctcgccaagcagtacggcccgctcgtgcagctccagttcggctccttccccgtcgtcgtcggctcctccgtcgagatggccaagttcttcctcaagacccacgacgttgtcttcaccgaccggcccaagaccgccgccggcaagcacaccacctacaactactgcgacatcacctggtccccctacggcgcctactggcggcaggcccgcaagatgtgcctcaccgagctcttcagcgccaaacggctcgagtcgtacgagtacatccgcagggaggaggtgctcgccctcctccgcgacctgaatcgcggcgccgccgccgcaggcggacgccctctggtgctcaaggactacctttccacggtgagcctgaacgtgatcacgcgcatggtgatgggcaagaaatacctggagaaggaggtgagggacgagagcggcgcggtgatcacgacgccagacgagttcaagtggatgatcgacgagctgttcctgctcaacggcgtgctaaacatcggcgactccatcccgtggctcgactggctggacctgcaggggtacattaagaggatgaagaagctgagcaagatgttcgaccggttcttggagcacgtggtggatgagcacagcgagcggcgccacctcgacggggagagcttcgtggccaaggacatggtcgacgtgctgctgcagttcgccagcaaccccgatctcgaggtcaagctcaacagggagggcgtcaaggctttcactcaggatctcattgccgggggcacggaaagctcggccgtgacagtggagtgggccctctcggagttgctgaagaagcccgaggtgtttgcgaaggcgacggaggagctggaccgcgtcgtcggccgagaccgctgggtcaccgagaaggacatgcccagcctcccctacgtggacgccatcgtgaaggaaacaatgcgactccaccctgtagcaccgatgctggtgccccgcctctcccgcgaggacacgtccatcggcggctatgacatccctgccggaacacgggtgcttgtcagcgtgtggaccatcggccgcgacccggagctgtgggactcgccggaggagttcatgccagagcggttcctcggcagtaagctcgatgtcaaggggcaggactacgagctgctgccgttcgggtcgggacgtaggatgtgtcccgggtacagcctggggcttaaggtgatccaggttagcctggcgaatctgctgcacgggttcgagtggagtctccccgatggtgtggagctgagcatggaggagatcttcgggctgtccacgccgcgcaagttcccgttggaggccgtagtggagcccaagctaccggctcacctatacgtcgaggcttgatgcatacacataccaacaaataatcgattagtcttgcgttgagtgatcaataatgttattactagttgtgttgctataattttctgtacttttatttatctcctagtagcggctgctgcttaaagttttatagaagttcaaaataaacactccaacttctcccagcg

SEQ ID NO: 5970 - DNA, 1807 bp, Avena sativa
gcattacttagccatacccacttactacatagtatcacctgctcggcaagccagccgaatcttcgatcccattaatggagcttcctcagtgggcgtccttcgtgggcatcgtggttgccacggtgctcttcctcaaggtcgtcctcggccgccggagccgcaagtacaacctcccgccgggtcccaaggcgtggccgatcatcggcaacctgaacctcatcggcacgctcccgcaccgctccatccacgcgctcgccaagcagtacggcccgctcgtgcagctccagttcggctccttccccgtcgtcgtcggctcctccgtcgagatggccaagttcttcctcaagacccacgacgttgtcttcaccgaccggcccaagaccgccgccggcaagcacaccacctacaactactgcgacatcacctggtccccctacggcgcctactggcggcaggcccgcaagatgtgcctcaccgagctcttcagcgccaagcggctcgagtcgtacgagtacatccgcagggaggaggtcctcgccctcctccgcgacctgcatcgcggcgcggccactgccggcgccggccgcgccctcgtgctcaaagactacctgtccacggtgagcttaaacgtgatcacgcgcatggtgatgggaaagaagtatctggagaaggaggtgagggacgagaccggagcggtgatcacgacgccagacgagttcaagtggatgatcgacgagcttttcctcctcaacggcgtgctaaacatcggcgactccatcccgtggctcgactggttggacctgcaggggtacattaagaggatgaagaagctgagcaagatgttcgaccggttcctggagcacgtcgtggaagagcacagcgagcggcgccgctgcaacggggagagcttcgtggccaaggacatggtcgacgtgctgctgcagttcgccagtgatcccaatctagaggtcaagctcaacagggagggcgtcaaggctttcactcaggatctcattgctgggggcacagaaagctcggcggtgacggtggaatgggctctctcggagctgctgaagaagcctgaggtgttcgccaaggcgaccgaagagctggacagcgtaatcggccgaggccgctgggtcacggagaaggatatcccgagcctcccatacatagaggccatcgtcaaggagactatgaggctgcacccggtggcgccgatgctggtgccccgtctctcccgcgaggacacatccatcggcggctacgacatccccgccggcacacgcgtgctggtcagcgtgtggtccatcggccgcgacccggagctgtgggatgcgccagaagagtttatgccagagcggtttctgagcagcaggcttgatgttaagggacaggattacgagctgctgccgttcgggtcgggacgcaggatgtgccctgggtatagtctgggactgaaggtgatccaggtgagcctggccaacctgctgcacggcttcacgtggaggctgcctaacggcgtggagctgagcatggaggagatctttggattgtccacgccgcgcaagttcccgctggaggccatcgtggagcccaagctcccggctcacctctatgccgagacttgatacgtaaacatacgatcgatctgtgttgagtcattattactgcttgtggtgctatattttcgtgtcttttttgtcttttcttgtgtggtttgttgcttacagtaagtgatataatggggatttgtaaagataagtgtaagtcgataagatactttgtaatcaatactaattcatca

SEQ ID NO: 5971 - DNA, 1551 bp, Festuca arundinacea
atggagtttcctcagtgggcgtccttcctgggtgtcgtgctcgccacggtgctctttctcaaggccgtcctccggcgccgaagcggccgaaagtacaacctcccgccgggtcccaaggcgtggccgatcatcggcaacctgaacctcatgggcacgctcccacatcgctccatccacgcgctctccaagcagtacggcccgctcttgcagctccagttcggctccttcccctgcgtcgtcggctcctccgtcgagatggccaagttcttccttaagacccacgacgtgtcgttcaccgaccggcccaagttcgcctccggcaagcacaccacctacaactacagcgatatcacctggtccccctacggcgcctactggcggcaggcccgcaagatgtgcctcaccgagctcttcagcgccaggcggctccggtcgtacgagtacatccgcagcgaggaggtgctggccctcgtccgcgacctgcatcgcggcgccaccgccggcgccggtcgcgccctggtgctcaaggactacctgtccacagtgagcctgaacgtgatcacgcgcatggtgatgggcaagaagtacctggagaaggaggtgagggacgagagcggcgcggtgatcacgacgccggacgagttcaagtggatgatcgacgagctattccttctcaacggcgtgctcaacatcggcgactccatcccgtggctcgactggatggacctgcaggggtacattaagaggatgaagaaactgagcaagatgttcgaccggttcctggagcacgtcgtggaagagcacagcgagcggcgccgccgcgacggggaaagcttcgtggcgaaggacatggtcgacgtgctgctgcagttcgccagcaaccccaacctcgaggtcaagctcaacagggagggcgtcaaggctttcactcaggatctcatcgctgggggcacagaaagctcggcagtgacagtggagtgggccctctcggagctcctgaagaagcccgaggtgttcgccagggcgacggaagagctggaccgcgtcgtcggcagaggccgctggatcaccgagaaggacatgccgagcctcccctacgtggacgccatcgtgaaggagacgatgcggctgcacccggtggcgccgatgctggtgccccgcctctcccgcgaggacacgaccatcggcggctacgacatccccgccggcacgcgggtgctcgtcagcgtgtggtccatcggccgcgacccggagctatgggaagcgccggaggagttcatgccagagcggttcatcggcagcaggctcgatgttaaggggcaggactacgagctgctgccgttcgggtcggggcgcaggatgtgccccgggtacagcctggggctgaaggtgatccaggtgagcctggcgaacctactgcacgggttcgagtggaagctccccgacggcgtggagctgaacatggaagagatcttcgggctgtccacgccgcgcaagttcccactggaggccgtcgtagagcccaagctcccggctcatctctacgaatga

SEQ ID NO: 5972 - DNA, 1990 bp, Oryza sativa
ccgtcctttcccaccatatgacacctcaacttcctccacacgctcgcgcgctctactaccgccatggtaacacctccgagctcgtcgtcttctataagtagctagctcgagctctggttgtccaccaccggccaagcagctcagcctataacatagtaactgaattgcagccaatccacgtactaccgaccggttaccgatggagctgatgctgccgccatgggcgtccttcgtcggcgtagtgctcgccaccgtgctgttcctgaaagcggtgctcggccgtagccgccgcgtgtacaacctcccgccggggccgaagccgtggccggtcatcggcaacctcaacctggtgggcacgctcccgcaccgctccatccacaacctctccaagaagtacggtcccctgatgtacctcaggttcgggtcgttccccgtcgtcgtcggctcgtcggtggagatggccaagttcttcctcaagacccacgacgtggtgttcaccgaccggcccaagaccgccgccggcaagcacaccacctacaactacagcgacatcacgtggtcgccctacggcgcgtactggcgccaggcgcgcaagatgtgcctcaccgagctcttcagcgccaagcggctggagtcgtacgagtacatccgtggcgaggaggtgcgcgcgctgctgcgcgacctgcacggcgcggccggcggcgtcgtggtgctcaaggactacctgtcgacggtgagcctgaacgtgatcacgcgcatggtgctgggcaagaagtacctggacaaggatgcgggggggtcggtgacgacgccggaggagttcaagtggatgctcgacgagctgttcctgctcaacggcgtgctcaacatcggcgactccatcccgtggctcgactggctggacctgcaggggtacatcaagaggatgaagaagctcggcaagatgttcgaccggttcctggaacacgtcgtggacgagcacaacgagcgccgccgccgcgagggggagagcttcgtggccaaggacatggtggacgtgctgctgcagttcgctgacaatcccaaccttgaggtcaagctcaagagggaaggtgtcaaggcattcactcaggacctcatcgctggcggcacagagagctcggcggtgaccgtggagtgggcgctgtcggagctcctgaagaagccggaggtgttcgccaaggccaccgaggagctggaccgcgtcgtgggccgcggccgctgggtcacggagaaggacgtcccgagcctcacctacgtggacgccatcgtgaaggagaccatgcggctgcacccggtggcgcccatgctggtgccccgcctgtcccgcgaggacacgtccgtcgacggctacgacatccccgccggcacgcgggtgctcgtcagcgtgtggaccatcggccgcgaccccaagctgtgggacgcgccggaggagttcatgccggagaggttcatcggcaacaagatcgacgtgaaggggcaggacttcgagctgctgccgttcgggtcgggccggcggatgtgccccggctacagccttgggctgaaggtgatccagctgagcctcgccaatctgctgcacggcttcgcgtggaggctgcccgacggcgtgacgagggagcagctgagcatggaggagatcttcggcttgtcgacgccgcgcaagttcccgcttgaggctgtcgtcgagcccaagctgcccgctcacctctatgctgctgcctgatctgatatgcctttgatgatgtgcgtgtgtacgttctgtgtctcttgactgtactgtaggcactgctcctgtcgcggtccaacattaagcttgcagtgtattgctagcgttgttacttattatgcatcctgtgctgcctttgtagagctgaatgtaatagggcaagtgtgagtcaataatatgcttgataataaggtgtcatgcaatattggagtgtcgtgcacaaaatagattcatcatactggc

SEQ ID NO: 5973 - DNA, 2275 bp, Panicum virgatum
cgggagaccagcgtcgttaagttttctttagctcaagtcgtctctgatttccccgtcctttcccaccaagagacacgacagcttccgcaagcgctccacccacccatcccccgcctataagaagcccgcgcgatccggcaccgcctcatcagctcaactcatcactcgaccacccaggcacccacatcaatccttccattccatttccatcaccaccacaggcaccagcggctgccggctgcgtcagcaagtcagcaacgccgcagcccctatagctcgtgcgtacgtcccgatggagcttccaccatgggcggcttttctcggcgtggtgctcgccaccgtgatgcttctcaaggccgtcctcggccgccgcgggcgccgcgcgtacaacctcccgccggggcccaagccgtggccgatcatcggcaacctcgacctgatgggcgcgctcccgcaccgctccatccacgagctgtcaaggaagtacggcccgctgatgcagctccggttcgggtccttccccgtggtcgtcggctcgtcggtggacatggccaagttcttcctcaagacccacgacgtgatgttcacggaccggcccaagaccgccgccggcaagtacaccacctacaacaaccgggacatcacctggtccccgtacggcgcctactggcggcaggcgcgcaagatgtgcctcaccgagctcttcagcgccaagcgtctcgagtcgtacgagtacatccgcaccgccgaggtccaagcgctgctgcgcgacctgcacgcggcgtctggcaccggccgcgccgtcatgctcaaggactacctgtccacggtgagcctgaacgtgatcacgcgcatggtgctcggcaagaagtacctggacaaggaggtggtggccggtgggtcctccgtgaccacgccggaggagttcaagtggatgctcgacgagctgttcctgctcaacggcgtgctcaacatcggcgactccatcccgtggctcgactggatggacctgcagggttacatcaggaggatgaagaagatcagcaagatgttcgaccggttcctggagcacgtcgtggaggagcacaaccagcggcggctgcgcgaggggaagagcttcgtcgccaaggacatggtcgacgtgctgctccagattgccgacgaccctaccctggaggttgagctgaacagagaaagcgtcaaggctttcactcaggacctcatcgccggcggcacggagagctctgcagtcacagtggagtgggccatctcggagctcctgaagaagcccgaggtcatcgccaaggccacggaggagctggaccgcgtcatcggccgcagccgctgggtcacggagaaggacattccccagctcccatacgtggacgccatcgtcaaggagaccatgcggctgcacccggtggcgccgttgctggtgccccgccttgcgcgcgaggacgccaccgtcgacggctacgacatccccgccggcacgcgcgtgctcgtcagcgtgtggtccatcggccgcgaccccgcgctgtgggacgccccggaggagttcatgccggagcgcttcctcggcagcaagctcgacgtgaagggacaagattacgagctgctgccgttcgggtcgggccggcggatgtgccccgggtacagcctcggcctgaaggtcatccaggtgagcctcgccaacctgctgcacggcttcacctggagcctccccaacggcatgaccaaggaggagctgagcatggaggagatcttcgggctgtccacgccgcgcaagttccctctcgaggccgtcgtcgagcccaagctgccggcacatctctacgccgccgaggcttgatcgacgatgtgcgccgtgcgcgtggtttgttcagtataggtgccgttaattttgcgtgttgctgtccagtgtccacttgctgctcccgctgttgttatagtcactctgtaatgtttctctccaagcttgcgtcgtgtgtggcttgtgactgtagtgtggaataatgttgtaactcagttatacccttacttttatatacacgacacagaaaaatacccctaattatcacaggttatattactgtattttattgatgagcattttactgattttataagccgagctggtaaacgttgtgtttgatcttaactataaatccgtagtgtgagcgggtttggagatccaggaggtgtttgttttgactatgggtggcccatcatcttttcactcctcatgcatgcgtgtaaattgttaagactagat

SEQ ID NO: 5974 - DNA, 1738 bp, Avena sativa
agcagccacaacactcaagcctcaaaacattagtgagacactttccattatccatcatcagcaagtgtacaagccgatcctaatggagcttctccactgggcgtcgtccttcctgggtgtcatgctggccacagtggtcttcctaagggctgtcctccgccgcagcaagtacaacaagctcccgccaggccccaaggcgtggccgatcattggcaaccttaacctcatgggcacgctcccgcaccgctccatccacgagctctgcaaacagtacggcccgctcacccagctctggtttggctccttccccgtcgttgtcggctcctccgtcgagatggccaagttcttcctcaagacccgcgatgtggtgttcactgaccggcccaagttcgccgtcggcaagtacatcacctacaactacagcaacatcacctggtccccttacggcgactactggcgccaggcccgcaagatttggctcactgaactcttcagcgccaagcggctcgagtcatatgagtacatacgcagagaggaggtgctcgccctcctcggtgacctgcatcgtggcgccgccgcgggccgcggcatggtgctcaaggactacctgtccacgatgagcctgaacgtgatcacccgcatggcgctggggaggaagtacctggggaaggagatgatggacctggacctggaggagttcaagtggatgctcgatgagctcttcatccttagcggcgtgctcaacattggggactccatcccgtggctcaactggatggacctgcaggggtatattaagaggatgaagaagctgagcaagatgttcgacctgttcctggaaaacgtggtggaggagcactgtgagcgtcgccgccgccatgacggggatagctttgtggccaaggacatggtcgacgtgctgctgcagttggccagcgaccccgggcttgaggtcaagctcacgagggagggcgtcaaggctttcaccctggacctcattgccggaggcacggaaacctcgtcggtgacattggagtgggccctctcggagctcctgaagaagcctgaggtgttggccaaggcgaccgaggagctggaccgcgtcattggccgacgccgctgggtcacggagaaggacattgcgagcctcccctacacacagggcatcgtgaaggagacgatgcggctgcacccggtggcgccgatgttggttccacggctttctcgccaagacacgtccgtcggcggctacgacatccctgccgggacacgcgttctagtaagcgtgtggtccatcggccgtgacccggagttatgggacgagccggaggagttcatgccagagcggttccttggcagcaggatcgacgtcaaggggcaagacttccagttgctgccgtttgggtcgggacgcaggatgtgcccggggtataacctcgggctaaaggtaattgaggtgagccttgccaacatgctgcatggcttcgagtggagactccctgatggcatggccaaggagcagctcagcatggaggagatcttcgggctaactataccgcgcaagtacccgctagaggctgtcctcgagtctaagctcccagctcatctctacgcccacgcttgaatacatatatatactctctccgtttcataatataaaatgttttagttttttttaaaacgaataaaagaatacatgcttattgtacatgcactcgtgtgttcggtaaccacgtct

SEQ ID NO: 5975 - DNA, 1737 bp, Avena sativa
agcagccacaacactcaagcctcaaaacattagtgagacactttccattatccatcatcagcaagtgtacaagccgatcctaatggagcttctccactgggcgtcgtccttcctgggtgtcatgctggccacagtggtcttcctaagggctgtcctccgccgcagcaagtacaacaagctcccgccaggccccaaggcgtggccgatcattggcaaccttaacctcatgggcacgctcccgcaccgctccatccacgagctctgcaaacagtacggcccgctcacccagctctggtttggctccttccccgtcgttgtcggctcctccgtcgagatggccaagttcttcctcaagacccgcgatgtggtgttcaccgaccggcccaagttcgccgtcggcaagtacatcacctacaactacagcaacatcacctggtccccttacggcgactactggcgccaggcccgcaagatttggctcaccgaactcttcagcgccaagcggctcgagtcatatgagtacatacgcagagaggaggtgctcgccctcctcggtgacctgcatcgtggcgccgccgcgggccgcggcatggtgctcaaggactacctgtccacgatgagcctgaacgtgatcacccgcatggcgctggggaggaagtacctggggaaggagatgatggacctggacctggaggagttcaagtggatgctcgatgagctcttcatccttagcggcgtgctcaacattggggactccatcccgtggctcaactggatggacctgcaggggtatattaagaggatgaagaagctgagcaagatgttcgacctgttcctggaaaacgtggtggaggagcactgtgagcgtcgccgccgccatgacggggatagctttgtggccaaggacatggtcgacgtgctgctgcagttggccagcgaccccgggcttgaggtcaagctcacgagggagggcgtcaaggctttcaccctggacctcattgccggaggcacggaaacctcgtcggtgacattggagtgggccctctcggagctcctgaagaagcctgaggtgttggccaaggcgaccgaggagctggaccgcgtcattggccgacgccgctgggtcacggagaaggacattgcgagcctcccctacacacagggcatcgtgaaggagacgatgcggctgcacccggtggcgccgatgttggttccacggctttctcgccaagacacgtccgtcggcggctacgacatccctgccgggacacgcgttctagtaagcgtgtggtccatcggccgtgacccggagttatgggacgagccggaggagttcatgccagagcggttccttggcagcaggatcgacgtcaaggggcaagacttccagttgctgccctttgggtcgggacgcaggatgtgcccggggtataacctcgggctaaaggtaattgaggtgagccttgccaacatgctgcatggcttcgagtggagactccctgatggcatggccaaggagcagctcagcatggaggagatcttcgggctaactataccgcgcaagtacccgctagaggctgtcctcgagtctaagctcccagctcatctctacgcccacgcttgaatacatatatatactctctccgtttcataatataaaatgttttagtttttttaaaacgaataaaagaatacatgcttattgtacatgcactcgtgtgttcggtaaccacgtct

SEQ ID NO: 5976 - DNA, 1673 bp, Triticum aestivum
ggaacttagaagctctgaatgcacggacacggctcactctcaatggagctaccaccatgggcgcccttcctcggcgtcgcgctcgccaccgtgctcttcctcgaggccgtcttccgtcgcagccgtcaggcatacaacctcccgccgggccctaaaccgtggccgatcatcggcaacctgaacctcatgggcgcgctcccgcaccgctccatccacgcgctctccaagaggtacggccctctcatgtacctccggttcggatcgttccccgtcgtgatcggctcgtcggttgagatggccaagttcttcctcaagacccacgacatggtgttcctcgaccggcccaagatggccgccggcaagtacacgacgtacaactacagagacatgacctggtccccgtacggcgcctactggcgccaggcgcgcaaggtgtgcctcaccgagctcttcagcgccaagcggctcgattcatatgagtacatccggagcgaggagatgcgcgcgctcctgcgagacctgcacgaggcctcccggtcccggcgcgccgtggtgctcaaggactacttgtccaccttgagcctgaacgtgatcacgcgcatggtgctgggcaagaagtacctgcacagggaggcaacggacgaagggggctccggctccgcgacgaccctggcggagttcaagcggatggtcgacgagtggttcttgctcaacggcgtgctcaacatcggcgactccatcccgtggctggactggatggacctgcaggggtacatcaagaggatgaagaagctgagcaagatgtttgatcagttcctcgaacatgtcgtggacgagcacaacgacagacgccgagtcgagggggagagcttcgtctccaaggacatggtggatgtgctactcgagatagccagagaccccaatcttgaggtgcagatcgaccgggatagcgtcaaggctttcattcaggacctcctcgtcggcggcacggagagctcggcggtcgcagtcgagtgggcgatctcggagctcctgaagaagccggaggtgttggccaaggcgaccgaggagctggaccgcgtggtggggcgaggccgctgggtgacggagaaggacatcccgagcctcccctacgtggaggccatcgtcaaggagacgctgcggctgcatccggtggcgccgatgctgactccccggctgtcccgcgaggaggcttccgtcggtggctacgacatccccgtcggcacgcgcgtgttcgtcaacgtgtggtccatcggccgcgacccggcggtgtggactgcgccggaggagttcacgccggagcggttccttggcagcaagatggacgtcaaggggcaggatttcgagctgctgcccttcgggtccggccggcggatgtgccccgggtacagcctcgggttgaaggtgattcaggcgagcctcgccaacctgctgcatggtttcgcctggaggctcccggacggcgtggcgacggacgagctcagcatggaggagaccttcggtctgtcgacgccgcgcaagttcccgctagaggtcgtgttaaaacccaagctcctcgatcacctctacacagcgggtcatcgaacccaataagagttgcgtgaatggcgcctcctggcgcgtgccacgtcgaatgcctgggttactctcac

SEQ ID NO: 5977 - DNA, 2613 bp, Sorghum bicolor
cgaaaacttttcactttttgaaactaaacaaggccctactaccgactccgaaaactgaaaacaaacagcataccgtagtgcacaagctgcacaactggaagccaacccatccacacaccacaccaaaatcacgcgctcccccaaacacgcacgggatgccacaccgccgccgccttttatcgctaacgccacccgattttgtacacacacggctacgccagcggccaatacatacggcctcccggctcaccgtcaccgaccagtctcccctccccagcagtccccactactgcgactgcgagacagcgcagcacaggctgctgcccgctggccgctcgctgcgagaggaaagagaatccaagaacgcgcaggagccaccccgccctcgtcaccggcgtccatgggcggcgccgcgatgtgggccgctgctttggcggcgacggtggtcttcttggccgtcgaggtttcgggtgccgcgggggcgttgccgaggttcgcggaggcgccggagtaccggaacggggaagggtgcccggctgcggcggcgggggtgtgcgacccgggcttggtgcacatcgccatgacgctggacgcgcactacctgcgtggctccatggcggcggtgtactcgctgctcaagcacgcgtcctgcccggagtccatcttcttccacttcctggccgcggaggcggacggggaggaggacccggagccggagctgctgcggcgcgcggtcgcggcgtcgttcccgtcgctgcggttcgagatctacccgttccgcgccgaggccgtggccgggctcatctcggcgtccgtgcgcgccgcgctcgaggcgccgctcaactacgcgcggaaccacctggcggacctgctcccgcgctgcgtgccgcgggcgatatacctcgactccgacgtgctcgccgccgacgacgtcaggcgcctctgggagacgcgcctccccgccgccgccgtcgtggcggcgcccgagtactgccacgccaacttatcccgctacttcacgcccgcgttctggtccgacccggagctcggcgcccgcgtcttcgccgggcgccgccgcccgccctgctacttcaacaccggcgtcatggtcatcgacctccgccgctggcgcgccgggaactaccgccagcgcatcgagcgctggatggaaatccagaaggtgaagcgcatctacgagctgggctccctgcccccgttcttgctcgtcttcgccggtgaggtggaggccgtcgaccaccgctggaaccagcacggcctcggcggcgacaacgtccacggcagctgccgcccgctccacgccgggcccgtcagcctcatgcactggtcgggcaagggcaagccatgggaccgcctcgacgccggcaggccgtgcccgctcgaccacacctggaagtcgtacgacctctacatccccagcgactccttcggcgcagcctctccggcctccgggccggcattgtccgcatccgtgctctcatggtagagagagagagagagagagagagagagagagagagcttctagttccatagttgcaacagctcttttgctgattgagaggttcttggcagtggcaatgtgctgcccccattgcattgcattgtcttgctgcggctgttgccgtcgctgctatgatctagctgctgctcgtggtgggctgtacagggcggcgaagggagcggcggtggcgacatggcaggggaaatcaggaatgggttggtagagaaggggagcttttgctctttggggtagaattcagattggttatttggggggattttgattctttttggtccggcaggtgattcttgcattggggttcccaattctctcgattggaggtgtaaagacttggaattttgctctattattgatcattctttcattcatatgtcatgccttcttgacctgaattcttactgtatggtgataatgatttgcttttttacttattagattgatgaactgaactgaactgcgttggaaatgcccttgtttatgatgttaattatctgtcaagtatcagacaggcttatctcccctccaatggttcttgtaatgctcaataattcttgattcaatttggcaaatgaggtgaggactgaggagcatagctggcagtacattgaagattcatggagctgaaatgtagcattggtccgtcggacctgatacatctgtgttgtgttgaatgaaatgttcttggaacctggctgttcatctgcagttggactgtttgtgatgtactgcatcctcctaccagtgatccattgtactacatgcctagtacttcagttctgtatcaattgtacattctacctctgattgaccaggctgaattgtagtagcactgaatttgaatgtctttttgtgaaacatgcctattgcacctgcagtcaattatttccacagatgtaaacactcccctctgatcgggaacagtactatgttacattctctgtatccattcctgttgtatcgatttttagatcagaattcaatactccgcacaagagtcctgtgactgtggaaactttaaagttcctcctgagaaggtttttgcaattaatttcccacctgctttaatcccgc

SEQ ID NO: 5978 - DNA, 1903 bp, Setaria italica
acaatgcctgtaacagttctaaaaccacagatattgaagtcaagaggtggaccaaacatcctctccacggccatcctaccacatgacactagaataaacgaggatcaaggtactactccaacggtacaaatgcctcctctcaccgaccactcccctccccactactgcgagacagcgcagcacaggctgccgcccgccgcagggagaagagaaaagaatccgagtaggcgcaggagagtcccctcgtcgccggcgtccatgggcggcgccgcgggcgaggcgatgcgggccggtgtcgcggtggcggcggcggtcttcttggctttcgcgttttccggtgcggcggcggcgctgccgaggttcgcggaggcgccggagtaccggaacggggagggttgcccagccgcggcggctggggtgtgcgacccgggtctggtgcatatcgccatgacgctggacgcgcactacctgcgcgggtccatggcggcggtgtactcgctgctcaagcacgcgtcctgcccggagtcgatcttcttccacttcctggccgcggaggccggcgccgcgggcggggagggcccggagccggagccggagctgctgcggcgcgcggtggccgcgtcgttcccgtcgctgcggttcgagatctacccgttccgcgccgaggccgtggcggggctcatctcggcgtccgtgcgcgctgcgctcgaggcgccgctcaactacgcccggaaccacctggcggacctgctcccgcgctgcgtgccacgggcgatatacctcgactccgacgtcctcgccgccgacgacgtgaggcggctctgggagacgcgcctgcctgccgccgccgtggtggcggcgcccgagtactgccacgccaacttctcccgctacttcacgccggccttctggtccgacccggacctcggcgcgcgcgtcttcgccgggcgccgccgcccgccgtgctacttcaacaccggcgtcatggtcatcgacctccgccgctggcgcgccgggaactaccgccaacgcatcgagcggtggatggagatccagaaggagaagcgcatctacgagctgggctccctgcccccgttcttgctcgtcttcgccggcgaggtggaggccgtcgaccaccgctggaaccagcacggcctcggaggcgacaacgtgcacggcagctgccgcccgctccacgacgggcccgtcagcctcatgcactggtcggggaagggcaagccatgggaccgcctcgacgccggcaggccatgcccgctcgaccacacctggaggttatatgacctctacatccccagcgacggcagtggcgctgcctcgccggcgtccgggccggcattgtccgcatccctgttttcatggtagagagagcttgtagttccataggcgcaacaggtacttgctgattgagcggttcttggcgatggcaatgtgcccccatcgcattgcattgtgttgtcttgctggagctgttgctgccgctgctatgagctagctgccgctcatggtgggctgtacagggcggtgaagggagcagcggtagcgacagcaggggaaggagaagagggatcagttcatagagaaggagagctcttgctcttttgggtagaattcagattggttatttgggggattttgattctttttggtctggccggtgatccttggggttcccaattctctcgattggagggtgtacaagtaggaaagacttggaattttgttctattattgatcattctttcattcatatgccatgccttgctgactctaattcgtacaaaatgatgatgatttggtattagattgtagatgaaccgaactgtggaatgccttgtatatggtctgaattatcagtgaactacaacaggcaatattctcccct

SEQ ID NO: 5979 - DNA, 1771 bp, Setaria italica
gcctcctctcaccgaccactcccctccccactactgcgagacagcgcagcacaggctgccgcccgccgcagggagaagagaaaagaatccgagtaggcgcaggagagtcccctcgtcgccggcgtccatgggcggcgccgcgggcgaggcgatgcgggccggtgtcgcggtggcggcggcggtcttcttggctttcgcgttttccggtgcggcggcggcgctgccgaggttcgcggaggcgccggagtaccggaacggggagggttgcccagccgcggcggctggggtgtgcgacccgggtctggtgcatatcgccatgacgctggacgcgcactacctgcgcgggtccatggcggcggtgtactcgctgctcaagcacgcgtcctgcccggagtcgatcttcttccacttcctggccgcggaggccggcgccgcgggcggggagggcccggagccggagccggagctgctgcggcgcgcggtggccgcgtcgttcccgtcgctgcggttcgagatctacccgttccgcgccgaggccgtggcggggctcatctcggcgtccgtgcgcgctgcgctcgaggcgccgctcaactacgcccggaaccacctggcggacctgctcccgcgctgcgtgccacgggcgatatacctcgactccgacgtcctcgccgccgacgacgtgaggcggctctgggagacgcgcctgcctgccgccgccgtggtggcggcgcccgagtactgccacgccaacttctcccgctacttcacgccggccttctggtccgacccggacctcggcgcgcgcgtcttcgccgggcgccgccgcccgccgtgctacttcaacaccggcgtcatggtcatcgacctccgccgctggcgcgccgggaactaccgccaacgcatcgagcggtggatggagatccagaaggagaagcgcatctacgagctgggctccctgcccccgttcttgctcgtcttcgccggcgaggtggaggccgtcgaccaccgctggaaccagcacggcctcggaggcgacaacgtgcacggcagctgccgcccgctccacgacgggcccgtcagcctcatgcactggtcggggaagggcaagccatgggaccgcctcgacgccggcaggccatgcccgctcgaccacacctggaggttatatgacctctacatccccagcgacggcagtggcgctgcctcgccggcgtccgggccggcattgtccgcatccctgttttcatggtagagagagcttgtagttccataggcgcaacaggtacttgctgattgagcggttcttggcgatggcaatgtgcccccatcgcattgcattgtgttgtcttgctggagctgttgctgccgctgctatgagctagctgccgctcatggtgggctgtacagggcggtgaagggagcagcggtagcgacagcaggggaaggagaagagggatcagttcatagagaaggagagctcttgctcttttgggtagaattcagattggttatttgggggattttgattctttttggtctggccggtgatccttggggttcccaattctctcgattggagggtgtacaagtaggaaagacttggaattttgttctattattgatcattctttcattcatatgccatgccttgctgactctaattcgtacaaaatgatgatgatttggtattagattgtagatgaaccgaactgtggaatgccttgtatatggtctgaattatcagtgaactacaacaggcaatattctcccc

SEQ ID NO: 5980 - DNA, 1907 bp, Brachypodium distachyon
cccacccttccttccttgacccatacgcgcaccgcggacgcggaacggatacatacatacggcctccctcggcttccacggccccctccgcattactgctccaccatcacgagacagcgcagcacaggctgcacaagcgccgcaagaatccaaggaaacacgccgaggggggaaggaggagagaacagagaagccatcggcggcgatgatggccggggcagtggcgctgctcttcttggccacggcggcggcggtgctcgtctccggcggtgaggcgggggcggaggcgctgccgaggttcgcggaggcgccggagtaccggaacggggaagggtgccccgcggcggcggcgggggtgtgcgacccgggcttggtccacatcgccatgacgctggacgcgcactacctgcggggctccatggcggccatctactcgctgctcaagcacgcctcctgcccggagtcgctcttcttccacttcatggcggccgcgcccggggacgccgaactgcggcgcgccgtggcggcgtcgttcccatccctgcggttcgagatctacccgttccgcgccgaggccgtggccgggctcatctccgcgtccgtgcgcgccgcgctcgaggcgccgctcaactacgcgcggaaccacctcgccgacctgctcccgccctgcgtgccgcgggcgatctacctcgactccgacgtgctagccgccgacgacgtgcggcgactctgggagacccgcctgccggccgccgccgtcgtcgccgcgcccgagtactgccacgccaacttctcccgctacttcacgccggccttttggtccgaccctgagctcggcgcgcgtgtcttcgctgaccgccgtcgcccgccttgctacttcaacaccggcgtcatggtcatagacctccgccgctggcgagccggcaactaccgccgccgcatcgagcgatggatggagatccagaaggacaagcgcatctatgagctgggctcgctgcccccgttcttgctggtcttcgctggcgaggtggaggctgtcgacctccgctggaaccagcatggcctcggcggcgacaacgtgcacggcagctgccgcccgctccacgacggccccgtcagccttatgcattggtcaggcaagggcaagccctgggaccgcctggacgccggcaggccctgcccgctagaccacacttggaagtcctacgacctctacatcggcggagatggcagcagtgctgccacgccggcctccgggccagcattgtcttcttggtagagggggaaacttgtagctgtagtggcatactgctagatacaacaattcttttgttctttatgcggttctgagcaatgggagcgtggcattgcattggtgctactgctcttgtcgccatgacctagctgcagttccccatcggctgtacagggcagtgaaggaaggggcagctgccattgcagcgccgggagacgagtgaagagtggacagagaaaagaagagcttgttcttttctggtagaattcagattggttatttgggggattttgattcttttgggttggtgttgattggggttcccaattggctccattggtggcagtgtacaattcattgataggaaagacttggaattttgttctgttattgatgattcattcattcatttgacaagtgttctgatctgaaatctaaattatctgagttgcttcaaattctgttgaactgagtgacatatcctgtatctgcttctgaggtggttctctttgaacttgaagtcttaatttgtttcttgtaatacctgaagctcaatcagacctggcaatctgatgaagaacatagccaaggcattctacatttttgtttgattcaaaacctggggcaactcatgtcatatacattgatgggt

SEQ ID NO: 5981 - DNA, 1890 bp, Brachypodium distachyon
cttgacccatacgcgcaccgcggacgcggaacggatacatacatacggcctccctcggcttccacggccccctccgcattactgctccaccatcacgagacagcgcagcacaggctgcacaagcgccgcaagaatccaaggaaacacgccgaggggggaaggaggagagaacagagaagccatcggcggcgatgatggccggggcagtggcgctgctcttcttggccacggcggcggcggtgctcgtctccggcggtgaggcgggggcggaggcgctgccgaggttcgcggaggcgccggagtaccggaacggggaagggtgccccgcggcggcggcgggggtgtgcgacccgggcttggtccacatcgccatgacgctggacgcgcactacctgcggggctccatggcggccatctactcgctgctcaagcacgcctcctgcccggagtcgctcttcttccacttcatggcggccgcgcccggggacgccgaactgcggcgcgccgtggcggcgtcgttcccatccctgcggttcgagatctacccgttccgcgccgaggccgtggccgggctcatctccgcgtccgtgcgcgccgcgctcgaggcgccgctcaactacgcgcggaaccacctcgccgacctgctcccgccctgcgtgccgcgggcgatctacctcgactccgacgtgctagccgccgacgacgtgcggcgactctgggagacccgcctgccggccgccgccgtcgtcgccgcgcccgagtactgccacgccaacttctcccgctacttcacgccggccttttggtccgaccctgagctcggcgcgcgtgtcttcgctgaccgccgtcgcccgccttgctacttcaacaccggcgtcatggtcatagacctccgccgctggcgagccggcaactaccgccgccgcatcgagcgatggatggagatccagaaggacaagcgcatctatgagctgggctcgctgcccccgttcttgctggtcttcgctggcgaggtggaggctgtcgacctccgctggaaccagcatggcctcggcggcgacaacgtgcacggcagctgccgcccgctccacgacggccccgtcagccttatgcattggtcaggcaagggcaagccctgggaccgcctggacgccggcaggccctgcccgctagaccacacttggaagtcctacgacctctacatcggcggagatggcagcagtgctgccacgccggcctccgggccagcattgtcttcttggtagagggggaaacttgtagctgtagtggcatactgctagatacaacaattcttttgttctttatgcggttctgagcaatgggagcgtggcattgcattggtgctactgctcttgtcgccatgacctagctgcagttccccatcggctgtacagggcagtgaaggaaggggcagctgccattgcagcgccgggagacgagtgaagagtggacagagaaaagaagagcttgttcttttctggtagaattcagattggttatttgggggattttgattcttttgggttggtgttgattggggttcccaattggctccattggtggcagtgtacaattcattgataggaaagacttggaattttgttctgttattgatgattcattcattcatttgacaagtgttctgatctgaaatctaaattatctgagttgcttcaaattctgttgaactgagtgacatatcctgtatctgcttctgaggtggttctctttgaacttgaagtcttaatttgtttcttgtaatacctgaagctcaatcagacctggcaatctgatgaagaacatagccaaggcattctacatttttgtttgattcaaaacctggggcaactcatgtcatatacattgatg

SEQ ID NO: 5982 - DNA, 1417 bp, Avena sativa
ctccctccgcattactgctccaccatcgccagacagctcagcgcaggctgcacaccacaaccccatcgccgcaggaatccaagaagaatcgccgagccatcgccggcgccgatgatggctggggcagcagcagccgcagcgctgataatcttcttggccgcgacggccgccgtctccggcgccgagctgccgaggttcgcggaggcgccgcagtaccggaacggggaaggctgcccggccgcggcggcgggggtgtgcgaccctgggctggtacacatcgccatgaccctggacgcgcactacctgcgtggctccatggcggccatctactccctcctcaagcacgcctcctgcccggagtccctcttcttccacttcctcgccgccgacgcgccccccggggacatcacggacctgcgccgcgccgtggcggcgtcgttcccgtcgctgcggttcgagatctacccgttccgcgctgaggccgtggcggggctcatctcggcctccgtgcgggccgccctcgacgcgccgctcaactacgcgcggaaccacctcgccgacctgctcccgccctgcgtgccccgcgccatctacctcgactccgacgtgctggccgccgacgacgtgcgccgcctctgggagacgcgcctcccagccgccgccgtcgtcgccgcgcccgagtactgccacgccaacttctcccgctacttcaccccggccttctggtccgacccggagctcggcacgcgggtcttcgcgggccgacgccgcccgccctgctacttcaacacgggcgtcatggtcatcgacctccgccgctggcgggcgggcaactaccgccgccgcatcgagcgctggatggagatccagaaggagaagcgcatctacgagctgggctccctgcccccgttcctgctcgtcttcgccggcgaggtggaggccgtcgacctccgctggaaccagcacggcctcggcggcgacaacgtgcacggcagctgccgaccgctccacgacgggcccgtcagcctcatgcattggtcgggcaagggcaagccgtgggaccggctggacgccggcaggccctgcccgctcgaccacacctggaagtcctacgacctctacattgccggagacggcagcggcgccgcctcgccggcctccgggccggcattgtcggcttcttggttgtagaaacagagcgcgtagatgtagcggatggatagatacaataattcttttgttggttggggcggttcttggcaatggcagccgtggcatcgcattggtgctaccgctgccgctcccaccgccgccccaccccatcggctgtacagggtcggtcgcggtgattgcatcgcgacgaggctgggtagagaaaagaagagcttgttcttttcggtagaaattcagattcatt

SEQ ID NO: 5983 - DNA, 2137 bp, Zea mays
aacgacccggcccaagctgccatcgaggagggacgagggagggatccagcgagcggagcggagcggacgccaccctcgcgcgcacacctacgcgcaggcgcatacaccaacgacgccgaccccttccagggagggagggagggaaccacacaaccggacccgacccgacgccccgaggcgaaggcgagggcgagcggtcagccggccggggcggggaccaggggggatcccctcggcggcggcggccatgggcgcggcctccccggcgatgtgggccgggctggtcctggtggtgttattggccgcatcgggcccggcgtcggcggggctgccgaggttcgccgaggcgcccgagtacaggaacggggacgggtgcccggccccggtgacgggcgcgggggtctgcgacccgggcctggtgcacatcgccatgacgctcgacgcgcactacctcaggggctccatggcggccatctactcgctgctcaagcacgcctcctgcccggagtccatcttcttccacttcctcgccgcggagggcggcggcgcgccggccgtcgccgagctccgggccgccgtggccgcctccttcccgtccctgcgcttcgagatctacccgttccgcgccgacgcggtcgccgggctcatctccgcgtccgtgcgcgccgcgctcgaggcgccgctcaactacgcgcgcaaccacctcgccgacctgctcccgcgctgcgtgccgcgcgcgatatacctcgactccgacgtgctcgccgtcgacgacgtgcggcgcctctgggagacgcgcctgcccgccgccgcggtcgtcgccgcgcccgagtactgccacgccaacttctcccgctacttcaccgaggccttctgggacgaccccgtcctcggcgccagggtctttgccggccgccgccgcgcgccctgctacttcaacaccggcgtcatggtcatcgacctccggaggtggcgcgttggcaactaccgccagcgcatcgagcgctggatggagatgcagaaggagaaaagaatctacgagcttggctccttgccccccttcctgctcgtcttcgccggcgagatagaggccgtcgaccaccggtggaaccagcacggcctgggcggcgacaacgtcttcggcagctgccgccctctccataacgggcccgtcagcctgatgcactggtccgggaagggcaagccatgggaccgtctcgacgccggcaagccttgccccctcgaccacacctggaagtcgtacgacctctacattggcgagaatgattcttcaccagcatcagggccgtcccggtcagccttgtcatcgttggtggcatggtagaagttcatatacacaataattctttgatctcgggtgcccgtggttcttggccggtaatggaattgccttgcgatgcattcccactgccggctgccgccacagctgctgccgcaagccagctgccgccttcggctgtacaggacagtgaggggaggggcggtatacagattgcagcaggagcagcagcagcagcaagggggtgaagacagtgaatagcgggggggagcaaattcttgttcgttttgcactatgattgagattgattcattaggctctggtttggaggctgtgactatcatgggatggaaggaattacttggttggtggtgtacaattcttggataggacaaaggtttcggttttttggtgtattagttcagaattgtttcatttacatgtctattcagtacactcgtgtaatacggattaaattgatttgaaacaaattgagtgcatcctggtcgtgtacctgtgctgaaatcctgctctctttgtgactttcgtcatccagaatgtcctgccaattgctctcttggttgccatgtttattgtctatgtagggattctaggatagcacaatggtttgctgttctggttttgcgtattatgctcagcaagaatggcctaattcattgttgagagtccttgccatccttactccatccagaatggcctaacatgctgtgctcctgccattgttggtactgtctgtctgctgttattagttctacaccatttggttaacaagctttagctaatgtctgattcctgtgttcacctgttgttgaactt

SEQ ID NO: 5984 - DNA, 1799 bp, Panicum virgatum
gcccccccagctagcccaggccatcgatccatccatccagccggggccagggccagcgccaccaccccaacgaacgcgtacaccaccaacgacgccgaccacttctagggaggaggacccgaccgacccgacccccgcgagggcgagggcgagggcgagcggcgagccgggggccaaggggggattcccctcgtcgtcgtcggcggcggccatgggcgcggcctccccggcgatgtgggccgggctcgtgctggcggccttgttattggcgcaatcggcggcgggggcgctgccgaggttcgccgaggcgcccgagtaccggaacggggaggggtgcccggcgccggtggcgggcgcgggggtgtgcgacccgggcctggttcacatcgccatgacgctcgacgcgcactacctccggggctccatggcggccatctactcgctgctcaagcacgcctcctgcccggagtcgctcttcttccacttcctcgccgcggggggcggcggcgcgccgccggtcgccgacctccgggccgccgtcgccgcctccttcccctccctgcgcttcgagatctacccgttccgcgccgacgcggtcgccgggctcatctccgcctccgtgcgcgccgcgctcgaggcgccgctcaactacgcgcggaaccacctcgccgacctgctcccgcgctgcgtgccgcgcgcgatatacctcgactccgacgtgctcgccgtcgacgacgtgcgcaggctctgggagacgcgcctgcccgccgccgcggtcgtcgccgcgccagagtactgccacgccaacttctcccgctacttcaccgaggccttctggaacgaccccgtcctcggcgcgcgggtcttcgccggccgccgccgcgcgccctgctacttcaacaccggggtcatggtcatcgacctccggagatggcgcgtcggcaactaccgccagcgcatcgagcgctggatggagatgcagaaggagaagagaatctacgagcttggctccttgcccccattcttgctcgtattcgccggcgagattgaggccgtcgaccaccgctggaaccagcacggcttgggcggcgacaacgtgttcggcagctgccgacccctccacaacggccccgtgagcctcatgcactggtccgggaagggcaagccatgggaccgcctcgacgccggcaagccttgcccgctcgaccacacctggaagtcgtatgacctgtacattggagagaacgattcatcagcatcatggcagtcccggtcctccttgtcatcatcggcggcattgcctgctggggtgttttcttggtagaagaagctcaagacatacacaataattcattggtttgagggtgccgtggttcttggctggtaatggaattgccttgcaatgcattgccactggccaccaccacggctgctgctgctgcaagcgagctgccgccttcggctgtacaggacagtgaggggaggggcggtatacacattgcggcggcaaggggatgaagacagtgaatagagggagagcaaattcttgttcatttgcactacgattcagattgattcgttaggctgtgattggtggtgactatcaggggtgggaaggaattacttgattggtggtgtacaattcttggataggataaacgtttcagtttttctttggtcagttagttcagaattgtttcatttacatgtctattcagtacacgcgtataatatggattaaattgatttgaatcaaattgagtggatcctgttcttgtgcctgtgccgagatcctgtta

SEQ ID NO: 5985 - DNA, 2507 bp, Setaria italica
gatcgacccagccagccagccatcgatcgatccagccagcgccaccaccccaacgaacgcgtacaccaccaacgacgccgaccacttcccagggagggaaccacacgacccacccgaccccgagacccgaccgcccccgagggcgagggcgagggcgagccggccgcggcgggggatcccctcggcgccggccatgggcgcggccaccccggcgatgtgggccgggctggtgctggcggcgatgttgttattggcccaatcggggccggcggcggcggcggggctgccgaggttcgccgaggcgcccgagtaccggaacggggaggggtgcctggcgcccgtggccggcgcgggggtctgcgacccgggcctcgtccacatcgccatgacgctcgacgcgcactacctccggggctccatggcggccatctactcgctgctcaagcacgcctcctgcccggagtcgctcttcttccacttcctcgccgcggagggcggcggcgcgccgccggtcgccgacctccgggccgccgtcgccgcctcgttcccctcgctgcgcttcgagatctacccgttccgcgccgacgcggtcgccgggctcatctccgcctccgtgcgcgccgcgctcgaggcccctctcaactacgcgcggaaccacctcgccgacctgctcccgcgctgcgtgccgcgcgcgatatacctcgactccgacgtgctcgccgtcgacgacgtgcgcaggctctgggagacgcgcctgcccgccgccgcggtcgtcgccgcgccagagtactgccacgccaacttctcccgttacttcaccgaggccttctggaacgaccccgtcctcggcgcgcgggtcttcgccgggcgccgccgcgcgccctgctacttcaacaccggggtcatggtcatcgacctccggagatggcgcgtcggcaactaccgccagcgcatcgagcgctggatggagatgcagaaagagaagagaatctacgagctcggctccttgcccccgttcttgctcgtcttcgccggcgagattgaggccgtcgaccaccggtggaaccagcacggcttgggcggcgacaacgtgttcggcagctgccgccccctccacaacggtcccgtcagcctgatgcactggtccggaaagggcaagccatgggaccgcctcgacgccggcaagccttgcccgctcgaccacacctggaagtcgtacgacctctacattggcgagaatgattcatcagcatcagggcagtcccggtctgccttgtcatcatcggcggcattgcctgcggcggtgttttcttggtaggagaagctgaagacatacatacacaataattctttggtttggggatgccgtggttcttggctggtaatggaattgccttgcaatgcattgccactgccaccacggctgctgctgctgctgcaaacgagctgccgccttcggctgtacaggacagtgaggggaggggcggtatacacattgcggtggtggcaaggggatgaagacagtgaatagagggagagcaaattcttgttcagttgcactacgattcagattgattcattgggctttgattggtggagactatcaggggttggaaggaattacttgattggtggtgtacaattcttggataggataaaggtttcagttttttttggtctaatagttcagaattgtttcatttacatgtctattcagtacactcttataatatggattaaattgatttgaatcaaattgagtggatcctgttcttgtgcctgtgccggaatcctgctgtatttgacactcagtccatcatccagaatggcctaatctcctgctgttgctattttccttgctatgttgatctatgattgtttggcataatagatgtttctgttttgcttattatgctcatcaagaatggcctaacccatttatgtgcttgtcctccttccttcatcaagaatgggcatacatgtgacaggttctgtggttttggcatcgttagtagttttacctattatttgcttcttcaacctttttcccctaattgcaatcctgttttccttgttcatctgttttgctcttgagctccaaatgttgctttcctgtgttctggaagttcctgttgctgtggtgatgacttgtttgtttgttctgacttatgagctggggccaattgtgtttcttcagcgttacacattacctggagcatctctggagttgaagagcattagactacgcgaggatctttacagatggatgtgcacctagagaagagagctgcaaaggacggaggaaaacaacaacaatatttcggttagttaggatgaactttttatatcagaaagtggaggcgtgagatggggacttctcaacagactcataatacagtcagtgttaatactacttctaatcccccaactaacgccacctaaatctccacaataccagtgagacagataacctctctttaaattatcatcagtcacggacgtcggaa

SEQ ID NO: 5986 - DNA, 3047 bp, Panicum virgatum
caaacagaaatttcaaaatacgcggctccattcggttcaccacccgctggattagtggatctccacgagagggtaacgtgcgcggccgattgtttgagcccggcgacctggtccggccttgatttatttgctccttcaactgtgaaacccacatgctagtttacccttgatttgaagatgccgcgcctgtgcattcctgcagatgcgactgaccaaaatgagcatattcatttgttcatgatcgtttcgaattggccatcagcaggcgtgaaactttttaaatttattcacgccggatgattccaaacgaaacaaaacacgtggcgccatccacttggcaatttttcacaaacactaaccactgtcacgggctcgcgcatgtgctaacctaacccgtggccgttaccaacgaccctacaataaaccccagaaaggaaaattattgaaataaaaaaaaactagagacgaagaagaactagaacgacgtcgaagcaagcagtgtggcgtacgtacgcggtgtacgcgtcgccgtacgtatttgtacagctggtcgcaggctgccgcagcgctaatcccattttagccctagttaaaaggccgtaattaaccctccctctccgagcgatgggtgaacgcgtaggcaagcaaagcagcgtcccgagcagcggggccaggccagccaacgcggccgcacgtggggcccaccgctcccacgcgtgctttattggtaacgccacatataaatgtccccgataaaacgactccaccgatcgagcgccccaggccccagctagctagcccaggctgcctgcctggcatcgatccatccagccagccaccccaacgaacgcgtaccacttctagggaggaggaaaccacacagggagcccgacccgaccgacccgacccccgcgagggcgagggcgagggcgagcggcgcgccgggggccaaggggggattcccctcgtcggcggcggccatgggcgcggcctccccggcgatgtgggccgggctcgtgctggcggccttgttattggcgcaatcggcggcggcgctgccgaggttcgccgaggcgcccgagtaccggaacggggaggggtgcccggcgccggtggcgggcgcgggggtgtgcgacccgggcctggtgcacatcgccatgacgctcgacgcgcactacctccggggctccatggcggccatctactcgctgctcaagcacgcctcctgcccggagtcgctcttcttccacttcctcgccgcggagggcggcggcgcgccggcggtcgccgacctccgggccgccgtcgccacctcgttcccctccctgcgcttcgagatctacccgttccgcgcggacgcggtcgccggcctcatctccgcgtccgtgcgcgccgcgctcgaggcgccgctcaactacgcgcggaaccacctcgccgacctgctcccgcgctgcgtgccgcgcgcgatatacctcgactccgacgtgctcgccgtcgacgacgtgcgcaggctctgggagacgcgcctgcccgccgcggcggtcgtcgccgcgccagagtactgccacgccaacttctcccgctacttcaccgaggccttctggaacgaccccgtcctcggcgcgcgggtcttcgccgggcgccgccgcgcgccctgctacttcaacaccggggtcatggtcatcgacctccggagatggcgcgtcggcaactaccgccagcgcatcgagcggtggatggagatgcagaaagagaagaggatctacgagcttggctccttgcccccattcttgctcgtattcgctggcgagattgaggccgtcgaccaccggtggaaccagcacggcttgggcggcgacaacgtgatcggcagctgccggcccctccacaacggccccgtcagcctgatgcactggtccggaaagggcaagccatgggaccgcctcgacgccggcaagccttgcccgctcgaccacacctggaagtcgtatgacctctacattggagagaatgattcatcagcatcagggcagtcccggtccgccttgtcatcatcggcagcattgcctgcgggggtgttttcttggtagaagaagctcaagacaaacacaataattcattggtttgaggttgccgtggttcttggctggtaatggaattgccttgcaatgcattgccactgccaccacggctgctgctgctgctgctgcaagcgagctgccgccttcggctgtacaggacagtgaggggaggggcggtatacacattgcagcggcggcaaggggatgaagacagtgaatagagggagagcaaattcttgttcatttgcactacgattcagattgattcgttaggctgtgattggtggtgactatcagggtttggaaggaattacttggattggtggtgtacaattcttggataggatataagtttcagtttttctttggtccgttagttcagaattgtttcatttacatgtcaattcagtacacgcctataatatggattaaattgatttgaatcaaattgagtggatcctgttcttgtgcctgtgccgaaatcctgttgtatttatttgagatagcccatccaagaatggcctaatctcctgctgttactattttccttgctatatgttgatctaggattggatggcataatagctgtttcttttttgcttcttatgctcatcaagaatggcctaacccattgatgtgcttgtcttccttcatcaagaacgggcaaacatgtgacaggttcgatagttttggcatttcttagtagttttacactatttgcttcttcaacctcttcccctaattgcaagcatgttttccttgtccatctgttttgctgttgagctccaaatgttgccttcctgtgttctggaagttcctggtgctctggtgatgacttgtttgttctgactcgtgacctggggccaatagtgtttcttcagtattacacattacctggagcatctggagtttagggcattagactacgcgaggatctttacagatggatgtgcatctagagagctt

SEQ ID NO: 5987 - DNA, 2531 bp, Sorghum bicolor
gccgatcgacccagcccaggctgcctgcctgcctgccatctcgaggtcgagggatccagcgagcggagcggagcggacgcggacgccacccgcgcccgcacacctacgcgcaggcgcatacaccaacgacgccgaccacttccagggagggaaaccacacaaccggacccgaccccccgacgcccccgaggcgagggcgagggcgagcggtgagccggccggggcggggaccaagggggatcccctcggcggcggcggccatgggtgcgccctccccggcgatgtgggccgggctggtgctggtggcgttattggccgcatcggggccggcggcgacagcggcggcggggctgccgaggttcgccgaggcgcccgagtacaggaacggggaggggtgcccggccccggtggcgggcgcgggggtctgcgacccgggcctggtgcacatcgccatgacgctcgacgcgcactacctcaggggctccatggcggccatctactcgctgctcaagcacgcctcctgcccggagtcgctcttcttccacttcctcgccgcggagggcggcggcgcgccggccgtcgccgacctccgggccgccgtgtccgcctccttcccgtccctgcgcttcgagatctacccgttccgcgccgacgcggtcgccgggctcatctccgcgtccgtgcgcgccgcgctcgaggcgccgctcaactacgcgcggaaccacctcgccgacctgctcccgcgctgcgtcccgcgcgcgatatacctcgactccgacgtgctcgccgtcgacgacgtgcggaggctctgggagacgcgcctgcccgcagccgcggtcgtcgccgcgcccgagtactgccacgccaacttctcccgctacttcaccgaggccttctggaacgaccccgtcctcggcgccagagtctttgctggccgccgccgcgcgccctgctacttcaatacgggcgtcatggtcatcgacctccggagatggcgcgttggcaactaccgccagcgcatcgagcgctggatggagatgcagaaggagaaaagaatctacgagcttggctccttgccccccttcttgctcgtcttcgccggcgagattgaggctgtcgaccaccggtggaaccagcacggcttgggcggcgacaacgtcttcggcagctgccgccctctccataacgggcccgtcagcctgatgcactggtccgggaagggcaagccatgggaccgtctcgacgccggcaagccttgcccgctcgaccacacctggaggtcgtacgacctctacattggcgagaatgattcatcatcagcatcagggccgtcccggtcagccttgtcatcatcggcggcatggtagaagttcagatatacacacaataattctttgatttggggatgccgtggttcttggccggtaatggaattgccttgcaatgcattgccactgctgccacagctgctgctgctgctgcaagtcagctgccgccttcggctgtacaggggaggggcggtatacagattgcagcagcagcaaggggatgaagacagtgaatagggggggagcaaattcttgttcattttgcactatgattcggattgattcattaggctctggtttggaggttgtgactatcatgggttggaaggaaaattacttgattggtggtgtacaattcttggataggataaaggtttcagtttttggtctattagttcagaattgtttcatttacatgtctattcagtacactcgtataatatggatttaattaaattgatttggaacaattcgagtgcatcctggtcttgtgcctttgctgaaatccttctatatgtgaattccatcatccagaatggcctgatgtcctgccaattgctctctcggttgccatgtttatctatgctgggaatcttggatagcacaatggtttgctgttctggtttggcttattatggtcagcaagaatggcctaattcatttatctccttgtcatccttactccatccagaatggcataacatgttgaagttctagtatacctgtctgtctgctgtttttagttctacaccctttggttcttcaacgccccacaaactccagctgatgtttgattcctgtgtttacctgttgttgaacttgaaatactatttcctgtgttctggaagttcatattgcttccaagatggtgatgacttgtttgattcgacttttgagctgtggccaatggtgtttcttcagtgttacacatatgcagaagcatcatgaattaaaagagcattagactacgcgaggatctttacagatgggtgtgcaccaagagagctgcaaagaaagggaaatagcaataatattgaagttagttaggatgaactttttatatcagaagaaggtggaagcgtaaggacggggacgtctcaacagactcataatacagtgttaataccacctctagtcctccaactaacgccacctaaatgtatacaaaaccatagagaaagatgacctctctttaaattagca

SEQ ID NO: 5988 - DNA, 2463 bp, Setaria italica
acgccgtaattaaccctcccctcctcccccaggcggccggccccaccaacgatgaacgcgtaggcaagcaaagcagcgcccaaagccaagccaagccaacgcagcgccacgtggggcccaccctcccacgcgtgctttattggaacgccacatataaatgtccccgataaaacgactccaccgatcgacccagccagccagccatcgatcgatccagccagcgccaccaccccaacgaacgcgtacaccaccaacgacgccgaccacttcccagggagggaaccacacgacccacccgaccccgagacccgaccgcccccgagggcgagggcgagggcgagccggccgcggcgggggatcccctcggcgccggccatgggcgcggccaccccggcgatgtgggccgggctggtgctggcggcgatgttgttattggcccaatcggggccggcggcggcggcggggctgccgaggttcgccgaggcgcccgagtaccggaacggggaggggtgcctggcgcccgtggccggcgcgggggtctgcgacccgggcctcgtccacatcgccatgacgctcgacgcgcactacctccggggctccatggcggccatctactcgctgctcaagcacgcctcctgcccggagtcgctcttcttccacttcctcgccgcggagggcggcggcgcgccgccggtcgccgacctccgggccgccgtcgccgcctcgttcccctcgctgcgcttcgagatctacccgttccgcgccgacgcggtcgccgggctcatctccgcctccgtgcgcgccgcgctcgaggcccctctcaactacgcgcggaaccacctcgccgacctgctcccgcgctgcgtgccgcgcgcgatatacctcgactccgacgtgctcgccgtcgacgacgtgcgcaggctctgggagacgcgcctgcccgccgccgcggtcgtcgccgcgccagagtactgccacgccaacttctcccgttacttcaccgaggccttctggaacgaccccgtcctcggcgcgcgggtcttcgccgggcgccgccgcgcgccctgctacttcaacaccggggtcatggtcatcgacctccggagatggcgcgtcggcaactaccgccagcgcatcgagcgctggatggagatgcagaaagagaagagaatctacgagctcggctccttgcccccgttcttgctcgtcttcgccggcgagattgaggccgtcgaccaccggtggaaccagcacggcttgggcggcgacaacgtgttcggcagctgccgccccctccacaacggtcccgtcagcctgatgcactggtccggaaagggcaagccatgggaccgcctcgacgccggcaagccttgcccgctcgaccacacctggaagtcgtacgacctctacattggcgagaatgattcatcagcatcagggcagtcccggtctgccttgtcatcatcggcggcattgcctgcggcggtgttttcttggtaggagaagctgaagacatacatacacaataattctttggtttggggatgccgtggttcttggctggtaatggaattgccttgcaatgcattgccactgccaccacggctgctgctgctgctgcaaacgagctgccgccttcggctgtacaggacagtgaggggaggggcggtatacacattgcggtggtggcaaggggatgaagacagtgaatagagggagagcaaattcttgttcagttgcactacgattcagattgattcattgggctttgattggtggagactatcaggggttggaaggaattacttgattggtggtgtacaattcttggataggataaaggtttcagttttttttggtctaatagttcagaattgtttcatttacatgtctattcagtacactcttataatatggattaaattgatttgaatcaaattgagtggatcctgttcttgtgcctgtgccggaatcctgctgtatttgacactcagtccatcatccagaatggcctaatctcctgctgttgctattttccttgctatgttgatctatgattgtttggcataatagatgtttctgttttgcttattatgctcatcaagaatggcctaacccatttatgtgcttgtcctccttccttcatcaagaatgggcatacatgtgacaggttctgtggttttggcatcgttagtagttttacctattatttgcttcttcaacctttttcccctaattgcaatcctgttttccttgttcatctgttttgctcttgagctccaaatgttgctttcctgtgttctggaagttcctgttgctgtggtgatgacttgtttgtttgttctgacttatgagctggggccaattgtgtttcttcagcgttacacattacctggagcatctctggagttgaagagcattagactacgcgaggatctttacagatggatgtgcacctagaga

SEQ ID NO: 5989 - DNA, 2771 bp, Zea mays
gtactaacacagcacataataaagcatcagacgtcgacgacaacaacagaacacgggaaggacgtcgaacaggagctggcgtcctgctgctaattccgcccgaattagccctaattaaacaccccagctcgttaaccacgccgtaattaacccctgtcccgcggccttgcattgcaattgcaattgcaattgcagtcctgcagacgatgaaatgctgaagcccggtaagcaaagaaatgacagaagccaacgaagcgcgcgttggaacctttcacgcgtgctttattggtaacgcttcttctccacatctaaatgtccccgacaaaacgacctggccggccgatcgagctgccatcgaggtcgaggaggcgtccagcgaacggagcggacgccaccgggcgcgcacacctacgcgtaggcgcatagaccaacgcgccgaccacttccagggagggaaccacacaaccggacccgacgcccccgaggcgagcgcgagcggtgggccggccggggcggggaccaaggggggtcccctcggcggcggtggccatgggcgcggcctccccggcgatgtgggccgggctggtgctggtggcgttattggccgtatcggggccggcggtggcggcggggctgccgaggttcgccgaggcgcccgagtacaggaacggggaggggtgccctgcccctgtggcgggcgcgggggtctgcgacccgggcctggtgcacatcgccatgacgctcgacgcccactacctcaggggctccatggcagccatctactcgttgctcaagcacgcctcctgcccggagtcgctcttcttccacttcctcgctgcggcggagggcggcggcgcgccggcggcctccgggctccgggccgtcgtggcggcctccttcccgtccctgagcttcgagatctacccgttccgcgccgacgcggtcgccgggctcatctccgcgtccgtgcgcgccgcgctcgaggcgccgctcaactacgcgcggaaccacctcgccggcctgctcccgcgctgcgtgccgcgcgcgatatacctcgactccgacgtgctcgccgtcgacgacgtgcggtggctctgggagacgcggctgcccgccgccgcggtcgtcgccgcgcccgagtactgccacgccaacttctcgcgctacttcaccgacgccttctgggacgaccccgtcctcggcgccagggtcttcgccggccgccgccgcgcgccctgctacttcaacacgggtgtcatggtcatcgacctccggaggtggcgcgtcggcaactaccgccagcgcatcgagcgctggatggagatgcagaaggagaagaggatctacgagcttggctccttgccccccttcctgctcgtcttcgccggcgagatagaggccgtcgaccaccggtggaaccagcacggcttgggcggcgacaacgtgttcggtagctgccgccctctccataacgggcctgtcagcctcatgcactggtccgggaagggcaagccatgggaccgtctcgacgccggcaagccttgcccactggaccacacctggaaggcgtacgacctctacattggcgagaatgattcatcatcttcagggccgtcacggtcagcattgtcatctttggcggcatggtagaagttcagatacgcaacacgatagttctttgatttggggatgccgtggttcttggccggtaatggaattgccttgcgatgcaccagtgccgccacagcggctgctgcaagccagctgccgccctcggctgtacaggacagtgaggtgaggggcggtatacagattgcagcggcagcgaggggacgaagacagtaaaataggggtatggggagccaaattcttgttcattttgcactatgatacagattgattcattaggccctgggttgttggaggttgtgactatcatgagttgggaagaaattacttgattggtggtgtacaattcttggacaggatacaggttccagtttttggtccattagttcaggaattgtttcatttacatgtctattcagtacactcgtataatatggattaagttgatttgaaacgaatcgatgagtgcatccgaccgtgttcctgtgctgaaaccctgctctgtttgtgagtttagtcatccagaatggcctgatatgttgtgcttctgccattgttagtactgtctgtctgtctgccgctattagttctacacccttcggttcgtcgacccctcacaaactttagctaatgttcggttcctttgttcacctgctgttgagcttgaaatgcagataaacctctcctttacattaccattcacgggtgatggaagctctggaagcagaccacaggaatgcagtaggaaaggaacctatcatttgaaactgaaacctgagaaaaacataaaagctgttttctgaaactgcgtcttctcagttatattcgttggtgattcgtgacgctgaaatgcagccaccgaacctgagcacctccacgcgcagtgacatctctggcgatgacccgcatttgcagctggccactacagagtacagaccacagagcaatagctgtgattgacacatctaagattctgaaaataaaaaacatatcactctcctaaatatcactggtcccatgcaccgacgatatctgctcccctcatcgcttggcaggggtgtaaaggctacactcacatacacaggctcagggtcaggctggaggctggcagtgacccgctggagagctggaaacgcaaggca

SEQ ID NO: 5990 - DNA, 2178 bp, Brachypodium distachyon
cccatcccgaggaagccatcggagccgatccatccgtcgccgccgagacgagccgggacgggcaacaggaggaagaaagagagattggttgcaaggaaggaacaaacgccgaccacttctcaagggaaaaagggcgaaccaacccaaagcgaacccaaccctcccctcgagcgagcgagaggagaggagagggagggggagcgagggagcccgacccgtgcgcgcgaggagagggcctccggattacctaggagcccgcgccggcggcggcggtccatgggcggcgcctcaccggcgatgcgggccgggtgggtcctggtggcgtttatcctggccgcatctgggccgggggcggcggtcgtggcgctgccgaggttcgcggaggcgccggagtaccggaacggggacgggtgcccggcggccgtggcgggggccggggtctgcgacccgggcctcgtgcacatcgcgatgacgctcgacgcgcactacctcaggggctccatggccgccatctactcgctgctcaagcatgcgtcctgccccgagtcgctcttcttccacttcctcgccgccgcggacggcggcggccccggcgcgggagccccggaggtgggcgagctccggagcgcgctggccgcgtcgttcccctcgctgcggttcgagatctacccgttccgcgccgacgcggtgaccgggctcatctcggcctccgtgcgcgcggcgctcgaggcgccgctcaactacgccaggaaccacctcgccgacctgctccccaggtgcgtgccgcgggcgatttacctcgactcggacgtgctggccgtcgacgacgtgcggcgcctctgggagacccgcctgcccgccgccgccgtcgtcgcggcgcccgagtactgccacgccaacttctcccgctacttcaccgacgccttctggtccgaccccgacctgggtgcgcgcgtcttcgcgggacgccgccgcgcgccctgctacttcaacaccggcgtcatggtcatcgacctcaggcgctggcgttccggcaactaccgccaccgcatcgagcagtggatggagctgcagaaggagaagcgaatctacgagctcggctccttgccccctttcttgcttgtcttcgccggcgaggtggaggccgtcgaccatcggtggaaccagcacggtctgggcggtgacaacgtgctcggcagctgccgccccctccacaagggtcctgtcagcttgatgcactggtcagggaagggcaagccatgggatcgcctggacgccggcaggccttgcccgctcgaccacacctggaagtcatacgacctctacgtcgacgatggcgatgcgtcgtcggcatcagcgccttcccggacctcgttgtcgtcatcggcattgcccgcggcggtgttttcttggtagacagatacggcacatacactattattttttcatttgggtgccttggttcgtgggcggtgatggaattgccttgcaattcattgccactgcagccacagctgccactgcaagccagctgccgccttcggctgtacagcgcggagaggggcggcacattgcagcggcagcaaggagaagaggaacagtgcataggggaagcaaattcttgttcgtttgcgatacaattcagattgattcattatgctttgaccacggggttgccagactatggggtgttggagttacttgattggtggttgtacaattcttggataggataaaagctttcagtttctttttgtgtattagttcagaattgtttcattttacgtgatcattcagtgaacccgtataaatattgattgaattggttgtccttcaataaaacacagtggatcctattcttgttgctgctgtgccaaaactctgttgtatctgtcactcttcattcggaaatgcattcagaatgggctacctctctttgcattttacatctttcagagtggccaaatctacttctatttctagtttgctcgctcagttaatccagattggcctaatctatgctgttcctattttgcctgccatgttcatacacatgacctaatttattgctgtttttctgtcttgcttactgtgatcatccagaattgcctaatgcctttttggttatggagtttcagccaattgtatgatctactagtaaatgctcatctgttttgt

SEQ ID NO: 5991 - DNA, 2183 bp, Brachypodium distachyon
cccatcccgaggaagccatcggagccgatccatccgtcgccgccgagacgagccgggacgggcaacaggaggaagaaagagagattggttgcaaggaaggaacaaacgccgaccacttctcaagggaaaaagggcgaaccaacccaaagcgaacccaaccctcccctcgagcgagcgagaggagaggagagggagggggagcgagggagcccgacccgtgcgcgcgaggagagggcctccggattacctaggagcccgcgccggcggcggcggtccatgggcggcgcctcaccggcgatgcgggccgggtgggtcctggtggcgtttatcctggccgcatctgggccgggggcggcggtcgtggcgctgccgaggttcgcggaggcgccggagtaccggaacggggacgggtgcccggcggccgtggcgggggccggggtctgcgacccgggcctcgtgcacatcgcgatgacgctcgacgcgcactacctcaggggctccatggccgccatctactcgctgctcaagcatgcgtcctgccccgagtcgctcttcttccacttcctcgccgccgcggacggcggcggccccggcgcgggagccccggaggtgggcgagctccggagcgcgctggccgcgtcgttcccctcgctgcggttcgagatctacccgttccgcgccgacgcggtgaccgggctcatctcggcctccgtgcgcgcggcgctcgaggcgccgctcaactacgccaggaaccacctcgccgacctgctccccaggtgcgtgccgcgggcgatttacctcgactcggacgtgctggccgtcgacgacgtgcggcgcctctgggagacccgcctgcccgccgccgccgtcgtcgcggcgcccgagtactgccacgccaacttctcccgctacttcaccgacgccttctggtccgaccccgacctgggtgcgcgcgtcttcgcgggacgccgccgcgcgccctgctacttcaacaccggcgtcatggtcatcgacctcaggcgctggcgttccggcaactaccgccaccgcatcgagcagtggatggagctgcagaaggagaagcgaatctacgagctcggctccttgccccctttcttgcttgtcttcgccggcgaggtggaggccgtcgaccatcggtggaaccagcacggtctgggcggtgacaacgtgctcggcagctgccgccccctccacaagggtcctgtcagcttgatgcactggtcagggaagggcaagccatgggatcgcctggacgccggcaggccttgcccgctcgaccacacctggaagtcatacgacctctacgtcgacgatggcgatgcgtcgtcggcatcagcgccttcccggacctcgttgtcgtcatcggcattgcccgcggcggtgttttcttggtagacagatacggcacatacactattattttttcatttgggtgccttggttcgtgggcggtgatggaattgccttgcaattcattgccactgcagccacagctgccactgcaagccagctgccgccttcggctgtacagcgcggagaggggcggcacattgcagcggcagcaaggagaagaggaacagtgcataggggaagcaaattcttgttcgtttgcgatacaattcagattgattcattatgctttgaccacggggttgccagactatggggtgttggagttacttgattggtggttgtacaattcttggataggataaaagctttcagtttctttttgtgtattagttcagaattgtttcattttacgtgatcattcagtgaacccgtataaatattgattgaattggttgtccttcaataaaacacagtggatcctattcttgttgctgctgtgccaaaactctgttgtatctgtcactcttcattcggaaatgcattcagaatgggctacctctctttgcattttacatctttcagagtggccaaatctacttctatttctagtttgctcgctcagttaatccagattggcctaatctatgctgttcctattttgcctgccatgttcatacacatgacctaatttattgctgtttttctgtcttgcttactgtgatcatccagaattgcctaatgcctttttggttatggagtttcagccaattgtatgatctactagtaaatgctcatctgttttgtagaca

SEQ ID NO: 5992 - DNA, 1769 bp, Oryza sativa
ggcggattcgatcgcctccgccctcgccctcgcctcgcctccgcctcgctcgccacccacccccgcacatacaagcgcgacgaggaagaaggggacgccgacctccaagaacccaccccaacccccccgagggtgggaggaggaggagggaatcgaggccggaggcgccggatatggggggcaatccggcgatgcgggccggattggcgttggtggtggtggtggtggcggtggtggtgggggatgtgggcgcggcgttgccgaggttcgcggaggcgccggagtacaggaacggggaggggtgcccggcggcggtggcgggggcgggggtgtgcgacccggggctggtccacatcgcgatgacgctcgacgcgcactacctgagggggtccatggcggccatctactcgctgctcaagcacgcgtcgtgcccggagtcgatattcttccacttcctggcggcggcggacggcggcgaggggtgcgggggtggggtcggggagctgaggaccgccgtggcggcgtcgttcccgtcgcttcggttcgagatctacccgttccgcgctgacgcggtcaccgggctcatctcggcgtccgtgcgcgccgctctcgaggcgccgctcaactacgccaggaactacctcgccgacctgctccccaagtgcgtcccgcgggcgatatacctcgactccgacgtgctcgccgtcgacgacgtgaggcgcctctgggagacgcgcctgcccgccgccgccgtcgtggccgcgcccgagtactgccacgccaacttctcccgctacttcaccgagaccttctggtccgacccgcagctcggcgaccgcgtcttcgccgggcgacgccgcgcgccctgctacttcaacaccggcgtcatggtcatcgacctccggcggtggcgcgtcggcaactaccgtcgccgcatcgaggtgtggatggagctgcagaaggagaagcgaatctacgagctagggtcgctgcccccgttcttgctggtgttcgccggcgaggtggaggccgtcgaccaccgctggaaccagcacggattgggcggcgacaacgtcctcggcagctgccgccctctccacaagggccctgtcagcctcatgcactggtccgggaagggcaagccatgggaccggctcgacgccggcaagccttgcccgctcgaccacacttggaaatcatacgacctctacattgcagagggtgattcatcttcagcatcagcaccgttcgcattgtcatcatcggcattgcctgcggcggcattttcttggtagacagctaatgagtatacacaataattctttcattgaggttgccttgtggagctgtgtgtggtgatggaattgctttgcaattcattgccacagccatcacagctgccaccacaagccagctgccgccttcggctgtacaggacagtgaaggggaggggcggcacactgcggtggcgcacaaagggaagatggagaatagaggaagcaaattcttgttcatttgtggtacaattcagattgattcgttaggcttcggtttggaggtggctgactttggggggatggaattacttgattggtggtgtacaattcttggataggataaaggtttcatttttttgtctattagttcagaatccacatgtttgttcgctgaactcgcataatattgattgaattgatttgaatcaaaatgagttgatcccatccttgtgtctgagctgaaacaatgttgcatctatagctcatcctgaa

SEQ ID NO: 5993 - DNA, 1505 bp, Avena sativa
tcctggttgggcggttcttggccggcgatcggggcgggggtagtcggcggggggaggcggctgccgaggttcgcggaggcgcccgagtaccggaacggggagggctgcccggcgcccgtcgcgggggccggggtgtgcgacccgggcctggtccacatcgcgatgacgctcgacgcgcactacctcaggggctccatggccgccatctactcgctgctcaagcacgcctcctgcccggagtcgctcttcttccacttcctcgccgccgacgccgccgcgccaggggtaggcgagctcaggagcgcgctcgcagcgtcgttcccctccctgcgcttcgagatctacccgttccgcgccgacgccgtcacgggcctcatctcggcctccgtgcgcgccgcgctcgaggcgccgctcaactacgccaggaactacctcgccgacctgctccccaagtgcgtgcccagggcgatatacctcgactccgacgtgctcgccgtcgacgacgtgcgccgcctctgggagacgcgcctgcccgccgcggccgtcgtcgccgcgccagagtactgccacgccaacttctcccgctacttcaccgacgccttctggtccgacccggagctcggcgcgcgcgtcttcgcgggccgccgccgcgcgccctgctacttcaacaccggggtcatggtcatcgacctccggcgctggcgttcgggaaactaccgccaccgtatcgagcagtggatggagttgcagaaagagaaaagaatctacgagctggggtctttgccccctttcttgctcgtctttgccggcgaggtggaggctgtcgaccatcggtggaatcagcacggtttgggcggtgacaacgtgctcggtagctgccgccccctccacaagggtcctgtcagcctgatgcactggtctggcaagggcaagccatgggatcgcctcgacgccggcaggccttgtcctcttgaccacacctggaagtcatacgacctctatgttgaccaaggtgatgcatcgtcagcatcagcgccgtccctgacctcattgtcgtcatcggcattgcccgcggcggtgttctcttggtagaaagatatacagcacacgctacaattcttttcatttggggtgcttgggtttgtcggtggcaacgcaattgccttgcaatgcattgccactgccaccatagctgccaccgttagccggctgccgccttcggctgtacagcaaggggaggggcggtacattgcagcggctgcgaaaggaagaggaacagtgcatagaggaagcaaattcttgttcatccgggatacgattcagattgattcattatgctttggttctgatggggtgttggaattacttgattggtggtgtacaattcttggatagtaggaagataaaggtttcacttttttgtctgttatagttcaggattgtttcatttacatgtctgttcagtaaacccgtataaatattgatttaattgatttcaataaaac

SEQ ID NO: 5994 - DNA, 1367 bp, Sorghum bicolor
ggataacgaagggataagctgggcaacggccactcccatccccgcacttcaccggcctccgcctcctccctcccctccatcgccgtcgccggggcgctctacagctcaaaatggcggccaccgccaccgccaccgccatggccatagcaactatctccccctcggctccgatcccttccgcgcccttcccatccctccccctccgcctccgttctcaacccctcctcgctgcctcccgccgcctcctcctccctgtccccaaggcctcctcctgggacgaatccgtcgccgaggagggaggagacacggaggaatccgccgccgctggggatgaggaggacgaggacgagaagccgcggccggagccggtgtcgtcctccgagttccagttcgcggcgccccccgagggctacgtggagcccgcggcgttcgacgagctgcctccggagtccccagaagacgtggcggcggcgtacgagtcgctctacgggccggccttcagcggcgagtcgctgctggggaacaacgtctacgaggtcaaggtggtcgaccccatcgacatggaccgggagcagcgccccaacgacgatttcaccgagcgcgtcgtccaggtcaaccgcgtcaccaaggtcgtcaagggaggcaggcagctctcctaccgcgcaattgtcgtcgttggcgacatgaagggccacgttggtgtcggcgtgggaaaggccaaggaggtcacggaggccatcaccaaggccgccatgaacggccgacgcaaccttgtcacagtgccgctcactaagtactccacattcccgcacagagctgatgcggactatggagcagccagggtgatgctgaggcctgcttgccctggatctggtgttattgccggtggagctgtgcgggttgtgttggagatggctggtgtggaaaatgctctgggtaagcaactgcgcagcaagaaccccttgaacaacgcacgagccaccatcaaggcgacgcagatgatgaagcagttcaaggatgtcgccgaggagcgtggtgttccaatggaggagctatggaaatgataaaaacaaatcgaaaccgacccccctgcccccaccccctcccttttgtagcattctttctccttgcgctgtatttttctcaagttcttttttctgctgtgtctatctatgggatgggataaccccgcctcacgatttctttttgcatatctcttctgagatcgccagtagtgccaacatttacacgcaagtttacggtgaaaattgaatcagtgaaatctgaccttgtattatatgcattctcttcacatctgtacactaactcctggtagaaattcagaccaaagaatgaacagattcagc

SEQ ID NO: 5995 - DNA, 1751 bp, Panicum virgatum
agaaagggacggaaggaacgggagattacaattcacattgcgacttgaggtccgggtccgcttgtattgaggaagaataaggtgttctcagttcatacatgattcatcgggtctattcgaattgaaatactggccgcgctggatttgtgcgtgctacatttcccaacggtgtgcgtacttttcttaaatacccatcctttatttttcgcatattttggaacattcagttattgatttcttttttgaatttgagtccaacttcttttatttttggcacgggcgcacgggccgattcgtagccaaacgtaactagtccggcccgggtggcccaaccccgatccaacaaggttgcctgtagcctgtccgaacgccggataatgaagggaagggataagctgggcaacggccgcttctcatccatccccccgcacttcacccgcctgcgcctcctccctctccggggcgtcctccaactccaaaatggcggccaccgccaccatggccatggccactatctcccccaccacccccataccgaccgcacccttcccatcgctccccctcggcttccgcctcctcccccaaccgctcctcctctccgcctcccggcgcctcctcctcgtccccgtccccagggcctcatcctgggacgaatccgcccccgaggaggaaggcgaggcggaggagtccgagcaatcctccgccgccggggacgaggaggacgaggacgagaagccgcggccggagccggtgtcctcggccgagttccagttcgcggcgccccccgagggctacgtggagcccgcggcgttcgacgagctcccgccggagtcccccgaggacgtggccgcggcgtacgagtcgctctacgggcctgcgttcagcggcgagaccgtgctggggaacaacgtcttcgaggtcaaggtggtcgaccccatcgacatggaccgggagcagcgccccaacgacgacttcagcgagcgcgtcgtgcaggtcaaccgcgtcaccaaggtcgtcaagggagggaggcagctctcctaccgcgccatcgtcgtcgtgggcgacatgaaggggcacgtcggggtcggcgtgggcaaggccaaggaggtcaccgaggccatcaccaaggctgccatgaacggccgccgcaatcttgtcacagtgccgctcaccaagtactccaccttcccgcacagagctgatgcggactttggagcagccagagttatgttgaggcctgcttgccctggatctggtgtcattgctggtggggctgtgagggtcgtgctggagatggctggggttgaaaatgctctggggaagcagctgcggagcaagaaccccctgaacaacgcgagagctaccatcaaggcgacgcagatgatgaggcagtttaaagacgtctcagaggagcgtgggatcccaatggaggagctatggaaatgacagaaacactttcaaactaaccccccccccccccttcgtagcattctttctcctttttgctgtatttttcttgagttcattttctgatgtatctatgggataggataatcccgcctcacgatttcgcttcgcaaatctcttctggaatcagtgagttgtaccaacatttacacgcaagcttgggagatgaaaacgaatccatggtaatctatatatatgcagattctttccatctgtacaccgcgaggaccggaagagatttgaaccaaagaataaacagattcagcagcacgaatgcgtgcgtc

SEQ ID NO: 5996 - DNA, 1828 bp, Panicum virgatum
ggataacgaagggataagctgggcaacggccgctcccatccccccgcaatacttcacccgccggcgcctcccccctcccctcctccctcgccggggcgcccccctccgaaatggcggccaccgccagcaccgccaccgccgtggccatggccaccatctcacccaccacccccataccgaccgcacccttcccatcgctccccctcggcttccgcttccgcctccgcccccaacccctcctcctctccgcctcccgccgcctcctcctcgtccccgtccccagggcctcctcctgggacgaatccggccccgaggaggaaggcgaggcggaggagtccgaggaatccgccgccgccggggacgaggaggacgaggacgaggacgagaagccgcggccggagccggtgtcctcggccgagttccagttcgcggcgccccccgagggctacgtggagcccgcggcgttcgacgagctcccgccggagtcccccgaggacgtggccgcggcgtacgagtcgctctacgggccggcgttcagcggcgagaccgtgctggggaacaacgtcttcgaggtcaaggtggtcgaccccatcgacatggaccgggagcagcgccccaacgacgacttcagcgagcgcgtcgtgcaggtcaaccgcgtcaccaaggtcgtcaagggagggaggcagctctcctaccgcgccatcgtcgtcgtcggcgacatgaaggggcacgtcggggtcggcgtgggcaaggccaaggaggtcaccgaggccatcaccaaggctgccatgaacggccgccgcaatcttgttacggtgccgctcaccaagtactccaccttcccgcacagagctgatgcggactttggagcagccagagttatgctgaggcctgcttgccctggatctggtgtcattgctggtggggctgtgagggttgtgctggagatggctggggttgaaaatgctctggggaagcagctgcggagcaagaaccccctgaacaatgcgagagctaccatcaaggcgacgcagatgatgaggcagttcaaagacgtctcagaggagcgcgggatcccaatggaggagctatggaaatgatagaaacactttcaaactaaaacccccttctgtagcattctctctcttttttgctgtatttttcgagttcatttctgatgtatctatctatggaatagggataatcccgcctcacgatttggcttcgcaaatctcttgtggaatcagtgagtactaccaacatttacacgcaaccttaagagataaaaacgaatccatgaaatatgatctactgcatctgtacactgagaaattcaaatcaaagaatgaaccaattctgcagcacaaatgcttgcgtctgtacatgcaactcatcatctatctagcttcgcatgccacgccgagcatctgctggaaccggtcggcgccgcaggggatcctgagcacgcctcgctggccgtacccgaactgctgcgcggccatctccagaaccgccgccatgcatggctccccgagcatctcgacgcgcaccatgatccgccgctcctcgccgccgccgacgagcaccatgggcacgtagcctctcgggaccctcccgtcgtcgccgggcaacaaggcgaggacctctcgcgacggactcgggctccccttcaccgatccccgaaccgccgccattgctggtgcggaagatcggagctgagctttgcagattgaaggacgcggtatgatcgaagatttggtttgatcacctgggcactacttcaccgatgctttgtttgctccgttgagtgaggcacaactgcacaagt

SEQ ID NO: 5997 - DNA, 1194 bp, Setaria italica
ccctccctcgccggggcgccctccaactcgaaaatggcggccaccgccagcaccgccaccgccatggccatggccaccgtctcccccaccactcccaccccaacggcacccttcccatccctccccctcgccttccgcctccgcccccaaccgctcaatcctctgctgatccgcctcctcctccttcccgtccccaaggtctcctcctgggacgaatccgcccccggggaggaaggcgaggcagaggattccgaggaatccggcgccgcggccggggacgaagacgaggacgaggaggacgagaagccgcggccggagccggtgtcctccgccgagttccagttcgcggcgccccccgagggctacgtggagcccgcggcgttcgacgagctcccgccggagtcccccgaggacgtggccgcggcgtacgagtcgctctacgggccggcattcagcggcgagaccgtgctggggaacaacgtcttcgaggtcaaggtggtcgaccccgtcgacatggaccgggagcagcgccccaacgacgagttcagcgagcgcgtagtgcaggtcaaccgcgtcaccaaggtcgtcaagggaggcaggcagctctcctaccgcgccattgtcgtcgtgggcgacatgaaggggcacgtcggggtcggcgtgggcaaggccaaggaggtcagtgaggccatcaccaaggctgccatgaacggccgccgcaatctcgtcacagtgccgctcaccaagtactcaacattccctcacagagctgatgcggactttggagcagccagagttatgctgaggcctgcttgccctggatctggtgtcattgctggtggagctgtgagggtcgtgctggagatggctggggttgaaaatgctcttgggaagcagctgcggagcaagaaccctctgaacaacgcaagagctaccatcaaggcgacgcagatgatgaggcagttcaaagacgtcgcagatgaacgtgggatcccaatggaggagctatggaaatgatagaaacacattcacactgaaaacccgtttgtagcattctttctccttttgctgtatgtttcttgagttcattctctctgctgtaatctatcaatgggatggggataatcccggctcacgatttcgtttcgcaaatcccatctggaatctgtgagtagtgcatgccaacatttacac

SEQ ID NO: 5998 - DNA, 1602 bp, Setaria italica
tcccatccgcttcaccagcctgcgcctgcgcctcctcccctcccctcccctccctcgccggggcgccctccaactcgaaaatggcggccaccgccagcaccgccaccgccatggccatggccaccgtctcccccaccactcccaccccaacggcacccttcccatccctccccctcgccttccgcctccgcccccaaccgctcactcctctgcgcctccgcctcctcctcctccccgtccccaaggtctcctcctgggacgaatccgcccccggggaggaaggcgaggcagaggattccgaggaatccggcgccgcggccggggacgaagacgaggacgaggaggacgagaagccgcggccggagccggtgtcctccgccgagttccagttcgcggcgccccccgagggctacgtggagcccgcggcgttcgacgagctcccgccggagtcccccgaggacgtggccgcggcgtacgagtcgctctacgggccggcattcagcggcgagaccgtgctggggaacaacgtcttcgaggtcaaggtggtcgaccccgtcgacatggaccgggagcagcgccccaacgacgagttcagcgagcgcgtagtgcaggtcaaccgcgtcaccaaggtcgtcaagggaggcaggcagctctcctaccgcgccattgtcgtcgtgggcgacatgaaggggcacgtcggggtcggcgtgggcaaggccaaggaggtcagtgaggccatcaccaaggctgccatgaacggccgccgcaatctcgtcacagtgccgctcaccaagtactcaacattccctcacagagctgatgcggactttggagcagccagagttatgctgaggcctgcttgccctggatctggtgtcattgctggtggagctgtgagggtcgtgctggagatggctggggttgaaaatgctcttgggaagcagctgcggagcaagaaccctctgaacaacgcaagagctaccatcaaggcgacgcagatgatgaggcagttcaaagacgtcgcagatgaacgtgggatcccaatggaggagctatggaaatgatagaaacacattcacactgaaaacccgtttgtagcattctttctccttttgctgtatgtttcttgagttcattctctctgctgtaatctatcaatgggatggggataatcccggctcacgatttcgtttcgcaaatcccatctggaatctgtgagtagtgcatgccaacatttacacccaagcttcagagatggaattgaatcgatgaaatttgacctacatataatgcaaattcttcccatctgtacaccgaggacgggaagaaattcaaaccaaagaatgaacaaattcagcagcacaaatgcgtgcaattcatctatgtagcggcgcacgccgcccgaccatttgctggaaccggtcggcgccgcaggggatccggagcacgcctcgctggccgtacccgaactgctgcgcggccatctccagaacggccgccatgcatggctccttgagcatctcaacgcgcaccatgatccgccgctcctcgctacctccctcgtcgtcgccgacgagcaccatggggacgtagcctctcggg

SEQ ID NO: 5999 - DNA, 1298 bp, Oryza sativa
gaccgccgcacttcatcccccctcccctccctccctccgccggagcgccgtctcaaaatggccgccacctcctccaccgcctccgccatggcggtggccgccacctcccctaccattgccactgcgccattctcgtctcttcctctctgccttcgcctccgccccaaacccctcctcttcacttctcgcctcctcctccccgtccccaagtcctcctcctgggttgaatccgtctcggaggaaggggaggaagaaggcgtggaggaggattccgaggaatccggtgccgcgggggaagacgatgacggggaggacaacgacgaaaagccgcggcctgagccggtggccgcctctgggttcgagttcgcgtcgccgccggagggctacgtggagccggccccgttcgacgagctgcccccggagtcgcccgaggacgtggcagcggcgtacgaagcgctctacgggccggcctttagcggcgagacggtcatgggcaacaacgtcttcgaggtcaaggtggtggatcccgtcgacatggaccgggagcagcgccctagcgacgagttcagcgagcgggtcgtgcaggtcaatcgcgtcaccaaggtcgtcaagggcgggaggcagttatccttccgtgcgatcgtcgtcgtcggcgacatgaagggccacgtcggtgtgggcgttggcaaggccaaggaggtcaccgaggccatcaccaaggccgccatgaacggccgtcgcaatctcgtcaccgtgccgctcaccaagtattcgaccttcccgcatagagcagatgcagactatggagcagccagggtcatgttgaggcctgcttgccctggatctggtgtaattgcaggtggagctgtgagggtcgtgctggagatggctggggttgaaaatgctctggggaaacagctgaggagcaagaaccccctcaacaatgcaagagctaccatcaaggcgacccaaatgatgaggcagttcaaggatgttgctgcagagcgcgggcttccaatggagcagctatggaaataatcaaataaatcaaccttaaattccctccaatatttttctttctccatttcttgagttcattttcagttgtatctgtcagtggggataatcctacatttaagtcctctccccaccctaaatgcattatgtgtctccacatatacatggcaaagctttagatgaattgatctgcgaatacctttagcttcactagtaatagtgcatgtgcaagacacgttccgcacgtataaattcgagtttattatgttttcccactatgc

SEQ ID NO: 6000 - DNA, 1751 bp, Sorghum bicolor
ctccactagagcagtgcgtgcacggtgcaggtgcacacacatggatcccttttgactgttcgttctagatctagcgattagcgacacttgctcgcaggagattctcgcaagaacagctcaccggcagtagcaacatgccaatatcataagcacaatcgcaagctgcatccaggtcgcagctggccaccagcacgtacccacaactcccaagctagcagcggtggttggcacgtcgcagttgatacggaggcgtagccgcgtagctgtactggttctcccgcgtcggcgtcgacggccgtctccctcccgggaagatggtcatggggcgcgcgtccgccgccacggtgctcgtcgcgctcgccgtcctcgctctggcggtgatggcgcaggcgacctgcgacgacgagctgccggctcagcttgccggcaacttctcggggctcgcctgcgcccccgtctggaacaacttcgtgctccggtacgcgcagggcaaggacaacgtgctgcgggtggtgctgtcgaccatgtacagcacagggtgggtggggatggggttctccaagaacggcctcatggtgggctcgagcgccatggtggggtggatgggcaagacaggcgtcccgcacatcaagcccttctcgctggagggcaagaccccctccaaggtggtggcggaccagggcttcctcgcctccagcgaccaccacaagcccaccgtgctcgtgcagcaggccaagatctacctcgccttccagctcagcttcaccgagccgctcaagagccagaacgtgctcttcgccattggctccgccatccccgtcaacgaccacctctccgagcaccaggacaagaccgccatcgtgtttgatttcaccacaggcagcgcttcaagctcatcatccttcccggacggtctgaaaaggacccatggggcgctcaacttgttcgcgtggggtgtgctcctgccaattggtgccattgttgcaaggtactgcaggagatgggaccccctctggttctacctccatgccggtatccagttcgtgggattcatcctgggtctggccggcgttgtggctggagtatcattgtacaacaagatccaagccgacgtcccggcccataggggccttggcatatttgtgcttgtgctaggcattttgcagatcctggcaattttcctgaggcccaataaggactccaagtaccgcaagttctggaactggtaccaccactgggtcggcaggctcgccctcttctttgcagccatcaacattgtgctcgggatcaaggtcggcggcgcaggcaactcttggaagatcggctacggtttcaacctggccatccttctgatcaccatcatcacgctggaagtcctgctctggacaaggtggaaaaacaacagcggttccacgggggcatattagcagcgacttaccgatttatttaggtgttcgtgatggtcactgaaggaggtccatattcttctttcaatgttttcaagtgtaatgttcgcgtgtgctgcaggatctgttatagcggcaaagatctgcaagcaagacgagtatgcgtgatgcgttttggtgtttgttagaactggtcagaaaagcttgataggatgtgcgacgggcttgccgttccggtgccttttgtactgcacggagtggagttggaatgatgatttccgcatttcccttggtgtgtactatggtggtagatctgggccttgtttacttcccaacaaattttgc

SEQ ID NO: 6001 - DNA, 2275 bp, Panicum virgatum
gggtctcggtagtatatcgcttctgaacaggatccggttcaagactcgatatgttatcaggtggttgcagctacccaaggtggctgcagcgaaccagagtatatatatgtgtgattttatataccgcagtactgcacattgagagggttggatggaggaagaacatgcttgcatgtgtaggcgtgaatccgagcgtttttcttaaaagaccccaacctggcaacatgtttctaccggcgtgttatgcggcgttggaacgttagttctccgtatatgttctgtaattttctgatatcctctgttatggcagctgttaagatggagttcaaattcaaactagaccctgatacatgtcgacgcttgataacacattcagttttgaaatgcactgaatttaccggaaactcaaaagttcctctagaactcaaaccgaaagagcgcgatttgaacttgagatttgccagaaaccatcgtaatccacctcaaagattagtgtataaatcactgcattttctgaatgacacgaaaacaaggcaagcacaatcccagaaagctccaagtagcgcgtgcgcacacatggatcccctttgcctgttggttccagatctggcgagctcgcaagcacacatggccgctagcagcatgccaatatcataagcgtaatggcaagctgcatccaggttgcagctgccgcctgccgcctccaccaagcagaagcagctcgttccggaggccagtaaaggtaaagctagtaccggtggttggcacgtcgcagttgataggccgctgcccgctgcaccccacttctcccacgtcgccggctccggttccctgacgcggggaaggggaatgctgggaatggggcgcgcgtccgtcggcgcgctgcttgtcgcgctcgccgtcctcgcgccggcggcgacggcgcagtcctgcggcgacgagctgccgacccagctcgtcggcaactactcggggctcgcctgcgcccccgtctggaacaacttcgtgctccggtacgcgcaggacagggacaacgtgctgcgggtggtgctgtcgaccatgtacagcacggggtgggtggggatggggttctccaaggacggcctcatggtgggctcgagcgccatggtggggtggatgggcaagacgggggtcgcccacatcaagcagttctcgctgcagggcaaggtcccctcgcaggtggtcgtggacaagggctccctcgtctccaacgaccacgaccacaccgtgctcgtgcagcaggccaagatctacctcgccttccagctcaggttcaccgcgccgctcaagcgccagaacgtgctcctcgccatcggctccgccatccccgtcaacgaccgcctctccgagcaccaggacaagacctccatcaccttcgatttcaccacaggcagctcttcaagcgggtcatccttccaggaaggtctgaaaaggactcatggggcgctcaacttgttcgcgtggggtgtgctcctgccaattggcgccatcgtcgcaaggtactgcaggagatgggaccctctgtggttctacctccatgccggcatccagtttgtgggattcatcctgggtctggccggcattgtggctggagtatcattgtacaacaagatccaagccaacgtccccacgcacaggggcctcggcatatttgtgcttgtgttaggcatcttgcagatcctagcaatcttcctgaggcccaacaaggactccaagtaccgcaaattctggaactggtaccaccactgggtaggccggctcgcgctcttctttgctgcgatcaacatcgtcgtcgggatcaaggtcggcggtgctggcagctcgtggaaggtcggctacggttttaaccttgctgtcctcctgatcaccatcatcgccctggaagtcctgctgtggacgaggtggagaaataacagcagctctacgacggcatactaaggacgatcagtttcttgtgtcgtggtataactgaaggaggttcatattcttttgatgtttctgtgtgctatgctgttgctgtagcgttcatgcgtgctgcggggtcttttgtagcagcaaagatctgcaagatcaatagcctatatgatgacatttttgcccttttggcttgtaaaatcatgagacggtcagcggacttgtctgtgttcaggcttgccgttccggtgcttttgggatttaggagtgctccaaatggaaagggatggtttgcgcatttccctttgtgtgaatggtcaatgatggatctttttctgcc

SEQ ID NO: 6002 - DNA, 1640 bp, Oryza sativa
atccatcaagtcgcacttgccactccaccagcctctgcctccctctccctcccaaatcgccgagaaaagaaggagataaaataatcggcagttcggtttccagcttccagcaattgcgattttgggtgattagctccagcagcagataggtgattagttctttcagactttcaccgtttcacgtcgccggccggcgggacacccggcaaatggcgcgcgccggtgcggtgctcgtggtggtgctcgccgcggcgtcggtgctgttggcgccgtgggcggcgacggcgcagacatccagctgcgacgacgcgctgcccccggcgctcgccggcaactactccgggctggcctgccgcccggtctggaacaacttcgtcctccggtacgcgcaggggaaggacaacgtgctgcgggtggtgatctcgtcgatgtacagcacggggtgggtggggatggggttctccaaggacgggatgatggtgggatcgagcgccatggttgggtgggtcggcaagacggggctgtcccacgtcaagcagttcagcctccgcgggaagacgccgtcgcaggtggtcgccgacgagggcttcctccaatccaaggaccacgaccacaccgtcgtggtgcagcaggccaagatctacctcgccttccagctcaggttccagtcgccgctcaggcggcagcaggtgctcctcgccttcggcaacgccatccccgtcaacgaccgcctcactgagcaccagggcaagacgtccttcaccttcgatttcaccactggcagctcttcaggttcgtcttacccggatggtctgaagagggcccatggggcactcaacctgtttgcctggggagttctcctgcctatcggtgctatcatcgcgcggtactgcaggagatgggaccctctgtggttctaccttcacgccggcatccagcttgtgggcttcatccttggtctggctggcattgtggccggagtatcgttgtacaataagatccaagcagatgtcccggcgcataggggccttggcatatttgtgcttgtgctgggtatcctgcagattctggccttcttcctaaggcctcacaaggactcaaaatatcggaaatactggaactggtaccaccattgggtaggcaggcttgcgctcttctttgcagccatcaacattgtccttggaatcaaggtcggagccgccggcaactcgtggaagatcggctatggcttcaacctggccatcctcctgatcaccattatcaccctggaggtcctgctatggacaaggtggaaaaacaacaacagcagttcgatgccaacatattaagtgtgattaaattaggttgatcttgtcgctgtaacttataactgaaggccctattcttccattagtttcttttaatggttgtaccatttgtgtgatgctgttgctttgatgtttctgcaagatcttttagcagaaaccaaagatgtagtacaagactagtcagttgatgtcttgatgatgagctgtgacgtgcaaaatgacgaggtgaacacaactggtaattgtaatgcagtggcaaaggtgtagtattatactccctccgtttcaagttgtaagatgcgtttcaagttataagatgttttgatttttatc

SEQ ID NO: 6003 - DNA, 914 bp, Zea mays
cgccagtgagtgaacaccagccgtcttggcccgctccttccctgctgcggccatggcgacctccgcggcgctctcgaccgccgccaaccccacccagctctgccggtcccgcgctgcgttgggcaagccagtgaaggggcttggcctggggatggggcgggagcgcgcaagccagcggagcatcacgtgccaggcggcgagcagcatccccgccgaccgcgtccccgacatggagaagcggaagctgatgaacctcctcctcctgggcgccatatcgctgcccaccgtcggcatggtcgtcccctacggcgccttcttcgtccccgccggctccgggaacggcggcggcgggacctacgccaaggacaagctgggcaacgacatcacggtggaggagtggctcaacacgcacggtcccaacgaccgcacgctcgcgcaggggctcaagggtgaccccacgtacctggtggtggagcaggacaagacgctggccacctacgggatcaacgccgtgtgcacccacctcggctgcgtcgtgccgtggaacggcgccgagaacaagttcatctgcccctgccatggatcccagtacaacaaccagggcaaggtggtccgcggaccggcgcctctgtcgctggccctggttcacgccgacgtcgacgacggcaaggtcctcttcgtcccgtgggtggagaccgacttcaggaccggccaggacccgtggtggagtgcatgaggaggatcatccgacacaagcggtgctcagtactcataggctttctccgagggcgttgttgctacaaattcacttgcctcttgcctccaaattatatatattacacacactgcatgaaacaagaacacagctgtttgtcatctcttcactataaccttttgaacactctgaaatctgc

SEQ ID NO: 6004 - DNA, 882 bp, Sorghum bicolor
ccgatcctcacctgctgctgcagccatggcgaccaccgcggcgctctccacggccgccaaccccacccaccagctctgccggtcccgcgctacgctgggcaagccagtgaaggggcttggcctggggatgggcagggagcgcgcccagagcatcacgtgccaggcggcgagcagcatccccgccgaccgcgtccccgacatggagaagcggaagctgatgaacctcctcctcctcggcgccatctcgctgcccaccgtcggcatggtcgtcccctacggcgccttcttcgtccccgccggctccggcggcgccggcggcgggacctacgccaaggacaagctgggcaacgacatcacggtggatgagtggctcaagacgcacggtcccaacgaccgcacgctggcgcaggggctcaagggtgacccgacgtacctggtggtggagcaggacaagacgctggccacctacgggatcaacgccgtgtgcactcacctcggctgcgtcgtgccgtggaacggcgccgagaacaagttcatctgcccctgccatggatcccagtacaacaaccagggcaaggtggtccgtggaccggcgcctctgtcgctggcgctggttcacgccgacgtcgacgacggcaaggtcctcttcgtcccgtgggtggagaccgacttcaggaccggcgaggacccgtggtggaaggcatgaggaggatcccacaccagcggtgctcagtgctcacagatgacctatgtatggtgcctcctgtgtcgctgtgatgaggtcatagacttgccttgcgttcgttctccaagggcgtacaaactcacttgcttcttgcctccaaattatatatatgtacacaaactgtatgaaacaccaac

SEQ ID NO: 6005 - DNA, 948 bp, Saccharum officinarum
cgggggctcatccgcaagcctgtggacgccagggagtgaacaccagccgtcttgccccgactccgaccgatcctcacctgctgcagccatggcgacctccgcggcgctctccacggccgccaaccccacccagctctgccggtcccgcgctacgctgggcaagccagcgaaggggcttggcccggggatgggccgggagcgcgcccagagcatcacgtgccaggcggcgagcagcatccccgccgaccgcgtccccgacatggagaagcggaagctgatgaacctcctcctcctgggcgccatctcgctgcccaccgtcggcatggtcgtcccctacggcgccttcttcgtccccgccggctccggcggcgccggcggcgggacctacgccaaggacaagctgggcaacgacatcacggtggatgagtggctcaagacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaatagcgccgagaacaagttcatctgcccctgccacggatcccagtacaacaaccagggcaaggtggtccgtggaccggcgcctctgtcgctggccctggttcacgccgacgtcgacgacggcaaggtcctcttcgtcccgtgggtggagaccgacttcaggaccggcgaggacccgtggtggaaggcatgaggaggatccgacaccagcggtgctcagtgctcacatatgacctatgtatgcgttcgttctccgagggcgttgttgctacaaattcacttgcttcttgcctccaaattatatatatgtacacacactgtatgaaacaataacatctgtttctcatatcttcgtatactagtacattgcgcgcg

SEQ ID NO: 6006 - DNA, 1022 bp, Avena sativa
ctagctcgctcgatcgtcgcctccgccctgcagcagctgccatggcctccaccgcgctctccaccgcctccaaccccacacagctctgccggtccagagctcatgtgtgcaagcccgtgaagggcctaggcctgggccgggagcgcatcccgaggaacatcacatgcatggccggcagcatctcggcggaccgcgtcccggacatgagcaagagggagacgatgaacctcctcctgctcggcgccatctcgctcccaaccttcggcatgctcgtcccctacggctccttcctcgtcccagccggctcaggaagcaacgccggtggagtcgtcgccaaggacaagctcggcaacgacatcctcgtctcggaatggctcaacacgcacggccccaacgaccgcacgctcgcccagggactcaagggtgatcctacctacctggtcgtggagtccgacaagaccctcgccacctacggggtcaacgccgtctgcacgcatctcgggtgtgtcgtgccgtggaacgccgccgagaacaagttcctctgcccttgccacggatcccagtacaacaaccagggcaaggttgtccgtggacctgctcctctgtcgctggccctggttcacgccgacgtcgacgatggcaaggtcgtctttgtgccgtgggtcgaaaccgacttcaggaccggcgagaacccctggtggaagtaaggaacataagctccagccgcaatgctcacttctgtgatcatcccatatagcctcctgagaacgctgctataaatgcacctgtttcttgtatccaattatatgtatgtatacactctatgaaagaacagaaacttcctgattggatatatcacattttgagcactctgaatccggtaagacctttttatatctaaagatcagacctgaaggatatctcctgaatttggacaccttagacaggaacctctgaagaatgtaagagctaaaatagcatatcttcagcatcgtttcaaaagggtaatgaatagtcgatct

SEQ ID NO: 6007 - DNA, 1089 bp, Avena sativa
ctccacttcccaaaaggacatataacccgtgcctcatctgcaagcctgtggacacaggcagtgctagctcgctcgatcgtcgcctccgccctgcagcagctgccatggcctccaccgcgctctccaccgcctccaaccccacacagctctgccggtccagagctcatgtgtgcaagcccgtgaagggcctaggcctgggccgggagcgcatcccgaggaacatcacatgcatggccggcagcatctcggcggaccgcgtcccggacatgagcaagagggagacgatgaacctcctcctgctcggcgccatctcgctcccaaccttcggcatgctcgtcccctacggctccttcctcgtcccagccggctcaggaagcaacgccggtggagtcgtcgccaaggacaagctcggcaacgacatcctcgtctcggaatggctcaacacgcacggccccaacgaccgcacgctcgcccagggactcaagggtgatcctacctacctggtcgtggagtccgacaagaccctcgccacctacggggtcaacgccgtctgcacgcatctcgggtgtgtcgtgccgtggaacgccgccgagaacaagttcctctgcccttgccacggatcccagtacaacaaccagggcaaggttgtccgtggacctgctcctctgtcgctggccctggttcacgccgacgtcgacgatggcaaggtcgtctttgtgccgtgggtcgaaaccgacttcaggaccggcgagaacccctggtggaagtaaggaacataagctccagccgcaatgctcacttctgtgatcatcccatatagcctcctgagaacgctgctataaatgcacctgtttcttgtatccaattatatgtatgtatacactctatgaaagaacagaaacttcctgattggatatatcacattttgagcactctgaatccggtaagacctttttatatctaaagatcagacctgaaggatatctcctgaatttggacaccttagacaggaacctctgaagaatgtaagagctaaaatagcatatcttcagcatcgtttcaaaagggcaatgaagagtcgatctgttt

SEQ ID NO: 6008 - DNA, 1016 bp, Avena sativa
gcctgtggacacaggcagtactagctcgctcgatcgtcgcctccgccctgcagcagctaccatggcatccaccgcgctctccaccgcctccaaccccacacagctctgccggtccagagctcatgtgtgcaagcccgtcaagggcctaggcctgggccgggagcgcatcccgaggaacatcacatgcatggccggcagcatctcggcggaccgcgtcccggacatgagcaagagggagacgatgaacctcctcctgctcggcgccatctcgctcccaaccttcggcatgctcgtcccctacggctccttcctcgtcccagccggctcaggaagcaacgccggtggagtcgtcgccaaggacaagctcggcaacgacatcctcgtctcggaatggctcaacacgcacggccccaacgaccgcacgctcgcccagggactcaagggtgatcctacctacctggtcgtggagtccgacaagaccctcgccacctacggggtcaacgccgtctgcacgcatctcgggtgtgtcgtgccgtggaacgccgccgagaacaagttcctctgcccttgccacggatcccagtacaacaaccagggcaaggttgtccgtggacctgctcctctgtcgctggccctggttcacgccgacgtcgacgatggcaaggtcgtctttgtgccatgggtcgagaccgacttcaggaccggcgagaacccatggtggaagtaagcaacacaggctccagaagcagcaatgttcacttctgtgatcaccccatatagcctcctgagaacgctgctataaatgcacctgtttcttcttgtatccaattatatgtatgtatacactgtatgaaagaagagaaacttcctgattggatatatcacattttgaggactctgaatcaggtaagacctttttatatctgatgatcaaacctgaagggtggatatctcctgaatctggacaccaagatagcaatctcaagaatttgtgagctaaaatagcatatcatcag

SEQ ID NO: 6009 - DNA, 1130 bp, Avena sativa
caaaaggacatataacccgtgcctcatctgcaagcctgtggacacaggcagtgctagctcgctcgatcgtcgcctccgccctgcagcagctgccatggcctccaccgcgctctccaccgcctccaaccccacacagctctgccggtccagagctcatgtgtgcaagcccgtcaagggcctaggcatcggccgggagcgcatcccgaggaacatcacatgcatggccggcagcatctccgcggaccgcgtcccggacatgagcaagagggagacgatgaacctcctcctgctcggcgccatctcgctcccaaccttcggcatgctcgtcccctacggctccttcctcgtcccagccggctcaggaagcaacgccggcggtgtcgtcgccaaggacaagctcggcaacgacatcctcgtctcggaatggctcaacacgcacggccccaacgaccgcacgctcgcccagggactcaagggtgatcctacctacctggtcgtggagtccgacaagaccctcgccacctatggggtcaacgccgtctgcacgcatctcgggtgtgtcgtgccgtggaacgccgccgagaacaagttcctctgcccttgccacggatcccagtacaacaaccagggcaaggttgtccgtggacctgctcctctgtcgctggccctggttcacgctgacgtcgacgatggcaaggtcgtctttgtgccgtgggtcgaaaccgacttcaggaccggcgagaacccctggtggaagtaaggaacataagctccagccgcaatgctcacttctgtgatcatcccatatagcctcctgagaacgctgctataaatgcacctgtttcttgtatccaattatatgtatgtatacactctatgaaagaacagaaacttcctgattggatatatcacattttgagcactctgaatccggtaagacctttttatatctaatgatcagacctgaaggatatctcctgaatctggacaccttagacaggaacctctgaagaatgtaagagctaaaatagcatatcttcagcatcgtttcaaaagggtaatgaatagtcgatctgtttctggaaatgttacaagctcatggtttctcaagtatattaacattccttccg

SEQ ID NO: 6010 - DNA, 862 bp, Avena sativa
accgcctccaaccccacacagctctgccggtccagagctcatgtgtgcaagcccgtcaagggcctaggcctgggccgggagcgcatcccgaggaacatcacatgcatggccggcagcatctccgcggaccgcgtcccggacatgagcaagagggagacgatgaacctcctcctgctcggcgccatctcgctcccaaccttcggcatgctcgtcccctacggctccttcctcgtcccagccggctcaggaagcaacgccggtggagtcgtcgccaaggacaagctcggcaacgacatcctcgtctcggaatggctcaacacgcacggccccaacgaccgcacgctcgcccagggactcaagggtgatcctacctacctggtcgtggagtccgacaagaccctcgccacctacggggtcaacgccgtctgcacgcatctcgggtgtgtcgtgccgtggaacgccgccgagaacaagttcctctgcccttgccacggatcccagtacaacaaccagggcaaggttgtccgtggacctgctcctctgtcgctggccctggttcacgccgacgtcgacgatggcaaggtcgtctttgtgccgtgggtcgagaccgacttcaggaccggcgagaacccatggtggaagtaagcaacacaggctccagaagcagcaatgttcacttctgtgatcaccccatatagcctcctgagaacgctgctataaatgcacctgtttcttcttgtatccaattatatgtatgtatacactgtatgaaagaagagaaacttcctgattggatatatcacattttgagcactctgaatccggtaagacctttttatatctgatgatcaaacctgaaggg

SEQ ID NO: 6011 - DNA, 3266 bp, Triticum aestivum
ggcgggcggccatggcggtggcggcgccggggcagctgaacctcgacgagttcccctcctggggctcccgcggcgtcgactgcttcgagaagctcgagcagatcggcgagggcacctacgggcaggtgtacatggccaaggagacggagaccaacgagatcgtcgcgctcaagaagatccgcatggacaacgagcgcgagggcttccccatcacggcgatacgggagatcaagatcctcaagaagctccaccaccagaacgtcatccagctcaaggagatcgtcacctccccaggcccggaccgagacgagcaagggaagccaatcgacggcaacaagtacaaggggagcatctacatggtcttcgagtacatggaccacgacctcaccggactcgccgacaggcccgggatgcgcttcaccgtgccgcagatcaagtgctacatgaagcagctgctcacaggcctgcactactgccacgtcaatcaggtgctgcatcgagatatcaaaggttctaaccttttgatagacaatgagggtaacctcaagctggctgattttgggcttgcgaggtcgttctctagtgatcacaatggcaacctgactaaccgtgtcatcaccttatggtatagacctccagaactgcttctcggaagcacaaggtatggtccagctgttgacatgtggtctgtgggttgtatttttgctgagcttctcaatggaaagccaatcctgccagggaagaatgagccggagcagctgaccaaaattttcgagctttgtggcacccctgatgagttaatctggcctggtgtcactaagatgccatggtacaacaacttcaagcctccccgagtgttgaagagaaaagttaaagatgcctttaaacattttgaccggcatgctctggacctgttggagaggatgttaactttagatccatcacagaggataccagcgaaggaggcacttgatgcagagtatttctggactgatcccttgccatgtgacccgaaaagtttgccatcgtatgaagcatcacacgaattccagactaagaaaaaacgtcagcagcagaggcaagcggaggaagctgcaaagcgccaaaaaataaatcatcctcccccacattctcgcttgcctccgatccagcatccaggccaatcacaccagatcaggcctggccatgcgccacctgtggcaggtggctcgagccactatgcgaaacctcggggacctggagggcctaacaggtacccgcagggtgggaaccaaggcgcaggctataataacccgaaccgcggagggcaaggcagtggctatggcagcgccccgtatcctcagcaaggaagaggacctcctccgttccctgcagcaggtgctccacgcggtggtgccggcagtggctatggagtcggtggcccaaattacccaccaggcggtccgccgtatggcacgtctggtccaggccgaggaggccccaactatcctcaaggcggttctcgcaatcagcagcagtatggtagctggcaataatatttgtcatatcacgtcgcggtgatacgcccctccagttggagtatttttatttgtagaatctttgctgtccaaattctactttctgtgattgttgcgcaacagctcttaaggtacgtcctttatgattcaagctgtattttatcaatgtataaactgagattgtagcacaacaggctattgcagtgtctcgtttatgattcaatttgtatgttatgaatacacgaaatgtataatcaccttatgattcaagctgtatgttatgaatgtatgaccattaatgagatgttcttgtagcatgcaagtctgaagaaaagtttgctatcaagtactcttctctgttagtactcttgctcaatgtatctgcaacgtgcatatacatacttgcttctttgggacttaatcacaagaatcatataaacacttgcttctaaggatcaacgatagagacaagtgaggcggacgtgtcaacgactgaaccaaaaaagctgtaattgttgaaaagattgcttctaataagttctagcatgttagccaaaatcttgttacatgagaaacactagtaacagggtcaaatttatgggaaaatggcttcaacaaatgcctctgcatcaaaaggttggagatcttccaccccttcgccgacgccaacaaacttgactggaattccaagttcgtctaccacgctcaccacgcagccaccacgagcagtcccgtctaacttcgtcaggatgaatcctgtgattccaacaacatcgttgaactccttcgcttgctgtagcatatttaatccagttgtgccatccagaaccagcaagatctcattaggagcaccaggcagggctttagctatgactttcttgcaagaaaccaactcttccatcagaccgtaatttgtatgaagtcgtcctgacgtatcacacagcacaacatcaaatccttcacgcttcccacgttttactgcctgcgaaagaactgatggagcctgtgccttcttatcattatcgataacaatctctgagccagtcctctcagcccaaatttctagctggtcacgagctgctgcccggaaggtatcacctgctgccatcaataccttggctccttcattcttaaatctgtaggcaagttttcctagcgatgtcgtcttgccgcctccgttcactcccacaatcatgatgactgccggcttcctgaagccgagctgcagctcagtcttgctgcccttggtcgtgagcagctcgaggatgcatctcttcagcgacgccttgatctcggtcccggacttgagcttgccgtcgcggatctggtcgcggagggtgtcgacgatccggaacgagatcttgggcccgaagtccgacaccagaagcgcctcctcgaggtcgtcgaggacgcggtcggtgtcggcgaggttccagtaggtgaggagctcgtcgacgacggagaggttctcgcgggtcttggagaagccggagaagagcttgtcgacgtcgctcttggccttctccttgatgaggcggccgaggcgggtgaagaagccggcctgcccggcggtggccgcgcagcggagacggccggagggggcgcgcagggaggcggaggcggcggtgtacggcggcgagaggaaggggaggacgcgggagggtgccgacgccattcttgggcgctggctggctgcggataccggcgaagcgatgggtggtgggagaggatagagctgagcgagctggc

SEQ ID NO: 6012 - DNA, 1237 bp, Brachypodium distachyon
tccacccaatccgaagcgcccaaaaatggcggcaccctcccaccacgcgctgctccccttcctctcctccacggcctccccgcgcaccgccccctccgccggacgccgccgcctcctccgctgcgcggccgccgccgggcaggccggcttcttcacccgcctcggccgcctcatcaaggagaaggccaagagcgacgtcgacaagctcttctccggcttctccaagacccgcgagagcctctccgtcgtcgacgagctcctcacctactggaacctcgccgacaccgaccgcgtcctcgacgacctcgaagaggcgctgctggtgtccgacttcgggcccaagatctcgttccggatcgtcgacaccctccgcgacgagatccgcgacggcaagctcaagtccgggcccgagataaaggcgtcgcttaagagatgcatcctccagctgctgaccagcaagggcagcaacaccgagctgcagctcggcttcaggaagccggcggttatcatgattgtgggggtgaatggaggtggaaagacgacatcactaggaaaacttgcttacagatttaagaatgaaggagtgaaggtattgatggcagcaggtgataccttcagagcagcagctcgtgaccagctagaaatttgggctgagagaactggctcagagattgttatcgataacgataagaaggcacaggctccatcagttctttcgcaggcagtgaaacgtgggaagcgtgaaggatttgatgttgttctatgtgatacgtcaggacgactccatacaaattacggtctaatggaagagttggtttcttgcaagaaagtcatagctaaagccctgcctggtgctcctaatgagatcttgctggttctggatggtacaactggcttaaatatgctgcagcaagcgagagaattcaacgatgttgttggaatcacaggattcatcctgacaaagctagatggcactgctcgtggtggctgcgtggttagcgttgtagatgaacttggaattccagtgaagtttgtcggcattggcgaaggagtggaagatctccaaccttttgatgctgaagcatttgtcgaagccattttcccataaattttggttttggaagaaaaaaaaatccttttctcatgtacatccacgaatatcctgtcttgtcattagtgtttatcatgtaacaagattcagctaacatgctagaagttagaagcaaagctttgacca

SEQ ID NO: 6013 - DNA, 1243 bp, Brachypodium distachyon
gctctatccacccaatccgaagcgcccaaaaatggcggcaccctcccaccacgcgctgctccccttcctctcctccacggcctccccgcgcaccgccccctccgccggacgccgccgcctcctccgctgcgcggccgccgccgggcaggccggcttcttcacccgcctcggccgcctcatcaaggagaaggccaagagcgacgtcgacaagctcttctccggcttctccaagacccgcgagagcctctccgtcgtcgacgagctcctcacctactggaacctcgccgacaccgaccgcgtcctcgacgacctcgaagaggcgctgctggtgtccgacttcgggcccaagatctcgttccggatcgtcgacaccctccgcgacgagatccgcgacggcaagctcaagtccgggcccgagataaaggcgtcgcttaagagatgcatcctccagctgctgaccagcaagggcagcaacaccgagctgcagctcggcttcaggaagccggcggttatcatgattgtgggggtgaatggaggtggaaagacgacatcactaggaaaacttgcttacagatttaagaatgaaggagtgaaggtattgatggcagcaggtgataccttcagagcagcagctcgtgaccagctagaaatttgggctgagagaactggctcagagattgttatcgataacgataagaaggcacaggctccatcagttctttcgcaggcagtgaaacgtgggaagcgtgaaggatttgatgttgttctatgtgatacgtcaggacgactccatacaaattacggtctaatggaagagttggtttcttgcaagaaagtcatagctaaagccctgcctggtgctcctaatgagatcttgctggttctggatggtacaactggcttaaatatgctgcagcaagcgagagaattcaacgatgttgttggaatcacaggattcatcctgacaaagctagatggcactgctcgtggtggctgcgtggttagcgttgtagatgaacttggaattccagtgaagtttgtcggcattggcgaaggagtggaagatctccaaccttttgatgctgaagcatttgtcgaagccattttcccataaattttggttttggaagaaaaaaaaatccttttctcatgtacatccacgaatatcctgtcttgtcattagtgtttatcatgtaacaagattcagctaacatgctagaagttagaagcaaagctttgacca

SEQ ID NO: 6014 - DNA, 1422 bp, Avena sativa
cggctgagctctatccacccacccatctcgctggtagtatccgcaccgcagcgcccaagaatggcggcaccctcccacgtcgtccccttcctctccccgtcctccgcctacgcctccctacgagccccctccggccgccccgctgcctcccacctccgctgcgcggccgccgccgggcaggccggcttcttcactcgcctcggccgcctcatcaaggagaaggccaagagcgacgtcgacaagctcttctccggcttctccaagacccgcgagaacctctccgtcgtcgacgagctcctcacctactggaacctcgccgacaccgaccgcgtcctcgacgacctcgaggaggctctgctggtgtcggacttcgggcccaagatctcgttccggatcgtcgacacgctgcgcgacgaaatccgcgacggcaagctcaagtcaggggcagagataaaggcgtcgctgaaaagatgcatcctcgagctgctgacgagcaagggcagcaacaccgaactgaagctcggcttcaggaagccggcggttatcatgattgtgggagtgaatggaggtggaaaaacgacctcgctaggaaaacttgcttacagatttaagaatgaaggagcaaaggtattgatggcagcaggtgataccttcagagcagcagctcgtgaccaactagaagtttgggccgagagaactggctcagagattgttatcgataaagataagaaggcacaagctccatcagttctttcgcaggcagtgaaacgtgggaagcgtgaaggatttgatatcgtcttgtgtgatacatcaggacgacttcatacaaattatggtctgatggaagagttggttacttgcaagaaagtcatggctaaagcccttcccggtgctcctaatgaggtgttactggttctggatggcacaactggcttaaatatgctacaacaagcgagggagttcaatgatgttgttggaatcacaggattcatcctgacaaagctagatggcactgctcgtggtggctgcgtggtgagcgttgtagacgaacttggaattccagtcaagtttgtcggtgtcggcgaaggggtggaggatctccaaccttttgacgcagaggcatttgttgaagccattttcccgtaaattttgattctggagaaatgatcattgttctcctcatgtgcatcctcaaaagttgtgttggccttgttattagtgtatttatttttccatgtacgtaacaagattttgctaacctgctagaagttgccgacgtctcactagtggtttcttccattcatcctagttgcggagtcctttgaaggcagaacagaagcaagcattcgtgattgctataatgtgaatcttgtgattagactacagattatttttgattaactaaggaagcattcattcaaa

SEQ ID NO: 6015 - DNA, 1433 bp, Setaria italica
accggagctccgtatccgcgacgcccggaaatggcggcaccctcccacgtcctccccttcctctcccccgccagcaccgcctcctccgtccgcgtcagcccgggccgccgctccggcctcctccgctgcgcggccgcggccgggcaggcgggcttcttcacccgcctcggccgcctcatcaaggagaaggccaagagcgacgtcgagaagctcttctccggcttctccaagacccgcgagaacctctccgtcgtcgacgagctcctcacctactggaacctcgccgacaccgaccgagtcctcgacgagctcgaggaggcactgctcgtgtcggacttcgggcccaaaatctcgttccggatcgtcgacacgctacgcgaggaaatccgcgatggcaagctcaagtccgggcccgagataaaggcatccctgaagaggtgcattctcgaactgctgacaagcaagggcggcaacccggagctgaatctaggtttcagaaagccggcggtcatcatgattgtgggagtgaatggtggtggaaagacaacctcgcttggaaagcttgctcacagatttaagaatgaaggagtgaaggtattgatggcagcaggtgatactttcagagcagccgcccgtgaccagctagaagtttgggctgagagaacaggttcagagattgtcatcgacaatgataagaaggcacagcctccagcagttctttcacaggcagtaaaacgtgggaagcgtgaaggatttgatgtggttctgtgtgatacatcaggaagacttcatacaaattatggtttgatggaagaattggtttcttgcaaaaaagtcatagctaaagcccttcctggagctcctaatgagattttgcttgttcttgatggcacaactggcctaaacatgttgcagcaagcgcgggagttcaatgatgttgttggagttacaggattcatcctgactaagctagatggcactgcgcggggtggctgcgtggttagcgttgtagatgaacttggaatcccagtgaagtttattggggttggtgaagggatggaagatcttcaaccctttgatgctgaggcatttgtggaagccattttcccatgaatttggattttgaagaaaaaaatcatgctcctactgtaaagtttttgacgctgtcattacttcagcttttcatgtaagattgttttcgtttacggcacggcatggtcatgaaccacaaggcacgagttgaagacctagatggggaatggtagccaggccagacattagttcgactgcttggtgcgttgtcagtgtctcagtgagggataacttatcgtccaatctgtaatgagttaagacttaagagtgagagggtttattcgtggagtatagacttgtgaaaattgtaccagaaggattcagagaaggaaatggaggag

SEQ ID NO: 6016 - DNA, 1970 bp, Setaria italica
gttttggtcgggccagcgagcgctatccacccatcaccggagctccgtatccgcgacgcccggaaatggcggcaccctcccacgtcctccccttcctctcccccgccagcaccgcctcctccgtccgcgtcagcccgggccgccgctccggcctcctccgctgcgcggccgcggccgggcaggcgggcttcttcacccgcctcggccgcctcatcaaggagaaggccaagagcgacgtcgagaagctcttctccggcttctccaagacccgcgagaacctctccgtcgtcgacgagctcctcacctactggaacctcgccgacaccgaccgagtcctcgacgagctcgaggaggcactgctcgtgtcggacttcgggcccaaaatctcgttccggatcgtcgacacgctacgcgaggaaatccgcgatggcaagctcaagtccgggcccgagataaaggcatccctgaagaggtgcattctcgaactgctgacaagcaagggcggcaacccggagctgaatctaggtttcagaaagccggcggtcatcatgattgtgggagtgaatggtggtggaaagacaacctcgcttggaaagcttgctcacagatttaagaatgaaggagtgaaggtattgatggcagcaggtgatactttcagagcagccgcccgtgaccagctagaagtttgggctgagagaacaggttcagagattgtcatcgacaatgataagaaggcacagcctccagcagttctttcacaggcagtaaaacgtgggaagcgtgaaggatttgatgtggttctgtgtgatacatcaggaagacttcatacaaattatggtttgatggaagaattggtttcttgcaaaaaagtcatagctaaagcccttcctggagctcctaatgagattttgcttgttcttgatggcacaactggcctaaacatgttgcagcaagcgcgggagttcaatgatgttgttggagttacaggattcatcctgactaagctagatggcactgcgcggggtggctgcgtggttagcgttgtagatgaacttggaatcccagtgaagtttattggggttggtgaagggatggaagatcttcaaccctttgatgctgaggcatttgtggaagccattttcccatgaatttggattttgaagaaaaaaatcatgctcctactgtaaagtttttgacgctgtcattacttcagcttttcatgtaagattgttttcgtttacggcacggcatggtcatgaaccacaaggcacgagttgaagacctagatggggaatggtagccaggccagacattagttcgactgcttggtgcgttgtcagtgtctcagtgagggataacttatcgtccaatctgtaatgagttaagacttaagagtgagagggtttattcgtggagtatagacttgtgaaaattgtaccagaaggattcagagaaggaaatggaggaggatgttgttattatccgttcgtcccctcagttcccagtcctttcctaccacagttctaactgattctttggatcatcgatctcgccagctacaatattgctaacacagtagtaagtcgaagaaaattgaatagctgtgaccgtctagagcagcatgaaaattgtgttaataacagcaaactctattgtctttgtaggatccttccagtggcatagacgcatagtacaacagcttgagtcattaacagcgtaatgttacgagatgtcttatcctattaaagtatcaattataagatgcatctcgcaaaaatcgcttcaattgcagaggtcctgcaaatacataggacaattggaatgacatttcagtggcacgatacatccatcttattgccagttcccgtactgctgctgattgcgggagccaccttgatagttgttgggtcctcgacctggaccggatgcaccatacgggccaccttgttggtagtttggtccaccagctc

SEQ ID NO: 6017 - DNA, 2503 bp, Panicum virgatum
cggcatccgcgacctcggcgcaccgcgtgcgagaggcagaaagggggaggtggagaacgcgggtcgacgcgtcagcggcagagcgcgtggagccgccgccgccgctcttgctccggcctcgggatgctctgtctctgtgggagagcaagcagagagccatgggcggggcaggcggtgcacgtgacggcacgccttgcctcgtcacgcggccgtggcggtggacgccagcagcgaataaactggctggcttccacaacgtttacaatgtgccgagccacactttgaataataatactaatgaatactcaccgccagcggatatggatggatggacgagcgaataaaattccattagaactggtctaacaactgatactaaatcattagagaaaaagatttgttggcggcttcgtgggctgtacctcgttttgggcccccaagcccactggatggatagcgccaagaagaagaagaaatcaggcagccctatccacccacagctccgtatccgcgacgccgcgccgcgccggaaatggcggcaccctcccacgtcctgcccttcctctcccccaccgccaccggcaccgcctcctccgtccgcgccagccccgcccgcctacgctgcgccgccgcggccgggcaggcgggcttcttcacccgcctcggccgcctcatcaaggagaaggccaagagtgacgtcgagaagctcttctccggcttctccaagacccgcgagaacctctccgtcgtcgacgagctcctcacctactggaacctcgccgacaccgaccgcgtcctcgacgaccttgaggaggcacttctcgtgtcggatttcgggcctaaaatctccttcaggatcgtcgacacgctccgcggggaaatccgcgacggcaagctcaagtccggggccgaaataaaggcggccctgaagaggtgcattctccaactgctgacaagcaagggcggcaactccgagctgaacctcggcttcaggaagccgtcggtcatcatgatcgtgggagtgaatggtggtggaaaaactacctccttaggaaagcttgctcacagatttaagaatgaaggagtgaaggtattgatggcagcaggtgataccttcagagcagcagctcgtgaccagctagaagtttgggctgagagaacaggttcagagatcgtcatcgacaatgataagaaggcacagcctccagcagttctatcgcaggcagtaaaacgtgggaagcgtgaagggtttgatgtggttctatgtgatacatcaggaagacttcacacaaactatggtttgatggaagagttggtttcctgcaaaaaagtcatagctaaagcccttcctggcgctcctaatgagattttgcttgttcttgatggcaccacaggcttaaacatgttacagcaagcgagggagttcaatgatgttgttggagtcacaggattcatcctgactaagctagatggcactgcgcggggtggctgtgtggttagtgttgtagatgaacttggaatcccagtgaagtttattggggttggtgaagggatggaagatcttcaaccttttgatgctgaggcatttgtggaagccattttcccatgaattcggatttatgctcctattgtaaagttttttatagtcattacttcagctctttacgtaagagatagttgtcgtttattacgctgaggctgtgaggcatgactatgaagcagcaaaaagcaaaactaaggaattgaagcacaaggcagttgaagagctagatgggcgagtggtagccgggccagacatttaattcgactgctttgtgcattgccagtgaaagggtttattattggagtctagacctgctggtcccttacataagagacttgcgaactgtacctgaacgattcagagaagaaatggtggaggatattgattatcatctgttaatagcaaactctgctgtctttgcagcatccttccagtggcatagtacaactactcgagtccaacagcatacatacgagatgcctggatccaattacagtgtcaattataagatgcatctcacaaatacatacatgttacaactggaagaacatttcagtggcatgatactgctaatacatggtacaacttggagggacaattcagtggcatgatactgccatcttattgccagttcccatactgctgctgattgcgggagccaccttgagaatagtttcctcggcctggaccggatgcaccatatgggccaccttgtgggtagcttggtcctccagctccatagccactgccaccagcgccccgtgggccagcagctccagggtatggcggaggtcctcgcccttgctgaggataagggccactcccatagcctcctccctgccctccgcggttcggattatagcctcccccttgattcccaccctgagggtaccggttagggcctcctggtcctcggggcttaccatagtgatggcttgggccagctgccacaggaggtac

SEQ ID NO: 6018 - DNA, 1700 bp, Panicum virgatum
gccgagccacacttgaataataatgaatactcaccgccagcgccagctgataacgttggccacattagagaacacgacgatgatggtgatgatggatggatggacggacgagcgaataaaattccacccaaatttaggcccgctaacttcgtttggttcgtgttgggcccccaccaagaccaagcccactggatagcgctaagaagaaatcagctgtcgttttgctcgggccagcgcagcgctatccacccatcgccggagctccgtatccgccacgccgcgcagcgcagcgccggaaatggcggcaccctcccacgtcctgcccttcctctcccccgtcggcgccgcctcctccgcccgcgctggccccggccgccgcgccggcctcctacgctgcgccgccgcggccgggcaggcgggcttcttcacccgcctcggccgcctcatcaaggagaaggccaagagcgacgtcgagaagctcttctcgggcttctccaagacccgcgagaacctctccgtagttgacgagctcctcacctactggaacctcgccgacaccgaccgcgtcctcgacgagctcgaggaggcactgctcgtgtcggacttcgggcctaaaatctccttcaggatcgtcgacacgctccgcgaggaaatccgcgacggcaagctcaagtctggggccgagataaaggcgtccctgaagaggtgcattctccaactgctgacaaccaagggcggcaactccgagttgaacctcggcttcaggaagccgtcggtcatcatgattgtgggagtgaatggtggtgggaagacaacctccctaggaaagcttgctcacagatttaagaatgaaggagtgaaggtattgatggcagcaggtgatacgttcagagcagcagctcgtgaccagctagaagtttgggctgagagaacaggttcagagatcgtcatcgataatgataagaaggcacagcctccagcagttctatcgcaggcagtaaaacgtgggaagcgtgaagggtttgatgttgttctatgtgatacatcaggaagacttcatacaaactatggtttgatggaagagttggtttcctgcaaaaaagtcatagctaaagcccttcctggcgctcctaatgagattttgcttgttctcgatggcaccacaggcttaaacatgttacaacaagcaagggagttcaatgatgttgttggagtcacaggattcatcctgactaagctagatggcacagcgcggggtggctgtgtggttagtgttgtagatgaacttggaatcccagtgaagtttattggggttggtgaagggatggaagatcttcaaccttttgacgctgaggcatttgtggaagccattttcccatgaattcggatttatgctcctactgtaaagttttttttaacgctgtcattacttcagctattcatgtaagagatagttgtcatttgttacgctgaggctgtgaggcgtgactacgaagcagcaaaaagcaaaactaaggaattaaagcacaagacatgagttgaagagctagatgggagagtggtagccgggccggacattgccagtgaaagggtttattagagtctagacctgcaggtcccttgtataagagacttgcgaactgtacctgaagaattcagagaaggaaatggtgaaggatattgattattatctgttcgtc

SEQ ID NO: 6019 - DNA, 1461 bp, Sorghum bicolor
ccatcagcgctcgtatccgcagcgcccggaatggcggcaccctcccacgtcctccccttcctctcccccgccggcgggtgcgccgcctcctccgcccgcgcccgctcccactcccactctggccgccgcgctggaatcctgcgctgctcggccgcggccggccaggcgggcttcttcacccgccttggtcgcctcatcaaggagaaggccaagagcgacgtcgagaagctcttctccggcttctccaagacccgcgagaacctctccgtcgtcgacgaactcctaacctactggaacctcgccgacaccgaccgcgtcctcgacgaccttgaggaggcgctgctggtctcggacttcgggcccaaaatctcgttccggatcgtcgacacgctccgcgaggagatccgcgacggcaagctcaagtccggcgccgagataaaggcggcgctgaaaaggtgcatcctggaactgctgacgagcaagggcggcaactcggagctcaatctcggcttcaggaagccggctgtcatcatgatcgtgggagtgaatggcggtggaaagacaacctcactagggaagcttgcttacaggtttaagaacgaaggagtgaaggtattgatggcagcaggtgacaccttcagagcagcagctcgtgaccagctagaagtttgggctgagagaactggttcagagattgtcattgacaatgataagaaggcacagcctccagcagttctttcgcaggcagtaaagcgcgggaagcgtgaagggtttgatgtggttctatgtgatacatcaggaagacttcatacaaattatggtttgatggaagagctagtttcttgcaaaaaagtcctagctaaagcgcttcctggtgctccaaatgagattttactggttcttgatggaacgactggcttgaacatgttacagcaagcaagagagttcaatgatgttgtaggagtcacaggattcatcctgacgaagctcgatggcactgcacgtggtggctgtgtggttagtgttgtggatgagcttggaatcccggtgaagtttattggggttggtgaagggatggaagacctgcaaccttttgacgctgaggcatttgttgaagccattttcccataaattcgggttttgtggagaaaaatcatgcttctactgtaaagcttttgactctgtcgactgtggttgctttggctcttcatgtaagttattcttgttgtgtccactgaaactacagtagtgtaggaagcacaaggccagggtaaaatgaattggagtcggagctaagctgagacagaatttgtcttccagtccgtaacgagctaggagctgaagtttttgttggtggagtttgtggacctgtgggtccctgtgtaagaggctggaaactgtaaactttcgaattgcaccgggaggattcagagaaaggaatgggaaaatatactcgatcgt

SEQ ID NO: 6020 - DNA, 1344 bp, Oryza sativa
gcgtggctgccgttttggcagcgaagcgctatccacccagagcggagccttggcatccctacaatggcggcacactcccacgtcatccccttcctctccccggcggcgacgtccgcgcgctgctccccctacggccaccgccgccgcggccgcgcggggctcctgcggtgcgcggcggcggcggggcaggcggggttcttcacccgcctgggacgcctcatccaggagaaggccaagagcgacgtcgagaagctcttctccggcttctccaagacccgcgagagcctctccgtcgtcgacgagctcctcacctactggaacctcgccgacaccgaccgcgtcctcgacgagctcgaggaggctctgctggtgtcggattttggccccaagatttcgttccggatcgtggacactctacgcgaggaaatccgcgatggcaagctcaagtctggggctgagataaaggaagcgctgaaaaggtgtattcttgaactgctgacgagcaaaggcggcaatccggagctgcagctcggtttcagaaagccggcagttatcatgattgtgggagtgaatggaggtggaaagactacctcattaggaaaacttgcttacagattcaagaatgaaggagtgaaggtattgatggcagcaggtgataccttcagagcagcagctcgtgaccagctagaagtttgggcagagagaacaggttcagagattgttatcgataatgataagaaagcaaaacctgcatcagttctctcgcaggcagtgaagcgcgggaagcgtgaaggatttgatcttgttctttgcgacacgtcaggacgacttcatacaaattatggtctgatggaagaattggtttcctgcaagaaagtcatagctaaagcccttccgggtgctcctaatgagatcttgctggttctggatggcacgactggcttgaatatgctacaacaagcgagggagttcaatgatgttgttggagtcacaggattcgtcctaacaaagcttgatggaactgctcgtggtggttgtgtggttagcgttgtagatgaacttggaattccagtaaagtttattggtgttggtgaagggatggaggatcttcagccttttgatgctgaggcatttgttgaagccatttttccttgagctaggacgctttgttttttgagatggagaatttgaagtttcggagagagcatgtttgcttacttgtacatcattctggtttttcactcctgtgacaatttcactatgtgtccatcctttcatgtaatatatatttgctaacatgctaggaaattagaagcaaaattttggaccatcacagttttgttc

SEQ ID NO: 6021 - DNA, 1033 bp, Festuca arundinacea
gcacgaggctgagctctatccacccatcgctgctcgtatcctcaccgcagcgtcccaagaatggcggcacctccccacgtcctccccttcctctccccgtcctccgcatccgcctccctgcgcgccccctccggccgccgccgagccgccggcctccgctgcgctgcagcggcggggcaggccggcttcttcacccgcctcggccgcctcatcaaggagaaggccaagagcgacgtcgacaagctcttctccggcttctccaagacccgcgagaacctctccgtcgtcgacgagctcctcacctactggaacctcgccgacaccgaccgcgtcctcgacgacctcgaggaggcgctgctggtgtcggacttcgggcccaagatctcgttccggatcgtcgacaccctccgcgacgaaatccgggacggcaagctcaaatccggcagcgagataaaggcgtcgctgaaaagatgcatccttgagctgctgacaagcaagggcagtaacaccgaactgaagctcggcttcaggaagccggcggtcatcatgattgtgggagtgaatggtggtggaaagacgacatcgctaggaaagcttgctcacagatttaagaatgaaggagcgaaggtattgatggcagcaggtgataccttcagagctgcagctcgtgaccagctagaagtttgggctgagagaactggctcagagattgttatcgataaagataagaaggcacaagctccatcagttctttcgcaggcagtgaaacgtgggaagcgtgaaggatttgatattgtcctgtgtgatacgtcaggacgacttcatacaaattatggtctgatggaagagctggttacttgcaagaaagtcatggctaaagcccttcctggtgctcctaatgaggtcttgctggttctggatggcacaactggcttaaacatgctacagcaagcgagggagttcaacgacgttgttggaatcacaggatttatcctgacgaagctcgatggcactgctcgtgggggctgtgtgg

SEQ ID NO: 6022 - DNA, 1270 bp, Avena sativa
acctccgctgcgcggccgccgccgggcaggccggcttcttcactcgcctcggccgcctcatcaaggagaaggccaagagcgacgtcgacaagctcttctccggcttctccaagaccccgcgagaacctctccgtcgtcgacgagctcctcacctactggaacctcgccgacaccgaccgcgtcctcgacgacctcgaggaggctctgttggtgtcggacttcgggcccaagatctcgttccggatcgtcgacaccctccgcgacgaaatccgcgacggcaagctcaagtcaggggcagagattaaggcgtcgctgaaaaaatgcatcctcgagctgctgaccagcaagggcagcaacactgagctgaagctcggcttcaggaagccggcggttatcatgattgtgggagtgaacggaggtggaaaaacgacctcgctaggaaaacttgcttacagatttaagaatgaaggagcaaaggtattgatggcagcaggtgataccttcagagcagcagctcgtgaccaactagaagtttgggctgagagaactggctcagagattgttatcgataaagataagaaggcacaagctccatcagttctttcgcaggcagtgaaacgtgggaagcgtgaaggatttgatatcgtcttgtgtgatacatcaggacgacttcatacaaattatggtctgatggaagagttggttacttgcaagaaagtcatggctaaagcccttcccggtgctcctaatgaggtgttactggttctggatggcacaactggcttaaatatgctacaacaagcgagggagttcaacgatgttgttggaatcacaggattcatcctgacaaagctagatggcactgctcgtggtggctgcgtggtgagcgttgtagacgaacttggaattccagtcaagtttgtcggtgtcggcgaaggggtggaggatctccaaccttttgacgcggaggcatttgttgaagccattttcccataaattttgattctggagaaataatcattggtctcctcatgtgcatcctcaaaagttgtgttggccttgttattagtgtatttatttttccatgtaacaaagatattgctaacctgctagaagttgccgacatctcactagtggtttcttccattcatcctagtagctgcggagtcgttttaaaggcagaacagcagcaagcattcgtgattgctataatgtgaatcttgcgattagactgcagattatttttgattaactaaggaagcattcattc

SEQ ID NO: 6023 - DNA, 1556 bp, Triticum aestivum
atgggctgagtacatgatcagtctacttcgctggtgctactcgatcagttagccagccggcgatcgatatggggaaggtggtcgtcgcggaggccacggcgcggcaggtggcctccttcgtcctcggcgccgccgccgcgctcaccgtcgtcatgctcgtccagtaccgggcgccggccgcgggcctcagccgcgccaggacgccggcccacttctccggcttgagatcatcatccgacgaccagcaccaccgccgcaacggacggcagcgcgtgccgtcttcatcatccgtcgccgtccatcgccggcagtgctgcccgagacgacgatcatcgccgtcgtccggcgaacgccacgacaatcacaaagcccagttctacctccactgctgctgctgctctaagtcatcttcccggcacacatcggcatgaagaaaagggagcgaaggaggagccggcggagttccgggggctggcggcggcggtggcacgagcagcgacggacgaccggacggtgatcatcacgtgcgtgaaccaggcctgggcggcgccgggctccctgctggacctgttcctcgagagcttccgcatcggcgacggcacggcgcggctcctcccacacgtgctggtcgtggccatggaccccggcgcccacgcgcggtgcctcgccgtgcaccagcactgctaccactacaccatcccggggatcaacatcgacttcgccgcccacaagtacttcctctccaaggactacctggagctggtgtggagcaagctgaagctgcagcgccgcatcctggagctcggctacggcttcctcttcaccgacgtcgacatcgtgtggctgcgcgacccgttcaagcacgtcacggcgtacgctgacatgaccgtgtccagcgacgtctacttcggcgaccccgacaacctgggcaacttccccaacacgggcttcttccacgtgaagcccaacgcgcggaccatcgccatgacgaagctgtggcacggtggtaggggcaagtacccgggcgccaacgagcagcccgtgttcaacatgatgaagaagcagatggtggcggagctcgggctccgggtgcagtacctgaacccggcctacgtcggcgggttctgcagctacgggaaggatttggggaagatcgtcaccatgcacgcgaattgctgcgtggggattggaaacaagattagggatttgaagggcgtgctgggtgattggaggaactataccaggatgccgccgtgggagaggcaccgggccaagtggaccgtgcccggcgcctgcattcgagcggaaaaacaagtttgatccatcaattggttgatggattttgcaatcgtctgttacttatagagtagtttaattcttcatatatactccctgtggggatggagagatagaccatagagtatttgttgctatacctctaaaatgctctataatgaaaacatatactgtatctacttatttgctgctttttcctgttttaccactttcattcctatgtttacatgtaaatatatctgaaccaatacaccaaattt

SEQ ID NO: 6024 - DNA, 1670 bp, Leymus cinereus x Leymus triticoides
gcccgccgcgcctctcataagctcttcctagctaattccatcactcatcatccacacatacatggggtgaggacatcatcagtgtacttcgctagtgctactcgatcagttagctaccgatggggaagatggtcgtcacggaggccacggcgcggcaggtggcgtccttcgtcctcggcgccgccgccgtgctcaccgtcgtcatgctcgtccagtaccgggcgccggccgcagggctcagccacgccaggacgccggggcacttctccggcttgcgatcatcatccgacgaccagcatcaccgccgcaacgggacgacagcgcgcgccgttgttcatcgggcgccaccggttgccgctagtgcaggagacgatcatcaccgtccggcgaacaccacaacaatcacaaagcccaactctacctccactgctgctgctctaagtcatcttcccagcacacatcggcatgaagaaaagggagcgaaggaggaggcggcggagttccgggggctggcggcggcggtagcgcgggctgcgacagatgaccggacggtgataattacgtgcgtgaaccaggcctgggcggcgccaggctcccttctggacctgttcctggagagcttccgcatcggcgacggaacggcgcgcctgctcccgcacgtgctcgtggtggccatggacccccgcgcccacgcgcggtgcctcaccgtgcaccggcactgctaccactacaccatcccgggcctcaacatcgacttcgccacccacaagtacttcctctccaaggactacctggagctggtctggagcaagctgaagctgcagcgccgcatcctggagctcggctacggcttcctcttcaccgacgttgacatcatgtggttgcgtgacccactcaagcacgtgacggcgtacgccgacatgacggtatccagtgacgtgtatttcggcaacccggacaacctggacaacttccccaacacggggttcttccacgtgaagccgaacgcgcggaccatcaccatgacgaagctgtggcacggggctaggggcaagtacccgggcgccaacgagcagccggtgttcaacctgatgaagaagcggatggtgaagaagctggggctccgggttcgttacttggacccggtctatgtgggcggattttgtaggtatggtaaggatctggggaagatcgttaccatgcatgcaaactgctgtgtggggattgggaacaagattagggacttgaagggcgtgcttgatgactggaagaactataccaggttgccgcattgggaaaagcaccgggccaagtggaccgtgcccggcgcctgcatccgcgcagaaaaacaagtttgatccatcaatcggttgatggatttctcggtcgacctttgcttgaaggatataagccgagtgtccttcgtcgagagctgcgctcggcaaagcctttgccgagtttttcgaacacttggcggttacatagatttcagtagtggtcgtctgttacttatagagtagtttaattctacatatatatactccatgtgggcgtggagagatagaggatcgagtattaatcgttatacctgtaaaatactctatactgaaaaatatattgtatttacttattttattacatgttagcaagaaaccctgtttatctgttca

SEQ ID NO: 6025 - DNA, 2186 bp, Setaria italica
ccaaactgaggtcacaccaccacaccaacccccccgactccgcgcgcgtatccatcccatccatcttccatcccccacggttttagttgctgccccgagtctccctcgcctctacgatcggcggcggcggcagcatggcccgcgaggcccactttggcggggacgacgcggcggcggccaaggacaagaacgccgaagccgacgccggcgccgcgtcggcggccacggccgcgccgggcggtgggcacaagaagctgtccctggtgccgctcatcttcctcatcttcttcgaggtggcgggtggcccctacggcgcggagcccgcggtgcagtcggcgggcccgctctacgcgctgctgggcttcctcatcttccccttcatctgggccatcccggaggcgctcgtcaccgccgagctctccaccgccatgccgggcaacggggggttcgtcctctgggccgaccgcgccttcggccccttctcgggctccctcatgggcacctggaagtacgtgtccggggccatcaacggcgccgccttcccggccctctgcgccgactacctcgcccgcgtcgtgcccgccgtctccggaggcgggccccggaccgccaccatcgtcgccttcaacgtcgcgctcacggtggtcaactacacggggctcaccgtcgtggggtggaccgccgtcgggctgggcgtcgcgtcgctctcgccgttcctgctcatgtccggcgtcgcgctgcccaagatccggccccggcggtgggccggcgtggcgcccgagaaggactggaagctcttcttcaacacgctcttctggaacctcaactactgggacagcgtcagcaccatggccggcgaggtggagcgccccgggaagacgctgcccaaggcgctcgtctccgccgtcaccatgacatcgctcgggtacctgctgccgctcatggccgccacgggcgccatcgacgtcgcgccggaggactgggggaacggattcttcgcggacgccgcaggcatgatcgcgggcaggtggctcaagtactggatcgaggtgggcgcggtgctgtcctccatcggcctctactcggcgacgctgagcagcgcggcgttccagctgctgggcatggcggaccttggcctcctcccgtccgccttcgcgacgcgcgccccggtcttcaacacgccctgggtcagcatcgtgaccaccagcgccatcaccctgggcatgtccttcttcagcttcaacaacatcgtggccgccgcaaacttcctctacagcctcggcatgctccttgagttcgccgccttcatctggctccgcatcaagcggccggacctgtcccggccgtaccgcgtgccggcccgcctccccggcgccgtggcgctgtgcctcgtgccgtcggcgttcctcgtcttcgtcatggccatcgccggctggaaggtgtacgccatcagcgccgcgttcacggccgccggggtcggggtgtactacctcatgcggttctgcaaggaacgggggtgcctcaggttcagcgacggtggcgacgagggggcggcggcggcgtaccaccagcgccagggcagcaggaacggtgatgtctgacgacatcatcaatcgtactgacatctacaccctgttcttttttggtgcctgcagctcgatccggcgttgctgcgatgtgtaatgattgtactggggtcgtgctcgtgcaaaaatgcataggaatttccggatctgtagcaaggtcttttcagggtttggctggctggcattgctgaccggatgagtgtttcttgctcgagtggttttcctcgttgctgcagaaagtgtaaaggcacttcaagtgtctgtgactccagagatggacagatagtaggacgattgggccgccgtgcttgacgcaacacagcaacagggcaggtcacgcatcagcatgccgaaggcgtggcggatggcatgtcgtggtggagatgcttgctgatcatagcgcagttgggagtactggacgccaccatttgccctgtccctcgtgaggcaacaacattctcaaatgagcaggatagttatagttccggtaaatctcgacacttgggaggcagaaaaatcttgctcagctacaaaaattattacattagtgaacactagtttttgccgttaaatcaaagaaaaaaaatgaatttagcctcc

SEQ ID NO: 6026 - DNA, 2151 bp, Setaria italica
tcacaccaccacaccaacccccccgactccgcgcgcgtatccatcccatccatcttccatcccccacggttttagttgctgccccgagtctccctcgcctctacgatcggcggcggcggcagcatggcccgcgaggcccactttggcggggacgacgcggcggcggccaaggacaagaacgccgaagccgacgccggcgccgcgtcggcggccacggccgcgccgggcggtgggcacaagaagctgtccctggtgccgctcatcttcctcatcttcttcgaggtggcgggtggcccctacggcgcggagcccgcggtgcagtcggcgggcccgctctacgcgctgctgggcttcctcatcttccccttcatctgggccatcccggaggcgctcgtcaccgccgagctctccaccgccatgccgggcaacggggggttcgtcctctgggccgaccgcgccttcggccccttctcgggctccctcatgggcacctggaagtacgtgtccggggccatcaacggcgccgccttcccggccctctgcgccgactacctcgcccgcgtcgtgcccgccgtctccggaggcgggccccggaccgccaccatcgtcgccttcaacgtcgcgctcacggtggtcaactacacggggctcaccgtcgtggggtggaccgccgtcgggctgggcgtcgcgtcgctctcgccgttcctgctcatgtccggcgtcgcgctgcccaagatccggccccggcggtgggccggcgtggcgcccgagaaggactggaagctcttcttcaacacgctcttctggaacctcaactactgggacagcgtcagcaccatggccggcgaggtggagcgccccgggaagacgctgcccaaggcgctcgtctccgccgtcaccatgacatcgctcgggtacctgctgccgctcatggccgccacgggcgccatcgacgtcgcgccggaggactgggggaacggattcttcgcggacgccgcaggcatgatcgcgggcaggtggctcaagtactggatcgaggtgggcgcggtgctgtcctccatcggcctctactcggcgacgctgagcagcgcggcgttccagctgctgggcatggcggaccttggcctcctcccgtccgccttcgcgacgcgcgccccggtcttcaacacgccctgggtcagcatcgtgaccaccagcgccatcaccctgggcatgtccttcttcagcttcaacaacatcgtggccgccgcaaacttcctctacagcctcggcatgctccttgagttcgccgccttcatctggctccgcatcaagcggccggacctgtcccggccgtaccgcgtgccggcccgcctccccggcgccgtggcgctgtgcctcgtgccgtcggcgttcctcgtcttcgtcatggccatcgccggctggaaggtgtacgccatcagcgccgcgttcacggccgccggggtcggggtgtactacctcatgcggttctgcaaggaacgggggtgcctcaggttcagcgacggtggcgacgagggggcggcggcggcgtaccaccagcgccagggcagcaggaacggtgatgtctgacgacatcatcaatcgtactgacatctacaccctgttcttttttggtgcctgcagctcgatccggcgttgctgcgatgtgtaatgattgtactggggtcgtgctcgtgcaaaaatgcataggaatttccggatctgtagcaaggtcttttcagggtttggctggctggcattgctgaccggatgagtgtttcttgctcgagtggttttcctcgttgctgcagaaagtgtaaaggcacttcaagtgtctgtgactccagagatggacagatagtaggacgattgggccgccgtgcttgacgcaacacagcaacagggcaggtcacgcatcagcatgccgaaggcgtggcggatggcatgtcgtggtggagatgcttgctgatcatagcgcagttgggagtactggacgccaccatttgccctgtccctcgtgaggcaacaacattctcaaatgagcaggatagttatagttccggtaaatctcgacacttgggaggcagaaaaatcttgctcagctacaaaaattattacattagtgaacactagtttttgccgttaaatcaa

SEQ ID NO: 6027 - DNA, 2123 bp, Panicum virgatum
aataagatggcacgaacaccatgttggttggtgccgggcgacggaacggagccgaacaaaactgattcccgagccctgggcaacttccattccatgggaatcgaatggggaacccgcatctcccccgctcccaacgtgactgaacctgggatggcagacaggcagagcagcaccaaccgcgcaggcgccaagcctttccttccttcccagtagcagttggccaatgctacaacaagcaagcaagcaaggaaggcggccgaactgaactcatcagagcgagcgcgagcgctctctgaacccacgcggtcaggcggccaccaacgcccgccccgactccgcgcttcccacgtatccatccatgatccccccattcatcccctgatcccccgtccacactgttagttgctgccctgcccgtctgctccccctccccgagtggccgagtctccctcgccccacgatcggcggcggcggcgtcatggcgggcgaggcccatctcgacggggacgcgacggcggcggcagctgccaaggacaagaacgccgaggccgacgccctggcggcggcggacggcgccggcggaggaggaggggccagggccggcgccggcgggcacaagctctcgctggtgccgctcatattcctcatcttcttcgaggtggcgggggggcccctacggcgccgagccggcggtgcagtcggcgggcccgctctacgcgctgctgggcttcctcgtcttccccttcatctgggccgtcccggaggcgctcgtcaccgccgagctctccaccgccatgccgggcaacggcggcttcgtcctctgggccgaccgcgccttcggccccttcccgggctccctcatgggcacctggaagtacgtctcgggcgccatcaacggcgccgccttccccgcgctctgcgccgactacctcgcccgcgtcgtgcccgccgtcggggacggcggcccgcgggtcgccgccatcgtcgccttcaacgtcgcgctctccttcctcaactacacggggctcaccgtcgtcgggtggaccgccgtcgggctcggggtcgcctcgctctcgccgttcctgctcatgtccggcgtcgcgctgcccaagatccgccccaggcggtggcgcggcgtcgccaaggacaaggactggaagctcttcttcaacacgctcttctggaacctcaactactgggacagcgtcagcaccatggccggcgaggtggagcgccccgggaagacgctgcccaaggcgctcgtcgccgccgtctccatgacctcgctcggctacctgctgccgctcatggccgccacgggcgccgtcgacgtcgcgccggaggactgggggaacggattcttcgccgacgccgcaggcatgatcgccggcaagtggctcaagtactggatcgaggtgggcgcggtgctgtcctccatcggcctctactcggcgacgctgagcagcgcggcgttccagctgctgggcatggcggacctgggcctcctcccccgcgtcttcgccgtgcgcgcccccgtcttcaacacgccctgggtcagcatcgtggccaccagcgccatcaccctgggcatgtccttcttcagcttcaacaacatcgtggccgccgccaacttcctctacagcctgggcatgctcctcgagttcgccgccttcatctggctccgcgtcaagcggcccgacctgccgcggccgtaccgcgtgccggcgcgcctgccgggcgccgtggcgctctgcctcgtgccctcggcgttcctcgtcttcgtcatggccatcgccgggtggaaggtctacgccatcagcgccgcgttcacggccgccggggtcggggtgtactacctcatgcggctctgcaaggcccggggctgcctcagcttcagcgagggcggtggcgacgagggggcgccggcgtaccagcggcagggcagcaggaacggcgatgtctgactataacatcattcggtcgctggatcggaggggccggccgcggtcgggaatttttttttctttctttttggtgcctgcggctccggcgtgctgcaacttgtaatgtttgtattttggacgcccgttcttgtgcaaaatgcataggaatttgtaggatcg

SEQ ID NO: 6028 - DNA, 2239 bp, Sorghum bicolor
agtgtgcccttccctgccgctgcccatgcccaagagaagagcagaccgacgacccatatcgtcgagtaccctaaacgaacggcagtgattgccaaggaataattgtcgctcgatcaggttgcgcaggacacggtcgccccggcccacaccgcggcaggataattcactctcatcaggttgcttctccctgttggtcatgtggtggtccgtgctgctgctgtgagctaccagccgacgacgacgacgcccgcgttcgctttgttataagcgcgagggtttgtggcgaggttgctgggcattagagctcggctaacggcatttgggacataagagagagggagacgggggccggggcggtatggagcttgacgaggaggcgttcttggacgagctcatgtcgctgcggcgggaggcggcggcgtcgtccgcgccgtggcagcaagctgatccctgtagtgcctacccgggcgcaggcggaggcggcggcggcatgatgatgagcgacctcctcttctacggcgggacgacggagggcgccgccgccgacgccaccagcatggacctctcgccgttccaccaggagccgctgcaggcgcccatgccgcccgcggcggcccggaccccgctcccgcccccgcacccgcacgaggagttcaactttgactgcctgagcgaggtctgcaacccgtacaggagcggcggcggcggcgtcgccgtcccgggggccgaggccgtagcggtgcccggacacaaacaggcgcttgctgcactccacgacgccatggtcgaggaggagacgagcggtgaccttgacctgcagggacagcagcactatggaggtggcgggtccccaacgttcgtgttcggcggaggcgcccgcggcgagagctccgagatgcccatcgtcaggggtgtcggcggccctcatcaccacaggagcaagctccacggcgcgccgtccaagaatctcatggccgagaggcggcggaggaagcgcctcaacgaccgcctctccatgctccgctccattgttcccaagatcagcaagatggacaggacatccattcttggggacaccattgactatgtgaaggagctgacggagcggatcaaagtcctcgaagaggagatcggcgcctcgccggaggacctggacctcctcaataccttgaaagattcgtccagttgcagcaacgagatgatggtgaggaactccaccaagttcgacgtcgagaagcggggcaacgggagcacgaggatcgagatctgctgcccgacaaaccccggggtgctgctgtccacagtaagcgcgctggaggtgctcggcctggagatcgagcagtgcgtcgtgagctgcttcagcgactttgccatgcaggcctcttgctcacaagaggacgggaagaggcaagttctgagcaccgacgagataaagcaggcattgtttaggagtgctggctacggagggaggtgcctctagctagcaaacagctccaaaaaccaacccagcaaatataagctagtaagttgcatgattgttattgttgttgatgctttgcttcattgatatattattccatggctttgctccatgaattagtgtagagctagtgtgtagtagtatgaggtacgtatctgaagaatcccagcagcaaattaacaatttgttgctcaggtattgtaaggtgatcatttcttgcggtttgtataattggatcatgtggtgtgtatgcgggttgatatatattgtggtgtaccacgcggcatgggttaaattccaagaagcagattgtttcttctgtgagtttagctgtgtttttgttctcttcctgccaggaaacggttcatacagttcttacgtccttgagctaccatatgctctcatatgagggaacagtagtgtatgattgttttattccctttgttgcttgtgggttttgatcgtggcctaacaattgtatatgcgggagatgcaagcccggcaaagtacgtaccataatagtgggtaaagaacaaggagaattgaaaggcgatcttgctgctagcgcgctgatcagtgacatgcatgcaacgcctctgaacaggagcaggccggaaccagtaaatatatatgtaattgtaatgcattttagtacgctcactgctgctatagaatggttcgttattttatggtctatctaaacgttaaaagccatgaaaagtacatttatgcatgtgaatgtgtacggttgatcagagc

SEQ ID NO: 6029 - protein, 355 aa, Arabidopsis lyrata
MVKSKKEDLNQFLIPRLNTIYDTLQLFDRTASPTVEKVNWNDVLQMSDHLSKQATIVGMLWTGESPKAESLKETMESYFNALQGFLLCCHGSTVGAGPTLSSIIHVSVKQIVDSSFRLLQGSVSLYEGSYEKDKKPSIPQLSGVVWEACSSFKKVPATNIVAIGRAITQVAVSMKDVLREMKEVKPACHSAECEASGDNMSGDDDDDLGDDLSPEEMEVARMVAEIVSETIMVIKELIRVITGMIKMENPNDNSGFVESLEKLLKLCQGTGVQIDELGACVYPPQEMNKMKQTVKIIQGNLNEFETEVERLKSSSDGCSGACEKLRNSLKHMETELDKRCEAELVVEMQNVTLGN

SEQ ID NO: 6030 - protein, 355 aa, Eutrema parvulum
MGKSKKDLNQFLIAHLNTIYDTLQLFDRTASPTEEKVNWNDVLQMSDHLSKQATIVGMLWTGEAPKAESLKETMESYFNALQGFLLCCHGSTVGAGPTLSSIIHVSVKQIVDSSFRLLQGSVSLYEGSYEKDKKPSIPQLSGVVWEACSGFKKVPATNITAIGRGITQVAVSMKDVLREMKEVKPACPSPEGEASGDNNSDDDDEDDLGDDLSPEEMEVAQIVAEIVSETIMVIKELIRVITGMIKLENPKDNSGFVDSLEKLLKLCQGTGVQIDELGACVYPPQEMDKMKQTLKIIQGNLDEVETEVEGLKNSSDAFSGACRKLRNSVKYMEAELDKRCEAEVVVGMQNVTLGS

SEQ ID NO: 6031 - protein, 356 aa, Eutrema halophilum
MGKSKREDLNQFLIAHLNTIYDTLQLFDRTASPTEEKVNWNDVLQMSDHLSKQATIVGMLWTGEAPKAESLKETMESYFNALQGFLLCCHGSTVGAGPTLSSIIHVSVKQIVDSSFRLLQGSVSLYEGSYEKDKKPSIPQLSGAVWEACSGFKKVPATNIIAIGRAITQVAVSMKDVLREMKEVKPACPSPELEASGDNNTDDDDDDDLGDDLSPEEMEVAQMVAEIVSEMLMVMKELIRVITGMIKLENPKDNSGFVDSLEKILKLCQGTGVQIDELGACVYPPQEINKMQQTVKIIQENLDEVEAEVGGLKSSSDAFSGACIKLRNSMKNMETELDKRCEAEVVVEMQNVTLGS

SEQ ID NO: 6032 - protein, 356 aa, Brassica napus
MGKTKKEDLNQFLIAHLNTIYDTLQLFERTASPTEEKVNWNDVLQMSDHLSRQATIVGMLWSGEAPKAESLKETMESYFNALQGFLLCCHGSTVGAGPTLSSLIHLSVKKIVDSSFRLLQGSVSLYEGSYEKDKKPSIPQLSGAVWEACSSFKKVPATNITAIGRAITQVAVSMKDVLREMKEVKPASPEDEASGDNNNSDDDEDDDDLGNDLSPEEMEVAQMVAEIVSETIIVIKELIRVITGMIKLENPKDNSGFVDSLEKLLKLCKGTGDQIDEIGACVYPPQEIVKMKQALKIIQGNLDEVEAEVEGLKSASEAFTGACGKLRSSMKHMEGELDKRCEDEVVAGMQNVTLGS

SEQ ID NO: 6033 - protein, 356 aa, Brassica juncea
MGKTKKEDLNQFLIAHLNTIYDTLQLFERTASPTEEKVNWNDVLQMSDHLSKQATIVGMLWNGGEAPKAESVKETMESYFNALQGFLLCCHGSTVGAGSTLSSLIHVSVKKIVDSSFRLLQGSVSLYEGSYEKDKKPSIPQLSGAVWEACSSFKKVPATNITAIGRAITQVAVSMKDVLREMKEVKPAPPEDEASGDNNNSDEDDDDLGNDLSPEEMEVAQMVAEIVSETITVIKELIRVITGMIKLENPKDSKSGFVDSLEKLLKLCKGTGDQIDEIGACVYPPQEIAKMKQALKIIQGNLGEVEAEVEGLKNSSEALTGACRELRSSMEHMEAELEKRCEDEVVAVMQNVTLGS

SEQ ID NO: 6034 - protein, 353 aa, Brassica rapa
MGKTKKEDLNQFLIAHLNTIYDTLHKLFLQLFERTASPTEEKVNWNDVLQMSDHLSRQATIVGMLWSGEAPKAESLKETMESYFNALQGFLLCCHGSTVGAGPTLSSLIHLSVKKIVDSSFRLLQGSVSLYEGSYEKDKKPSIPQLSGAVWEACSSFKKVPATNITAIGRAITQVAVSMKDVLREMKEVKPASPEDDDDDEDDDDLGNDLSPEEMEVAQMVAEIVSETIIVIKELIRVITGMIKLENPKDNSGFVDSLEKLLKLCKGTGDQIDEIGACVYPPQEIVKMKQALKIIQGNFDEVESEVEGLKSASEAFTGACGKLRNTMKHMEGELDKRCEDEVVAEMQNVTLGS

SEQ ID NO: 6035 - protein, 356 aa, Brassica napus
MRKTKKEDLNQFLIAHLNTIYDTLDNLQLFERTAFATEEKVNWNDVLQMSGHLSRQATIVGMLWSGEAPKAESLKETMESYFNALQGFILCCHGSTVGAGPTLSSLIHVSVKKIVDSSLRLLQGSVSLYEGSYEKDKKPSIPQLSGAVWEACSGFKKVPTTNITAIGRAITQVAVSMKDVLREMKEVKPAPPEDEASGDNNNSDDDDDLGNDLSPEEMEVAQMVAEIVSETIMVIKELIRVITGMIKLENPKDNSGFVDSLEKMLKLCKGTGDQIDEIGACVYPPQEIVKMKQALKIIQGNLDEVESEVEGLKSASEAFTGACRKLSSSMKHMEAELDKRCEDEVVTEMQNVTLGS

SEQ ID NO: 6036 - protein, 356 aa, Brassica oleracea
MGKTKKEDLNQFLIPHLNTIYDTLDNLQLFERTAFATEEKVNWNDALQMSGHLSRQATIVGMLWSGEAPKAESLKGTMESYFNALQGFILCCHVSTVGAGPTLSSLIHVSVKKIVDSSLRLLQGSVSLYEGSYEKDKKPSIPRLSGAVWEACSGFKKVPTTNIIAIGRAITQVAVSMKDVLREMKEVKPAPPEDDASGDNNNSDDDDDLGNDLSPEEMEIAQMVAEIVSETIMVTKELIRVITGMIKLENPKDNSGFVDSLEKMLKLCKGTGDQIDEIGACVYPPQEIVKMKQALKIIQGNLDEVESEVEGLKSASEAFTGACRKLSSSMKHMEAELDKRCEDEVVTEMQNVTLGS

SEQ ID NO: 6037 - protein, 356 aa, Brassica oleracea
MGKTKKEDLNQFLIPHLNTIYDTLDNLQLFERTAFATEEKVNWNDALQMSGHLSRQATIVGMLWSGEAPKAESLKGTMESYFNALQGFILCCHVSTVGTGPTLSSLIHVSVKKIVDSSLRLLQGSVSLYEGSYEKDKKPSIPRLSGAVWEACSGFKKVPTTNIIAIGRAITQVAVSMKDVLREMKEVKPAPPEDDASGDNNNSDDDDDLGNDLSPEEMEIAQMVAEIVSETIMVTKELIRVITGMIKLENPKDNSGFVDSLEKMLKLCKGTGDQIDEIGACVYPPQEIVKMKQALKIIQGNLDEVESEVEGLKSASEAFTGACRKLSSSMKHMEAELDKRCEDEVVTEMQNVTLGS

SEQ ID NO: 6038 - protein, 581 aa, Arabidopsis lyrata
MYRLVTNVASKARIARNCTSQIGSRLNSTRNYAAKDIRFGVEARALMLKGVEDLADAVKVTMGPKGRNVIIEQSWGAPKVTKDGVTVAKSIEFKDRIKNVGASLVKQVANATNDVAGDGTTCATVLTRAIFTEGCKSVAAGMNAMDLRRGIKLAVDTVVTNLQSRARMISTSEEIAQVGTISANGDREIGELIAKAMETVGKEGVITIQDGKTLFNELEVVEGMKIDRGYISPYFITNPKTQKCELEDPLILIHEKKISNINAMVKVLELALKKQRPLLIVAEDVESDALATLILNKLRAGIKVCAVKAPGFGENRKANLHDLAALTGAQVITEELGMNLDNIDLSMFGNCKKITVSKDDTVVLDGAGDKQAIGERCEQIRSMVEASTSDYDKEKLQERLAKLSGGVAVLKIGGASETEVSEKKDRVTDALNATKAAVEEGIVPGGGVALLYASKELDKLSTANFDQKIGVQIIQNALKTPVYTIASNAGVEGAVIVGKLLEQDNPDLGYDAAKGEYVDMVKAGIIDPLKVIRTALVDAASVSSLLTTTEAVVTEIPTKEVVSPGMGGGMGGMGGMGGMGF

SEQ ID NO: 6039 - protein, 584 aa, Brassica napus
MYRLISSIASKARVARNCTSQIGSRLSSTRNYAAKDIRFGVEGRALMLRGVEELADAVKVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLFNELEVVEGMKIDRGYISPYFITNQKNQKCELEDPLILIHEKKISNLNSMVKVLELALKSQRSLLIVAEDLESDALAVLILNKLRAGIKVCAVKAPGFGENRKANMHDLATLTGAQVITEELGMNLEKIDLSMLGNCKKITVSKDDTVFLDGAGDKKAIGERCEQIRSMVEASESDYDKEKLQERLAKLSGGVAVLKIGGASESEVGEKKDRVTDALNATKAAVEEGIVPGGGVALLYASKELEKLSTANFDQKIGVQIIQNALKTPVYTIASNAGVEGAVIVGKLLESDNPDLGYDAAKGEYVDMVKSGIIDPVKVIRTALVDAASVSSLLTTTEAVVTEIPTKEDASPAMGGGGGGMGGMGGMGGMGF

SEQ ID NO: 6040 - protein, 582 aa, Eutrema halophilum
MYRLVSNIASKARIARNCTSQVGSRLNSTRNYAAKDIRFGVEARASMLRGVEELADAVKVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLYNELEVVEGMKIDRGYISPYFITNQKNQKCELDDPLILIHEKKISNLNAMVKVLELALKKQRPLLIVAEDLESDALAVLILNKLRAGIKVCAVKAPGFGENRKANLHDLAILTGAQVITEELGLNLEKVDLSMFGNCKKITVSKDDTVFLDGAGDKKSIGERCEQIRSMVEASESDYDKEKLQERLAKLSGGVAVLKIGGSSEAEVGEKKDRVTDALNATKAAVEEGIVPGGGVALLYASKELEKLSTANFDQKIGVQIIQNALKTPVHTIASNAGVEGAVIVGKLLEQDNPDLGYDAAKGEYVDMVKAGIIDPLKVIRTALVDAASVSSLLTTTEAVVTEIPAKEEASPAMGGGMDGGMGGMGGMGF

SEQ ID NO: 6041 - protein, 584 aa, Brassica oleracea
MYRLISSIASKARVARNCTSQIGSRLSSTRNYAAKDIRFGVEGRALMLRGVEELADAVKVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLFNELEVVEGMKIDRGYISPYFITNQKNQKCELEDPLILIHEKKISNLNSMVKVLELALKSQRSLLIVAEDLESDALAVLILNKLRAGIKVCAVKAPGFGENRKANMHDLATLTGAQVITEELGMNLEKIDLSMLGNCKKITVSKDDTVFLDGAGDKKAIGERCEQIRSMVEASESDYDKEKLQERLAKLSGGVAVLKIGGASESEVGEKKDRVTDALNATKAAVEEGIVPGGGVALLYASKELDKLSTANFDQKIGVQIIQNALKTPVYTIASNAGVEGAVIVGKLLESDNPDLGYDAAKGEYVDMVKSGIIDPVKVIRTALVDAASVSSLLTTTEAVVTEIPTKEDASPAMGGGGGGMGGMGGMGGMGF

SEQ ID NO: 6042 - protein, 583 aa, Eutrema halophilum
MYRLLTNIASKARIARNCTSQVGSRLNSTRNYAAKDIRFGVEARASMLRGVEELADAVKVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLFNELEIVEGMKIDRGYISPYFITNQKNQKCELEDPLILIHEKKISNLNSMVKVLELALKTQRPLLIVAEDLESDALAVLVLNKLRAGIKVCAVKAPGFGENRKANLHDLAVLTGGQVITEELGMNLEKVDLSMFGNCKKITVSKDDTVFLDGAGDKKSIGERCEQIRSMVEASESDYDKEKLQERLAKLSGGVAVLKIGGASESEVGEKKDRVTDALNATKAAVEEGIVPGGGVALLYASKELEKLSTANFDQKIGVQIIQNALKTPVHTIASNAGVEGAVIVGKLLEQDNPDLGYDAAKGEYVDMVKSGIIDPVKVIRTALVDAASVSSLLTTTEAVVTEIPTKEEASPAMGGGGMGGMGGGMGGMGF

SEQ ID NO: 6043 - protein, 584 aa, Brassica rapa
MYRLISSIASKARVARNCTSQIGSRLSSTRNYAAKDIRFGVEGRALMLRGVEELADAVKVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLFNELEVVEGMKIDRGYISPYFITNQKNQKCELEDPLILIHEKKISNLNSMVKVLELALKSQRSLLIVAEDLESDALAVLILNKLRAGIKVCAVKAPGFGENRKANMHDLATLTGAQVITEELGMNLEKIDLSMLGNCKKITVSKDDTVFLDGAGDKKAIGERCEQIRSMVEASESDDDKEKLQERLAKLAGGVAVLKIGGASESEVGEKKDRVTDALNATKAAVEEGIVPGGGVALLYASKELDKLSTANFDQKIGVQIIQNALKTPVYTIASNAGVEGAVIVGKLLESDNPDLGYDAAKGEYVDMVKSGIIDPVKVIRTALVDAASVSSLLTTTEAVVTEIPTKEDASPAMGGGGGGMGGMGGMGGMGF

SEQ ID NO: 6044 - protein, 584 aa, Raphanus sativus
MYRLITSIASKARVARNCTTQIGSRLSSTRNYAAKDIRFGVEGRALMLRGVEELADAVKVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLFNELEVVEGMKIDRGYISPYFITNQNNQKCELEDPLILIHEKKISNLNSMVKVLELALKSQRSLLIVAEDLESDALAVLILNKLRAGIKVCAVKAPGFGENRKANMHDLATLTGAQVITEELGMNLEKIDLSMLGNCKKITVSKDDTVFLDGAGDKKSIGERCEQIRSMVEASESDYDKEKLQERLAKLSGGVAVLKIGGASESEVGDKKDRVTDALNATKAAVEEGIVPGGGVALLYASKELEKLSTANFDQKIGVQIIQNALKTPVYTIASNAGVEGAVIVGKLLESDNPDLGYDAAKGEYVDMVKSGIIDPVKVIRTALVDAASVSSLLTTTEAVVTEIPTKEDASPAMGGGGGGMGGMGGMGGMGF

SEQ ID NO: 6045 - protein, 586 aa, Brassica napus
MYRLVSSVASKARVARNCTTQIGSRLSATRNYAAKDIKFGVEGRALMLRGVEELADAVQVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLFNELEVVEGMKIDRGYISPYFITNQKNQKCELEDPLILIHEKKISNLNSIVKVLELALKKQRPLLIVAEDLDSEALAVLILNKLRAGIKVCAVKAPGFGENRKANLQDLAILTGAQVITEELGMNLEKVDLSMFGNCKKITVSKDDTVFLDGAGDKKSISERCEQIRSMVEASESDYDKEKLQERLAKLSGGVAVLKIGGASESEVGEKKDRVTDALNATKAAVEEGIVPGGGVALLYASKELEKLSTANFDQKIGVQIIQNALKTPVYTIASNAGVEGAVVVGKLLESDDPDLGYDAAKGEYVDMVKSGIIDPVKVIRTALVDAASVASLLTTTEAVVTDIPTKEDASPAMGGGGGMGGMGGMGGMGGMGF

SEQ ID NO: 6046 - protein, 583 aa, Brassica oleracea
MYRLVSSVASKARVARNCTTQIGSRLSATRNYAAKDIKFGVEGRALMLRGVEELADAVQVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLFNELEVVEGMKIDRGYISPYFITNQKNQKCELEDPLILIHEKKISNLNSIVKVLELALKKQRPLLIVAEDLDSEALAVLILNKLRAGIKVCAVKAPGFGENRKANLQDLAILTGAQVITEELGMNLEKVDLSMFGNCKKITVSKDDTVFLDGAGDKKSISERCEQIRSMVEASESDYDKEKLQERLAKLSGGVAVLKIGGASESEVGEKKDRVTDALNATKAAVEEGIVPGGGVALLYASKELEKLSTANFDQKIGVQIIQNALKTPVYTIASNAGVEGAVVVGKLLESDDPDLGYDAAKGEYVDMVKSGIIDPVKVIRTALVDAASVASLLTTTEAVVTDIPTKEDASPAMGGGGGMGGMGGMGGMGF

SEQ ID NO: 6047 - protein, 586 aa, Brassica rapa
MYRLVSSIASKARVARNGTTQIGSRLSSTRNYAAKDIKFGVEGRALMLRGVEELADAVQVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLFNELEVVEGMKIDRGYISPYFITNQKNQKCELEDPLILIHEKKISNLNSIVKVLELALKKQRPLLIVAEDLDSEALAVLILNKLRAGIKVCAVKAPGFGENRKANLQDLAILTGAQVITEELGMNLEKVDLSMFGNCKKITVSKDDTVFLDGAGDKKSISERCEQIRSMVEASESDYDKEKLQERLAKLSGGVAVLKIGGASESEVGEKKDRVTDALNATKAAVEEGIVPGGGVALLYASKELEKLSTANFDQKIGVQIIQNALKTPVYTIASNAGVEGAVVVGKLLESDDPDLGYDAAKGEYVDMVKSGIIDPVKVIRTALVDAASVASLLTTTEAVVTDIPTKEDASPAMGGGGGMGGMGGMGGMGGMGF

SEQ ID NO: 6048 - protein, 363 aa, Brassica napus
MKIDRGYISPYFITNQKNQKCELEDPLILIHEKKISNLNSIVKVLELALKKQRPLLIVAEDLDSEALAVLILNKLRAGIKVCAVKAPGFGENRKANLQDLAILTGAQVITEELGMNLEKVDLSMFGNCKKITVSKDDTVFLDGAGDKKSISERCEQIRSMVEASESDYDKEKLQERLAKLSGGVAVLKIGGASESEVGEKKDRVTDALNATKAAVEEGIVPGGGVALLYASKELEKLSTANFDQKIGVQIIQNALKTPVYTIASNAGVEGAVVVGKLLESDDPDLGYDAAKGEYVDMVKSGIIDPVKVIRTALVDAASVASLLTTTEAVVTDIPTKEDASPAMGGGGGMGGMGGMGGMGGMGF

SEQ ID NO: 6049 - protein, 586 aa, Brassica napus
MYRLVSSIASKARVARNGTTQIGSRLSATRNYAAKDIKFGVEGRALMLRGVEELADAVQVTMGPKGRNVIIEQSWGAPKVTKDGVTVAKSIEFKDRVKNVGASLVKQVANATNDVAGDGTTCATVLTRAIFTEGCKSVAAGMNAMDLRRGIKLAVDTVVTNLKSRARMISTSEEIAQVGTISANGDREIGELIAKAMESVGKEGVITIQDGKTLFNELEVVEGMKIDRGYISPYFITNQKNQKCELEDPLILIHEKKISNLNSIVKVLELALKKQRPLLIVAEDLDSEALAVLILNKLRAGIKVCAVKAPGFGENRKANLQDLAILTGAQVITEELGMNLEKVDLSMFGNCKKITVSKDDTVFLDGAGDKKSISERCEQIRSMVEASESDYDKEKLQERLAKLSGGVAVLKIGGASESEVGEKKDRVTDALNATKAAVEEGIVPGGGVALLYASKELEKLSTANFDQKIGVQIIQNALKTPVYTIASNAGVEGAVVVGKLLESDDPDLGYDAAKGEYVDMVKSGIIDPVKVIRTALVDAASVASLLTTTEAVVTDIPTKEDASPAMGGGGGMGGMGGMGGMGGMGF

SEQ ID NO: 6050 - protein, 577 aa, Arabidopsis lyrata
MYRFASNLASKARIAQNTSQVSSRMSWSRNYAAKEIKFGVEARALMLKGVEDLADAVKVTMGPKGRNVVIEQSWGAPKVTKDGVTVAKSIEFKDKIKNVGASLVKQVANATNDVAGDGTTCATVLTRAIFTEGCKSVAAGMNAMDLRRGISMAVDAVVTNLKSRARMISTSEEIAQVGTISANGEREIGELIAKAMEKVGKEGVITIQDGKTLFNELEVVEGMKLDRGYTSPYFITNQKTQKCELDDPLILIHEKKISSINSIVKVLELALKRQRPLLIVSEDVESDALATLILNKLRAGIKVCAIKAPGFGENRKANLQDLAALTGGEVITDELGMNLEKVDLGMLGTCKKVTVSKDDTVILDGAGDKKGIEERCEQIRSAIELSTSDYDKEKLQERLAKLSGGVAVLKIGGASEAEVGEKKDRVTDALNATKAAVEEGILPGGGVALLYAARELEKLPTANFDQKIGVQIIQNALKTPVYTIASNAGVEGAVIVGKLLEQDNPDLGYDAAKGEYVDMVKSGIIDPLKVIRTALVDAASVSSLLTTTEAVVVELPKDESESAGAGAGMGGMGGMDY

SEQ ID NO: 6051 - protein, 579 aa, Tabernaemontana elegans
MYRFAANLASKARVAKSSSQQVASRFGWNRNYAAKDIKFGVEARALMLKGVEDLAEAVKVTMGPKGRNVVIEQSWGAPKVTKDGVTVAKSIEFKDKVKNVGASLVKQVANATNDVAGDGTTCATILTRAIFTEGCKSVAAGMNAMDLRRGINMAVDNVVTNLKSRARMISTSEEIAQVGTISANGEREIGELIAKAMEKVGKEGVITIQDGKTLFNELEVVEGMKLDRGYISPYFVTNPKTQKCELEDPLILIHEKKISSINAIVKVLELALKRQRPLLIIAEDVESDALATLILNKLRAGIKVCAMKAPGFGENRKAILHDLSVLTGGQVITEELGLNLDNLELDMLGSCKKVTISKDDTVVLDGAGDKKSIEERCEQIRSSIELSTSDYDKEKLQERLAKLSGGVAVLKIGGASEVEVGEKKDRVTDALNATKAAVEEGILPGGGVALLYASKELEKLSTANFDQKIGVQIIQNALKTPVHTIACNAGVEGAVVVGKLLEQENPDLGYDAAKGEYVDMVKAGIIDPLKVLRTALVDAASVSSLLTTTEAVVVELPKEEKPAPAMGGGGMGGMGDMDY

SEQ ID NO: 6052 - protein, 582 aa, Chrysanthemum coronarium
MYRFAANLASKSRIATKTTRQIGSRLNISRNYAAKDIRFGVDARALMLRGVEELADAVKVTMGPKGRNVVIEQSYGAPKVTKDGVTVAKAIEFNDKVKNVGASLVKQVANATNDVAGDGTTCATVLTRAIFSEGCKSVAAGMNAMDLRRGITMAVDSVVTNLKSRARMISTSEEITQVGTISANGEREIGELIAKAMERVGKEGVITIQDGKTLYNELEVVEGMKLDRGYISPHFITNTKNQKCELDDPIVLIYEKKISNINSVIKVLELALKKQRPLLIVAEDVESEALATLILNKLRAGIKVCAIKAPGFGENRKANLQDLATLTGGQVITEELGMNLDNVELEMLGSCKKVTVSKDDTVVLDGAGDKKSIEERCEQIRSAIESSTSDYDREKFQERLAKLSGGVAVLKIGGASDTEVSEKKDRVTDALNATKAAVEEGIVPGGGVALLYASKELDKLQTANFDQKIGVQIIQNALKMPVHTIASNAGVEGSVVVGKLLEQDDPDLGYDAAKGEYVDMVKNGIIDPLKVIRTALVDAASVSSLMTTTEAIVTELPKPASEAAPGMGGGMGGMGGMGGMDF

SEQ ID NO: 6053 - protein, 575 aa, Amsonia hubrichtii
MYRFAANLASKARVAKNSSQQVGSRLGWNRNYAAKEIKFGVEARALMLKGVEDLAEAVKVTMGPKGRNVVIEQSWGAPKVTKDGVTVAKSIEFKDKIKNVGASLVKQVANATNDVAGDGTTCATILTRAIFTEGCKSVAAGMNAMDLRRGINMAVDAVVTNLKSRARMISTSEEIAQVGTISANGEREIGELIAKAMEKVGKEGVITIQDGKTLFNELEVVEGMKMDRGYISPYFITNQKTQKCEMEDPLILIHEKKISSINAVVKVLEFALKRQRPLLIIAEDVESDALATLILNKLRAGIKVCAVKAPGFGENRKANLHDLAALTGGQVITEELGLNLDNMELDMLGSCKKVTISKDDTVVLDGAGEKKAIEERCEQIRSSIELSTSDYDKEKLQERLAKLSGGVAVLKIGGASEAEVGEKKDRVTDALNATKAAVEEGILPGGGVAVLYASKELEKLSTANFDQKIGVQIIQNALKMPAHIIASNAGVEGAVVVGKLLEQENPDLGYDAAKGEYVDMVKAGIIDPLKVIRTALVDAASVSSLLTTTEAVVVELPKEEKPAPGMGGGMGDMDY

SEQ ID NO: 6054 - protein, 578 aa, Tripterygium wilfordii
MYRLSSSLASKSRVVRTSAQQVGSRLNWSRNYAAKDIRYGVEARALMLRGVEELADAVKVTMGPKGRNVVIEQSYGPPKVTKDGVTVAKSIEFKDKVKNIGASLVKQVANATNDVAGDGTTCATVLTKAIFAEGCKSVAAGMNAMDLRRGITMAVDSVVTNLKSRARMISTSEEIAQVGTISANGEREIGELIAKAMEKVGKEGVITIQDGKTLFNELEVVEGMKLDRGYISPYFITNQKNQKCELEDPLVLIHEKKISSINAVVKVLELALKKQRPLLIVAEDVESDALATLILNKLRAGIKVCAIKAPGFGENRKANLQDLAVLTGGELITEELGMNLEKVDLDMLGSCKKVTVSKDDTVILDGAGDKKAIEERCEQIRAAIESSKSDYDKEKLQERLAKLSGGVAVLKIGGASETEVGEKKDRVTDALNATKAAVEEGIVPGGGVALLYASKELDKLSTANFDQKIGVQIIQNALKTPVYTIAANAGVEGAVVVGKLLEQDNPDLGYDAAKDEYVDMVKSGIIDPLKVIRTALVDAASVSSLMTTTEAVVSELPKDEKEVPAMGGGMGGMGGMDY

SEQ ID NO: 6055 - protein, 577 aa, Daucus carota
MYRFAANLASKARIASNSSKQIGSRLSLSRNYAAKDIRFGVEARALMLKGVEELADAVKVTMGPKGRTVVIEQPYGAPKVTKDGVTVAKSIEFKDRVKNIGASLVKQVANATNDVAGDGTTCATVLTRAIFTEGSKSVAAGMNAMDLRRGITMAVDAVVTNLKSRARMISTSEEIAQVGTISANGEREIGELIAKAMERVGKEGVITIQDGKTLYNELEVVEGMKLDRGYISPYFITNQKNQKCELDDPLILIHEKKISSINAVVKVLELALKKQRPLLIVAEDVDSEALATLILNKLRAGIKVCAIKAPGFGENRKANLQDLAVLTGGQVITEELGMNLDNVELDMFGSCKKITISKDDTVVLDGAGEKKSIEERCEQIRSSIELSTSDYDKEKFQERLAKLSGGVAVLKIGGASETEVGEKKDRVTDALNATKAAVEEGIVPGGGVALLYAAKELDKLPTANFDQKIGVQIIQNALKTPVHTIASNAGVEGAVVVGKLLEQDDPDLGYDAAKGAYVDMVKAGIIDPLKVIRTALVDAASVSSLMTTTEAIVVEIPKDEKDVPMGGGMGGMGGMDY

SEQ ID NO: 6056 - protein, 577 aa, Euonymus alatus
MYRLASSLVNKSRVVRTSAQQVGSRLNWSRNYAAKEIRFGVDARALMLRGVEELADAVKVTMGPKGRNVVIEQSYGAPKVTKDGVTVAKSIEFKDKVKNIGASLVKQVANATNDVAGDGTTCATVLTKAIFAEGCKSVAAGMNAMDLRRGITMAVDSVVTNLKSRARMISTSEEIAQVGTISANGEREIGELIAKAMEKVGKEGVITIQDGKTLFNELEVVEGMKLDRGYISPYFITNQKNQKCELEDPLVLIHEKKISSINAVVKVLELALKKQRPLLIVAEDVESDALATLILNKLRAGIKVCAIKAPGFGENRKANLQDLAVLTGGELITEELGMNLDKVDLDMLGSCKKVTVSKDDTVVLDGAGDKKGIEERCEQIRSAIELSTSDYDKEKLQDRLAKLSGGVAVLKIGGASETEVNEKKDRVTDALNATKAAVEEGIVPGGGVALLYASKELDKLATANFDQKIGVQIIQNALKTPVYTIAANAGVEGAVVVGKLLEQDDPDLGYDAAKGEYVDMVKSGIIDPLKVIRTALVDAASVSSLMTTTEAVVSELPKDEKEPAMGGGMGGMGGMDY

SEQ ID NO: 6057 - protein, 580 aa, Arachis hypogaea
MYRFATSLASKVRIARNSSQQIGSRLSWSRNYAAKDIRFGVEARAAMLKGVEELADAVKVTMGPKGRNVVIEQSFGAPKVTKDGVTVAKSIEFKDKVKNVGASLVKQVANATNDVAGDGTTCATVLTRAIFTEGCKSVAAGMNAMDLRRGINMAVDAVVTNLKSRARMISTSEEIAQVGTISANGEREIGELIAKAMEKVGKEGVITISDGKTLYNELEVVEGMKLDRGYISPYFITNQKNQKCELEDPLILIHEKKISSINAIVKVLELALKRQRPLLIVAEDVESDALATLILNKLRAGIKVCAIKAPGFGENRKSGLQDLAVLTGGDLITEELGLNLEKVDLEMLGTCKKVTISKDDTVILDGAGDKKAIEERCDQIRSAIENSTSDYDKEKLQERLAKLSGGVAVLKIGGASEAEVGEKKDRVTDALNATKAAVEEGIVPGGGVALLYASNELDKLPTANFDQKIGVQIIQNALKTPVHTIASNAGVEGAVVVGKLLEQDNPDLGYDAAKGEYVDMVKSGIIDPLKVIRTALVDAASVSSLMTTTEAVIAELPKEDEAPPMAGGMGGMGGMGGMGY

SEQ ID NO: 6058 - protein, 577 aa, Daucus carota
MYRFAANLASKARIATSSTQQIGSRLSLSRNYAAKDIRFGIEARALMLKGVEELADAVRVTMGPKGRTVVIEQSYGAPKVTKDGVTVAKSIEFKDKVKNIGASLVKQVANATNDVAGDGTTCATVLTRAIFTEGCKSVAAGMNAMDLRRGITMAVDAVVTNLKSRARMISTSEEIAQVGTISANGEREIGELIAKAMERVGKEGVITIQDGKTLYNELEVVEGMKLDRGYISPYFITNQKNQKCELDDPLILIHEKKISSINAVVKVLELALKKQRPLLIVAEDVDSEALATLILNKLRAGIKVCAIKAPGFGENRKANLQDLAVLTGGQVITEELGMNLDNVELDMFGSCKKITISKDDTVVLDGAGEKKSIEERCEQIRSSIELSTSDYDKEKFQERLAKLSGGVAVLKIGGASETEVGEKKDRVTDALNATKAAVEEGIVPGGGVALLYAAKELDKLPTANFDQKIGVQIIQNALKTPVHTIASNAGVEGAVVVGKLLEQDDPDLGYDAAKGAYVDMVKAGIIDPLKVIRTALVDAASVSSLMTTTEAIVVELPKDEKDIPMGGGMGGMGGMDY

SEQ ID NO: 6059 - protein, 577 aa, Arabidopsis thaliana
MYRFASNLASKARIAQNARQVSSRMSWSRNYAAKEIKFGVEARALMLKGVEDLADAVKVTMGPKGRNVVIEQSWGAPKVTKDGVTVAKSIEFKDKIKNVGASLVKQVANATNDVAGDGTTCATVLTRAIFAEGCKSVAAGMNAMDLRRGISMAVDAVVTNLKSKARMISTSEEIAQVGTISANGEREIGELIAKAMEKVGKEGVITIQDGKTLFNELEVVEGMKLDRGYTSPYFITNQKTQKCELDDPLILIHEKKISSINSIVKVLELALKRQRPLLIVSEDVESDALATLILNKLRAGIKVCAIKAPGFGENRKANLQDLAALTGGEVITDELGMNLEKVDLSMLGTCKKVTVSKDDTVILDGAGDKKGIEERCEQIRSAIELSTSDYDKEKLQERLAKLSGGVAVLKIGGASEAEVGEKKDRVTDALNATKAAVEEGILPGGGVALLYAARELEKLPTANFDQKIGVQIIQNALKTPVYTIASNAGVEGAVIVGKLLEQDNPDLGYDAAKGEYVDMVKAGIIDPLKVIRTALVDAASVSSLLTTTEAVVVDLPKDESESGAAGAGMGGMGGMDY

SEQ ID NO: 6060 - protein, 583 aa, Helianthus annuus
MYRFALNLASKSRIASNRTQQIGSKLNWSRNYAAKDIKFGVDARALMLRGVEELADAVRVTMGPKGRNVVIEQSYGAPKVTKDGVTVAKSIEFNDKVKNVGASLVKQVANATNDVAGDGTTCATVLTRAIFAEGCKSVAAGMNAMDLRRGISMAVDAVVTNLKSRARMISTSEEITQVGTISANGEREIGELIAKAMERVGKEGVITIQDGKTLYNELEVVEGMKLDRGYISPHFITNQKNQKCELDDPLVLIYEKKISNINSVIKVLELALKKQRPLLIVAEDVESDALATLVLNKLRAGVKVCAIKAPGFGENRKANLQDLATLTGGQLITEELGMNLDNLEPEMLGSCKKVTVSKDDTVVLDGAGDKKSIEERCEQIRSAVESSTSDYDKEKLQERLAKLSGGVAVLKIGGASDTEVGEKKDRVTDALNATKAAVEEGIVPGGGVALLYASKELDKLQTANFDQKIGVQIIQNALKMPVHTIASNAGVEGSVVVGKLLEQDDPDLGYDAAKGEYVDMVKNGIIDPLKVIRTALVDAASVSSLMTTTEAIVVELPQPASEAAPGMGGGMGGMGGGMGGMGF

SEQ ID NO: 6061 - protein, 582 aa, Chrysanthemum coronarium
MYRFAANLASKSRIATKTTRQIGSRLNISRNYAAKDIRFGVDARALMLRGVEELADAVKVTMGPKGRNVVIEQSYGAPKVTKDGVTVAKAIEFNDKVKNVGASLVKQVANATNDVAGDGTTCATVLTRAIFSEGCKSVAAGMNAMDLRRGITMAVDSVVTNLKSRARMISTSEEITQVGTISANGEREIGELIAKAMERVGKEGVITIQDGKTLYNELEVVEGMKLDRGYISPHFITNTKNQKCELDDPIVLIYEKKISNINSVIKVLELALKKQRPLLIVAEDVESEALATLILNKLRAGIKVCAIKAPGFGENRKAKLQDLATLTGGQVITEELGMNIDNVELEMLGSCKKVTVSKDDTVVLDGAGDKKSIEERCEQIRSAIESSTSDYDREKFQERLAKLSGGVAVLKIGGASDTEVSEKKDRVTDALNATKAAVEEGIVPGGGVALLYASKELDKLQTANFDQKIGVQIIQNALKMPVHTIASNAGVEGSVVVGKLLEQDDQDLGYDAAKGEYVDMVKNGIIDPLKVIRTALVDAASVSSLMTTTEAIVTELPKPASEAAPGMGGGMGGMGGMGGMDF

SEQ ID NO: 6062 - protein, 582 aa, Chrysanthemum coronarium
MYRFAANLASKSRIATKTTRQIGSRLNISRNYAAKDIRFGVDARALMLRGVEELADAVKVTMGPKGRNVVIEQSYGAPKVTKDGVTVAKAIEFNDKVKNVGASLVKQVANATNDVAGDGTTCATVLTRAIFSEGCKSVAAGMNAMDLRRGITMAVDSVVTNLKSRARMISTSEEITQVGTISANGESEIGKIIAKTMERVGKEGVITIQDGKTLYNELEVVEGMKLDRGYISPHFITNTKNQKCELDDPTVLIYEKKISNINSVIKVLELALKKQRPLLIVAEDVESEALATLILNKLRAGIKVCAIKAPGFGENRKANLQDLATLTGGQVITEELGMNLDNVELEMLGSCKKVTVSKDDTVVLDGAGDKKSIEERCEQIRSAIESSTSDYDREKFQERLAKLSGGVAVLKIGGASDTEVSEKKDRVTDALNATKAAVEEGIVPGGGVALLYASKELDKLQTANFDQKIGVQIIQNALKMPVHTIASNAGVEGSVVVGKLLEQDDPDLGYDAAKGEYVDMVKNGIIDPLKVIRTALVDAASVSSLMTTTEAIVTELPKPASEAAPGMGGGMGGMGGMGGMDF

SEQ ID NO: 6063 - protein, 426 aa, Arachis hypogaea
MYRFATSLASKARIARNSSQQIGSRLSWSRNYAAKDIRFGVEARAAMLKGVEELADAVKVTMGPKGRNVVIEQSFGAPKVTKDGVTVAKSIEFKDKVKNVGASLVKQVANATNDVAGDGTTCATVLTRAIFTEGCKSVAAGMNAMDLRRGINMAVDAVVTNLKSRARMISTSEEIAQVGTISANGEREIGELIAKAMEKVGKEGVITISDGKTLYNELEVVEGMKLDRGYISPYFITNQKNQKCELEDPLILIHEKKISSINAIVKVLELALKRQRPLLIVAEDVESDALATLILNKLRAGIKVCAIKAPGFGENRKSGLQDLAVLTGGDLITEELGLNLEKVDLEMLGTCKKVTILKMTLSFLMALVTRKQLRKDVIRLGQQLKIALQIMTRKSCRNAWPNFLGVLQCSRLEEPVRLKLVRRRIE

SEQ ID NO: 6064 - protein, 575 aa, Theobroma cacao
MYRFASSLASKARIARNTTHQIGSRLSWNRNYAAKDIKFGVEARALMLKGVEELADAVKVTMGPKGRNVVIEQSYGAPKVTKDGVTVAKSIDFKDKIKNVGASLVKQVANATNDVAGDGTTCATLLTRAIFTEGCKSVAAGMNAMDLRRGITMAVDDVVTNLKSRARMISTSEEIAQVGTISANGEREIGELIAKAMEKVGKEGVITIQDGKTLFNELEVVEGMKLDRGYISPYFITNTKNQKCELDDPLILIHEKKISSLNAVVKVLELALKRQRPLLIVAEDVESEALATLILNKLRAGIKVCAIKAPGFGENRKASLQDLAVLTGGEVITEELGMNLEKVDLDMLGTCKKATVSKDDTVFLDGDGDKKAIEERCEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVYTIASNAGVEGAVVVGKLLEQDNPDLGYDAAKGEYVDMVKAGIVDPLKVIRTALVDAASVSSLMTTTEAIVVELPKDEKDVSAMPGGMGGMDY

SEQ ID NO: 6065 - protein, 578 aa, Citrus clementina
MYRFASSLASKARIARNSTQQIGNRLSWSRNYAAKDIRFGVEARALMLKGVEELADAVKVTMGPKGRNVVIEQSWGAPKVTKDGVTVAKSIEFKDKVKNIGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIQDGKTLYNELEVVEGMKLDRGYISPYFITNQKNQKCELEDPLILVHEKKISNLTAVVRVLELALKRQRPLLIVAEDVESEALATLILNKLRAGIKVCAIKAPGFGENRKANMQDLAVLTGGDLITEELGMDLEKVNLDMLGTCKKVTISKDDTVILDGAGDKKSIEERCEQIRSAIENSTSDYDKEKLQERLAKLSGGVAVLKIGGASEAEVGEKKDRVTDALNATKAAVEEGIVPGGGVALLYAAKELEKLSTANFDQKIGVQIIQNALKTPVHTIAANAGVEGAVVVGKLLEQDNTDLGYDAAKGEYVDMVKSGIIDPLKVIRTALVDAASVSSLMTTTEAIVVELPKEEKEAPGGMGGMGGMGGMDY

SEQ ID NO: 6066 - protein, 575 aa, Gossypium raimondii
MYRFASSLASKARAARNTTYQIGSRLSWNRNYAAKDIKFGVEARALMLKGVEELADAVRVTMGPKGRNVVIEQSYGAPKVTKDGVTVAKSIEFKDKVKNVGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIQDGKTLYNELEVVEGMKLDRGYISPYFITNTKTQKCELDDPLILIHEKKVSSLNAVVKVLELALKRQRPLLIVAEDVESEALATLILNKLRAGIKVCAIKAPGFGENRKSSLHDLAVLTGGEVITEELGMNLEKVDLDMLGTCKKVTVSKDDTVILDGNGDKKAIEERCEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVIVGKLLEQDNPDLGYDAAKGEYVDMVKAGIIDPLKVIRTALVDAASVSSLMTTTEAVVVELPKDEKDVPAMPGGMGGMDY

SEQ ID NO: 6067 - protein, 575 aa, Vitis vinifera
MYRFATSLASKARIARNSTHQIGSRLNWSRNYAAKDIRFGVEARALMLKGVEELADAVRVTMGPKGRNVVLEQSFGAPKVTKDGVTVAKSIEFKDRIKNVGASLVKQVANATNDVAGDGTTCATVLTRAIFTEGCKSVAAGMNAMDLRRGISMAVDAVVTNLKSRAKMISTSEEIAQVGTISANGEREIGELIAKAMEKVGKEGVITISDGKTLYNELEVVEGMKLDRGYISPYFITNQKTQKCELENPLVLIHEKKISNIHAVVKVLEMALKTQRPLLIVAEDVESEALATLILNKLRAGIKVCAIKAPGFGENRKAALQDLATLTGGELITEELGLNLEKAELDMLGTCKKVTISKDDTVILDGAGDKKAIEERCEQIRSAIESSTSDYDKEKLQERLAKLSGGVAVLKIGGASEAEVSEKKDRVTDALNATKAAVEEGIVPGGGVALLYASKELDKLPTSNFDQKIGVQIIQNALKTPVFTIASNAGVEGAVVVGKLLEQDNPDLGYDAAKGEYVDMVKAGIIDPLKVIRTALVDAASVSSLMTTTEAVVVELPKDEKEVPAMGGGMGGMDY

SEQ ID NO: 6068 - protein, 575 aa, Olea europaea
MYRFAANLASKARVARNSSQQIGSRLGWSRNYAAKDIRFGVEARALMLKGVEELAEAVKVTMGPKGRHVVIEQSWGAPKVTKDGVTVAKSIEFKDKVKNIGASLVKQVANATNDVAGDGTTCATVLTRAIFTEGCKSVAAGMNSMDLRRGISMAVDAVVTNLKSRARMISTSEEIAQVGTISANGEREIGELIAKAMERVGKEGVITIQDGKTLFNELEVVEGMKLDRGYISPYFITNQKNQKCELDDPLILIHEKKISNLNAVVKVLELALKRQRPLVIVAEDVESEALATLILNKLRAGIKVCAIKAPGFGENRKANLQDLAALTGGQVITEELGLNLENVELDMLGSCKKVTISKDDTVILDGAGEKRAIEERCEQIRSAIELSTSDYDKEKLQERLAKLSGGVAVLKIGGASEAEVSEKKDRVTDALNATKAAVEEGIVPGGGVALLYASKELDKLPTANFDQKIGVQIIQNALKTPVHTIAANAGVEGAVIVGKLLEQDNPDLGYDAAKGEYVDMVKAGIIDPLKVIRTALTDAASVSSLMTTTEAIVVEQPKDEKAAPEMGGGMGGMDY

SEQ ID NO: 6069 - protein, 584 aa, Chrysanthemum coronarium
MYRFAANLASKSRIATKTTRQIGSRLNLSRNYAAKDIRFGVDARALMLRGVEELADAVKVTMGPKGRNVVIEQSYGAPKVTKDGVTVAKAIEFNDKVKNVGASLVKQVANATNDVAGDGTTCATVLTRAIFSEGCKSVAAGMNAMDLRRGITMAVDSVVTNLKSRARMISTSEEITQVGTISANGEREIGELIAKAMERVGKDGVITIQDGKTLYNELEVVEGMKLDRGYISPHFITNTKNQKCELDDPLVLIYEKKISNITSVIKVLELALKKQRPLLIIAEDVESEALATLILNKLRAGVKVCAIKAPGFGENRKANLQDLATLTGGQVITEELGMNLDNVELDMLGSCKKVTVSKDDTVVLDGAGDKKSIEERCEQIRSGIDSSTSDYDREKFQERLAKLSGGVAVLKIGGASDTEVGEKKDRVTDALNATKAAVEEGIVPGGGVALLYASKELDKLQTANFDQKIGVQIIQNALKMPVHTIASNAGVEGSVVVGKLLEQDDPDLGYDAAKGEYVNMVKNGIIDPVKVIRTALVDAASVSSLMTTTEAIVTELPKPASEAAPGMGGMGGMGGMGGMGGMDF

SEQ ID NO: 6070 - protein, 575 aa, Gossypium hirsutum
MYRFASSLASKARAARNTTYQIGSRLSWNRNYAAKDIKFGVEARALMLKGVEELADAVRVTMGPKGRNVVIEQSYGAPKVTKDGVTVAKSIEFKDKVKNVGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIQDGKTLYNELEVVEGMKLDRGYISPYFITNTKTQKCELDDPLILIHEKKVSSLNAVVKVLELALKRQRPLLIVAEDVESEALATLILNKLRAGIKVCAIKAPGFGENRKSSLHDLAVLTGGEVITEELGMNLEKVDLDMLGTCKKVTVSKDDTVILDGNGDKKAIEERCEQIRSAIELSTSDYDKEKLQERLAKLSGGVAVLKIGGASEAEVGEKKDRVTDALNATKAAVEEGIVPGGGVALLYALKELDKLPTANFDQKIGVQIIQNALKTPVHTIASNAGVEGAVIVGKLLEQDNPDLGYDAAKGEYVDMVKAGIIDPLKVIRTALVDAASVSSLMTTTEAVVIELPKDEKDVPAMPGGMGGMDY

SEQ ID NO: 6071 - protein, 578 aa, Cajanus cajan
MYRFASSLASKARIARSSRQQVGSRLSWSRNYAAKDIKFGVEARALMLKGVEDLADAVKVTMGPKGRNVVIEQSFGAPKVTKDGVTVAKSIEFKDKVKNVGASLVKQVANATNDVAGDGTTCATVLTRAIFAEGCKSVAAGMNAMDLRRGISMAVDAVVTNLKSRARMISTSEEIAQVGTISANGEREIGELIAKAMEKVGKEGVITISDGKTLYNELEVVEGMKLDRGYISPYFITNDKNQKCELEDPLILIHEKKISSINAVVKVLELALKRQRPLLIVAEDVESDALATLILNKLRAGIKVCAIKAPGFGENRKAGLQDLAVLTGGALITEELGLKLEKVDLDMLGSCKKITISKDDTVILDGAGDKKSIEERCEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVLTIASNAGVEGAVVVGKLLEQDNPDLGYDAAKGEYVDMVKSGIIDPLKVIRTALVDAASVSSLMTTTEAIVSELPKDDKDTPAMGGGMGGMGGMDY

SEQ ID NO: 6072 - protein, 575 aa, Sesamum indicum
MYRFATNLAGKARLARNSSQQVGSRWGWSRNYAAKDIRFGVEARALMLKGVEELADAVKVTMGPKGRNVVIEQSWGAPKVTKDGVTVAKSIEFKDKVKNIGASLVKQVANATNDVAGDGTTCATVLTRAIFMEGCKSVAAGMNAMDLRRGITMAVDAVVTNLKSRARMISTSEEIAQVGTISANGEREIGELIAKAMEKVGKEGVITIQDGKTLFNELEVVEGMKLDRGYISPYFITNQKNQKCELDDPLILIHEKKISSINAVVKVLELALKRQRPLLIVAEDVESDALATLILNKLRAGIKVCAVKAPGFGENRKSSLQDLAVLTGGQVITEELGMNLDDVELDMLGSCKKVTISKDDSVILDGAGEKKSIEERCEQIRSAIELSTSDYDKEKLQERLAKLSGGVAVLKIGGASEAEVGEKKDRVTDALNATKAAVEEGIVPGGGVALLYASKELEKLPTANFDQKIGVQIIQNALKTPVYTIASNAGVEGAVVVGKLLESDNPDLGYDAAKGEYVDMVKAGIIDPLKVIRTALVDAASVSSLMTTTEAIVVEQPKDEKPAPPMGGGMGEMDY

SEQ ID NO: 6073 - protein, 575 aa, Glycine max
MYRFASNLASKARIARSSSHQIGSRLSSSRNYAAKDIRFGVEARALMLKGVEELADAVKVTMGPKGRNVVIEQSFGAPKVTKDGVTVAKSIEFKDKVKNVGASLVKQVANATNDVAGDGTTCATVLTRAIFTEGCKSVAAGMNAMDLRRGISMAVDAVVTNLKSRARMISTSEEIAQVGTISANGEREIGELIAKAMEKVGKEGVITISDGKTLYNELEVVEGMKLDRGYISPYFITNDKNQKCELEDPLILIHEKKISSINAIVKVLELALKRQRSLLIIAEDVESDALATLILNKLRAGIKVCAIKAPGFGENRKANLQDLAVLTGGALITEELGLKLEKVDLDMLGTCKKITVSKDDTVILDGAGDKKALEERCEQIRSAIENSTSDYDKEKLQERLAKLSGGVAVLKIGGASEAEVGEKKDRVTDALNATKAAVEEGIVSGGGVALLYASKELDKLQTANFDQKIGVQIIQNALKTPVLTIASNAGVEGAVVVGKLLEQENHDLGYDAAKGEYVDMVKAGIIDPLKVIRTALVDAASVSSLMTTTEAVVSELPNDDKDTPAMAGGMGGMGY

SEQ ID NO: 6074 - protein, 576 aa, Vinca minor
MYRFAANLATKARVAKSSSQQVGSRLGWNRNYAAKDIKFGVEARALMLKGVEDLAEAVKVTMGPKGRNVVIEQSWGAPKVTKDGVTVAKSIEFKDKVKNVGASLVKQVANATNDTAGDGTTCATILTRAIFTEGCKSVAAGVNAMDLRRGINSAVDSVVTHLKSRAQMISTSEEIAQVGTISANGEREIGELIAKAMEKVGKEGVITIQDGKTLFNELEVVEGMKLDRGYISPYFITNQKTQKCELENPLIVIHEKKISSINAVVKVLELALKRQRPLLIISEDVDSEALATLILNKLRAGIKVCAVKAPGFGESRKAGLHDLAALTGAQVITEELGLNLDNLELEMLGSCKKVTISKDDTVLLDGAGEKKAIEERCEQIRSSIELSTSDYDKEKLQERLAKLSGGVAVLKIGGASEAEVGEKKDRVTDALNATKAAVEEGIVPGGGVALLYASKELEKLSTANFDQKIGVQIIQNALKMPVHTIAANAGVEGAVVVGKLLEQDNPELGYDAAKGEYVDMVKAGIIDPLKVIRTALVDAASVSSLLTTTEAVVVELPKEEKADPAMGGGGMGDMGY

SEQ ID NO: 6075 - protein, 575 aa, Eucalyptus grandis
MYRFASSLASKARIARNSAHQIGSRASWARNYAAKDIKFGVEARALMLKGVEDLADAVKVTMGPKGRNVVIEQSFGAPKVTKDGVTVAKSVEFKDRIKNVGASLVKQVANATNDVAGDGTTCATVLTRAIFTEGCKSVAAGMNAMDLRRGITLAVDAVVTNLKSRARMISTSEEIAQVGTISSNGEREIGELIAKAMEKVGKEGVITISDGKTLYNELEVVEGMKLDRGYISPYFITNQKNQKCELEDPLILIHEKKISSINAVVKVLELALKRQRPLLIVAEDVESDALATLILNKLRAGIKVCAIKAPGFGENRKAGLQDLASLTGGELITEELGMNLEKVDLEMLGSCKKVTVSKDDTIILDGAGDKKSIEERCEQIRSAIELSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQDNPDLGYDAAKGDYVDMVKSGIIDPLKVIRTALVDAASVSSLLTTTEAVVVELPKDDKEGASMPPGMGGMDY

SEQ ID NO: 6076 - protein, 574 aa, Ricinus communis
MYRFASSLASKARIARNSTHQIGSRLSWSRNYAAKDIKFGVEARALMLKGVEELAEAVKVTMGPKGRNVVIEQSFGAPKVTKDGVTVAKSIEFKDKIKNIGASLVKQVANATNDVAGDGTTCATVLTRAIFTEGCKSVAAGMNAMDLRRGISMAVDAVVTNLKSRARMISTSEEIAQVGTISANGEREIGELIAKAMEKVGKEGVITIQDGKTLYNELEVVEGMKLDRGYISPYFITNQKNQKCELDDPLILIHEKKISSINAVVKVLELALKRQRPLLIIAEDVESEALATLILNKLRAGIKVCAIKAPGFGENRKAGLQDLAVLTGGQVITEELGLNLEKVDLDMLGSCKKVTVSKDDTVVLDGAGEKKDIEERCEQIRSTIELSTSDYDKEKLQERLAKLSGGVAVLKIGGASEAEVGEKKDRVTDALNATKAAVEEGIVPGGGVALLYATKELEKLQTANFDQKIGVQIIQNALKTPVHTIASNAGVEGAVVVGKLLEQDNYDLGYDAAKGEYVDMVKAGIIDPLKVIRTALVDAASVSSLMTTTEAVVSELPKDESAAPAMPPGMGMDY

SEQ ID NO: 6077 - protein, 577 aa, Petroselinum crispum
MYRFAANLASKARIASNSSKQIGSRLNLSRNYAAKDIRFGVEARALMLKGVEELADAVRVTMGPKGRTVVIEQPYGAPKVTKDGVTVAKSIEFKDKVKNIGASLVKQVANATNDVAGDGTTCATVLTRAIFTEGCKSVAAGMNAMDLRRGITMAVDAVVTSLKSRARMISTSEEIAQVGTISANGEREIGELIAKAMERVGKEGVITIQDGKTLYNELEVVEGMKLDRGYISPYFITNQKNQKCELDDPLILIHEKKISSINAVVKVLELALKRQRPLLIVAEDVDSEALATLILNKLRAGIKVCAIKAPGFGENRKSNLQDLAVLTGGQVITEELGMNLDNVELDMFGSCKKITISKDDTVVLDGAGEKKAIEERCEQIRSSIELSTSDYDKEKYQERLAKLSGGVAVLKIGGASETEVGEKKDRVTDALNATKAAVEEGIVPGGGVALLYATKELEKLPTANFDQKIGVQIIQDALKTPVHTIASNAGVEGAVVVGKLLEQDDPDLGYDAAKGAYVDMVKAGIIDPVKVIRTALVDAASVSSLMTTTEAIVVELPKDDKDVPMGGGMGGMGGMDY

SEQ ID NO: 6078 - protein, 575 aa, Gossypium hirsutum
MYRFASSLASKARAARNTTYQIGSRLSWNRNYAAKDIKFGVEARALMLKGVEELADAVRVTMGPKGRNVVIEQSYGAPKVTKDGVTVAKSIEFKDKVKNVGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIQDGKTLYNELEVVEGMKLDRGYISPYFITNTKTQKCELDDPLILIHEKKVSSLNAVVKVLELALKRQRPLLIVAEDVESEALATLILNKLRAGIKVCAIKAPGFGENRKSSLHDLAVLTGGEVITEELGMNLEKVDLDMLGTCKKVTVSKDDTVILDGNGDKKAIEERCEQIRSAIELSTSDYDKEKLQERLAKLSGGIAVLKIGGASEAEVGEKKDRVTDALNATKAAVEEGIVPGGGVALLYASKELDKLPTANFDQKIGVQIIQNALKAPVHTIASNAGVEGAVIVGKLLEQDNPDLGYDAAKGEYVDMVKAGIIDPLKVIRTALVDAASVSSLMTTTEAVVVELPKDEKDVPAMPGGMGGMDY

SEQ ID NO: 6079 - protein, 575 aa, Gossypium hirsutum
MYRFASSLASKARAARNTTYQIGSRLSWNRNYAAKDIKFGVEARALMLKGVEELSDAVRVTMGPKGRNVVIEQSYGAPKVTKDGVTVAKSIEFKDKVKNIGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIQDGKTLYNELEVVEGMKLDRGYISPYFITNTKTQKCELDDPLILIHEKKVSSLNAVVKVLELALKRQRPLLIVAEDVESEALATLILNKLRAGIKVCAIKAPGFGENRKSSLHDLAVLTGGEVITEELGMNLEKVDLDMLGTCKKVTVSKDDTVILDGNGDKKAIEERCEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVIVGKLLEQDNPDLGYDAAKGEYVDMVKAGIIDPLKVIRTALVDAASVSSLMTTTEAVVVELPKDEKDVPAMPGGMGGMDY

SEQ ID NO: 6080 - protein, 575 aa, Gossypium hirsutum
MYRFASSLASKARAARNTTYQIGSRLSWNRNYAAKDIKFGVEARALMLKGVEELADAVRVTMGPKGRNVVIEQSYGAPKVTKDGVTVAKSIEFKDKVKNVGASLVKQVANATNDVAGDGTTCATVLTRAIFTEGCKSVAAGMNAMDLRRGITMAVDAIVTNLKSRARMISTSEEIAQVGTISANGEREIGELIAKAMEKVGKEGVITIQDGKTLYNELEVVEGMKLDRGYISPYFITNTKTQKCELDDPLILIHEKKVSSLNAVVKVLELALKRQRPLLIVAEDVESEALATLILNKLRAGIKVCAIKAPGFGENRKSSLHDLAVLTGGEVITEELGMNLEKVDLDMLGTCKKVTVSKDDTVILDGNGDKKAIEERCEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVIVGKLLEQDNPDLGYDAAKGEYVDMVKAGIIDPLKVIRTALVDAASVSSLMTTTEAVVVELPKDEKDVPAMPGSMGGMDY

SEQ ID NO: 6081 - protein, 575 aa, Olea europaea
MYRFAANLASKARIARNSSQQIGSRLGWSRNYAAKDIRFGVEARALMLKGVEELSEAVKVTMGPKGRNVVIEQSWGAPKVTKDGVTVAKSIEFKDKVKNIGASLVKQVANATNDVAGDGTTCATVLTRAIFAEGCKSVAAGMNSMDLRRGISMAVDSVVTNLKSRARMISTSEEISQVGTISANGEREIGELIAKAMERVGKEGVITIQDGKTLFNELEVVEGMKLDRGYISPYFITNQKNQKCELDDPLILIHEKKISNLNAIVKVLELALKRQRPLVIVAEDVESDALATLILNKLRAGIKVCAIKAPGFGENRKASLQDLAALTGGQVITEELGLNLENVELDMLGSCKKVTISKDDTVILDGAGEKKAIEERCEQIRSAIELSTSDYDKEKLQERLAKLSGGVAVLKIGGASEAEVSEKKDRVTDALNATKAAVEEGIVPGGGVALLYASKELDKLPTANFDQKIGVQIIQNALRTPVHTIAANAGVEGAVVVGKLLEQDNPDLGYDAAKGEYVDMVKAGIIDPLKVIRTALTDAASVSSLMTTTEAIVVELPKDEKPAPEMGGGMGGMDY

SEQ ID NO: 6082 - protein, 578 aa, Prunus persica
MYRFASSLASKARVARNCSKQIGGTLSWSRNYAAKDIKFGVEARALMLNGVEDLADAVKVTMGPKGRNVVIEQSFGAPKVTKDGVTVAKSIEFKDKIKNVGASLVKQVANATNDVAGDGTTCATILTRAIYTEGCKSVAAGMNAMDLRRGITMAVDSVVTNLKSRARMISTSEEIAQVGTISANGEREIGELIAKAMEKVGKEGVITISDGKTLDNELEVVEGMKLDRGYISPYFITNQKNQKCELENPLIVIHEKKISSINAVVKILELALQKQRPLLIVAEDVESEALATLILNKLRAGIKVCAIKAPGFGENRKSSLQDLAVLTGGSLITEELGLNLDKVELDMLGTCKKVTISKDDTVILDGAGDKKAIDERSEQIRSAIELSTSDYDKEKLQERLAKLSGGVAVLKIGGASETEVGEKKDRVTDALNATKAAVEEGIVPGGGVALLYASKELEKLPTANFDQKIGVQIIQNALKAPVHTIASNAGVEGAVVVGKLLEQDNPDLGYDAAKGEYVDMVKSGIIDPLKVIRTALVDAASVSSLLTTTEAVVVELPSDKETPAMGGGMGGGMGGMDY

SEQ ID NO: 6083 - protein, 577 aa, Fragaria vesca
MYRLASSLASKARGIRNNAQQIGGRLNWSRNYAAKDIRFGVDARALMLSGIEDLADAVKVTMGPKGRNVVIEQSFGAPKVTKDGVTVAKSIEFKDKVKNVGASLVKQVANATNDVAGDGTTCATILTRAIYTEGCKSVAAGMNAMDLRRGITMAVDSVVTNLKSRARMISTSEEIAQVGTISANGEREIGELIAKAMEKVGKEGVITIADGKTLYNELEVVEGMKLDRGYISPHFITNPKNQKCELEDPLVLIHEKKISNINAVIKVLELALKKQKPLLIVAEDVESDALATLILNKLRAGIKVCAIKAPGFGENRKSNMQDLAVLTGGTVITEELGLNLEKVDMDMLGTCKKVTISKDDTVILDGAGDKKALEERCEQIRSAIEASTSDYDKEKLQERLAKLSGGVAVLKIGGASEAEVGEKKDRVTDALNATKAAVEEGIVPGGGVALLYAAKELDKLSTANFDQKIGVQIIQNALKAPVHTIASNAGVEGAVIVGKLLEQDDPDLGYDAAKGEYVDMVKAGIIDPLKVIRTALVDAASISSLLTTTEAVVVELPSDKETPAMGGGMGGMGGMDY

SEQ ID NO: 6084 - protein, 578 aa, Prunus mume
MYRFASSLASKARVARNCSKQIGGTLSWSRNYAAKDIKFGVEARALMLNGVEDLADAVKVTMGPKGRNVVIEQSFGAPKVTKDGVTVAKSIEFKDKIKNVGASLVKQVANATNDAAGDGTTCATILTRAIYTEGCKSVAAGMNAMDLRRGITMAVDFVVTNLKSRARMISTSEEIAQVGTISANGEREIGELIAKAMEKVGKEGVITISDGKTLDNELEVVEGMKLDRGYISPYFITNQKNQKCELENPLIVIHEKKISSINAVVKILELALQKQRPLLIVAEDVESEALATLILNKLRAGIKVCAIKAPGFGENRKSSLQDLAVLTGGSLITEELGLNLDKVELDMLGTCKKVTISKDDTVILDGAGDKKAIDERSEQIRSAIELSTSDYDKEKLQERLAKLSGGVAVLKIGGASETEVGEKKDRVTDALNATKAAVEEGIVPGGGVALLYASKELEKLPTANFDQKIGVQIIQNALKAPVHTIASNAGVEGAVVVGKLLEQDNPDLGYDAAKGEYVDMVKSGIIDPLKVIRTALVDAASVSSLLTTTEAVVVELPSDKETPAMGGGMGGGMGGMDY

SEQ ID NO: 6085 - protein, 575 aa, Amborella trichopoda
MYRLASGLLAKSRIRNTSSQIGSRVNWNRNYAAKDIRFGIDARALMLKGVEDLADAVRITMGPKGRNVVIEQSFGAPKVTKDGVTVAKSIEFKDRVKNMGASLVKQVANATNDVAGDGTTCATILTRAIFSEGCKSVAAGMNAMDLRRGISMAVDAVVTNLKSRARMISTSEEIAQVGTISANGEREIGELIAKAMEKVGKEGVITIEDGKTLFNELEVVEGMKLDRGYISPYFITNQKTQKCELEDPLILIHEKKISSINAVVKVLELALKKQRPLLIVAEDVESDALATLILNKLRAGVKVCAIKAPGFGENRKAYLQDLATLTGGEVITEELGLNLEKVDLKMLGSAKKVTVSKDDTVVLDGAGDKKAIEERCEQLRSAIEVSTSDYDREKLQERLAKLSGGVAVLKIGGASEVEVGEKKDRVTDALNATKAAVEEGIVPGGGVALLYATKELEKLQTANFDQKIGVQIIQNALKTPALTIAANAGVEGAVVVGKLLEQDNPDLGYDAAKGEYVDMVKAGIIDPLKVIRTALVDAASVSSLMTMTEAVVAEFPKNESASPAMGASGMGGMHF

SEQ ID NO: 6086 - protein, 577 aa, Brassica napus
  Sequence also found in Organisms: Brassica rapa
MFRFVSSLASKARIASNTRQVSSRMSWSRNYAAKEIKFGVEARALMLRGVEELADAVRVTMGPKGRTVVIEQSWGAPKVTKDGVTVAKSIEFKDKVKNVGASLVKQVANATNDVAGDGTTCATVLTRAIFTEGCKSVAAGMNAMDLRRGISMAVDAVVTNLKSRARMISTSEEIAQVGTISANGEREIGELIAKAMEKVGKEGVITIQDGKTLINELEVVEGMKLDRGYTSPYFITNQKTQKCELEEPLILIHEKKISSINSIVKVLELAMKKQRPLLIVSEDVESEALATLILNKLRAGIKVCAIKAPGFGENRKANLQDLAALTGGEVITDELGMNLEKVDLGMLGTCKRVTVSKDDTVILDGAGDKTAIEERCEQIRSAIELSTSDYDKEKLQERLAKLSGGVAVLKIGGASEAEVGEKKDRVTDALNATKAAVEEGILPGGGVALLYAARELEKLPTANFDQKIGVQIIQNALKTPVHTIASNAGVEGAVIVGKLLEQDNTDLGYDAAKGEYVDMVKAGIIDPLKVIRTALVDAASVSSLLTTTEAVVVDLPKDESESAGAGAGMGGMGGMDY

SEQ ID NO: 6087 - protein, 575 aa, Vaccinium corymbosum
MYRFAANLASKARIARNGTQQIGTRLTWSRNYAAKDIKFGVEARALMLRGVEELADAVKVTMGPKGRNVVLEQSYGAPKVTKDGVTVAKSIEFKDRVKNIGASLVKQVANATNDVAGDGTTCATVLTRAIYAEGCKSVAAGMNAMDLRRGITMAVDAVVTNLKSRARMISTSEEIAQVGTISANGEREIGELIAKAMEKVGKEGVITIADGKTLYNELEVVEGMKLDRGYISPYFITNTKNQKCELEDPLILIHEKKISSLNAVVKVLEMALKERRPLLIVAEDVESEALATLILNKLRAGIKVCAIKAPGFGENRKANLQDLATLTGGEVITEELGMNLENVGPGTFGTCKKVTISKDDTVILDGNGDKKAIEERCEQLRTSIELSTSDYDKEKLQERLAKLSGGVAVLKIGGASEAEVGEKKDRVTDALNATKAAVEEGIVPGGGVALLYASKELEKLHTANFDQKIGVQIIQNALKAPVHTIASNAGVEGAVVVGKLLEQDNPDLGYDAAKGEYVDMVKAGIIDPLKVIRTALVDAASVSSLLTTTEAVVVELPKDEKEAPAMGGGMGGMDY

SEQ ID NO: 6088 - protein, 575 aa, Gossypium hirsutum
MYRFASSLASKARAARNTTYQIGSRLSWNRNYAAKDIKFGVEARALMLKGVEELSDAVRVTMGPKGRNVVIEQSYGAPKVTKDGVTVAKSIEFKDKVKNIGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIQDGKTLYNELEVVEGMKLDRGYISPYFITNTKTQKCELDDPLILIHEKKVSSLNAVVKVLELALKRQRPLLIVAEDVESEALATLILNKLRAGIKVCAIKAPGFGENRKSSLHDLAVLTGGEVITEELGMNLEKVDLDMLGTCKKVTVSKDDTVILDGNGDKKAIEERCEQIRSAIELSTSDYDKEKLQERLAKLSGGVAVLKIGGASEAEVGEKKDRVTDALNATKAAVEEGIVPGGGVALLYALKELDKLPTANFDQKIGVQIIQNALKTPVHTIASNAGVEGAVIVGKLLEQDNPDLGYDAAKGEYVDMVKAGIIDPLKVIRTALVDAASVSSLMTTTEAVVIELPKDEKDVPAMPGGMGGMDY

SEQ ID NO: 6089 - protein, 575 aa, Vigna unguiculata
MYRFATSLASKARIARSSTQQIGSRVNWSRNYAAKDIKFGVEARALMLKGVEELADAVKVTMGPKGRNVVIEQSFGAPKVTKDGVTVAKSIEFKDKVKNIGASLVKQVANATNDVAGDGTTCATILTRAIFTEGCKSVAAGMNAMDLRRGINMAVDAVVTNLKSRARMISTSEEIAQVGTISANGEREIGELIAKAMEKVGKEGVITISDGKTLYNELEVVEGMKLDRGYISPYFITNQKNQKCELEDPLIIIHEKKISSINAIVKVLELALKRQRPLLIVAEDVESDALATLILNKLRAGIKVCAIKAPGFGENRKSGLQDLAVLTGGQLITEELGLNLEKVDLEMFGSCKKITISKDDTVILDGAGDKKAIEERCEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTSVHTIASNAGVEGAVVVGKLLEQDNPDLGYDAAKGEYVDMVKSGIIDPLKVIRTALVDAASVSSLMTTTEAVVSELPKDDKDVPAMGGGMGGMDY

SEQ ID NO: 6090 - protein, 574 aa, Panax ginseng
MYRFAANLASKARIATNSTQQIGSRLSWSRNYAAKDIRFGVEARALMLKGVEELADAVRVTMGPKGRTVVIEQSYGPPKVTKDGVTVAKSIEFKDKVKNIGASLVKQVANATNDVAGDGTTCATILTRAIFTEGCKSVAAGMNAMDLRRGITMAVDAVVTNLKSRARMISTSEEIAQVGTISANGEREIGELIAKAMEKVGKEGVITIQDGKTLYNELEVVEGMKLDRGYISPYFITNQKTQKCELDDPLILIHEKKISSINAVVKVLELALKKQRPLLIVAEDVEGEALATLILNKLRAGVKVCAIKAPGFGENRKANLQDLAVLTGGQVITEELGMNLDNVELDMFGSCKEVTISKDDTVVLDGAGDKKAIEERCEQIRSAIESSTSDYDKEKFQERLAKLSGGVAVLKIGGASETEVGEKKDRVTDALNATKAAVEEGIVPGGGVALLYATKELDKLPTANFDQKIGVQIIRDALKTPVHTIASNAGVEGAVVVGKLLEQDDPDLGFDAAKGAYVDMVKAGIIDPLKVIRTALVDAASVSSLMTTTEAIVVELPKEEKEVPMGGGMGGMDF

SEQ ID NO: 6091 - protein, 575 aa, Gossypium raimondii
MYRFASSLASKARAARNTTYQIGSRLSWNRNYAAKDIKFGVEARALMLKGVEELSDAVRVTMGPKGRNVVIEQSYGAPKVTKDGVTVAKSIEFKDKVKNVGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIEDGKTLYNELEVVEGMKLDRGYISPYFITNTKTQKCELDDPLILIHEKKVSSLNAVVKVLELALKRQRPLLIVAEDVESEALAALILNKLRAGIKVCAIKAPGFGENRKSSLHDLAVLTGGEVITEELGMNLEKVDLDMLGTCKKVTVSKDDTVILDGNGDKKAIEERCEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVIVGKLLEQDNPDLGYDAAKGEYVDMVKAGIIDPLKVIRTALVDAASVSSLMTTTEAVVVELPKDEKDVPAMPGGMGGMDY

SEQ ID NO: 6092 - protein, 579 aa, Mimulus guttatus
MYRFAANLASKARVARNSSQQIGGRLGGLRNYAAKDIRFGVEARALMLKGVEELADAVKVTMGPKGRNVVIEQSWGAPKVTKDGVTVAKSIEFKDKVKNIGASLVKQVANATNDAAGDGTTCATVLTRAIFAEGCKSVAAGMNAMDLRRGITMAVDAVVTNLKSRARMISTSEEIAQVGTISANGDREIGELIAKAMEKVGKEGVITIQDGKTLFNELEVVEGMKLDRGYISPYFITNQKNQKCELDDPLILIYEKKISSIASIVKVLELALKRQRPLLIIAEDVESDALATLILNKLRAGIKVCAVKAPGFGENRKSNMQDLAVLTGGQVITEELGMNLDDVELDMLGSCKKVTISKDDTVVLDGAGEKKSIEERCEQIRSTIELSTSDYDKEKLQERLAKLSGGVAVLKIGGASEAEVGEKKDRVTDALNATKAAVEEGIVPGGGVALLYAAKELDKLATANFDQKIGVQIIQNALKMPVYTIAANAGVEGAVVVGKLLESVDPDLGYDAAKGEYVDMVKAGIIDPLKVIRTALVDAASVSSLMTTTEAIVVEQPSSDKAGPPMGGGGMGGMGDMDY

SEQ ID NO: 6093 - protein, 577 aa, Raphanus sativus
MFRFVSSLASKARIASNTRQVSSRMSWSRNYAAKEIKFGVEARALMLRGVEELADAVRVTMGPKGRTVVIEQSWGAPKVTKDGVTVAKSIEFKDKVKNVGASLVKQVANATNDVAGDGTTCATVLTRAIFTEGCKSVAAGMNAMDLRRGISMAVDAVVTNLKSRARMISTSEEIAQVGTISANGEREIGELIAKAMEKVGKEGVITIQDGKTLINELEVVEGMKLDRGYTSPYFITNQKTQKCELEEPLILIHEKKISSINSIVKVLELAMKRQRPLLIVSEDVESEALATLILNKLRAGIKVCAIKAPGFGENRKANLQDLAALTGGEVITDELGMNLEKVDLSMLGTCKRVTVSTDDTVILDGAGDKTAIEERCEQIRSAVELSTSDYDKEKLQERLAKLSGGVAVLKIGGASEAEVGEKKDRVTDALNATKAAVEEGILPGGGVALLYAARELEKLPTANFDQKIGVQIIQNALKTPVHTIASNAGVEGAVIVGKLLEQDNTDLGYDAAKGEYVDMVKAGIIDPLKVIRTALVDAASVSSLLTTTEAVVVDLPKDESESAGAGAGMGGMGGMDY

SEQ ID NO: 6094 - protein, 577 aa, Brassica oleracea
MFRFVSSLASKARIASNTRQVSSRMSWSRNYAAKEIKFGVEARALMLRGVEELADAVRVTMGPKGRTVVIEQSWGAPKVTKDGVTVAKSIEFKDKVKNVGASLVKQVANATNDVAGDGTTCATVLTRAIFTEGCKSVAAGMNAMDLRRGISMAVDAVVTNLKSRARMISTSEEIAQVGTISANGEREIGELIAKAMEKVGKEGVITIQDGKTLINELEVVEGMKLDRGYTSPYFITNQKTQKCELEEPLILIHEKKISSINSIVKVLELAMKRQRPLLIVSEDVESEALATLILNKLRAGIKVCAIKAPGFGENRKANLQDLAALTGGEVITDELGMNLEKVDLGMLGTCKRVTVSKDDTVILDGAGDKTAIEERCEQIRSAIELSTSDYDKEKLQERLAKLSGGVAVLKIGGASEAEVGEKKDRVTDALNATKAAVEEGILPGGGVALLYAARELEKLPTANFDQKIGVQIIQNALKTPVHTIASNAGVEGAVIVGKLLEQDNTDLGYDAAKGEYVDMVKAGIIDPLKVIRTALVDAASVSSLLTTTEAVVVDLPKDESESAGAGAGMGGMGGMDY

SEQ ID NO: 6095 - protein, 579 aa, Trifolium pratense
MYRFASSLASKARIARNSTHQIGSRVAWSRNYAAKEIKFGVEARALMLKGVEELAEAVKVTMGPKGRNVVIEQSFGAPKVTKDGVTVAKSIEFKDKVKNIGASLVKQVANATNDVAGDGTTCATILTRAIFAEGCKSVAAGMNAMDLRRGINMAVDAVVTNLKSRARMISTSEEIAQVGTISANGDREIGELIAKAMEKVGKEGVITIADGKTLDNELEVVEGMKLDRGYISPYFITNQKNQKCELEDPLIIIHEKKISSINSIVKVLELALKKQRPLLIVAEDVESDALATLILNKLRAGIKVCAIKAPGFGENRKSGLQDLAVLTGGQLITEELGLNLEKVDLDVFGSCKKITISKDDTVILDGAGDKKAIEERCEQIRSAVENSTSDYDKEKLQERLAKLSGGVAVLKIGGASEAEVGERKDRVTDALNATKAAVEEGIVPGGGVALLYASNELSKLPTANFDQKIGVQIIQNALKTPVHTIASNAGVEGAVVVGKLLEQDNPDLGYDAAKGEYVDMVKAGIIDPLKVIRTALVDAASVSSLMTTTEAIVSDLPSDDKDGSAMPGGMGGMGGMGGY

SEQ ID NO: 6096 - protein, 576 aa, Brassica juncea
MFRFVSSLASKARIASNTRQVSSRMSWSRNYAAKEIKFGVEARALMLRGVEELADAVRVTMGPKGRTVVIEQSWGAPKVTKDGVTVAKSIEFKDKVKNVGASLVKQVANATNDVAGDGTTCATVLTRAIFTEGCKSVAAGMNAMDLRRGISMAVDAVVTNLKSRARMISTSEEIAQVGTISANGEREIGELIAKAMEKVGKEGVITIQDGKTLINELEVVEGMKLDRGYTSPYFITNQKTQKCELEEPLILIHEKKISSINSIVKVLELAMKKQRPLLIVSEDVESEALATLILNKLRAGIKVCAIKAPGFGENRKANLQDLAALTGGEVITDELGMNLEKVDMGMLGTCKRVTVSKDDTVILDGAGDKTAIEERCEQIRSAIELSTSDYDKEKLQERLAKLSGGVAVLKIGGASEAEVGEKKDRVTDALNATKAAVEEGILPGGGVALLYAARELEKLPTANFDQKIGVQIIQNALKTPVHTIASNAGVEGAVIVGKLLEQDNTDLGYDAAKGEYVDMVKAGIIDPLKVIRTALVDAASVSSLLTTTEAVVVDLPKDESESAGAGGMGGMGGMDY

SEQ ID NO: 6097 - protein, 575 aa, Gossypium hirsutum
MYRFASSLASKARAARNTTYQIGSRLSWNRNYAAKDIKFGVEARALMLKGVEELSDAVRVTMGPKGRNVVIEQSYGAPKVTKDGVTVAKSIEFKDKVKNVGASLVKQVANATNDVAGDGTTCATVLTRAIFTEGCKSVAAGMNAMDLRRGITMAVDAVVTNLKSRARMISTSEEIAQVGTISANGEREIGELIAKAIEKVGKEGVITIEDGKTLYNELEVVEGMKLDRGYISPYFITNTKTQKCELDDPLILIHEKKVSSLNAVVKVLELALKRQRPLLIVAEDVESEALAALILNKLRAGIKVCAIKAPGFGENRKSSLHDLAVLTGGEVITEELGMNLEKVDLDMLGTCKKVTVSKDDTVILDGNGDKKAIEERCEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVIVGKLLEQDNPDLGYDAAKGEYVDMVKAGIIDPLKVIRTALVDAASVSSLMTTTEAVVVELPKDEKDVPAMPGGMGGMDY

SEQ ID NO: 6098 - protein, 574 aa, Medicago truncatula
MYRFASSLASKARIARSNANQIGSRVAWSRNYAAKEIKFGVEARALMLKGVEELAEAVKVTMGPKGRNVVIEQSFGAPKVTKDGVTVAKSIEFKDKVKNIGASLVKQVANATNDVAGDGTTCATVLTRAIFTEGCKSVAAGMNAMDLRRGINMAVDAVVTNLKSRARMISTSEEIAQVGTISANGDREIGELIAKAMEKVGKEGVITIADGKTLQNELEVVEGMKLDRGYISPYFITNQKNQKCELEDPLIIIHEKKISNINSIVKVLELALKKQRPLLIVAEDVESDALATLILNKLRAGIKVCAIKAPGFGENRKSGLQDLAVLTGGQLITEELGMNLEKVDLEMFGSCKKITISKDDTVILDGAGDKKSIEERCEQIRSAVENSTSDYDKEKLQERLAKLSGGVAVLKIGGASEAEVGEKKDRVTDALNATKAAVEEGIVPGGGVALLYASNELSKLPTANFDQKIGVQIIQNALKTPVHTIASNAGVEGAVVVGKLLEQDNPDLGYDAAKGEYVDMVKSGIIDPLKVIRTALVDAASVSSLMTTTEAVVSELPKEDKDTPAMPGMGGMDY

SEQ ID NO: 6099 - protein, 574 aa, Elaeis guineensis
MYRAAASLASKARIAGSSSRQIGSRLGWSRNYAAKDIRFGVEARALMLKGVEELADAVKVTMGPKGRNVVLEQSFGAPKVTKDGVTVAKSIEFKDKVKNVGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIADGNTLYNELEVVEGMKLDRGYISPYFITNQKNQKCELEDPLILIHEKKISSINAVVKVLELALKKQRPLLIVAEDVESDALATLILNKLRAGIKVCAIKAPGFGENRKSSLHDLAILTGGDVITEELGMNLEKVEFDMLGTCKKVTISKDDTVILHGAGDKKAIEERCEQLRSAIEASTSDYDKEKLQERLAKLSGGVAVLKIGGASEAEVGERKDRVTDALNATKAAVEEGIVTGGGVALLYASKELEKLQTANFDQKIGVQIIQNALKTPVHTIATNAGVEGAVVIGKLLEQDNPDLGYDAAKGEYVDMVKAGIIDPLKVIRTALVDAASVSSLMTTTEAVVVELPKEEKDVPAMSGGMGGMD

SEQ ID NO: 6100 - protein, 577 aa, Arachis hypogaea
MYRFAASLASKAKIARSSSQQIGSRWNWNRNYAAKDIRFGVEARAVMLKGVEELADAVKVTMGPKGRNVVIEQSFGAPKVTKDGVTVAKSIEFKDKVKNIGASLVKQVANATNDVAGDGTTCATVLTRAIFMEGCKSVAAGMNAMDLRRGINMAVDAVVTNLKSRARMISTSEEIAQVGTISANGEREIGELIAKAMEKVGKEGVITISDGKTLYNELEVVEGMKLDRGYISPYFITNQKNQKCELEDPLILIHEKKISSINAIVKVLELALKKQRPLLIVAEDVESDALATLILNKLRAGIKVCAIKAPGFGENRKSGLHDLAVLTGGELITEELGMNLEKVHSEMLGTCKKVTISKDDTVILDGAGDKKAIEERCDQIRSAIENSTSDYDKEKLQERLAKLSGGVAVLKIGGASEAEVGEKKDRVTDALNATKAAVEEGIVPGGGVALLYASSELDKLPTANFDQKIGVQIIQNALKTPVHTIATNAGVEGAVVVGKLLEQNNPDLGYDAAKGEYVDMVKAGIIDPLKVIRTALVDAASVSSLMTTTEAVVSELSKDDEAPSMAGGMGGMGGMDY

SEQ ID NO: 6101 - protein, 575 aa, Citrullus lanatus
MHRFATGLASKARLARNSTNQIASRSSWSRNYAAKDVKFGVEARGLMLKGVEDLADAVKVTMGPKGRNVVIEQSYGAPKVTKDGVTVAKSIEFKDKVKNVGASLVKQVANATNDVAGDGTTCATILTRAIFTEGCKSVAAGMNAMDLRRGISMAVDSVVTNLKSRARMISTSEEIAQVGTISANGEREIGELIAKAMEKVGKEGVITIADGKTLYNELEVVEGMKLDRGYISPYFITNQKNQKCELEDPLILIHEKKISSINAVVKVLELALKRQRPLLIISEDVESDALATLILNKLRAGIKVCAIKAPGFGENRKAGLQDLAVLTGGEVITEELGMNLEKVDLDMLGSCKKITISKDDTVILDGAGDKKAIEERCEQIRAGIEASTSDYDKEKLQERLAKLSGGVAVLKIGGASEAEVGEKKDRVTDALNATKAAVEEGIVPGGGVALLYASKELEKLPTANFDQKIGVQIIQNALKTPVHTIASNAGVEGAVVVGKLLEQDNPDLGYDAAKGEYVDMVKAGIIDPLKVIRTALVDAASVSSLMTTTEAIVVELPKDEKEVPAMGGGMGGMDY

SEQ ID NO: 6102 - protein, 577 aa, Brassica napus
MFRFVSSLASKARIASNTRQVSSRMSWSRNYAAKEIKFGVEARALMLKGVEELADAVRVTMGPKGRTVVIEQSWGAPKVTKDGVTVAKSIEFKDKVKNVGASLVKQVANATNDVAGDGTTCATVLTRAIFTEGCKSVAAGMNAMDLRRGISMAVDAVVTNLKSRARMISTSEEIAQVGTISANGEREIGELIAKAMEKVGKEGVITIQDGKTLINELEVVEGMKLDRGYTSPYFITNQKTQKCELEEPLILIHEKKISSINSIVKVLELAMKRQRPLLIVSEDVESEALATLILNKLRAGIKVCAIKAPGFGENRKANLQDLAALTGGEVITDELGMNLEKVDLGMLGTCKRVTVSKDDTVILDGAGDKTAIEERCEQIRSAIELSTSDYDKEKLQERLAKLSGGVAVLKIGGASEAEVGEKKDRVTDALNATKAAVEEGILPGGGVALLYAARELEKLPTANFDQKIGVQIIQNALKTPVHTIASNAGVEGAVIVGKLLEQDNTDLGYDAAKGEYVDMVKAGIIDPLKVIRTALVDAASVSSLLTTTEAVVVDLPKDESESAGAGAGMGGMGGMDY

SEQ ID NO: 6103 - protein, 579 aa, Centaurea maculosa
MYRFAVNLASKARVANNGNQLIGSRLSWRRNYAAKDIRFGVDARALMLRGVEELADAVRVTMGPKGRNVVIEQSYGAPKVTKDGVTVAKSIEFKDKVKNVGASLVKQVANATNDVAGDGTTCATVLTGAIFSEGCKSVAAGMNAMDLRRGISMAVDSVVANLKSRARMISTSEEITQVGTISANGEREIGELIAKAMEKVGKEGVITIQDGKTLYNELEVVEGMKLDRGYISPHFITNQKNQKCELEDPLVLIHEKKISNINSVIKVLELALKRQRPLLIVAEDVESDALATLILNKLRAGIKVCAIKAPGFGENRKANLEDLATLTGGQLITEELGMNLDNVELEMLGSCKKVTVSKDDTVVLDGAGDKKSIEERCEQIRSAIESSTSDYDKEKFQERLAKLSGGVAVLKIGGASDSEVGEKKDRVTDALNATKAAVEEGIVPGGGVALLYASKELDKLPTANFDQKIGVQIIQNALKMPVYTIASNAGVEGSVVVGKLLEQDDPDLGYDAAKGEYVDMVKNGIIDPLKVIRTALVDAASVSSLMTTTEAIIVELPKPASEAAPGMGGGMGGMGGMDY

SEQ ID NO: 6104 - protein, 575 aa, Cicer arietinum
MYRFASSLASKARIARNNTHQIGSRVGWNRNYAAKEIKFGVEARALMLKGVEELAEAVKVTMGPKGRNVVIEQSFGAPKVTKDGVTVAKSIEFKDKVKNIGASLVKQVANATNDVAGDGTTCATILTRAIFTEGCKSVAAGMNAMDLRRGINMAVDAVVTNLKSRARMISTSEEIAQVGTISANGEREIGELIAKAMEKVGKEGVITIADGKTLNNELEVVEGMKLDRGYISPYFITNQKNQKCELEDPLIIIHEKKISSINAIVKVLELALKRQRPLLIVAEDVESDALATLILNKLRAGIKVCAIKAPGFGENRKSGLQDLAVLTGGQLITEELGMNLEKVDLDMFGSCKKITISKDDTVILDGAGDKKSIEERCEQIRSAIENSTSDYDKEKLQERLAKLSGGVAVLKIGGASEAEVGEKKDRVTDALNATKAAVEEGIVPGGGVALLYASNELSKLQTANFDQKIGVQIIQNALKTPVQTIASNAGVEGAVVVGKLLEQDNPDLGYDAAKGEYVDMVKAGIIDPLKVIRTALVDAASVSSLMTTTEAIVYELPKEDNSSPAMPGGMGGMDY

SEQ ID NO: 6105 - protein, 575 aa, Gossypium hirsutum
MYRFASSLASKARAARNTTYQTGSRLSWNRNYAAKDIKFGVEARALMLKGVEELSDAVRVTMGPKGRNVVIEQSYGAPKVTKDGVTVAKSIEFKDKVKNVGASLVKQVANATNDVAGDGTTCATVLTRAIFTEGCKSVAAGMNAMDLRRGITMAVDAVVTNLKSRARMISTSEEIAQVGTISANGEREIGELVAKAMEKVGKEGVITIEDGKTLYNELEVVEGMKLDRGYISPYFITNTKTQKCELDDPLILIHEKKVSSLNAVVKVLELALKRQRPLLIVAEDVESEALATLILNKLRAGIKVCAIKAPGFGENRKSSLHDLAVLTGGEVITEELGMNLEKVDLDMLGTCKKVTVSKDDTVILDGNGDKKAIEERCEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVIVGKLLEQDNPDLGYDAAKGEYVDMVKAGIIDPLKVIRTALVDAASVSSLMTTTEAVVVELPKDEKDVPAMPGSMGGMDY

SEQ ID NO: 6106 - protein, 575 aa, Cucumis sativus
MHRFASGLASKARLARNSTNQIASRSNWSRNYAAKDVKFGVEARGLMLKGVEDLAEAVKVTMGPKGRNVVIEQSYGAPKVTKDGVTVAKSIEFKDKIKNVGASLVKQVANATNDVAGDGTTCATILTRAIFMEGCKSVAAGMNAMDLRRGISMAVDSVVTNLKSRARMISTSEEIAQVGTISANGEREIGELIAKAMEKVGKEGVITISDGKTLYNELEVVEGMKLDRGYISPYFITNQKNQKCELEDPLILIHEKKISSINAVVKVLELALKRQRPLLIISEDVESDALATLILNKLRAGIKVCAIKAPGFGENRKAGLQDLAVLTGGEVITEELGMNLEKVDLEMLGSCKKITISKDDTVILDGSGDKKAIEERCEQIRAGIEASTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVVVGKLLEQDNPDLGYDAAKGEYVDMVKAGIIDPLKVIRTALVDAASVSSLMTTTEAIVVELPKDEKEVPAMGGGMGGMDY

SEQ ID NO: 6107 - protein, 573 aa, Nicotiana benthamiana
MYRFAAKLASKASVSRNSTQQVGSRLNWSRNYAAKDVKFGVEARGLMLQGVEQLADAVKVTMGPKGRNVVIEQSWGAPKVTKDGVTVAKSIEFKDKIKNVGASLVKQVANATNDAAGDGTTCATVLTRAIFAEGCKSVAAGMNAMDLRRGITMAVDAVVTNLKSRARMISTSEEIAQVGTISANGEREIGELIAKAMEKVGKEGVITIQDGKTLFNELEVVEGMKLDRGYISPYFITNEKNQKCELDDPLILIHEKKISSINAVVKVLELALKRQRPLLIVSEDVESEILATLILNKLRAGIKVCAIKAPGFGENRKANLQDLATLTGGQVITEELGLNLENVELDMLGKCKKVTISKDDTVVLDGAGEKKAIEERCEQIRSAIEVSTSDYDKEKLQERLAKLSGGVAVLKVGGASELEVGEKKDRVTDALNATKAAVEEGIVPGGGVALLYASKELDNLPTANFDQKIGVQIIQNALKTPVHTIASNAGVEGAVVVGKLLEQDDPDLGYDAAKGEYVDMVKSGIIDPLKVIRTALVDAASVSSLLTTTEAVVVELPKDETPSPPMPGGGMGY

SEQ ID NO: 6108 - protein, 573 aa, Solanum phureja
MYRFAAKLASKSRVARRSTQQVGSRLNWSRNYAAKDIKFGVEARGLMLQGVEQLADAVKVTMGPKGRNVVIEQSWGAPKVTKDGVTVAKSIEFKDKIKNVGASLVKQVANATNDAAGDGTTCATVLTRAIFAEGCKSVAAGMNAMDLRRGITMAVDAVVTNLKSRARMISTSEEIAQVGTISANGEREIGEIIARAMEQVGKEGVITIQDGKTLLNDLQVVEGMKLDRGYISPYFITNEKNQKCELDDPLILIHEKKISSINAIVKVLELALKRQRPLLIVSEDVESEALATLILNKLRAGIKVCAIKAPGFGENRKANLQDLAALTGGQVITEELGMNIENVELDMLGKCKKVTVSKDDTVVLDGAGEKKAIEERCEQIRSAIELSTSDYDKEKLQERLARLSGGVAVLKVGGASEIEVGEKKDRVTDALNATKAAVEEGILPGGGVALLYASKELDSLPTANFDQKIGVQIIQNALKTPVYTIASNAGVEGSVVVGKLLEQDNPDLGYDAAKGEYVDMIKAGIIDPLKVIRTALVDAASVSSLLTTTEAVIVELPKDEKASPAMPGGGMDY

SEQ ID NO: 6109 - protein, 575 aa, Glycine max
MYRLASNLASKARIARSSSQQIGSRLSLSRNYAAKDIKFGVEARALMLKGVEELADAVKVTMGPKGRNVVIEQSFGAPKVTKDGVTVAKSIEFKDKVKNVGASLVKQVANATNDVAGDGTTCATVLTRAIFTEGCKSIAAGMNAMDLRRGISMAVDAVVTNLKSRARMISTSEEIAQVGMISANGEREIGELIAKAMEKVGKEGVITISDGKTLYNELEVVEGMKLDRGYISPYFITNDKNQKCELEDPLILIHEKKISSINAIVKVLELALKRQRPLLIIAEDVESDALATLILNKLRAGIKVCAIKAPGFGENRKAGLQDLAVLTGGALITEELGLKLEKVDLDMLGTCKKITVSKDDTVILDGAGDKKALEERCEQIRSAIENSTSDYDKEKLQERLAKLSGGVAVLKIGGASEAEVGEKKDRVTDALNATKAAVEEGIVPGGGVALLYASRELDKLQTANFGQKIGVQIIQNALKTPVLTIASNAGVEGAVVVGKLLEQENHDLGYDAAKGEYVDMVKAGIIDPLKVIRTALVDAASVSSLMTTTEAVVSELPNDNKDTPAMAGGMGGMGY

SEQ ID NO: 6110 - protein, 579 aa, Valeriana officinalis
MYRYAANLASKARIARLNGQQVGSRLAWSRNYAAKEIKFGVEARALMLRGVEELADAVKVTMGPKGRNVCIDQSYGPPKVTKDGVTVAKSIEFKDRVKNVGASLVKQVANATNDIAGDGTTCATVLTRAIYTEGCKSVAAGMNAMDLRRGITMAVDAVVTNLKSRARMISTSEEIAQVGTISANGEREIGELIAKAMERVGKEGVITISDGKTLHNELEVVEGMKLDRGYISPYFITNQKNQKCELDDPLILIHEKKISSLNAIVKVLELALKKQRPLLIVSEDVESEALATLILNKLRAGIKVCAIKAPGFGENRKANLQDLATLTGGEVVTEELGHNLEKVGIEMLGTCKKVTISKDDTVILDGAGDKKAIEERCEQLRSSVELSTSDYDKEKLQERLAKLSGGVAVLKIGGASEAEVSEKKDRVTDALNATKAAVEEGIVPGGGVALLYASKELDKLSTANFDQKIGVQIIQNALKAPVFTIASNAGVEGAVVVGKLLEQDNSDFGYDAAKGEYVDMVKAGIIDPLKVIRTALIDAASVSSLLTTTEAVVVDLPKDDKEVPMGGGGGMGGMGGMDY

SEQ ID NO: 6111 - protein, 245 aa, Gossypium hirsutum
MYRFASSLASKARAARNTTYQIGSRLSWNRNYAAKDIKFGVEARALMLKGVEELSDAVRVTMGPKGRNVVIEQSYGAPKVTKDGVTVAKSIEFKDKVKNIGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIEDGKTLYNELEVVEGMKLDRGYISPYFITNTKTKNVN

SEQ ID NO: 6112 - protein, 580 aa, Phalaenopsis aphrodite
MHRFATSLAAKSRVASGGGCSSRQIGSRLAWSRNYAAKDIRFGVEARALMLKGVEELADAVKVTMGPKGRNVVLEQSFGAPKVTKDGVTVAKSIEFKDRVKNMGASLVKQVANATNDVAGDGTTCATILTRAIFAEGCKSVAAGMNAMDLRRGISLAVDTVVTNLKSRTRMISTSEEIAQVGTISANGEREIGELIAKAMEKVGKEGVITISDGKTLYNELEVVEGMKLDRGYISPYFITNQKNQKCELEDPLILIHEKKISSINSVVKVLELALKRQRPLLIVAEDIESDALATLILNKLRAGIKVCAIKAPGFGENRKAGLQDLAVLTGGELITEELGLNLEKVELEMLGACKKVTVSKDDTVILDGSGDKKAIEERCEQIRSAVESSTSDYDKEKLQERLAKLSGGVAVLKIGGASEAEVSEKKDRVTDALNATKAAVEEGIVPGGGVALLYASKELEKLHTANFDQKIGVQIIQNALRTPVHTIASNAGVEGAVVVGKLLEQDNPDLGYDAAKGEYVDLVKAGIIDPLKVIRTALVDAASVSSLMTTTEAVVVEQPKDEKEVSPSMGGGGMGGLDY

SEQ ID NO: 6113 - protein, 575 aa, Musa acuminata
MYRAISSLASKARVARGSGGQIGSRLGWSRNYAAKDIRFGVEARALMLKGVEDLADAVKVTMGPKGRNVVIEQSFGAPKVTKDGVTVAKSIEFKDRIKNMGASLVKQVANATNDVAGDGTTCATILTRAIFSEGCKSVAAGMNAMDLRRGITMAVDAVVTNLKSRARMISTSEEIAQVGTISANGEREIGELIAKAMEKVGKEGVITVADGKTLYNELEVVEGMKLDRGYISPYFITDQKNQRCELEDPLILIHEKKISSINAVVKVLELALKRQRPLLIVAEDVESDALATLILNKLRAGIKVCAVKAPGFGENRKASLQDLATLTGGSVITEELGMNLEKVEFDMLGTCKKVSISKDDTVVLDGAGDKKALEERCEQIRSAIEVSTSDYDKEKLQERLAKLSGGVAVLKIGGASEIEVGEKKDRVTDALNATKAAVEEGIVPGGGVALLYASRELDKLQTANFDQKIGVQIIQNALKSPAHTIASNAGVEGAVVVGKLLEQENPDLGYDAAKGEYVDLVKAGIIDPLKVIRTALVDAASVSSLMTTTEAVVVELPKDEKETPPMGPGMGGMDY

SEQ ID NO: 6114 - protein, 575 aa, Nicotiana benthamiana
MYRFAANLASKARVARTSTQQIGGRLNWSRNYAAKDIRFGVEARAMMLQGVEELADAVKVTMGPKGRIVVIEQSWGAPKVTKDGVTVAKSVEFKDSIKNVGASLVKQVANATNDVAGDGTTCATVLTRAIFAEGCKSVAAGMNAMDLRRGITMAVDSVVTNLKSRARMISTSEEIAQVGTISANGEREIGELIAKAMERVGKEGVITIQDGKTLFNELEVVEGMKLDRGYISPYFITNQKNQKCELDDPLILIHEKKISSVNAVVKALELALKRQRPLLIVAEDVDSEALATLILNKLRAGIKVCAIKAPGFGENRKANLQDLAILTGGQVVTEELGLNIENVELEMLGSCKKVAISKDDTVILDGAGEKKSIEERCEQIRSTIELSTSDYDKEKLQERLAKISGGVAVLKIGGASEAEVGEKKDRVTDALNATKAAVEEGIVPGGGVALLYAAKELDKLETANFDQKIGVQIIQNALKTPVHTIASNAGVEGAVVVGKLLEQDDTDLGYDAAKGEYVDMVKAGIIDPLKVIRTALVDAASVSSLLTTTEAVVVELPKDEKETPAMGGGMGGMDY

SEQ ID NO: 6115 - protein, 573 aa, Nicotiana benthamiana
MYRFAAKLASKASVARNSSHQVGSRLNWSRNYAAKDVKFGVEARGLMLQGVEQLADAVKVTMGPKGRNVVIEQSWGAPKVTKDGVTVAKSIEFMDKIKNVGASLVKQVANATNDVAGDGTTCATVLTRAIFAEGCKSVAAGMNAMDLRRGITMAVDAVVTNLKSRARMISTSEEIAQVGTISANGEREIGELIAKAMEKVGKEGVITIQDGKTLFNELEVVEGMKLDRGYISPYFITNEKNQKCELDDPLILIHEKKISSINAIVKVLELALKRQRPLLIVSEDVEGEILATLILNKLRAGIKVCAIKAPGFGENRKANLQDLAALTGGQVITEELGLNLENVELDMLGKCKKVTISKDDTVVLDGAGEKKAIEERCEQIRSAIELSTSDYDKEKLQERLAKLSGGVAVLKVGGASELEVGEKKDRFTDALNATKAAVEEGIVPGGGVALLYASKELDNLPTANFDQKIGVQIIQNALKTPVHTIASNAGVEGAVVVGKLLEQDDPDLGYDAAKGEYVDMVKSGIIDPLKVIRTALVDAASVSSLLTTTEAVVVELPKEETPSPPMPGGGMGY

SEQ ID NO: 6116 - protein, 575 aa, Cajanus cajan
MYRFATSLASKARIARSSTQQIGSRVSWSRNYAAKDIRFGVEARALMLKGVEELADAVKVTMGPKGRNVVIEQSFGAPKVTKDGVTVAKSIEFKDKVKNIGASLVKQVANATNDVAGDGTTCATILTRAIFTEGCKSVAAGMNAMDLRRGINMAVDAVVTNLKSRARMISTSEEIAQVGTISANGEREIGELIAKAMEKVGKEGVITISDGKTLYNELEVVEGMKLDRGYISPYFITNQKNQKCELEDPLIIIHEKKISSINAIVKVLELALKRQRPLLIVAEDVESDALATLILNKLRAGIKVCAIKAPGFGENRKSGLQDLAVLTGGQLITEELGLNLEKVDLDMLGSCKKVTISKDDTVILDGAGDKKSIEERCEQIRSAIENSTSDYDKEKLQERLAKLSGGVAVLKIGGASEAEVGEKKDRVTDALNATKAAVEEGIVPGGGVALLYASSELDKLQTANFDQKIGVQIIQNALKTPVHTIASNAGVEGAVVVGKLLEQNNTDLGYDAAKGEYVDMVKSGIIDPLKVIRTALVDAASVSSLMTTTEAVVSELPKDDKDVPAMGGGMGGMDY

SEQ ID NO: 6117 - protein, 577 aa, Glycine max
MYRFATSLASKARIARSSTQQIGSRVSWNRNYAAKDIKFGVEARALMLKGVEELADAVKVTMGPKGRNVVIEQSFGAPKVTKDGVTVAKSIEFKDKVKNIGASLVKQVANATNDVAGDGTTCATILTKAIFTEGCKSVAAGMNAMDLRRGINMAVDTVVTNLKSRARMISTSEEIAQVGTISANGEREIGELIAKAMEKVGKEGVITISDGKTLYNELEVVEGMKLDRGYISPYFITNQKNQKCELEDPLIIIHEKKISSINAIVKVLELALKRQRPLLIVAEDVESDALATLILNKLRAGIKVCAIKAPGFGENRKSGLQDLAVLTGGQLITEELGLNLEKVDLEVFGSCKKITISKDDTVILDGAGDKKAIEERSEQIRSAIENSTSDYDKEKLQERLAKLSGGVAVLKIGGASEAEVGEKKDRVTDALNATKAAVEEGIVPGGGVALLYASSELDKLQTANFDQKIGVQIIQNALKTPVHTIASNAGVEGAVVVGKLLEQNDPDLGYDAAKGEYVDMVKAGIIDPLKVIRTALVDAASVSSLMTTTEAIVSELPKDDKDVPAMGGMGGMGGMDY

SEQ ID NO: 6118 - protein, 573 aa, Nicotiana tabacum
MYRFAAKLASKASVARNSSHQVGSRLNWSRNYAAKDVKFGVEARGLMLQGVEQLADAVKVTMGPKGRNVVIEQSWGAPKVTKDGVTVAKSIEFKDKIKNVGASLVKQVANATNDVAGDGTTCATVLTRAIFAEGCKSVAAGMNAMDLRRGITMAVDAVVTNLKSRARMISTSEEIAQVGTISANGEREIGELIAKAMEKVGKEGVITIQDGKTFFNELDVVEGMKLDRGYISPYFITNEKNQKCELDDPLILIHEKKISSINAVVKVLELALKRQRPLLIVSEDVESEILATLILNKLRAGIKVCAIKAPGFGENRKANLQDLATLTGGQVITEELGLNLENVELDMLGKCKKVTISKDDTVVLDGAGEKKAIEERCEQIRSAIELSTSDYDKEKLQERLAKLSGGVAVLKVGGASELEVGEKKDRVTDALNATKAAVEEGIVPGGGVALLYASKELDNLPTANFDQKIGVQIIQNALKTPVHTIASNAGVEGAVVVGKLLEQDDPDLGYDAAKGEYVDMVKSGIIDPLKVIRTALVDAASVSSLLTTTEAVVVELPKDETPSPPMPGGGMGY

SEQ ID NO: 6119 - protein, 574 aa, Trigonella foenum-graecum
MYRFVSSLASKARIARSSTHQIGSRVAWNRNYAAKEIKFGVEARALMLKGVEELAEAVKVTMGPKGRNVVIEQSFGAPKVTKDGVTVAKSIEFKDKVKNIGASLVKQVANATNDVAGDGTTCATILTRAIFTEGCKSVAAGMNAMDLRRGINMAVDAVVTNLKSRARMISTSEEIAQVGTISANGDREIGELIAKAMEKVGKEGVITIADGKTLQNELEVVEGMKLDRGYISPYFITNQKNQKCELEDPLIIIHEKKISNINSIVKVLELALKKQRPLLIVAEDVESDALATLILNKLRAGIKVCAIKAPGFGENRKSGLQDLAVLTGGQLITEELGMNLEKVDLEMFGSCKKITISKDDTVILDGAGDKKSIEERCEQIRSAIENSTSDYDKDKLQERLAKLSGGVAVLKIGGASEAEVGEKKDRVTDALNATKAAVEEGIVPGGGVALLYASNELSKLPTANFDQKIGVQIIQNALKTPVHTIASNAGVEGAVVVGKLLEQDNPDLGYDAAKGEYVDMVKSGIIDPLKVIRTALVDAASVSSLMTTTEAIVSELPKEDKDAPAMPGMGGMDY

SEQ ID NO: 6120 - protein, 565 aa, Tripterygium wilfordii
VDRSSVEQVGSRLNWSRNYAAKDIRFGVGARALMLRGVEELADAVKVTMGPKGRNVVIEQSYGAPKVTKDGVTVAKSIEFKDKVKNIGASLVKQVANATNDVAGDGTTCATILTKAIFAEGCKSVAAGMNAMDLRRGITMAVDSVVTNLKSRARMISTSEEIAQVGTISANGEREIGELIAKAMEKVGKEGVITIQDGKTLFNELEVVEGMKLDRGYISPYFITNQKNQKCELEDPLVLIHEKKISSINAVVKVLELALKKQRPLLIVAEDVESDALATLILNKLRAGIKVCAIKAPGFGENRKANLQDLAVLTGGELITEELGMNLEKVDLDMLGSCKKVTVSKDDTVVLDGAGDKKVIEERCEQIRAAIELSTSDYDKEKLQDRLAKLSGGVAVLKIGGASETEVGEKKDRVTDALNATKAAVEEGIVPGGGVALLYASKELDKLPTANFDQKIGVQIIQNALKTPVYTIAANAGVEGAVVVGKLLEQDNPDLGYDAAKGEYVDMVKSGIIDPLKVIRTALVDAASVSSLMTTTEAVISELPKDEKEVPAMGGGMGGMGGMDY

SEQ ID NO: 6121 - protein, 575 aa, Chrysanthemum coronarium
MYRLAASLASKSRIARNNAQQLRYYAAKDIHFGVGARALMLKGVEELADAVKVTMGPKGRNVVIEQSYGAPKVTKDGVTVAKAIEFNDKVKNVGASLVKQVANATNDVAGDGTTCATVLTRAIFSEGCKSVAAGMNAMDLRRGITMAVDSVVTNLKSRARMISTSEEITQVGTISANGEREIGELIAKAMERVGKEGVITIQDGKTLYNELEVVEGMKLDRGYISPHFITNTKNQKCELDDPIVLIYEKKISNINSVIKVLELALKKQRPLLIVAEDVESEALATLILNKLRAGIKVCAIKAPGFGENRKANLQDLATLTGGQVITEELGMNIDNVELEMLGSCKKVTVSKDDTVVLDGAGDKKSIEERCEQIRSAIESSTSDYDREKFQERLAKLSGGVAVLKIGGASDTEVSEKKDRVTDALNATKAAVEEGIVPGGGVALLYASKELDKLQTANFDQKIGVQIIQNALKMPVHTIASNAGVEGSVVVGKLLEQDDPDLGYDAAKGEYVDMVKNGIIDPLKVIRTALVDAASVSSLMTTTEAIVTELPKPASEAAPGMGGGMGGMGGMGGMDF

SEQ ID NO: 6122 - protein, 574 aa, Manihot esculenta
MYRFASSLASKARIARNSTHQIGSRISWSRNYAAKDIKFGVEARALMLKGVEELADAVKVTMGPKGRNVVIEQSFGAPKVTKDGVTVAKSIEFKDKVKNVGASLVKQVANATNDVAGDGTTCATVLTRAIFMEGCKSVAAGMNAMDLRRGISMAVDAVVTNLKSRTRMISTSEEIAQVGTISANGEREIGELIAKAMEKVGKEGVITIQDGKTLYNELEVVEGMKLDRGYISPYFITNQKNQKCELDDPLILIHEKKISSINAVVKVLELALKRQRPLLIVSEDVESEALATLILNKLRAGIKVCAIKAPGFGENRKAGLQDLAVLTGGEVITEELGLNLEKVDIDMLGSCKKITVSKDDTVILDGAGDKKAIEERCEQIRSAIELSTSDYDKEKLQERLAKLSGGVAVLKIGGASEAEVGEKKDRVTDALNATKAAVEEGIVPGGGVALLYASKELDNLQTANFDQKIGVQIIQNALKTPVHTIASNAGVEGAVVVGKLLEQDNPDLGYDAAKGEYVDMVKAGIIDPLKVIRTALVDAASVSSLMTTTEAVVSELPKDEKDVPAMAPGMGMDY

SEQ ID NO: 6123 - protein, 426 aa, Amorphophallus konjac
MYRAAASLASKARVAGSRSQQIGSRLGWSRNYAAKDIRFGVEARALMLKGVEDLADAVKVTMGPKGRNVVLEQSFGAPKVTKDGVTVAKSIEFKDRIKNMGASLVKQVASATNDVAGDGTTCATILTRAIFAEGCKSVAAGMNAMDLRRGITMAVDAVITNLKSRARMISTPEEIAQVGTISANGEREIGELIAKAMEKVGKEGVITVADGKTLDNELEVVEGMKLDRGYISPYFITDQKNQKCELEDPLILIHEKKISSINAVVKVLELALKRQRPLLIVAEDVESDALATLILNKLRAGIKVCAIKAPGFGENRKASLHDLAVLTGGDVITEDLGMNLDRVELSMLGTCKKVTISKDDTVILDGAGDKKAIEERCEQLRSSIELSTSDYDKEKLQGRLAKLSGGVAVLKIGGASEAEVGEKKTG

SEQ ID NO: 6124 - protein, 578 aa, Castanea mollissima
MYRFASSLASKARLARNTTQQIGSRLNSSRNYAAKDIRFGVEARALMLKGVEELADAVKVTMGPKGRNVVIEQSWGAPKVTKDGVTVAKSIEFKDKVKNIGASLVKQVASATNDAAGDGTTCATVLTRAIFTEGCKSVAAGMNAMDLRRGISMAVDCVVNHLKSSARKISKSDEIAQVGTISANGEREIGELIARAMERVGKEGVITIQDGKTLYNELEVVEGMKLDRGYISPYFITNQKNQKCELEDPLILIHEKKISSLNAIIKVLELALKRQRPLLIVSEDVESEALATLILNKLRAGIKVCAIKAPGFGENRKSNLQDLAILTGGELITEELGMNLEKVDLDMLGSCKKVTISKDDTVILDGAGDKKALEERCEQIRSAIENSTSDYDKEKLQERLGKLSGGVAVLKIGGASEAEVSEKKDRVTDALNATKAAVEEGIVPGGGVALLYASKELEKLETANFDQKIGVQIIQNALKTPVYTIACNAGVEGAVVVGKLLEENDPDKGYDAAKGEYVDMVKAGIIDPVKVIRTALVDAASVSSLMTTTEAIVTEIPKDDKEAPAMGGGMGGMGGMDY

SEQ ID NO: 6125 - protein, 575 aa, Musa acuminata
MYRAISSLASKARVARGSGGQIGSRLGWSRNYAAKDIRFGVEARALMLKGVEDLADAVKVTMGPKGRNVVIEQSFGAPKVTKDGVTVAKSIEFKDRIKNMGASLVKQVANATNDVAGDGTTCATILTRAIFSEGCKSVAAGMNAMDLRRGITMAVDAVVTNLKSRARMISTSEEIAQVGTISANGEREIGELIAKAMEKVGKEGVITVADGKTLYNELEVVEGMKLDRGYISPYFITDQKNQRCELEDPLILIHEKKISSINAVVKVLELALKRQRPLLIVAEDVESDALATLILNKLRAGIKVCAVKAPGFGENRKASLQDLATLTGGSVITEELGMNLEKVEFDMLGTCKKVSISKDDTVVLDGAGDKKALEERCEQIRSAIEVSTSDYDKEKLQERLAKLSGGVAVLKIGGASEIEVGEKKDRVTDALNATKAAVEEGIVPGGGVALLYASRELDKLQTANFDQKIGVQIIQNALKSPAHTIASNAGVEGAVVVGKLLEQENPDLGYDAAKGEYVDLVKSGIIDPLKVIRTALVDAASVSSLMTTTEAVVVELPKDEKETPPMGPGMGGMDY

SEQ ID NO: 6126 - protein, 575 aa, Panax ginseng
MYRFATKLAFKTQIVRKSNQQIGSRLAWSRNYAAKDIRFGVEARALMLRGVEELADAVKVTMGPKGRNVVLEQSFGAPKVTKDGVTVAKSIEFKDRVKNVGASLVKQVANATNDVAGDGTTCATILTRAIFSEGCKSVAAGMNAMDLRRGITMAVDAVVANLKSRARMISTSEEIAQVGTISANGEREIGELIAKAMEKVGKEGVITITDGKTLHNELEVVEGMKLDRGYISPYFITNPKNQKCELEDPLILIHEKKISSLTAVVKVLELALKKQRPLLIVSEDVESEALATLILNKLRAGIKVCAIKAPGFGENRKANLQDLATLTGGTVITDELGMNLEKVGLEVFGSCKKVTISKDDTVILDGAGDKKAIEERCEQLRSTIELSTSDYDKEKHQERLAKLSGGVAVLKIGGASEAEVSEKKDRVTDALNATKAAVEEGIVPGGGVALLYALKELEKLQTANFDQKIGVQIIQNALKAPVQTIASNAGVEGAVVVGKLLEQDDPDLGYDAAKGAYVDMVKAGIIDPLKVIRTALVDAASVSSLLTTTEAVVVELPEDEKEVPATGGGMGGMDY

SEQ ID NO: 6127 - protein, 573 aa, Solanum tuberosum
MYRFAAKLASKSRVARSSTQQIGSRLNWSRNYAAKDIKFGVEARGLMLQGVEQLADAVKVTMGPKGRNVVIEQSWGAPKVTKDGVTVAKSIEFKDKIKNVGASLVKQVANATNDAAGDGTTCATVLTRAIFAEGCKSVAAGMNAMDLRRGITMAVDAVVTNLKSRARMISTSEEIAQVGTISANGEREIGEIIARAMEQVGKEGVITIQDGKTLLNDLQVVEGMKLDRGYISPYFITNEKNQKCELDDPLILIHEKKISSINAIVKVLELALKRQRPLLIVSEDVESEALATLILNKLRAGIKVCAIKAPGFGENRKANLQDLAALTGGQVITEELGMNIENVELDMLGKCKKVTISKDDTVVLDGAGEKKAIEERCEQIRSAIELSTSDYDKEKLQERLARLSGGVAVLKVGGASEIEVGEKKDRVTDALNATKAAVEEGILPGGGVALLYASKELDSLPTANFDQKIGVQIIQNALKTPVYTIASNAGVEGSVVVGKLLEQDNPDLGYDAAKGEYVDMVKAGIIDPLKVIRTALVDAASVSSLLTTTEAVIVELPKDEKAAPAMPGGGMDY

SEQ ID NO: 6128 - protein, 575 aa, Trifolium pratense
MYRFATSIASKARIARSNVNQIGSRVAWSRNYAAKEIKFGVEARALMLKGVEELAEAVKVTMGPKGRNVVIEQSYGAPKVTKDGVTVAKSIEFKDKVKNIGASLVKQVANATNDVAGDGTTCATILTRAIFTEGCKSVAAGMNAMDLRRGINMAVDAVVTNLKSRARMISTSEEIAQVGTISANGDREIGELIAKAMEKVGKEGVITIADGKTLDNELEVVEGMKLDRGYISPYFITNQKNQKCELEDPLIIIHEKKISSINSIVKVLELALKKQRPLLIVAEDVESDALATLILNKLRAGIKVCAIKAPGFGENRKSGLQDLAVLTGGQLITEELGLNLEKVDLDVFGSCKKITISKDDTVILDGAGDKKSIEERCEQIRSAIENSTSDYDKEKLQERLAKLSGGVAVLKIGGASEAEVGEKKDRVTDALNATKAAVEEGIVPGGGVALLYASNELSKLPTANFDQKIGVQIIQNALKTPVHTIASNAGVEGAVVVGKLLEQDNPDLGYDAAKGEYVDMIKSGIIDPLKVIRTALVDAASVSSLMTTTEAVVSELPKDDKDGPAMPGGMGGMDY

SEQ ID NO: 6129 - protein, 578 aa, Flaveria ramosissima
MYRFAANLASKSRIVNTRTQQIGTRLNWSRNYAAKDIRFGVDARALMLKGVEELADAVRVTMGPKGRNVVIEQSYGAPKVTKDGVTVAKSIEFSDKVKNVGASLVKQVANATNDVAGDGTTCATVLTRAIFSEGCKSVAAGMNAMDLRRGISMAVDAVVTNLKSRARMISTSEEITQVGTISANGEREIGELIAKAMEKVGKEGVITIQDGKTLYNELEVVEGMKLDRGYISPHFITNQKNQKCELDDPIVLIHEKKISNINSVIKVLELALKKQRPLLIVAEDVESDALATLILNKLRAGIKVCAIKAPGFGENRKASLQDLATLTGGQLITEELGMNLDNVEPEMLGSCKKVTVSKDDTVVLDGAGDKKSIEERCEQIRSAIEASTSDYDKEKLQDRLAKLSGGVAVLKIGGASDSEVGEKKDRVTDALNATKAAVEEGIVPGGGVALLYASKELDKLQTANFDQKIGVQIIQNALKMPVHTIASNAGVEGSVVVGKLLEQDDPDLGYDAARGEYVDMVKNGIIDPLKVIRTALVDAASVSSLMTTTEAIVVELPKPASEPAPGMGGMGGMGGMDY

SEQ ID NO: 6130 - protein, 572 aa, Panax ginseng
MYRFATKLASKAQIARNSTHLIGSRLAWSRNYAAKDIRFGVEARALMLRGVEELADAVKVTMGPKGRNVILEQSFGAPKVTKDGVTVAKSIEFKDRVKNVGASLVKQVANATNDVAGDGTTCATVLTRAIYSEGCKSVAAGMNAMDLRRGITLAVDAVVANLKSRARMISTSEEIAQVGTISANGEREIGELIAKAMEKVGKEGVITIADGKTLDNELEVVEGMKLDRGYISPYFITNPKNQKCELEDPLILIHEKKISGLTSVVKVLELALQKQRPLLIVSEDVESDALATLILNKLRAGVKVCAIKAPGFGENRKANLQDLAILTGGEVITEELGMKIEKVGLEMLGSCKKVTISKDDTVILDGAGDKKAIEERCEQLRSTIELITSDYDKEKHQERLAKLSGGVAVLKIGGASEAEVSEKKDRVTDALNATKAAVEEGIVPGGGVALLYASKELEKLQTANFDQKIGVQIIQNALKAPVHTIASNAGVEGAVVVGKLLEQDDPDLGYDAAKGAYVDMIKSGIIDPLKVIRTALVDAASISSLLTTTEAVVVELPKDDKEVAAMGGGMGY

SEQ ID NO: 6131 - protein, 575 aa, Nicotiana benthamiana
MYRFAANLASKARVARTSTQHIGGRLNWSRNYAAKDIRFGVEARAMMLQGVEELADAVKVTMGPKGRNVVIEQSWGAPKVTKDGVTVAKNVEFKDKIKNVGASLVKQVANATNDVAGDGTTCATVLTRAIFAEGCKSVAAGMNAMDLRRGITMAVDSVVTNLKSRARMISTSEEIAQVGTISANGEREIGELIAKAMERVGKEGVITIQDGKTLFNELEVVEGMKLDRGYISPYFITNQKNQKCELDDPLILIHEKKISSVNAVVKALELALKRQRPLLIVAEDVDSEALATLILNKLRAGIKVCAIKAPGFGENRKANLQDLAILTGGQVVTEELGLNIENVELEMLGSCKKVAISKDDTVILDGAGEKKSIEERCEQIRSTIELSTSDYDKEKLQERLAKISGGVAVLKIGGASEAEVGEKKDRVTDALNATKAAVEEGIVPGGGVALLYAAKELDKLETANFDQKIGVQIIQNALKTPVHIIASNAGVEGAVVVGKLLEQDDTDLGYDAAKGEYVDMVKAGIIDPLKVIRTALVDAASVSSLLTTTEAVVVELPKDEKETPAMGGGMGGMDY

SEQ ID NO: 6132 - protein, 578 aa, Quercus alba
MYRFASSLASKARLARNTTQQIGSRLSSSRNYAAKDIRFGVEARALMLKGVEELADAVKVTMGPKGRNVVIEQSWGAPKVTKDGVTVAKSIEFKDKVKNIGASLVKQVASATNDAAGDGTTCATVLTRAIFTEGCKSVAAGMNAMDLRRGISMAVDSVVNHLKSSARKISKSDEIAQVGTISANGEREIGELIARAMERVGKEGVITIQDGKTLYNELEVVEGMKLERGYISPYFITNQKNQKCELEDPLILIHEKKISSLNAIIKVLELALKRQRPLLIVSEDVESEALATLILNKLRAGIKVCAIKAPGFGENRKSNLQDLAILTGGELITEELGMNLEKVDLDMLGSCKKVTISKDDTVILDGAGDKKALEERCEQIRSAIENSTSDYDKEKLQERLGKLSGGVAVLKIGGASETEVSEKKDRVTDALNATKAAVEEGIVPGGGVALLYASKELEKLETANFDQKIGVQIIQNALKTPVYTIACNAGVEGAVVVGKLLEENDPDKGYDAAKGEYVDMVKAGIIDPVKVIRTALVDAASVSSLMTTTEAIVTEIPKDDKEAPAMGGGMGGMGGMDY

SEQ ID NO: 6133 - protein, 574 aa, Populus trichocarpa
MHRFTSSLASKARIARSSTNQIGSRLSWSRNYAAKDIRFGVEARAGMLKGVEELADAVKVTMGPKGRNVVIEQSYGAPKVTKDGVTVAKSIEFKDKVKNVGASLVKQVANATNDTAGDGTTCATVLTQAIFTEGCKSVAAGMNAMDLRRGISMAVESVVTNLKSRARMISTSEEIAQVGTISANGEREIGELIAKAMEKVGKEGVITIQDGKTLSNELEVVEGMKLDRGYISPYFITDQKTQKCELDDPLILIHDKKVSSLHAVVKVLELALKRQRPLLIVAEDVESEALATLILNKLRAGIKVCSIKAPGFGENRKAILQDLAALTGGEVITEELGLNLENVDLDMLGSCKKVTVSKDDTVILDGAGDKKSIEERCEQIRSAIDSSTSDYDKEKLQERLAKLSGGVAVLKIGGASEAEVSEKKDRVTDALNATKAAVEEGIVPGGGAALLYASKELDKLQTANFDQKIGVQIIQNALKTPVHTIASNAGVEGAVVVGKLLEQDNPDLGYDAAKGEYVDMVKAGIIDPLKVIRTALVDAASVSSLMTTTEAVVTDLPKDVKDAPAMGPGMGMDY

SEQ ID NO: 6134 - protein, 576 aa, Fragaria vesca
MYRFASNLASKARLAKTSGQQIGSRISWRRNYAAKDIKFGVEARSLMLRGVEELADAVKVTMGPKGRNVVLEQSYGAPKVTKDGVTVAKSIEFKDKVKNIGASLVKQVANATNDAAGDGTTCATVLTRAIFTEGCKSVAAGMNAMDLRRGITMAVDCVVTNLKSRARMISTSEEIAQVGTISANGDREIGELIAKAMEKVGKEGVITISDGKTLDNELEVVEGMKLDRGYISPYFITNQKNQKCELEDALVLIYEKKISNLNAVVKILELALKKQRPLLIVAEDFESEALATLILNKLRAGIKVCAIKAPGFGENRKANLQDISVLTGGEVITEELGLNLEKVTPEMLGTCKRITVSKDDTVILDGAGDKKAIEERCEQLRSSIELSTSDYDKEKLQERLAKLSGGVAVLKIGGASETEVGEKKDRVTDALNATKAAVEEGIVPGGGAALLYASKELDKLQTANFDQKIGVQIIQNALKMPVYTIASNAGVEGAVVVGKLLEQDNPDLGYDAAKGEYVDMIKAGIIDPLKVIRTALVDAASVSSLMTTTEAVVVSLPEKEAPAVGAGMGGMGGMDY

SEQ ID NO: 6135 - protein, 526 aa, Panax ginseng
MLRGVEELADAVKVTMGPKGRNVILEQSFGAPKVTKDGVTVAKSIEFKDRVKNVGASLVKQVANATNDVAGDGTTCATVLTRAIYSEGCKSVAAGMNAMDLRRGITLAVDAVVANLKSRARMISTSEEIAQVGTISANGEREIGELIAKAMEKVGKEGVITIADGKTLDNELEVVEGMKLDRGYISPYFITNPKNQKCELEDPLILIHEKKISGITSVVKVLELALQKQRPLLIVSEDVESDALATLILNKLRAGVKVCAIKAPGFGENRKANLQDLAILTGGEVITDELGMKIEKVGLEMLGSCKKVTISKDDTVILDGAGDKKAIEERCEQLRSTIELITSDYDKEKHQERLAKLSGGVAVLKIGGASEAEVSEKKDRVTDALNATKAAVEEGIVPGGGVALLYASKELEKLQTANFDQKIGVQIIQNALKAPVHTIASNAGVEGAVVVGKLLEQDDPDLGYDAAKGAYVDMIKSGIIDPLKVIRTALVDAASISSLLTTTEAVVVELPKDEKDVPAMGGGMGY

SEQ ID NO: 6136 - protein, 573 aa, Capsicum annuum
MYRFAAKLASKSRVARSTTQQVGSRLNWSRNYAAKDIKFGVEARGLMLQGVEQLADAVKVTMGPKGRNVVIEQSWGAPKVTKDGVTVAKAVEFKDKIKNVGASLVKQVANATNDAAGDGTTCATVLTRAIFTEGCKSVAAGMNAMDLRRGITMAVDAVVTNLKSRARMISTSEEIAQVGTISANGEREIGELIARAMEKVGKEGVITIQDGRTLENDLEVVEGMKLDRGYISPYFITNEKNQKCELEDPLILIHEKKISSINAIVKVLELALKRQKPLLIVSEDVESEALATLILNKLRAGIKVCAIKAPGFGENRKSNLQDLAALTGGQVITEELGLNIENVELDMLGKCKKVTISKDDTVILDGAGEKKAIEDRCEQIRSAIELSTSDYDKEKLQERLAKLSGGVAVLKIGGASEVEVGEKKDRVTDALNATKAAVEEGIVPGGGVALLYASKELETLPTANFDQKIGVQIIQNALKMPVHTIASNAGVEGSVVVGKLLEQDNPDLGYDAAKGEYVDMVKAGIIDPLKVIRTALVDAASVSSLLTTTEAVIVELPKDEKASPPMPGGGMDY

SEQ ID NO: 6137 - protein, 581 aa, Aquilegia formosa
MFRAVANLATKARIARNSSHQIGSRIGWNRNYAAKDIRFGVEARALMLRGVEELADAVKVTMGPKGRNVVLEQSYGAPKVTKDGVTVAKSIEFKDRIKNVGASLVKQVANATNDAAGDGTTCATVLTRAIFSEGCKSVAAGMNAMDLRRGITMAIDSVVTTLKSRTRMISTSEEIAQVGTISANGEREIGELLAKAMEKVGKEGVITIVDGKTLYNELEVVEGMKLDRGYISPYFVTNQKNQKCELDDPLILIHEKKISSINAVVKVLELALKHQRSLLIIAEDVESDALATLLINKIRAGIKLCAIKAPGFGENRKASMQDLAVLTGGQLITEELGMNLEKVDLGMLGTCKKVTVSKDDTVVLNGAGEKTAIEERCEQLRSTMELSTSDYDKEKLQERLAKLSGGVAILKIGGASEAEVGERKDRVTDALNATKAAVEEGIVPGGGVALLYASRDLDKLQTANFDQKIGVQIIQNALKMPVHTIASNAGVEGAVVVGKLLEQDNTDLGYDAAKGEYVDMIKAGIIDPLKVIRTALVDAASVSSLMTTTEAVIVELPKDETSAPSMGGGMGGMGGMGGMDF

SEQ ID NO: 6138 - protein, 575 aa, Phaseolus vulgaris
MYRFATSLASKARISRSGTQQIGSRVSWSRNYAAKDIKFGVEARALMLKGVEELADAVKVTMGPKGRNVVIEQSFGAPKVTKDGVTVAKSIEFKDKVKNIGASLVKQVANATNDVAGDGTTCATILTRAIFTEGCKSVAAGMNTMDLRRGINMAVDSVVTNLKSRARMINTSEEIAQVGTISANGEREIGELIAKAMEKVGKEGVITISDGKTLYNELEVVEGMKLDRGYISPYFITNQKNQKCELEDPLIIIHEKKISSINAIVKVLELALKRQRPLLIVAEDVESDALATLILNKLRAGIKVCAIKAPGFGENRKSGLQDLAVLTGGQLITEELGLNLEKVDLEMFGSCKKLTISKDDTVILDGAGDKKAIEERCEQIRSAIENSTSDYDKEKLQERLAKLSGGVAVLKIGGASEAEVGEKKDRVTDALNATKAAVEEGIVPGGGVALLYASKELDKLHTANFGQKIGVQIIQNALKASVHTIASNAGVEGAVVVGKLLEQNNPDLGYDAAKGEYVDMVKAGIIDPLKVIRTALVDAASVSSLMTTTEAVVSELPKDDKDVPAMGGGMGGMDY

SEQ ID NO: 6139 - protein, 575 aa, Ricinus communis
MYRFVSGLASKARLAKNSTQQVGSRLAWSRSYAAKDIKFGVEARALMLKGVEDLADAVKVTMGPKGRNVVLEQSWGAPKVTKDGVTVAKSIEFQDRVKNVGASLVKQVANATNDVAGDGTTCATVLTRAILVEGCKSVAAGMNAMDLRRGISMAVDTVITNLKSRTRMISTSEEIAQVGTISANGEREIGELIAKAMEKVGKEGVITISDGKTLYNELEVVEGMKLDRGYISPYFVTNTKNQKCELEDPLILIHEKKISNLNAVVKVLELALKKQRPLLIVAEDVESEALATLILNKLRAGIKVCAIKAPGFGENRKASMQDLAVLTGGQVITEELGMNLEKVGAEAFGSCKKVTVSKDDTIILDGFGDKKALEERCEQLRSSIELSTSDYDKEKLQERLAKLSGGVAVLKIGGASEAEVSEKKDRVTDALNATKAAVEEGIVPGGGVALLYASKDLDKLHTANFDQKIGVQIIQNALKMPVHTIAANAGVEGAVVVGKLLEQDNPDLGYDAAKGEYVDMVKSGIIDPLKVIRTALVDAASVSSLMTTTEAIVTELPKDEKEPTAMAGGGGGMGY

SEQ ID NO: 6140 - protein, 399 aa, Cucurbita pepo
MHRFATGLASKARLARNGANQIASRSNWRRNYAAKDVKFGVEARGLMLKGVEDLADAVKVTMGPKGRTVVIEQSFGAPKVTKDGVTVAKSIEFKDKVKNVGASLVKQVANATNDVAGDGTTCATILTKAIFTEGCKSVAAGMNAMDLRRGISMAVDSVVTNLKSRARMISTSEEIAQVGTISANGEREIGELIAKAMEKVGKEGVITISDGKTMDNELEVVEGMKLDRGYISPYFITNQKNQKCELDDPLIIIYEKKISSINAVVKVLELALKKQRPLLIVSEDVESEALATLILNKLRAGIKVCAIKAPGFGENRKAGLQDLAVLTGGQVITEELGMNLEKVDLDMLGSCKKITISKDDTVILDGAGDKKAIEERCEQIRSGIEASTSDYDKENYRRD

SEQ ID NO: 6141 - protein, 579 aa, Lupinus angustifolius
MHRFASNLASKARVARNISQQFGGSRLSWSRNYAAKEVKFGVEARALMLKGVEDLADAVKVTMGPKGRNVVIEQSWGAPKVTKDGVTVAKSIEFNDKIKNIGASLVKQVANATNDVAGDGTTCATVLTRAIFTEGCKSVAAGMNAMDLRRGITLAVDAVVTNLKSRARMISTSEEIAQVGTISANGEREIGELIAKAMEKVGKEGVITIADGKTLYNELEVVEGMKLDRGYISPYFITNQKNQKCELEDPLILIHEKKISSIQSVVKVLELALKKQRPLLIVAEDVESDALATLILNKLRAGIKVCAIKAPGFGENRKSGLQDLAILTGGSLITEELGLNLEKVDLDLLGTCKKVTISKDDTVILDGAADKKALEERCEQIRSAIDNSTSDYDKEKLQERLAKLSGGVAVLKIGGASEAEVGEKKDRVTDALNATKAAVEEGIVPGGGVALLYASKELDKLQTANFDQKIGVQIIQNALKAPVHIIASNAGVEGAVVVGKLWEQDNHDLGYDAAKGEYVDMVKSGIIDPVKVIRTALVDAASVSSLMTTTEAVVVELPKDEKAAPAMPGGMGGMGGMDY

SEQ ID NO: 6142 - protein, 575 aa, Glycine max
MYRFATSLASKARIARSSTQQIGSRVTWNRNYAAKDIKFGVEARALMLKGVEELADAVKVTMGPKGRNVVIEQSFGAPKVTKDGVTVAKSIEFKDKVKNIGASLVKQVANATNDVAGDGTTCATILTKAIFTEGCKSVAAGMNAMDLRRGINMAVDAVVTNLKSRARMISTSEEIAQVGTISANGEREIGELIAKAMEKVGKEGVITISDGKTLYNELEVVEGMKLDRGYISPYFITNQKNQKCELEDPLIIIHEKKISSINAIVKVLELALKRQRSLLIVAEDVESDALATLILNKLRAGIKVCAIKAPGFGENRKSGLQDLAVLTGGQLITEELGLNLEKVDLDLFGSCKKITISKDDTVILDGAGDKKAIEERCEQIRSAIENSTSDYDKEKLQERLAKLSGGVAVLKIGGASEAEVGEKKDRVTDALNATKAAVEEGIVPGGGVALLYASSELDKLQTANFDQKIGVQIIQNALKTPVHTIASNAGVEGAVVVGKLLEQNDPDLGYDAAKGEYVDMVKTGIIDPLKVIRTALVDAASVSSLMTTTEAVVSELPKDDKDVPAMGGGMGGMDY

SEQ ID NO: 6143 - protein, 573 aa, Solanum lycopersicum
MYRFAAKLASKSRVARSSTQQVGSRLNWSRNYAAKDIKFGVEARGIMLQGVEQLADAVKVTMGPKGRNVVIEQSWGAPKVTKDGVTVAKSIEFKDKIKNVGASLVKQVANATNDAAGDGTTCATVLTRAIFAEGCKSVAAGMNAMDLRRGITMAVDAVVTNLKSRARMISTSEEIAQVGTISANGEREIGEIIARAMEQVGKEGVITIQDGKTLLNDLQVVEGMKLDRGYISPYFITNEKNQKCELDDPLILIHEKKISSINAIVKVLELALKRQRPLLIVSEDVESEALATLILNKLRAGIKVCAIKAPGFGENRKANLQDLAALTGGQVITEELGMNIENVELEMLGKCKKVTISKDDTVVLDGAGEKKAIEERCEQIRSAIELSTSDYDKEKLQERLARLSGGVAVLKVGGASEVEVGEKKDRVTDALNATKAAVEEGILPGGGVALLYASKELDSLPTANFDQKIGVQIIQNALKTPVYTIASNAGVEGSVVVGKLLEQDNPDLGYDAAKGEYVDMVKAGIIDPLKVIRTALVDAASVSSLLTTTEAVIVELPKDEKAAPAMPGGGMDY

SEQ ID NO: 6144 - protein, 575 aa, Elaeis guineensis
MYRAAASLASKARIAGSSSRQIGSRLGWNRNYAAKDIRFGVEARSLMLKGVEELADAVKVTMGPKGRNVVLEQSFGAPKVTKDGVTVAKSIEFKDRVKNMGASLVKQVANATNDVAGDGTTCATVLTRAIFAEGCKSVAAGMNAMDLRRGITMAVDAVVTNLKSRARMISTSEEIAQVGTISANGEREIGELIAKAMEKVGKEGVITISDGNTLYNELEVVEGMKLDRGYISPYFITNQKNQKCELEDPLILIHEKKISSINAVVKALELALKRQRPLLIVAEDVESDALATLILNKLRAGIKVCAIKAPGFGENRKAGLHDLAILTGGELITEELGMNLEKVEFDMLGTCKKVTISKDDTVILDGAGDKKAIEERCEQLRSAIEACTSDYDKEKLQERLAKLSGGVAVLKIGGASEAEVGEKKDRVNDALNATKAAVEEGILPGGGVALLYASKELEKLQTANFDQKIGVQIIQNALKTPVHTIAANAGVEGAVIVGKLLEQDNPDLGYDAAKDEYVDMVKAGIIDPLKVIRTALVDAASVSSLMTTTEAVVVELPKDEKDVPAPGGGMGGMDY

SEQ ID NO: 6145 - protein, 422 aa, Trifolium pratense
MYRFASSLASKARIARNSTNQIGSRVAWSRNYAAKEIKFGVEARALMLKGVEELAEAVKVTMGPKGRNVVIEQSFGAPKVTKDGVTVAKSIEFKDKVKNIGASLVKQVANATNDVAGDGTTCATVLTRAIFAEGCKSVAAGMNAMDLRRGINMAVDSVVTNLKSRARMISTSEEIAQVGTISANGDREIGELIAKAMEKVGKEGVITIADGKTLHNELEVVEGMKLDRGYISPYFITNQKNQKCELEDPLIIIHEKKISSINAIVKVLELALKKQRPLLIVAEDVESDALAILILNKLRAGIKVCAIKVHGFGENRKSGLQDLVVLTRGQTSATISRKWISKCLALAKRLQFPKMTQSFLTVPVIRNLSRKDVSRLGQQLKTVLQIMTRRNYRKDWPSFLVVLLCLRLEEPARLKLVRKRIE

SEQ ID NO: 6146 - protein, 575 aa, Ananas comosus
MYRVATTLASKARIAGSSSRQIGSRIAWSRNYAAKDIKFGVEARALMLKGVEELADAVKVTMGPKGRNVVLEQSFGAPKVTKDGVTVAKSIEFKDRAKNVGASLVKQVANATNDAAGDGTTCATVLTRAIFAEGCKSVAAGMNAMDLRRGITMAVDTVVSNLKSRARMISTSEEIAQVGTISANGEREIGELIAKAMEKVGKEGVITIADGNTLYNELDVVEGMKLDRGYISPYFVSNAKTQKCELEDPLILIYEKKISSINAVVKLLELALKRQKPLLIVAEDVESDALATVILNKLRAGIKVCAIKAPGFGENRKAILQDLAILSGGELITEELGMNLEKVEPHMFGTCKKVTVSKDDTVILDGAGDKKTIEERCEQLRAAIEASTSDYDKEKLQERLAKLSGGVAVLKIGGASEAEVSEKKDRVNDALNATKAAVEEGIVPGGGVALLYASKELEKLETANFDQKIGVQIIQNALKTPVHTIASNAGVEGAVVVGKLLEQDNPDLGYDAAKGEYVDMVKAGIIDPLKVIRTALVDAASVSSLMTTTEAVVVELPKEEKDVPAMGGGMGGMDY

SEQ ID NO: 6147 - protein, 574 aa, Amorphophallus konjac
MYRAAACLASKARIAGSRSQQVGSRLGWSRNYAAKDIKFGVEARALMLRGVEELADAVRVTMGPKGRNVVLEQSFGAPKVTKDGVTVAKSIEFKDRVKNMGASLVKQVANATNDSAGDGTTCATVLTRAIFAEGCKSVAAGMNAMDLRRGITMAVDAVVTNLKSRARMISTSEEIAQVGTISSNGEREIGELIAKAMEKVGKEGVITIADGKTLYNELEVVEGMKLDRGYISPYFMTDQKTQKCELEDPLILIHERKISSINAVVKVLELALKRQRPLLIVAEDVESDALATLILNKLRAGIKVCAIKAPGFGENRKAIMQDLATLTGGDVITEELGLNLEKVEFDMLGTCKKVTISKDDTVILDGAGDKKAIEERCEQLRSAIELSTSDYDKEKLQERLAKLSGGVAVLKIGGASEAEVGEKKDRVTDALNATKAAVEEGIVPGGGVALLYASRELEKLQTANFDQKIGVQIIQNALKTPVHTIASNAGVEGAVVVGKLLEQDNLDLGYDAAKGEYVDMVKSGIIDPLKVIRTALVDAASVSSLLTTTEAVVVEIPKEEKDSPPMPGMGGMDY

SEQ ID NO: 6148 - protein, 575 aa, Phaseolus vulgaris
MYRFASSLASKARIARSGSKQVGSRLSWSRNYAAKDIRFGVEARALMLKGVEELAEAVKVTMGPKGRNVVIEQSFGGPKVTKDGVTVAKSIEFKDKVKNVGASLVKQVANATNDAAGDGTTCATVLTRAIFAEGCKSVAAGMNAMDLRRGINMAVDAVVTNLKSRARMISTSEEIAQVGTISANGEREIGELIAKAMEKVGKEGVITISDGKTLYNELEVVEGMKLDRGYISPYFITNDKNQKCELEDPLILIHEKKISSINAVVKVLELALKRQRPLLIIAEDVESDALATLILNKLRAGIKVCAIKAPGFGENRKSGLQDLAVLTGGALITEELGLKLEQVDLDMLGSCKKITISKDDTVVLDGAGDKKAIEERCEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVLTIASNAGVEGAVVVGKLLEQDDLDLGYDAANGEYVDMVKSGIIDPLKVIRTALVDAASVSSLMTTTEAVVSELPKDDKDIPAMAGGMGGMDY

SEQ ID NO: 6149 - protein, 575 aa, Cicer arietinum
MYRFATSIASKTRIARNNVQRVGSRVGWNRNYAAKDIKFGVEARALMLKGVEELAEAVKVTMGPKGRNVVIEQSYGAPKVTKDGVTVAKSIEFKDKVKNIGASLVKQVANATNDVAGDGTTCATILTRAIFTEGCKSVAAGMNAMDLRRGINMAVDAVVTSLKSRARMISTSEEIAQVGTISANGEREIGELIAKAMEKVGKEGVITIADGKTLYNELEVVEGMKLDRGYISPYFITNQKNQKCELEDPLIIIHEKKISSINSIVKVLELALKKQRPLLIVAEDVESDALATLILNKLRAGIKVCAIKAPGFGENRKSGLQDLAVLTGGQLVTEELGMNLEKVDLDMFGSCKKITISKDDTVILDGAGDKKAIEERCEQIRSAIENSTSDYDKEKLQERLAKLSGGVAVLKIGGASEAEVGEKKDRVTDALNATKAAVEEGIVPGGGVALLYASNELSKLQTANFDQKIGVQIIQNALKTPVHTIASNAGVEGAVVVGKLLEQDNPDLGYDAAKGEYVDMVKAGIIDPLKVIRTALVDAASVSSLMTTTEAIVYELPKEDNSSPAMPGGMGGMDY

SEQ ID NO: 6150 - protein, 575 aa, Actinidia deliciosa
MYRFAANLASKARIASNGTQQIGGRFAWRRNYAAKEIKFGVEARALMLRGVEELADAVKVTMGPKGRNVVLEQSFGAPKVTKDGVTVAKSIEFKDRVKNIGASLVKQVANATNDVAGDGTTCATVLTRAIYSEGCKSVAAGMNAMDLRRGITMAVDAVVTNLKSRARMISTSEEIAQVGTISSNGEREIGELIAKAMEKVGKEGVITIADGKTLYNELEVVEGMKLDRGYISPYFITNPKNQKCELEDPLILIHEKKISSLNAVVKVLELALKSQRPLLIVSEDVESEALATLILNNLRAGIKVCAIKAPGFGENRKANLQDLAILTGGEVITDELGLNLEKVGPETFGSCKKVTISKDDSVILDGAGDKKAIEERCEQLRTSIELSTSDYDKEKLQERLAKLSGGVAVLKIGGASEAEVGEKKDRVNDALNATKAAVEEGIVPGGGVALLYASKELEKLHTANFDQKIGVQIIQNALKAPVYTIAANAGVEGAVVVGKLLEQDNPDLGYDAAKGEYVDMVKAGIIDPLKVIRTALVDAASVSSLLTTTEAVVVELPKDEKEAPAMGGGMGGMDY

SEQ ID NO: 6151 - protein, 579 aa, Solanum tuberosum
MYRFAANLASKARVARTSSQQIGGRFNWSRNYAAKDIRFGVEARALMLQGVEQLADAVKVTMGPKGRNVVIEQSWGAPKVTKDGVTVAKSIEFKDKIQNVGASLVKQVANATNDVAGDGTTCATVLTRAIFAEGCKSVAAGMNAMDLRRGITMAVDSVVTNLKSRARMISTSEEIAQVGTISANGEREIGDLIARAMEKVGKEGVITIQDGKTLLNELDVVEGMKLDRGYISPYFITNQKNQKCELDNPLILIHEKKISSVNAVVKALELALKRQRPLLIVAEDVDNEALATLILNKLRAGIKVCAIKAPGFGENRKAYLQDLAILTGGQVITEELGLNIENLEFEMLGTCKEATISKDDTVILDGAGEKKSIEERCELIRSTIEQSTSDYDKEKLQERLAKLSGGVAVLKIGGASEAEVGEKKDRVTDALNATKAAVEEGIVPGGGVALLYAARELDNLTTANFDQKIGVQIIQNALKTPVHTIASNAGVEGAVVVGKLLDQDNLDLGYDAAKGEYVDMIKAGIIDPVKVIRTALVDAASVSSLLTTTEAVVVELPKDEKESPAMGGGMGGGMGGMDF

SEQ ID NO: 6152 - protein, 516 aa, Phalaenopsis aphrodite
SGGGCSSRQIGSRLAWSRNYAAKDIRFGVEARALMLKGVEELADAVKVTMGPKGRNVVLEQSFGAPKVTKDGVTVAKSIEFKDRVKNMGASLVKQVANATNDVAGDGTTCATILTRAIFAEGCKSVAAGMNAMDLRRGISLAVDTVVTNLKSRTRMISTSEEIAQVGTISANGEREIGELIAKAMEKVGKEGVITISDGKTLYNELEVVEGMKLDRGYISPYFITNQKNQKCELEDPLILIHEKKISSINSVVKVLELALKRQRPLLIVAEDIESDALATLILNKLRAGIKVCAIKAPGFGENRKAGLQDLAVLTGGELITEELGLNLEKVELEMLGACKKVTVSKDDTVILDGSGDKKAIEERCEQIRSAVESSTSDYDKEKLQERLAKLSGGVAVLKIGGASEAEVSEKKDRVTDALNATKAAVEEGIVPGGGVALLYASKELEKLHTANFDQKIGVQIIQNALRTPVHTIASNAGVEGAVVVGKLLEQDNPDLGYDAAKGEYVDLVKAGIIDP

SEQ ID NO: 6153 - protein, 575 aa, Malus domestica
MYRFATNLASKARLARNSSQQIGSKLISRRNYAAKEIRFGVEARAGMLRGVEELADAVKVTMGPKGRNVVLEQSFGAPKVTKDGVTVAKSIEFKDKVKNIGASLVKQVANATNDAAGDGTTCATVLTRAIFTEGCKSVAAGMNAMDLRRGISMAVDSVVANLKSRARMISTSEEIAQVGTISANGEREIGELIAKAMEKVGKEGVITISDGKTLYNELEVVEGMKLDRGYISPYFITNPKNQKCELEDPLVLIHEKKLSNLNSIVKILELALQKQRPLVIVAEDVESEALATLIINKLRAGIKVCAIKAPGFGENRKANLQDLAVLTGAQVITEELGLNIEKVGIETLGTCKRITVSKDDTVILDGAGDKKAIEERCEQLRSSIELSTSDYDKEKLQERLAKLSGGVAVLKIGGASEAEVSEKKDRVTDALNATKAAVEEGIVAGGGAALLYASKELDKLVTANFDQKIGVQIIQNALKMPVSTIASNAGVEGAVVVGKLLEQDNPDLGYDAAKGEYVDMIKAGIIDPLKVIRTALVDAASVSSLMTTTEAVVVELPKDEKETPAMGGGMGGMDY

SEQ ID NO: 6154 - protein, 575 aa, Aquilegia formosa
MYRAVANLASKARIARKQSQQISSRWSWSRNYAAKDIQFGVEARGLMLRGVEELADAVKVTMGPKGRNVVLEQSFGAPKVTKDGVTVAKSIEFKDRVKNMGASLVKQVANATNDVAGDGTTCATVLTRAIFSEGCKSVAAGMNAMDLRRGINMAVDAVVTNLKSRARMISTSEEIAQVGTISANGEREIGELIAKAMEKVGKEGVITIADGKTLYNELEVVEGMKLERGYISPYFITNEKNQKCELENPLVLIHEKKISSITSVVKVLELAMKRQRPLLIVAEDVDSEALATLIINKIRAGLKLCAIKAPGFGENRKANMQDLATLTGATLITEELGMNLEKVDLDMFGSCKKVTISKDDTVVLDGAGDKKDLEERCEQIRSAIESSTSDYDKEKLQERLAKLSGGVAVLKIGGASETEVGEKKDRVTDALNATKAAVEEGIVPGGGVALLYASKELDKLQTANFDQKIGVQIIQNALKMPVHTIAANAGVEGAVVVGKLLEQDDTDLGYDAAKGEYVNMIKAGIIDPLKVIRTALVDAASVSSLMTTTEAVVVESPKDEKEAPAMGGGMGGMGY

SEQ ID NO: 6155 - protein, 575 aa, Fagus grandifolia
MYRFATSLASKARIARNSTQQIGSRLSSTRNYAAKDIRFGVEARALMLKGVEELADAVKVTMGPKGRNVVIEQSWGAPKVTKDGVTVAKSIEFKDKVKNIGASLVKQVASATNDTAGDGTTCATVLTRAIFSEGCKSVAAGMNAMDLRRGISMAVDAVVTHLKSSARKISKSDEIAQVGTISANGEREIGELIARAMERVGKEGVITIQDGKTLYNELEVVEGMKLDRGYISPYFITNQKNQKCELEDPLILIHEKKISSLNAVIKVLELALKRQRPLLIVSEDVESEALATLILNKLRAGIKVCAIKAPGFGENRKANLQDLATLTGGELITEELGMNLEKVDLDMLGSCKKVTISKDDTVILDGAGDKAALEERCEQIRSAIENSSSDYDKEKLQERLGKLSGGVAVLKIGGASEIEVSEKKDRVTDALNATKAAVEEGIVPGGGVALLYASKELEKLETANFDQKIGVQIIQNALKTPVYTIASNAGVEGAVVVGKLLEENDPAQGYDAAKGEYVDMVKAGIIDPVKVIRTALVDAASVSSLMTTTEAIITEIPSNDKEAPAMGGGMGGMDY

SEQ ID NO: 6156 - protein, 574 aa, Populus trichocarpa
MHRFTSSLASKARIARSTTKQIGSRLSWSRNYAAKDIRFGVEARAVMLKGVEELADAVKVTMGPKGRNVVIEQSFGAPKVTKDGVTVAKSIEFKDKVKNVGASLVKQVANATNDAAGDGTTCATVLTRAIFAEGCKSVAAGMNAMDLRRGISMAVESVVTNLKSRTRMISTSEEIAQVGTISANGEREIGELIAKAMEKVGKEGVITIQDGKTLSNELEVVEGLKLDRGYISPYFITDQKTQKCELDDPLILIHDKKVSNLHAVVKVLELALKRQRPLLIVAEDVESEALATLILNKLRAGIKVCAIKAPGFGENRKATLQDLAVLTGAEVITEELGLNLEKVDLDMLGSCKKVTVSKDDTVILDGAGDKKSIEERCEQIRSAVESSTSDYDKEKLHERLAKLSGGVAVLKIGGASEAEVGEKKDRVTDALNATKAAVEEGIVPGGGAALLYASKELDKLQTANFDQKIGVQIIQNALKTPVHTIATNAGVEGAVVVGKLLEQDNPDLGYDAAKDEYVDMVKAGIIDPLKVIRTALVDAASVSSLMTTTEAVITELPKDENDAPAMGPGMGMDY

SEQ ID NO: 6157 - protein, 573 aa, Cichorium intybus
MYRLAANLASKSRIARNNAQQISSNLSSRRNYAAKDIRFGVEARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELDDPLILIHEKKISSLNAIVKVLELALKNQRSLLIVAEDIESEALATLILNKLRAGIKVCAIKAPGFGENRKSNLQDLATLTGGEVITDELGMNLDKMAPEMLGTCKRVTISKDDTVILDGAGDKKSIEERCEQLRSSIELSTSDYDKEKLQERLAKLSGGVAVLKIGGASEAEVGEKKDRVTDALNATKAAVEEGIVPGGGVALLYASKELDNLVTANFDQKIGVQIIQNALKAPVHTIAANAGVEGAVIVGKLLEQDNPDLGYDAAKGEYVDMVKAGIIDPLKVIRTALVDAASVSSLLTTTEAVIVELPKDEKDAPAMGPGMGDY

SEQ ID NO: 6158 - protein, 571 aa, Panax ginseng
MYRFAANLASKARIATNCTQQIGSRFSLSRNYAAKDIRFGVEARALMLKGVEELADAVKVTMGPKGRTVVIEQPFGAPKVTKDGVTVAKSIEFKDKVKNIGASLVKQVANATNDVAGDGTTCATILTRAIFMEGCKSVAAGMNAMDLRRGINMAVDAVVTNLQSRARMISTSEEIAQVGTISANGEREIGELIAKAMEKVGKEGVITIQDGKTLYNELEVVEGMKLDRGYISPYFITNEKNLKCELDDPLILIHEKKISSINAVVKLLELALKIQRPLLIVAEDVESEALATLILNKLRAGIKVCAIKAPGFGENRKANLQDLAVLAGGQVISEELGMNLDNVELDMLGSCKKVTVSKDDTIVLDGAGEKKAIEERCEQIRSAIESSTSDYDKEKLQERLAKLSGGIAVLKIGGASEAEVSEKKDRVTDALNATKAAVEEGIVPGGGVALLYATKELEKLPTANFDQKVGVQIIQDALKTAVHTIASNAGVEGAVVVSKLLEQDNPDLGYDAAKGAYVDMVKAGIIDPLKVIRTALVDAASVSALMTTTEAIVVDLLKDEKEVPMGGGMDY

SEQ ID NO: 6159 - protein, 576 aa, Medicago truncatula
MYRFASSLASKARIARNNVQQVGSRVAWNRNYAAKEIKFGVEARALMLKGVEDLAEAVKVTMGPKGRNVVIEQSFGAPKVTKDGVTVAKSIEFKCKVKNIGASLVKQVANATNDVAGDGTTCATILTRAIFSEGCKSVAAGMNAMDLRRGINMAVDAVVTSLKSRARMISTSEEIAQVGTISANGDREIGELIAKAMEKVGKEGVITIADGKTLHNELEVVEGMKLDRGYISPYFITNQKNQKCELEDPLVIIHEKKISSLNAIVKVLELALKKQRPLLIVAEDIESDALATLILNKLRAGIKVCAIKAPGFGENRKSGLQDLAVLTGGQLITEDLGHNLEKVDLEMFGSCKKITISKDDTVILDGAGDKKAIEERCEQIRSAVENSTSDYDRDKLQERLAKLSGGVAVLKIGGASEAEVGEKKDRVTDALNATKAAVEEGIVPGGGVALLYASNELSKLSTANFDQKIGVQIIQNALKTPVHTIASNAGVEGAVVVGKLLEQDNPDLGYDAAKGEYVDMVKAGIIDPLKVIRTALVDAASVSSLMTTTEAIVSDLPSEDKDGPAMPAGMGGMGGY

SEQ ID NO: 6160 - protein, 579 aa, Orobanche aegyptiaca
MYRFATSLASKARNPKTSQLVGGRLSWSRNYGAKGIKFGVEARAAMLRGVEELADAVKVTMGPKGRNVVLEQSYGAPKVTKDGVTVAKSIEFQDKVMNVGASLVKQVANATNDVAGDGTTCATILTRAIYAEGCKSVAAGMNAMDLRRGINMAVDTVVTNLKSRARMISTSEEIAQVGTISANGEREIGELIAKAMEKVGKEGVITIADGKTLNNELEVVEGMKLDRGYISPHFITNKKNQKCELEDALILIHEKKIDNINAMVSALELALKKQKPLLIVAEDIESDALATLIINKLRVGLKVCAIKAPGYGDNRKAYLQDLAVLTGGEVITSDLGMDLENLTVDMLGSCKKVTVSKDDTVVLDGAGNKKSIEERCEQIRSGIELSTSDYDIEKLQERLAKLSGGVAVLKIGGASETEVGEKKDRVTDALNATKAAVEEGIVPGGGVALLYASKELEKLQTANFDQKIGVQIIQNALKAPVHTIASNAGVEGAVVVGKLLEQDNPDLGYDAAKGDYVDMVKAGIIDPLKVIRTALVDAASVSSLLTTTEAVVYELPSEEKPSPPMGGGGMGGMGGGMGF

SEQ ID NO: 6161 - protein, 579 aa, Solanum lycopersicum
MYRFAANLASKASVARTSSQKIGGRLNWSRNYAAKDIRFGVEARALMLQGVEQLADAVKVTMGPKGRNVVIEQSWGAPKVTKDGVTVAKSIEFKDKIQNVGASLVKQVANATNDVAGDGTTCATVLTRAIFAEGCKSVAAGMNAMDLRRGITMAVDSVVTNLKSRARMISTSEEIAQVGTISANGERVIGDLIARAMEKVGKEGVITIQDGKTLLNELDVVEGMKLDRGYISPYFITNQKNQKCELDNPLILIHEKKISSINAVVKALELALKRQRPLLIVAEDVDNEALATLILNKLRAGIKVCAIKAPGFGENRKAYLQDLAILTGGQVITEELGLNIENLEFEMLGTSKEATISKDDTVILDGAGEKKSIEERCELIRSTIEQSTSDYDKEKLQERLAKLSGGVAVLKIGGASEAEVGEKKDRVTDALNATKAAVEEGIVPGGGVALLYAARELDNLTTANFDQKIGVQIIQNALKTPVHTIASNAGVEGAVVVGKLLDQDNLDLGYDAAKGEYVDMIKAGIIDPVKVIRTALVDAASVSSLLTTTEAVVVELPKDEKESPAMGGGMGGGMGGMDF

SEQ ID NO: 6162 - protein, 385 aa, Gossypium hirsutum
MYRFASSLASKARAARNTTYHIGSRLSWNRNYAAKDIKFGVEARALMLKGAEELSDAVRVTMGPKGRNVVIEQSYGAPKVTKDGVTVAKSIEFKDKVKNIGASLVKQVANATNDVAGDGTTCATVLTRAIFTEGCKSVAAGMNAMDLRRGITMAVDAVGTNLKSRARMISTSEEIAQVGTISANGEREIGELIAKAMEKVGKEGVITIEDGKTLYNELEVVEGMKLDRGYISPYFITNTKTKNSELDDPLILIHEKKVSSLNAVVKVLELALKRQRPLLIVAEDVESEALATLILNKLRAGIKVCAIKAPGFGENRKSSLHDLAVLTGGEVITEELGMNLEKVDLDMLGTCKKVTVSKDDTVILDGNGDKKPLRKDVNRLDQQLN

SEQ ID NO: 6163 - protein, 576 aa, Panicum virgatum
MYRAAASLASKARQAGSSAAARQVGSRLGWSRNYAAKDIRFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKTQKCELEDPLILIHDKKVSNMHAVVKVLEMALKKQRPLLIVAEDVESEALGTLIINKLRAGIKVCAVKAPGFGENRKANLQDLAILTGGEVITEELGMNLENFEPHMLGTCKKVTVSKDDTVILDGAGDKKSIEERAEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQGNTDLGYDAAKGEYVDMVKAGIIDPLKVIRTALVDAASVSSLMTTTESIIVEIPKEETPAPAMGGMGGMDY

SEQ ID NO: 6164 - protein, 573 aa, Cichorium intybus
MYRLAANLASKSRIARNNAQQISSNLSSRRNYAAKDIRFGVEARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELDDPLILIHEKKISSLNAIVKVLELALKNQRSLLIVAEDIESEALATLILNKLRAGIKVCAIKAPGFGENRKSNLQDLATLTGGEVITDELGMNLDKMAPEMLGTCKRVTISKDDTVILDGAGDKKSIEERCEQLRSSIELSTSDYDKEKLQERLAKLSGGVAVLKIGGASEAEVGEKKDRVTDALNATKAAVEEGIVPGGGVALLYASKELDNLVTANFDQKIGVQIIQNALKAPVHTIAANAGVEGAVIVGKLLEQDNPDLGYDAAKGQYVDMVKAGIIDPLKVIRTALVDAASVSSLLTTTEAVIVELPKDEKDAPAMGPGMGDY

SEQ ID NO: 6165 - protein, 575 aa, Amborella trichopoda
MYRAAARLASKARFSNASQQIGSRVSWNRNYAAKDIKFGVEARALMLKGVEELADAVQVTMGPKGRNVVIEQSFGAPKVTKDGVTVAKSIEFKDRIKNVGASLVKQVANATNDVAGDGTTCATLLTRAIYAEGCKSVAAGMNAMDLRRGITMAVDTVVTSLKSRARMISTSEEIAQVGTISANGEREIGELIAKAMEKVGKEGVITIADGKTLYNELEVVEGMKLDRGYISPYFITNQKTQKCELDNPLILIHEKKISSLNAIVKVLELALKLQRPLLIVAEDIESDALATLILNKLRAGIKVCAIKAPGFGENRKASMQDLATLTGGELITEELGLNLEKVEPDMLGTAKKVTVSKDDTVVLDGAGEKKAIEERCDQLRSAIEASTSDYDKEKLQERLAKLSGGVAVLKIGGASEVEVSEKKDRVTDALNATKAAVEEGIVPGGGVALLYASRELEKLHTANFDQKIGVQIIQNALKMPVHTIASNAGVEGAVVVGKLLEQDNPDLGYDAAKGEYVDMVKAGIIDPLKVIRTALVDAASVSSLMTTTEATVVELPKDEKEMTPPMGGGMGGMDY

SEQ ID NO: 6166 - protein, 578 aa, Musa acuminata
MYRAMASLASRARVMEFCLVLQIGSRVGWSRNYAAKDIRFGVEARALMLKGVEELADAVKVTMGPKGRNVVLEQSFGAPKVTKDGVTVAKSIEFKDRIKNMGASLVKQVANATNDVAGDGTTCATILTKAIFAEGCKSVAAGMNAMDLRRGISMAVDAVVTNLKSRARMISTSEEIAQVGTISANGEREIGELIAKAMEKVGKEGVITVADGKTLDNELEVVEGMKFDRGYISPYFITDPKNQKCELEDPLILIHEKKISSINAVVKVLELSLKRQRPLLIVAEDIESDALATLILNKLRAGIKVCAVKAPGFGENRKANLQDLAILTGGSLITEELGLNLEKVELDMLGTCKKVTISKDNTVILDGSGEKKAIEERCDQIRSAIELSTSDYDKEKQQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQDELDLGYDAAKGEYVDMVKAGIIDPLKVIRTALVDAASVSSLMTTTESVIVELPKNEDAPAMGAGMGGMGGMDY

SEQ ID NO: 6167 - protein, 574 aa, Manihot esculenta
MYRFASSLASKARIARNSTHQIGSRLNWSRNYAAKDIKFGVEARALMLKGVEELADAVKVTMGPKGRNVVIEQSFGAPKVTKDGVTVAKSIEFKDKVKNIGASLVKQVANATNDVAGDGTTCATVLTRAIFTEGCKSVAAGMNAMDLRRGISMAVDAVVTNLKSRARMISTSEEIAQVGTISANGEREIGELIAKAMEKVGKEGVITIQDGKTLDNELEVVEGMKLDRGYISPYFITNQKNQKCELEDPLILIHEKKISSIHAMVKVLELALKRQRPLLIVSEDVESEALATLILNKLRAGIKVCAIKAPGFGENRKAGLQDLAVLTGGEVITEELGLNLEKVDLDMLGSCKKITVSKDDTIILDGAGDKKAIEERCEQIRSAIELSTSNYDKEKLQERLAKLSGGVAVLKIGGASEAEVGEKKDRVTDALNATKAAVEEGIVAGGGVALLYATKELAELQTDNFDQKIGVQIIQNALKTPVHTIASNAGVEGAVVIGKLLEQDDHNLGYDAAKGEYVDMVKAGIVDPLKVIRTALIDAASVSSLMTTTEAIVSELPKDEKDAPGMAPGMGMDY

SEQ ID NO: 6168 - protein, 574 aa, Oryza sativa
MYRAAASLASKARQAGSSARQVGSRLALSRNYAAKDIKFGVEARALMLRGVEELADAVKVTMGPKGRNVVIEQSYGSPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFVTNPKTQKCELDDPLILIHDKKVSNLHAVVKVLELALKKQRPLLIVAEDVESEALGTLIINKLRAGIKVCAVKAPGFGENRKANLQDLAILTGGEVITEELGMNLEKFEPQMLGTCKKVTVSKDDTVILDGAGDKKSIEERAEQIRSAIELSTSDYDKEKLQERLAKLSGGVAVLKIGGASEAEVGEKKDRVTDALNATKAAVEEGIVPGGGVALLYASKELDKLPTANFDQKIGVQIIQNALKTPVHTIASNAGVEGAVVVGKLLEQDNTDLGYDAAKGEYVDMVKAGIIDPLKVIRTALVDAASVSSLMTTTESIIVEIPKEEKEAPAMGGMGGMDY

SEQ ID NO: 6169 - protein, 575 aa, Tabernaemontana elegans
MYRLAAHLASKASVARNTSRQAGSRLAWSRNYAAKDIKFGVEARALMLQGVEELAEAVKITMGPKGRTVVIEQSFGAPKVTKDGVTVAKSIEFKDRVKNIGASLVKQVANATNDVAGDGTTCATILTRAIYTEGCKSVAAGMNAMDLRRGISMAVDSVVTNLKSRARMISTSEEIAQVGTISANGEREIGELIAKAMERVGKEGVITIADGKTLYNELEVVEGMKLDRGYISPYFITNQKTQKCEMDDPLILIHEKKIGSLNAVIKVLELALKRQKPLLIVAEDVESEALATLILNKLRAGIKVCAIKAPGFGENRKAYLQDLAILTGGQLITEELGLNLENVTIDVLGSCKKVTVSKDDTVILDGAGDKNAIEERCEQIRSATELSTSDYDKEKLQERLAKLSGGVAVLKIGGASEAEVSEKKDRVTDALNATKAAVEEGIVPGGGVALLYAAKELEKLQTANFDQKIGVQIIQNALKAPVQTIASNAGVEGAVVIGKLLEQDNHDLGYDAAKGEYVDMVKAGIIDPLKVIRTALVDAASVSSLLTTTEAVVVEHPKNEKESPAMGAGMDGMDY

SEQ ID NO: 6170 - protein, 553 aa, Eutrema parvulum
MSWSRNYAAKEIKFGVEARALMLRGVEELADAVRVTMGPKGRNVVIEQSWGAPKVTKDGVTVAKSIEFKDKVKNVGASLVKQVANATNDVAGDGTTCATVLTRAIFTEGCKSVAAGMNAMDLRRGISMAVDAVVTNLKSRARMISTSEEIAQVGTISANGEREIGELIAKAMERVGKEGVITIQDGKTLSNELEVVEGMKLDRGYTSPYFITNQKTQKCELEDPLILIHEKKISTINSIVKVLELALKKQRPLLIVSEDVESEALATLIVNKLRAGIKVCAIKAPGFGENRKANLQDLAALTGGEVITDELGMNLEKVDLSMLGTCKRVTVSKDDTVILDGAGDKAAIEERCEQIRSAIELSTSDYDKEKLQERLAKLSGGVAVLKIGGASEAEVGEKKDRVTDALNATKAAVEEGILPGGGVALLYAARELEKLPTANFDQKIGVQIIQNALKTPVHTIASNAGVEGAVIVGKLLEQDNPDLGYDAAKGEYVDMVKAGIIDPLKVIRTALVDAASVSSLLTTTEAVVVELPKDESESAGAGAGMGGMGGMDY

SEQ ID NO: 6171 - protein, 578 aa, Musa acuminata
MYRAMASLASRARVMEFCLVLQVGSRVGWSRNYAAKDIRFGVEARALMLKGVEELADAVKVTMGPKGRNVVLEQSFGAPKVTKDGVTVAKSIEFKDRIKNMGASLVKQVANATNDVAGDGTTCATILTKAIFAEGCKSVAAGMNAMDLRRGISMAVDAVVTNLKSRARMISTSEEIAQVGTISANGEREIGELIAKAMEKVGKEGVITVADGKTLDNELEVVEGMKFDRGYISPYFITDPKNQKCELEDPLILIHEKKISSINAVVKVLELSLKRQRPLLIVAEDIESDALATLILNKLRAGIKVCAVKAPGFGENRKANLQDLAILTGGSLITEELGLNLEKVELDMLGTCKKVTISKDNTVILDGSGEKKAIEERCDQIRSAIELSTSDYDKEKQQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQDDLDLGYDAAKGEYVDMVKAGIIDPLKVIRTALVDAASVSSLMTTTESVIVELPKNEDAPAMGAGMGGMGGMDY

SEQ ID NO: 6172 - protein, 238 aa, Euphorbia peplus
MYRLASNLASKARIARSSTHQVRNYAAKDIRFGVEARALMLQGVEELADAVKVTMGPKGRNVVIEQSFGAPKVTKDGVTVAKSIEFKDRVKNVGASLVKQVANATNDVAGDGTTCATVLTKAIFTEGCKSVAAGMNAMDLRRGISMAVDNVVTTLKSRAKMISTSEEIAQVGTISANGEREIGELIAKAMEKVGKEGVITIQDGKTLYNELEVVEGMKLDRGYISLILSPTKRTKNVN

SEQ ID NO: 6173 - protein, 578 aa, Capsicum annuum
MYRFAANLASKARVARTSSQQVSGRLNWSRNYAAKDIRFGVEARALMLKGVEELADAVKVTMGPKGRTVVIEQSWGAPKVTKDGVTVAKSVEFKDKIQNVGASLVKQVANATNDVAGDGTTCATILTRAIFAEGCKSVAAGMNAMDLRRGITMAVDSVVTNLKSRAKMISTSEEIAQVGTISANGEREIGELIARAMERVGKEGVITIQDGKTLENQLEVVEGMKLDRGYISPYFITNQKNQKCELEDPLILIHEKKISSVNAVVRALELALKRQKPLLIVAEDVDSEALATLILNKLRAGIKVCAIKAPGFGENRKANLQDLAILTGGQVVTEELGLSIENVEFEMLGTCKKVTISKDDTVILDGAGEKKSIEERCEQIRSAIESSTSDYDKEKLQERLAKISGGVAVLKIGGASETEVGEKKDRVTDALNATKAAVEEGIVAGGGVALLYAARELDNLKTANFDQQIGVQIIQNALKTPVHTIASNAGVEGAVVVGKLLEQDNLDLGYDAAKGEYVDMVKAGIIDPLKVIRTALVDAASVSSLLTTTEAVVVELPKDEKESPAMGGGMGGMGGMDF

SEQ ID NO: 6174 - protein, 573 aa, Centaurea maculosa
MYRFAVSLASKSRIARNNAQQISSNLSWRRNYAAKDIKFGVEARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNPKNQKCELDDPLILIHEKKISSLNAIVKVLELALKNQRSLLIVAEDIESEALATLILNKLRAGIKVCAIKAPGFGENRKSNLQDLATLTGGEVITDELGMNLEKMAPEMLGTCKRVTISKDDTVILDGAGDKKSIEERCEQLRSSIELSTSDYDKEKLQERLAKLSGGVAVLKIGGASEAEVGEKKDRVTDALNATKAAVEEGIVPGGGVALLYASKELEKLPTANFDQKIGVQIIQNALKAPVHTIACNAGVEGAVVVGKLLEQDNPDLGYDAAKGLYVDMVKEGIIDPLKVIRTALVDAASVSSLLTTTEAVIVELPKDEKEAPSMGGGMGDY

SEQ ID NO: 6175 - protein, 573 aa, Triphysaria pusilla
MYRFAANLASKASVARNSSQQIGSRFGWSRNYAAKDIRFGVDARALMLKGVEELADAVKVTMGPKGRNVVIEQSWGAPKVTKDGVTVAKSIEFKDKVKNIGASLVKQVANATNDVAGDGTTCATVLTRAIFAEGCKSVAAGMNSMDLRRGISMAVDAVVTNLKSRARMISTSEEIAQVGTISANGDREIGELIAKAMEKVGKEGVITIQDGKTLFNELEVVEGMKLDRGYISPYFITNQKNQKCELDEPLILIHEKKISSMNAIVKVLELALKRQRPLLIVAEDIESEALATLILNKLRAGIKVCAVKAPGFGENRKSNLQDLAVLTGGQVITEELGMTLEDVELDILGSCKKVTISKDDTVILDGSGEKKSIEERCEQIKSTIELSTSDYDKEKLQERLAKLSGGVAVLKIGGASEAEVGEKKDRVTDALNATKAAVEEGIVPGGGVALLYASKVLETLPTANFDQKIGVQIIQNALKTPVYTIASNAGVEGAVVVGKLLESDNPDLGYDAAKGEYVDMVKSGIIDPLKVIRTALVDAASVSSLMTTTEAIVVEQAKEDKAGPPMGGGEMDY

SEQ ID NO: 6176 - protein, 576 aa, Echinochloa colona
MYRAAASLASKARQVGNSAAARQVGSRLAWSRNYAAKDIKFGVEARALMLRGVEELADAVKVTMGPKGRNVVIEQSFGAPKVTKDGVTVAKSIEFEDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKTQKCELEDPLILIHDKKVNNMHATVKVLEMALKKQRPLLIVAEDVESEALGTLILNKLRAGIKVCAVKAPGFGENRKANLQDLAILTGGEVITEELGMNLENVEPHMLGSCKKVTVSKDDTVILDGAGDKKFIEERAEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQGNTDLGYDAAKGEYVDMVKAGIIDPLKVIRTALVDAASVSSLMTTTESIIVEIPKKEAPAPAMGGMGGMEY

SEQ ID NO: 6177 - protein, 577 aa, Pennisetum glaucum
MYRAAASLASKARQAGSSAAARQVGSRLAWSRNYAAKDIKFGVEARAQMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKTQKCELEDPLILIHDKKVSNMHAVVKVLEMALKKQKPLLIVAEDVESEALGTLILNKLRAGIKVCAVKAPGFGENRKANLQDLAILTGGEVITEELGMKLESVEPLMLGSCKKVTVSKDDTVILDGAGDKKAIEERAEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQGNTDLGYDAAKGEYVDMVKAGIIDPLKVIRTALVDAASVSSLMTTTESIIVEIPKEEAAPAPAMGGMGGMDY

SEQ ID NO: 6178 - protein, 575 aa, Papaver somniferum
MYRAVANLASKARIARNASQQIGSRASWTRNYSAKDIKFGVEARAMMLKGVEDLADAVKVTMGPKGRNVVIEQSFGAPKVTKDGVTVAKSIEFKDRVKNIGASLVKQVANATNDVAGDGTTCATVLTRAIFAEGCKSVAAGMNAMDLRRGISMAVDSVVTNLKSRTRMISTSEEIAQVGTISANGDRDIGEMIAKAMEKVGKEGVITITDGKTLNNEIEVVEGMKLDRGYISPYFITNQKNQKCELEDPLILIHEKKISSINSVVKVLELALKRQRPLLIVAEDIESDALATLILNKLRAGIKICAIKAPGFGENRKSSMQDLAVLTGGQLITEELGMNLEKVELEMLGTCKKVTISKDDTVVLDGAGDKKSIEERCEQLRAGVEMSTSDYDKDKLQERLAKLSGGVAVLKIGGASEAEVGEKKDRVTDALNATKAAVEEGIVPGGGIALLYASRELDKLETANFDQKIGVQIIQNALKAPVQTIASNAGVEGAVVVGKLLEQENTDLGYDAAKGEYVDMIKAGIIDPLKVIRTALTDAASVSSLMTTTEAIVVELPKDDKEMPAMGGGIGGMDY

SEQ ID NO: 6179 - protein, 575 aa, Papaver somniferum
MYRAVANLASKARIARNSSQQIGSRASWTRNYAAKDIKFGVEARAMMLKGVEDLADAVKVTMGPKGRNVVIEQSFGAPKVTKDGVTVAKSVEFKDRVKNIGASLVKQVANATNDVAGDGTTCATVLTRAIFAEGCKSVAAGMNAMDLRRGISMAVDSVVTNLKSRTRMISTSEEIAQVGTISANGDRDIGEMIAKAMEKVGKEGVITITDGKTLNNEIEVVEGMKLDRGYISPYFITNQKNQKCELEDPLILIHEKKISSINSVVKVLELALKRQRPLLIVAEDIESDALATLILNKLRAGIKVCAIKAPGFGENRKSGMQDLAVLTGGQLITEELGMNLEKVELEMLGTCKKVTISKDDTVVLDGAGDKKFIEERCEQLRAGVEMSTSDYDKDKLQERLAKLSGGVAVLKIGGASEAEVGEKKDRVTDALNATKAAVEEGIVPGGGIALLYASRELDKLETANFDQKIGVQIIQNALKAPVQTIASNAGVEGAVVVGKLLEQENTDLGYDAAKGEYVDMIKAGIIDPLKVIRTALTDAASVSSLMTTTEAIVVELPKDDKETPAIGGGIGGMDY

SEQ ID NO: 6180 - protein, 574 aa, Secale cereale
MYRAAASLASKARQAGSSARQVGSRLAWSRNYAAKDIRFGVEARASMLKGVEELADAVKVTMGPKGRTVIIEQSFGAPKVTKDGVTVAKSIEFKDRVKNVGASLVKQVANATNDTAGDGTTCATVLTKAIFTEGCKSVAAGMNAMDLRRGISMAVDDVVTNLKGMARMISTSEEIAQVGTISANGEREIGELIAKAMEKVGKEGVITIADGNTLYNELEVVEGMKLDRGYISPYFITNQKTQKCELEDPLILIHDKKVSNMHAVVKVLEMALKKQKPLLIVAEDLESEALGTLIINKLRAGIKVCAVKAPGFGENRKANLQDLAILTGGEVITEELGMNLENFDPEMLGTCKKVTVSKDDTVILDGAGDKKNIEERADQIRSAIEQSTSDYDKEKLQERLAKLSGGVAVLKIGGASEAEVSEKKDRVTDALNATKAAVEEGIVPGGGVALLYASKALDKLQTANFDQKIGVQIIQNALKTPVYTIACNAGVEGAVVVGKLLEQDNTDLGYDAAKGEYVDMVKVGIIDPLKVIRTALVDAASVSSLMTTTEAIIVEVPKEEKEAPAMGGMGGMDY

SEQ ID NO: 6181 - protein, 574 aa, Triticum aestivum
MYRAAASLASKARQAGSSARQVGSRLAWSRNYAAKDIRFGVEARASMLRGVEELADAVKVTMGPKGRTVIIEQSFGAPKVTKDGVTVAKSIEFKDRVKNVGASLVKQVANATNDTAGDGTTCATVLTKAIFTEGCKSVAAGMNAMDLRRGISMAVDDVVTNLKGMARMISTSEEIAQVGTISANGEREIGELIAKAMEKVGKEGVITIADGNTLYNELEVVEGMKLDRGYISPYFITNQKTQKCELEDPLILIHDKKVSNMHAVVKVLEMALKKQKPLLIVAEDLESEALGTLIINKLRAGIKVCAVKAPGFGENRKANLQDLAILTGGEVITEELGMNLENFDPEMLGTCKKVTVSKDDTVILDGAGDKKNIEERADQIRSAIEQSTSDYDKEKLQERLAKLSGGVAVLKIGGASEAEVSEKKDRVTDALNATKAAVEEGIVPGGGVALLYASKALDKLQTANFDQKIGVQIIQNALKTPVYTIACNAGVEGAVVVGKLLEQENTDLGYDAAKGEYVDMVKVGIIDPLKVIRTALVDAASVSSLMTTTEAIIVEVPKEEKEAPAMGGMGGMDY

SEQ ID NO: 6182 - protein, 575 aa, Allium cepa
MYRPALYAASKARSACISGKQVGSRLSWRRNYAAKDIRFGVDARALMLKGVEELADAVKVTMGPKGRNVVIEQSFGAPKVTKDGVTVAKSIEFKDRVKNMGASLVKQVANATNDSAGDGTTCATVLTKAIFSEGCKSVAAGMNAMDLRRGITMAVDSVVTNLKSRARMISTSEEIAQVGTISANGDREIGELIAKAMEKVGKEGVITIQDGKTLYNELEVVEGMKLDRGYISPYFITNPKNQKCELDNPLILIHEKKISSMNAIVKVLELALKRQRPLLIVAEDIESEALATLIINKLRAGIKVCAIKAPGFGENRKNSMQDLATLTGGELITEELGMNLEKVELEMLGTCKKVTVSKDDTVILDGAGDKKAIEERCDQLRSAIDASTSDYDKEKLQERLAKLSGGVAVLKIGGASEAEVGEKKDRVTDALNATKAAVEEGIVPGGGVALLYASKELEKLQTANFDQKIGVQIIQNALKMPAYIIASNAGVEGAVVVGKLLEQDHADVGYDAAKGEYVDMVKAGIIDPLKVIRTALVDAASVSSLMTTTEAVVVEQPKDEKDAAPAMPGMGGMDY

SEQ ID NO: 6183 - protein, 578 aa, Allium cepa
MYRAALSAASKVRAAGGSGKQIGSRLNWSRNYAAKDIKFGVDARALMLRGVEELADAVKVTMGPKGRNVVIEQSFGAPKVTKDGVTVAKSIEFKDRVKNMGASLVKQVANATNDVAGDGTTCATVLTKAIFSEGCKSVAAGMNAMDLRRGISLAVDSVVTNLKSRARMISTSEEIAQVGTISANGEREIGELIAKAMEKVGKEGVITIEDGKTLYNELEVVEGMKLDRGYISPYFVTNPKNQKCELDDPLILIHEKKISSINAVVKVLELALKRQRPLLIVAEDIESDALATLIINKLRAGLKICAIKAPGFGDNRKNSMQDLATLTGGVLITEELGMNLEKVELDMLGTCKKVTVSKDDTVILDGAGDKKALEERCDQLRSAIDLSTSDYDKEKLQERLAKLSGGVAVLKIGGASEAEVGEKKDRVTDALNATKAAVEEGIVPGGGVALLYASKELEKLHTANFDQKIGVQIIQNALKAPVHIIASNAGVEGAVVVGKLLEQDNTDLGYDAAKGEYVDMVKAGIIDPLKVIRTALVDAASVSSLMTTTEAVVVELPKDEKEGAAAAPGMGGMGGMDY

SEQ ID NO: 6184 - protein, 576 aa, Euphorbia peplus
FASGIASKSRLAKNTTQQIGSKLAWSRNYAAKDIKFGVEARALMLKGVEELADAVKVTMGPKGRTVVIEQSWGAPKVTKDGVTVAKSIEFKNRVKNIGASLVKQVANATNDVAGDGTTCATVLTRAIFAEGCKSVAAGMNAMDLRRGISMAVDSVITSLKSRARMISTSEEIAQVGTISANGEREIGELIAKAMEKVGKEGVITISDGKTLYNELEVVEGMKLDRGYISPYFITNTKNQKCELEDPLILIHEKKISNLNPIVKVLELSLKMQRPLLIIAEDVDSDALAALVLNKLRAGLKVCAIKAPGFGENRKANMQDLAILTGGEIITEELGMNLEKVGLESLGSCKKVTVSKDDTIILDGLGDKKAIEERCEQLRSAVESSTSDYDKEKIQERLAKLSGGVAVLKIGGASEAEVSEKKDRVTDALNATKAAVEEGIVPGGGVALLYASKELDKLQTANFDQKIGVQIIQNALKMPVHTIAMNAGVEGAVVVGKLLEQDDPDLGYDAAKGEYVDMVKAGIIDPLKVIRTALLDAASVSSLMTTTEAIISEIPNDKEAEASPGMGGMGGMGGMGF

SEQ ID NO: 6185 - protein, 576 aa, Setaria italica
MYRAAASLASKARQAGSSAAARQVGSRLAWSRNYAAKDIKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKTQKCELEDPLILIHDKKVSNMHAVVKVLEMALKKQKPLLIVAEDVESEALGTLILNKLRAGIKVCAVKAPGFGENRKANLQDLAVLTGGEVITEELGMKLESVEPLMLGSCKKVTVSKDDTVILDGAGDKKAIEERAEQIRSAIENSTSDYDKEKLQERLAKLSGGVAVLKIGGASEAEVGEKKDRVTDALNATKAAVEEGIVPGGGVALLYAAKELDKLQTANFDQKIGVQIIQNALKTPVHTIASNAGVEGAVVVGKLLEQGNTDLGYDAAKGEYVDMVKAGIIDPLKVIRTALVDAASVSSLMTTTESIIVEIPKEEAPAPAMGGMGGMEY

SEQ ID NO: 6186 - protein, 577 aa, Zea mays
MYRAAASLASKARQAGNSLAARQVGSRLAWSRNYAAKDIKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKTQKCELEDPLILIHDKKVTNMHAVVKVLEMALKKQKPLLIVAEDVESEALGTLIINKLRAGIKVCAVKAPGFGENRKANLQDLAILTGGEVITEELGMNLENFEPHMLGTCKKVTVSKDDTVILDGAGDKKSIEERAEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQENTDLGYDAAKGEYVDMVKTGIIDPLKVIRTALVDAASVSSLMTTTESIIVEIPKEEAPAPAMGGGMGGMDY

SEQ ID NO: 6187 - protein, 577 aa, Sorghum bicolor
MYRAAASLASKARQAGSSAAARQVGSRLAWSRNYAAKDIKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKNMARMISTSEEIAQVGTISANGEREIGELIAKAMEKVGKEGVITIADGNTLYNELEVVEGMKLDRGYISPYFITNSKTQKCELDDPLILIHDKKVTNMHAVVKVLELALKKQKPLLIVAEDVESEALGTLIINKLRAGIKVCAVKAPGFGENRKANLQDLAILTGGEVITEELGMNLENVEPHMLGTCKKVTVSKDDTVILDGSGDKKSIEERAEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQENTDLGYDAAKGEYVDMVKAGIIDPLKVIRTALVDAASVSSLMTTTESIIVEIPKEEAPAPAMGGGMGGMDY

SEQ ID NO: 6188 - protein, 260 aa, Allium cepa
MYRAALSAASKVRAAGGSGKQIGSRLNWSRNYAAKDIKFGVDARALMLRGVEELADAVKVTMGPKGRNVVIEQSFGAPKVTKDGVTVAKSIEFKDRVKNMGASLVKQVANATNDVAGDGTTCATVLTKAIFSEGCKSVAAGMNAMDLRRGITLAVDSVVTNLKSRARMISTSEEIAQVGTISSNGEREIGELIAKAMEKVGKEGVITIEDGKTLYNELEVVEGMKLDRGYISPYFVTNPKNQKCELDDPLILIHEKKFLA

SEQ ID NO: 6189 - protein, 578 aa, Allium cepa
MYRAALSAASKVRAAGGRGKQIGSRLNWSRNYAAKDIKFGVDARALMLRGVEELADAVKVTMGPKGRNVVIEQSFGAPKVTKDGVTVAKSIEFKDRVKNMGASLVKQVANATNDVAGDGTTCATVLTKAIFSEGCKSVAAGMNAMDLRRGISLAVDSVVTNLKSRARMISTSEEIAQVGTISANGEREIGELIAKAMEKVGKEGVITIEDGKTLYNELEVVEGMKLDRGYISPYFVTNPKNQKCELDDPLILIHEKKISSISAVVKALELALKRQRPLLIVAEDIESDALATLIINKLRAGLKICAIKAPGFGDNRKNSMQDLATLTGGVLITEELGMNLEKVELDMFGTCKKVTVSKDDTVILDGAGDKKALEERCDQLRSAIDLSTSDYDKEKLQERLAKLSGGVAVLKIGGASEAEVGEKKDRVTDALNATKAAVEEGIVPGGGVALLYASKELEKLHTANFDQKIGVQIIQNALKAPAYIIASNAGVEGAVVVGKLLEQDNTDLGYDAAKGEYVDMVKAGIIDPLKVIRTALVDAASVSSLMTTTEAVVVELPKDEKEGAAAAPGMGGMGGMDY

SEQ ID NO: 6190 - protein, 575 aa, Papaver somniferum
MYRAVANLASKARIAKNASQQIGTRASWTRNYAAKDIKFGVEARAMMLKGVEDLADAVKVTMGPKGRNVVIEQSFGAPKVTKDGVTVAKSIEFKDRVKNIGASLVKQVANATNDVAGDGTTCATVLTRAIFAEGCKSVAAGMNAMDLRRGISMAVDSVVTNLKSRTRMISTSEEIAQVGTISANGDRDIGEMIAKAMEKVGKEGVITITDGKTLNNEIEVVEGMKLDRGYISPYFITNQKNQKCELEDPLILIHEKKISSINSVVKVLELALKRQRPLLIVAEDIESDALATLILNKLRAGIKICAIKAPGFGENRKSSMQDLAVLTGGQLITEELGMNLEKVELEMLGTCKKVTISKDDTVVLDGAGDKKSIEERCEQLRAGVEMSTSDYDKDKLQERLAKLSGGVAVLKIGGASEAEVGEKKDRVTDALNATKAAVEEGIVPGGGIALLYASRELDKLETANFDQKIGVQIIQNALKAPVQTIASNAGVEGAVVVGKLLEQENTDLGYDAAKGEYVDMIKAGIIDPLKVIRTALTDAASVSSLMTTTEAIVVELPKDDKEMPAMGGGIGGMDY

SEQ ID NO: 6191 - protein, 573 aa, Secale cereale
MYRARQPPSKARQAGASARQVGSRLAWSRNYAAKDIRFGVEARASMLKGVEELADAVKVTMGPKGRTVIIEQSFGAPKVTKDGVTVAKSIEFKDRVKNVGASLVKQVANATNDTAGDGTTCATVLTKAIFTEGCKSVAAGMNAMDLRRGISMAVDDVVTNLKGMARMISTSEEIAQVGTISANGEREIGELIAKAMEKVGKEGVITIADGNTLYNELEVVEGMKLDRGYISPYFITNQKTQKCELEDPLILIHDKKVSNMHAVVKVLEMALKKQKPLLIVAEDLESEALGTLIINKLRAGIKVCAVKAPGFGENRKANLQDLAILTGGEVITEELGMNLENFDPEMLGTCKKVTVSKDDTVILDGAGDKKNIEERADQIRSAIEQSTSDYDKEKLQERLAKLSGGVAVLKIGGASEAEVSEKKDRVTDALNATKAAVEEGIVPGGGVALLYASKALDKLQTANFDQKIGVQIIQNALKTPVYTIACNAGVEGAVVVGKLLEQDNTDLGYDAAKGEYVDMVKVGIIDPLKVIRTALVDAASVSSLMTTTEAIIVEVPKEEKEAPAMGGMGGMDY

SEQ ID NO: 6192 - protein, 575 aa, Solanum phureja
MYRFAANLASKARVARISSQQIGGRFNWSRNYAAKDIRFGVEARALMLQGVEQLADAVKVTMGPKGRNVVIEQSWGAPKVTKDGVTVAKSIEFKDKIQNVGASLVKQVANATNDVAGDGTTCATVLTRAIFAEGCKSVAAGMNAMDLRRGITMAVDSVVTNLKSRARMISTSEEIAQVGTISANGEREIGDLIARAMEKVGKEGVITIQDGKTLLNELDVVEGMKLDRGYISPYFITNQKNQKCELDNPLILIHEKKISSVNAVVKALELALKRQRPLLIVAEDVDNEALATLILNKLRAGIKVCAIKAPGFGENRKAYLQDLAILTGGQVITEELGLNIENLEFEMLGTSKEATISKDDTVILDGAGKKKSIEERCELIRSTIEQSTSDYDKEKLQERLAKLSGGVAVLKIGGASEAEVGEKKDRVTDALNATKAAVEEGIVPGGGVALLYAARELDNLTTANFDQKIGVQIIQNALKTPVHTIASNAGVEGAVVVGKLLDQDNLDLGYDAAKGEYVDMIKAGIIDPVKVIRTALVDAASVSSLLTTTEAVVVELPKDEKESPAMGGGMGGMDF

SEQ ID NO: 6193 - protein, 564 aa, Cirsium arvense
MYRFAVNLASKARVAKNGTQLIGSRLSWSRNYAAKDIRFGVDARALMLRGVEELADAVRVTMGPKGRNVVIEQSYGAPKVTKDGVTVAKSIEFKDKVKNVGASLVKQVANATNDVAGDGTTCATVLTGAIFSEGCKSVAAGMNAMDLRRGISMAVDSVVANLKSRARMISTSEEITQVGTISANGEREIGELIAKAMEKVGKEGVITIQDGKTLYNELEVVEGMKLDRGYISPHFITNQKNQKCELEDPLVLIHEKKISNINSVIKVLELALKRQRPLLIVAEDVESDALATLILNKLRAGIKVCAIKAPGFGENRKANLEDLATLTGGQLITEELGMNLDNVELEMLGSCKKVTVSKDDTVVLDGAGDKKSIEERCEQIRSAIESSTSDYDKEKFQERLAKLSGGVAVLKIGGASDSEVGEKKDRVTDALNATKAAVEEGIVPGGGVALLYASKELDKLPTANFDQKIGVQIIQNALKMPVYMIASNAGVEGSVVVGKLLEQDDPDLGYDAAKGEYVDMVKNGIIDPLKVIRTALVDAASVSSLMTTTEAIVVELPKPASEAA

SEQ ID NO: 6194 - protein, 576 aa, Zea mays
MYRAAASLASKARQAGSSSAARQVGSRLAWSRNYAAKDIKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKAQKCELEDPLILIHDKKVTNMHAVVKVLEMALKKQRPLLIVAEDVESEALGTLIINKLRAGIKVCAVKAPGFGENRKANLQDLAILTGGEVITEELGMNLENVEPHMLGSCKKVTVSKDDTVILDGAGDKKSIEERADQIRSAVENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQGNTDLGYDAAKDEYVDMVKAGIIDPLKVIRTALVDAASVSSLMTTTESIIVEIPKEEAPAPAMGGMGGMDY

SEQ ID NO: 6195 - protein, 259 aa, Ambrosia trifida
MYRLAVNIATKSRVARNSAQQISSNLRWNRNYAAKDIKFGVDARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFVTNTKNQKCELDDPLILIHEKKIL

SEQ ID NO: 6196 - protein, 566 aa, Helianthus annuus
MYRLAANIATKSRIARNSAQQIRNYAAKDIRFGVDARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFVTNTKNQKCELDDPLILIHEKKISSLNAIVKVLELALKNQRSLLIVAEDIESEALATLILNKLRAGIKVCAIKAPGFGENRKSNLHDLATLTGGEVITEELGMNLEKMSPEMLGTCKRVTISKDDTVILDGAGDKKAIEERCEQIRSSIELSTSDYDKEKLQERLAKLSGGVAVLKIGGASEAEVGEKKDRVTDALNATKAAVEEGIVPGGGVALLYASKELDNLQTANFDQKIGVQIIQNALKAPVHTIASNAGVEGAVIVGKLLEQDNPDLGYDAAKGQYVDMVKEGIIDPLKVIRTALTDAASVSSLLTTTEAVIVELPKEEKESPAMPPGMGDY

SEQ ID NO: 6197 - protein, 576 aa, Chrysanthemum coronarium
MYRFAVNLASKSRLLRNNSHQIASRFASSRNYAAKDIRFGVGARAMMLRGVEDLADAVQVTMGPKGRNVVIEQSYGAPKVTKDGVTVAKSIEFKDRVKNVGASLVKQVANATNDVAGDGTTCATVLTRAIYSEGCKSVAAGMNAMDLRRGINMAVDSVVTHLKSKARMISTSEEIAQVGTISANGEREIGELIAKAMEKVGKEGVITISDGKTLHNELEVVEGMKLDRGYISPYFVTNPKNQKCELDDPLILIHEKKISSLHSIVKVLELALKKQRPLLIVAEDIESEALATLILNKLRAGIKVCAIKAPGFGENRKSNLQDLATLTGGEVITEELGMNLEKVGVEMLGTCKKVTVSKDDTVVLDGAGDKKAIEERCEQLRSSIELSTTDYDKEKFQERLAKLSGGVAVLKIGGASEAEVGEKKDRVTDALNATKAAVEEGIVPGGGVALLYASKELSNLATANFDQKIGVQIIQNALKSPVHIIASNAGVEGAVVVGKLLEQDNTDLGYDAAKGLYVDMVKEGIIDPVKVIRTALVDAASVSSLLTTTEAVVVELPKDEKEAPEMPGMGGYGSQF

SEQ ID NO: 6198 - protein, 560 aa, Cocos nucifera
AGSSSRQIGSRLGWSRNYAAKDIRFGVEARALMLKGVEELADAVKVTMGPKGRNVVLEQSFGAPKVTKDGVTVAKSIEFKDKVKNVGASLVKQVANATNDVAGDGTTCATVLTRAIFTEGCKSVAAGMNAMDLRRGITMAVDAVVTNLKSRARMISTSEEIAQVGTISANGEREIGELIAKAMEKVGKEGVITIADGNTLYNELEVVEGMKLDRGYISPYFITNQKNQKCELEDPLILIHEKKISSINAVVKALELALKRQRPLLIVAEDVESDALATLILNKLRAGIKVCAIKAPGFGENRKASLHDLAILTGGELITEELGMNLEKVEFDMLGACKKVTISKDDTVILDGAGEKKAIEERCDQLRSAIEACTSDYDKEKLQERLAKLSGGIAVLKIGGASEAEVGEKKDRVNDALNATKAAVEEGILPGGGVALLYASKELEKLQIANFDQKIGVQIIQNALKTPVHTIAANAGVEGAVVVGKLLEQDNPDLGYDAAKGEYVDMVKAGIIDPLKVIRTALVDAASVSSLMTTTEAVVVELPKDEDVPAPGGGMGGMDY

SEQ ID NO: 6199 - protein, 572 aa, Ambrosia trifida
MYRLAVNIATKSRVARNSAQQISSNLRWNRNYAAKDIKFGVDARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFVTNTKNQKCELDDPLVLIHEKKISSLNAIVKVLELALKNQRSLLIVAEDIESEALATLILNKLRAGIKVCAIKAPGFGENRKSNLHDLATLTGGEVITEELGMNLEKMSPEMLGTCKRVTISKDDTVILDGAGDKKAIEERCEQIRSSIELSTSDYDKEKLQERLAKLSGGVAVLKIGGASEAEVGEKKDRVTDALNATKAAVEEGIVPGGGVALLYASKELDNLQTANFDQKIGVQIIQNALKAPVHTIASNAGVEGAVIVGKLLEQDNPDLGYDAAKGQYVDMVKEGIIDPLKVIRTALTDAASVSSLLTTTEAVIVELPKEEKESPAMPGMGDY

SEQ ID NO: 6200 - protein, 557 aa, Lotus japonicus
IGSRAAWSRNYAAKDIKFGVAARALMLKGVEELADAVQVTMGPKGRNVVIEQSFGAPKVTKDGVTVAKSIEFKDKVKNVGASLVKQVANATNDVAGDGTTCATVLTRAIFAEGCKSVAAGMNAMDLRRGINMAVDSVVTNLKSRARMISTSEEIAQVGTISANGEREIGELIAKAMEKVGKEGVITIADGKTLENELEVVEGMKLDRGYISPYFITNQKNQKCELEDPLIIIHEKKISSINAIVKVLELALKKQRPLLIVAEDVESEALATLILNKLRAGIKVCAIKAPGFGENRKSGLQDLAVLTGGQLITEELGMNLEKVDLEMLGSCKKITISKDDTVILDGAGDKKALEERCEQIRSAIENSTSDYDKEKLQERLAKLSGGVAVLKIGGASEAEVSEKKDRVTDALNATKAAVEEGILPGGGVALLYASNELSKLQTANFDQKIGVQIIQNALKTPVHTIAANAGVEGAVVVGKLLEQNNPDLGYDAAKGEYVDMVKSGIIDPLKVIRTALVDAASVSSLMTTTEAIVTEFPKEDKDVPAMGGGMGGMGGMDY

SEQ ID NO: 6201 - protein, 560 aa, Prunus persica
FFFPVQIGSSLISRRNYAAKDIKFGVEARALMLKGVEELADAVKVTMGPKGRNVVLEQSFGAPKVTKDGVTVAKSIEFRDKVKNIGASLVKQVANATNDAAGDGTTCATVLTRAIFTEGCKSVAAGMNAMDLRRGISMAVDSVVTNLKSRARMISTSEEIAQVGTISANGEREIGELIAKAMEKVGKEGVITIADGKTLYNELEVVEGMKLDRGYISPYFITNPKNQKCELEDPLVLIHEKKISNLNSIVKILELALKKQRPLLIVAEDVESEALATLIINKLRAGIKVCAIKAPGFGENRKANLQDLAILTGGEVITEELGLNLDKVGVETLGTCKRVTISKDDTVILDGAGDKKAIEERCEQLRSSIELSTSDYDKEKLQERLAKISGGVAVLKIGGASEAEVSEKKDRVTDALNATKAAVEEGIVPGGGAALLYASKELDKLATANFDQKIGVQIIQNALKMPVSTIASNAGVEGAVVVGKLLEQDNPDLGYDAAKGEYVDMIKAGIIDPLKVIRTALVDAASVSSLMTTTEAVVVELPKDEKETPGMGGGMGGMDY

SEQ ID NO: 6202 - protein, 576 aa, Zostera marina
MYRAAAKIASNARIAGVLGQQIGGKFGYARNYAAKDIRFGVDARALMLKGVEELADAVKVTMGPKGRNVVLEQSFGAPKVTKDGVTVAKSIEFKDRVKNMGASLVKQVANATNDVAGDGTTCATVLTRAIFSEGCKSVAAGMNAMDLRRGITMAVDNVVTTLKSRARMISTSEEIAQVGTISANGEREIGELIAKAMEKVGKDGVITIADGKTLYNELEVVEGMKLDRGYISPYFITNQKNQKCELENPLILIHEKKISNIQALVKVLEMALKIQRPLLIIAEDVESDILATLILNKLRAGIKVCAIKAPGFGENRKANMQDLATLTGGEVITEELGMNLDKVEFEMLGTCKKVTISKDDSVVLDGAGDRKAIEERCEELRSAIEASDSDYDREKVQERLGKLSGGVAVLKIGGASEAEVGEKKDRVTDALNATKAAVEEGIVPGGGVALLYASKELDKLNVANFDQKIGVQIIQNALKTPVHTIASNAGVEGAVVVGKLLESDNYDLGYDAAKDEYVDMVKAGIIDPLKVIRTALVDAASVSSLMTTTEAVVTELPKDEKDASPMPGGGMGGMDY

SEQ ID NO: 6203 - protein, 260 aa, Allium cepa
MYRPALYAASKARSACVSGKQVGSRLSWRRNYAAKDIRFGVDARALMLKGVEELADAVKVTMGPKGRNVVIEQSFGAPKVTKDGVTVAKSIEFKDRVKNMGASLVKQVANATNDSAGDGTTCATVLTKAIFSEGCKSVAAGMNAMDLRRGITMAVDSVVTNLKSRARMISTSEEIAQVGTISANGDREIGELIAKAMEKVGKEGVITIQDGKTLYNELEVVEGMKLDRGYISPYFITNPKNQKCELDNPLILIHEKKFLA

SEQ ID NO: 6204 - protein, 577 aa, Petroselinum crispum
MYRFATKLASKSLIARNANQQFASRLAWSRNYAAKDIKFGVEARAMMLRGVEELADAVKVTMGPKGRNVVLEQSYGAPKVTKDGVTVAKSIEFKDRVKNVGASLVKQVANATNDVAGDGTTCATILTRAIYSEGCKSVAAGMNAMDLRRGINMAVDAVVTNLKSRARMISTSEEIAQVGTISANGDREIGELIAKAMEKVGKEGVITIADGKTLYNELEVVEGMKLDRGYISPYFITNTKNQKCELDDPLILIHEEKISNLNAVVKVLELALKKQRPLLIVSEDVESEALATLILNKLRAGIKVCAIKAPGFGENRKASLQDLAVLTGGTVITEELGMTLEKVGIEMLGSCKKVTISKDDTVILDGAGDKKAIEERCEQVRSSIELSTSDYDKEKHQDRLAKLSGGVAVLKIGGASEVEVGEKKDRVTDALNATKAAVEEGIVPGGGVALLYASKELENLHAANFDQKIGIQIIQSALKAPVHTIVSNAGVEGAVVVGKLLEQDDPDLGYDAAKGAYVDMVKSGIIDPLKVIRTALVDAASVASLLTTTEAVIVELPSDDKEMTAPGGMGGMGGMGF

SEQ ID NO: 6205 - protein, 587 aa, Triphysaria pusilla
MYRFASSLASKARTARSSQLVSGSRLSWSRNYAAKDIRFGVDARAAMLRGVEELADAVKVTMGPKGRNVILEQSYGGPKVTKDGVTVAKSIEFKDKVMNVGASLVKQVANATNDTAGDGTTCATILTRAIYSEGCKSVAAGMNAMDLRRGINMAVDAVVENLKSRARMISTSEEIAQVGTISANGEREIGELIAKAMERVGKEGVITIADGKTMSNELEVVEGMKLDKGYTSPYFITNDKNQKCELEDCLILIHEKKIDNFTSMIKALELALKDQRPLLIVSEDIESEALGALILNKLRAGLKVCAIKAPGYGENRKAFLQDLAVLTGGEVITSDLGMNLEDLTIEMLGSCKKITVSKDDTVILDGSGDKKSIEERCEQLRSGIELSTSDYDKEKLQERLAKLSGGVAVLKIGGASEAEVGEKKDRVTDALNATKAAVEEGIVPGGGAALLYASKELEKLPTANFDQKVGVQIIQNALKAPVYTIASNAGVEGSVVVGKLLEQDDPDLGYDAAKGEYVDMVKAGIIDPLKVIRTALVDAASVSSLLTTTEAVVVELPSSERSSPPMGGGGGGMGGMGGMGGMGGMRF

SEQ ID NO: 6206 - protein, 260 aa, Echinacea purpurea
MYRLAANIATKSRIARNSAQQIGANLRWSRNYAAKDIRFGVDARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFVTNTKNQKCELDDPLILIHEKKSLA

SEQ ID NO: 6207 - protein, 575 aa, Populus trichocarpa
MYRFASGLASKASGVAGNNAKQIGSRLAWRRNYAAKDIKFGVEARALMLRGVEELADAVQVTMGPKGRNVVLEQSWGAPKVTKDGVTVAKSIEFQDRVKNIGASLVKQVANATNDVAGDGTTCATVLTRAIFAEGCKSVAAGMNAMDLRRGISMAVEAVVTSLKSRARMISTSEEIAQVGTISANGEREIGELIAKAMEKVGKEGVITISDGKTMDNELEVVEGMKLDRGYISPYFITNDKNQKCELEDPLILIHEKKISSMSSTVKVLELALKRQRPLLIVAEDLEGEVLATLILNKLRAGIKVCAIKAPGFGENRKASLQDLSILTGGQVITEELGLNLDNVGLEMLGSCKKVTVSKDDTIILDGLGDKKTIEERCEQLRSAIGTSTSDYDKEKLQERLAKLSGGVAVLKIGGASEAEVGEKKDRVTDALNATKAAVEEGIVPGGGVALLYASKELDKLHTANFDQKIGVQIIQNALKTPVHTIASNAGVEGAVVVGKLLEQDNPDLGYDAAKGEYVDMVKSGIIDPLKVIRTALVDAASVSSLMTTTEAIVYELPKVEKETPASNGMSGMGF

SEQ ID NO: 6208 - protein, 529 aa, Catharanthus roseus
MYRFAANLASKASVASRASGQAGSRLAWSRNYAAKDIKFGVEARALMLQGVEELAEAVKVTMGPKGRNVVLEQSFGAPKVTKDGVTVAKSIEFKDRVKNIGASLVKQVANATNDVAGDGTTCATILTRAIYSEGCKSVAAGMNAMDLRRGISMAVDSVVTNLKSRARMISTSEEIAQVGTISANGEREIGELIAKAMERVGKEGVITIADGKTLYNELEVVEGMKLDRGYISPYFITNQKNQKCEMDDPLILIHEKKIGSLNAVIKVLELALKRQKPLLIVSEDVESEALATLILNKLRAGIKVCAIKAPGFGENRKANLQDLATLTGGQLITEELGLNLENVTIDMLGSCKKVTVSKDDTVILDGAGDKKTIEERCEQIRSAMELSTSDYDKEKLQERLAKLSGGVAVLKIGGASEAEVGEKKDRVTDALNATKAAVEEGIVPGGGVALLFASKELEKLQTANFDQKIGVQIIQNALKAPVQTIASNAGVEGAVVVGKLLEQDNDDLGYDAAKGEYVDMGEGVESLTQ

SEQ ID NO: 6209 - protein, 456 aa, Flaveria ramosissima
QSPPSHTLHLLLQLSPPPPSNRRYSARYRLAANIASKSRIARNNAQQINSSLRWNRNYAAKDIKFGVDARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELDDPLILIHEKKISSLNAIVKVLELALKNQRSLLIVAEDIESEALATLILNKLRAGIKVCAIKAPGFGENRKSNLQDLATLTGGEVITDELGMNLEKMSPEMLGTCKRITISKDDTVILDGAGDKKAIEERCEQLRSSIELSTSDYDKEKLQERLAKLSGGVAVLKIGELAKPRSVKRRIGLLML

SEQ ID NO: 6210 - protein, 566 aa, Chrysanthemum coronarium
MYRLAASLASKSRIARNNAQQLRYYAAKDIRFGVDARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELEDPLILIHEKKISSLNAIVKVLELALKNQRSLLIVSEDIESEALATLILNKLRAGIKVCAIKAPGFGENRKSNLQDLATLTGGEVITDELGMNLEKMSPEMLGTCKRVTISKDDTVILDGAGDKKGIEERCEQLRSSIELSTSDYDKEKFQERLAKLSGGVAVLKIGGASEAEVGEKKDRVTDALNATKAAVEEGIVPGGGVALLYASKELEKLVTANFDQKIGVQIIQNALKAPVHTIASNAGVEGAVIVGKLLEQDNPDLGYDAAKGQYVDMVKEGIIDPLKVIRTALVDAASVSSLLTTTEAVIVEAPKDEKESPAMTPGMGDY

SEQ ID NO: 6211 - protein, 574 aa, Brachypodium distachyon
MYRAAVSLASKARQAGSSARQVGSRLAWSRNYAAKDIKFGVEARALMLRGVEELADAVKVTMGPKGRTVIIEQSFGAPKVTKDGVTVAKSIEFKDRVKNVGASLVKQVANATNDTAGDGTTCATVLTKAIFSEGCKSVAAGMNAMDLRRGISMAVDDVVTNLKGMARMISTPEEIAQVGTISANGEREIGELIAKAMEKVGKEGVITIADGNTLYNELEVVEGMKIDRGYISPYFITNPKTQKCEMEDPMILIHEKKISNLPAFVKVLELAHAKQRPLLVVAEDLESEALGTLILNKLRVGLKLCAIKAPGFGENRKANLQDLAILTGGEVISEELGMSLENFDPQMLGTCKKVTVSKDDTVILDGAGDKKNMEERAEQIRSAIEESTSDYDKEKLQERLAKLSGGIAVLKIGGASEAEVSEKKDRVTDALNATKAAVEEGIVPGGGVALLYASKALDKLQTANFDQKIGVQIIQNALKTPVYTIASNAGVEGAVVVGKLLEQDNTDLGYDAAKGEYVDMVKVGIIDPLKVIRTALVDAASVSSLMTTTESIIVEIPKEEKEAPAMGGMGGMDY

SEQ ID NO: 6212 - protein, 574 aa, Festuca arundinacea
MYRAAASLASKARQAGSSARQVGSRLAWSRNYAAKDIKFGVDARALMLRGVEELADAVKVTMGPKGRTVIIEQSFGAPKVTKDGVTVAKSIEFKDRVKNVGASLVKQVANATNDTAGDGTTCATVLTKAIFTEGCKSVAAGMNAMDLRRGISMAVDDVVTNLKGMAKMISTSEEIAQVGTISANGEREIGELIAKAMEKVGKEDVITIADGNTLHNELEVVEGMKLDRGYISPYFVTNQKTQKCELEDPLILIHDKKISNMHAVVKVLEMALKKQRSLLIVAEDLESEALGTLILNKLRAGIKVCAVKAPGFGDNRKANLQDLAVLTGGEVISEEIGMNLENFDFQMLGTCKKVTVSKDDTVILDGAGDKKNIEERAEQIRSAIEQTTSDYDKEKLEGRLAKLSGGVAVLKIGGASEAEVSEKKDRVTDALNATKAAVEEGIVPGGGVALLYASKALDKLQTANFDQKIGVQIIQNALKTPVYTIASNAGVEGAVVVGKLLEQDNTDLGYDAAKGEYVDMVKVGIIDPLKVIRTALVDAASVSSLMTTTEAIIVESPKEEKEAPAMGGMGGMDY

SEQ ID NO: 6213 - protein, 566 aa, Chrysanthemum coronarium
MYRLAASLASKSRIARNNAQQLRYYAAKDIRFGVDARALMLRGVEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELEDPLILIHEKKISSLNAIVKVLELALKNQRSLLIVSEDIESEALATLILNKLRAGIKVCAIKAPGFGENRKSNLQDLATLTGGEVITDELGMNLEKMSPEMLGTCKRVTISKDDTVILDGAGDKKGIEERCEQLRSSIELSTSDYDKEKFQERLAKLSGGVAVLKIGGASEAEVGEKKDRVTDALNATKAAVEEGIVPGGGVALLYASKELEKLVTANFDQKIGVQIIQNALKAPVHTIASNAGVEGAVIVGKLLEQDNPDFGYDAAKGQYVDMVKEGIIDPLKVIRTALVDAASVSSLLTTTEAVIVEAPKDEKESPAMTPGMGDY

SEQ ID NO: 6214 - protein, 570 aa, Chrysanthemum coronarium
FAVNLASKSRLLRNNSQQISSRLGWSRNYAAKDIRFGVEARAMMLRGVEDLADAVQVTMGPKGRNVVIEQSYGAPKVTKDGVTVAKSIEFRDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELEDPLILIHEKKISSLNAIVKVLELALKNQRSLLIVSEDIESEALATLILNKLRAGIKVCAIKAPGFGENRKSNLQDLATLTGGEVITDELGMNLEKMSPEMLGTCKRVTISKDDTVILDGAGDKKGIEERCEQLRSSIELSTSDYDKEKFQERLAKLSGGVAVLKIGGASEAEVGEKKDRVTDALNATKAAVEEGIVPGGGVALLYASKELEKLVTANFDQKIGVQIIQNALKAPVHTIASNAGVEGAVIVGKLLEQDNPDLGYDAAKGQYVDMVKEGIIDPLKVIRTALVDAASVSSLLTTTEAVIVEAPKDEKESPAMTPGMGDY

SEQ ID NO: 6215 - protein, 596 aa, Arnica chamissonis
MYRFAVNLASKSRIANNTTQQIGSRLNCSRNYAAKDIRFGVDARALMLRGVEELADAVRVTMGPKGRNVVIEQSYGAPKVTKDGVTVAKAIEFNDKVKNVGASLVKQVANATNDVAGDGTTCATVLTHAIFSEGCKSVAAGVNAMDLRRGISMAVDAVVTNLKSRACMISTSEEITQVGTISANGEREIGELIAKAMEKVGKEGVITIQDGKTLYNELEVVEGMKLDRGYISPHFITNQKNQKCELDDPIVLIYEKKISNINSVIKVLELALKKQRPLLIVAEDVESEALATLILNKLRAGIKVCAIKAPGFGENRKANLQDLATLTGGQLITEELGMNLDNVEPEMLGSCKKVTASKDDTVVLDGAGDKKSIEERCEQIRSAIESSTSDYDKEKLQERLAKLSGGVAVLKIGGASDTEVGEKKDRVTDALNATKAAVEEGIVPGGGVALLYASKELDKLQTANFDQKIGVQIIQNALKMPVHTIASNAGVEGSVVVGKLLEHDDPDLGYDAAKGEYVDMVKNGIIDPLKVIRTALVDAASVSSLMTTTEAIVVEFPKPASEAAPGMGGGMGGMGGMGFLTCHVILQPLTYMLLTK

SEQ ID NO: 6216 - protein, 575 aa, Brachypodium distachyon
MYRAAASLASKARQAGSSARQVGSRLAWSRNYAAKDIRFGVEARALMLSGVEELADAVKVTMGPKGRTVIIEQSFGAPKVTKDGVTVAKSIEFTDRVKNVGASLVKQVANATNDTAGDGTTCATVLTKAIFTEGCKSVAAGMNAMDLRRGISMAVDSVVTNLKGMARMINTPEEIAQVGTISANGEREIGELIAKAMEKVGKEGVITIADGKTLYNELDVVEGMKFERGYISPYFITNQKSQKCELEDPLILIHEKKISSFPAMVKVLEYALKMKKPLLIVAEDLESEALGTLIINKLRINMKVCAVKAPGFGENRKSNLQDLAILTGGEVITEELGMNLENFEPHVLGTCKKVTVSKDDTVVLDGAGDKKAIEERAEQLRSAIEESTSDYDKEKIQERLAKLSGGIAVLKIGGASEPEVGEKKDRVTDALNATKAAVEEGIVPGGGVALLYASRDLDKLQTANFDQKIGVQIIQNALKTPVHTIASNAGVEGAVIVGKLLEQDNTDLGYDAAKGEYVDMIKAGIIDPLKVIRTALVDAASVSSLMTTTEAIIVETPTEEKSAPAMGGGMGGMGF

SEQ ID NO: 6217 - protein, 575 aa, Theobroma cacao
MYRFATSLASKARLAKNNTQLIASRLSWSRNYAAKDIKFGVEARALMLRGVEELADAVKVTMGPKGRNVVLEQSFGAPKVTKDGVTVAKSIEFKDRVKNIGASLVKQVASATNDVAGDGTTCATVLTRAIFVEGCKSVAAGMNAMDLRRGITMAVDAVVTNLKSRARMISTSEEIAQVGTISANGEREIGELIAKAMEKVGKEGVITIADGKTLCNELEVVEGMKLDRGYISPYFITNQKNQKCELENPLILIHEKKISNLPALVKFLELSLSKQRPLLIVAEDLESEALATLILNKLRVGIKVCAIKAPGFGENRKAGLQDLAALTGGEVVTEELGLNIEKVGAEVLGSCKKVTVSKDDTIILDGAGDKAAIEERCDQIRSAMESSTSDYDKDKLQERLAKLSGGVAVLKIGGASEAEVGEKKDRVTDALNATKAAVEEGIVPGGGVALLYASKELENLHTANFDQKIGVQIIQNALMMPVHAIASNAGVEGAVIVGKLLEQDNPDLGYDAAKGEYVDMVKAGIIDPLKVIRTALVDAASVSSLMTTTEAIVTELPNDEKAGPAAPGGMGGLDY

SEQ ID NO: 6218 - protein, 376 aa, Arnica chamissonis
MYRLAANIASKSRIARNNAQQISSNLSWNRNYAAKDIRFGVDARALMLRGIEELADAVKVTMGPKGRNVVIEQSYGAPKVTKDGVTVAKSIEFKDRVKNVGASLVKQVANATNDVAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELDDPLVLIHEKKISSLNSIVKVLELALKNQRSLLIVAEDIESEALATLILNKLRAGIKVCAIKAPGFGANRKSNLQDLATLTGGEVITDELGMNLEKLAPEMLGTCKRVTISKDDTVILMGLVIRKPLRKM

SEQ ID NO: 6219 - protein, 577 aa, Oryza sativa
MYRAAASLASKARQAGSSARQIGSRLALHRNYAAKDIKFGVEARALMLRGVEELADAVKVTMGPKGRTVVIEQSFGAPKVTKDGVTVAKSIEFSNRVKNVGASLVKQVANATNDTAGDGTTCATVLTKAIFAEGCKSVAAGMNAMDLRRGISMAVDEVVTNLKGMARMISTSEEIAQVGTISANGEREIGELIAKAMEKVGKEGVITITDGNTLYNELEVVEGMKLDRGYISPYFITNQKNQKCELDDPLILIHDKKVSNLHAVVKVLELALKKQRPLLIVAEDVESEALGTLIINKLRAGIKVCAVKAPGFGESRKANLQDLAILTGGEVITEELGMNLENFEPQMLGTCKKVTVSKDDTVILDGAGDKKAIEERAEQLRSAIELSTSDYDKEKLQERLAKLSGGVAVLKIGGASEAEVGEKKDRVTDALNATKAAVEEGIVPGGGVALLYASKDLDKLQTANFDQKIGVQIIQNALKTPVHTIASNAGVEGSVIIGKLLEQDNTDLGYDAAKGEYVDMVKSGIIDPLKVIRTALVDAASVSSLMTTTESIIVEIPKEEEAAAAAPAMGGMGGMGF

SEQ ID NO: 6220 - protein, 403 aa, Prunus mume
MYRFAGSLASKARLARNCTQQIGSSLISRRNYAAKDIKFGVEARALMLKGVEELADAVKVTMGPKGRNVVLEQSFGAPKVTKDGVTVAKSIEFRDKVKNIGASLVKQVANATNDAAGDGTTCATVLTRAIFTEGCKSVAAGMNAMDLRRGISMAVDSVVTNLKSRARMISTSEEIAQVGTISANGEREIGELIAKAMEKVGKEGVITIADGKTLYNELEVVEGMKLDRGYISPYFITNPKNQKCELEDPLVLIHEKKISNLNSIVKILELALKKQRPLLIVAEDVESEALATLIINKLRAGIKVCAIKAPGFGENRKANLQDLAILTGGEVITEELGLNLDKVGVETLGTCKRVTISKDDTVILDGAGDKKAIEERCEQLRSSIELSTSDYDNYHLQYTGASS

SEQ ID NO: 6221 - protein, 574 aa, Aristolochia fimbriata
MYRIAASVASKAKVASKTYQVRSRLSWSRNYAAKEIKFGVDARALMLRGVEELADAVKVTMGPKGRTVVIEQSFGAPKVTKDGVTVAKSIEFKDRTKNVGASLVKQVANATNDVAGDGTTCATVLTRAIFAEGCKSVAAGMNAMDLRRGISMAVDSVVTNLKSRARMISTSEEIAQVGTISANGEREIGELIAKAMEKVGKEGVITIADGNKLENELEVVEGMKLERGYISPYFITNQKTQKCELEDPLILIHEKKISNMNAVVKVLELALKRQRPLLIVAEDVESDALATLIVNKLRAGIKVCAIKAPGFGENRKANLQDLATLTGGVLITEDLGMNLEKVEFDMLGNCKKVTVSKDDTVILDGAGDKKVIEERCDQLRAGIASCTSDYDREKLEERLAKLSGGVAVLKVGGASETEVGEKKDRVVDALNATKAAVSEGIVPGGGVALLYASRDLEKLQTANFDQKIGVQIIQNALKMPVHAIASNAGVEGAVVVGKLLEQDDLDLGYDAAKGEYVDMVKSGIIDPLKVIRTALVDAASVSSLLTTTEAVVVELPKDEKEAPAMAPGMGGLDY

SEQ ID NO: 6222 - protein, 260 aa, Cyclamen graecum
MYRFAANLASKARVAKSCTQQVGGRLSWSRNYAAKDIRFGDKAREAMLKGVTELADAVKVTMGPKGRHVVIEQSYGAPKVTKDGVTVAKSVEFQDKVKNVGASLVKQVANATNDVAGDGTTCATVLTRAIFSEGCKSVAAGMNAMDLRRGINMAVDSVITNLKSKARMISTSEEIAQVGTISANGEREIGELIAKAMEKVGKEGVITIADGKTLYNELEVVEGMKLDRGYISPYFITNTKNQKCELDDPLILIHEKKSQI

SEQ ID NO: 6223 - protein, 528 aa, Panicum virgatum
MLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKTQKCELDDPLILIHDKKVSNMHAVVKVLEMALKKQRPLLIVAEDVESEALGTLIINKLRAGIKVCAVKAPGFGENRKANLQDLAILTGGEVITEELGMNLENVEPHMLGTCKKVTVSKDDTVILDGAGDKKSIEERAEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQGNTDLGYDAAKGEYVDMVKAGIIDPLKVIRTALVDAASVSSLMTTTESIIVEIPKEETPAPAMGGMGGMDY

SEQ ID NO: 6224 - protein, 575 aa, Pinus pinaster
MYRAAAALASRIGSRSSSYGQNFSRLGWRRNYAAKDIRFGVDARAAMLQGVEHLADAVKVTMGPKGRNVIIEQSYGAPKVTKDGVTVAKSIEFSDKLKNVGASLVKQVANATNDVAGDGTTCATILTRAIFTEGCKSVAAGMNAMDLRRGISMAIDAVVAHLKSRARMISTSEEIAQVGTISANGEREIGELIAKAMEKVGKEGVITIADGKTLYNELEVVEGMKLDRGYISPYFITNEKAQKCELENPLILIHEKKISNLNAVVRAMELALKKQRALLIVSEDVESDALATLILNKIRAGVKVCAIKAPGFGENRKANLEDLAVLTGGQMITEELGMKLEKVEADMFGSAKKVTVSKDDTIVLDGGGDKKAIEERCEQIRAAIEASTTDYDKDKYQERLAKLSGGVAVLKIGGASEAEVGEKKDRVTDALNATKAAVEEGIVPGGGVALLYATKELEKHQTANFDQKIGVQIIQNALKMPAYTIAANAGVEGAVVVGKLLEQDNLDLGYDAAKGEYVDMVKAGIIDPLKVIRTALVDAASVSSLLTTTECVVVEIPKDEKEGPAMGGGMGGMDY

SEQ ID NO: 6225 - protein, 566 aa, Chrysanthemum coronarium
MYRLAASLASKSRIARNNAQQLRYYAAKDIHFGVGARALMLKGVEELADAVKVTMGPKGRNVVIEQSYGAPKVTKDGVTVAKSIEFKDRVKNVGASLVKQVANATNDAAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELEDPLILIHEKKISSLNAIVKVLELALKNQRSLLIVSEDIESEALATLILNKLRAGIKVCAIKAPGFGENRKSNLQDLATLTGGEVITDELGMNLEKMSPEMLGTCKRVTISKDDTVILDGAGDKKGIEERCEQLRSSIELSTSDYDKEKFQERLAKLSGGVAVLKIGGASEAEVGEKKDRVTDALNATKAAVEEGIVPGGGVALLYASKELEKLVTANFDQKIGVQIIQNALKAPVHTIASNAGVEGAVIVGKLLEQDNPDLGYDAAKGQYVDMVKEGIIDPLKVIRTALVDAASVSSLLTTTEAVIVEAPKDEKESPAMTPGMGDY

SEQ ID NO: 6226 - protein, 564 aa, Allium cepa
AGGSGKQIGSRLNWSRNYAAKDIKFGVDARALMLRGVEELADAVKVTMGPKGRNVVIEQSFGAPKVTKDGVTVAKSIEFKDRVKNMGASLVKQVANATNDVAGDGTTCATVLTKAIFSEGCKSVAAGMNAMDLRRGITLAVDSVVTNLKSRARMISTSEEIAQVGTISSNGEREIGELIAKAMEKVGKEGVITIEDGKTLYNELEVVEGMKLDRGYISPYFVTNPKNQKCELDDPLILIHEKKISSINAVVKVLELALKRQRPLLIVAEDIESDALATLIINKLRAGLKICAIKAPGFGDNRKNSMQDLATLTGGVLITEELGMNLEKVELDMLGTCKKVTVSKDDTVILDGAGDKKALEERCDQLRSAIDLSTSDYDKEKLQERLAKLSGGVAVLKIGGASEAEVGEKKDRVTDALNATKAAVEEGIVPGGGVALLYASKELEKLHTANFDQKIGVQIIQNALKAPVHIIASNAGVEGAVVVGKLLEQDNTDLGYDAAKGEYVDMVKAGIIDPLKVIRTALVDAASVSSLMTTTEAVVVELPKDEKEGAAAAPGMGGMGGMDY

SEQ ID NO: 6227 - protein, 253 aa, Aristolochia fimbriata
MYRAAASLASKARRVSQGSQQLGSHLNWKRNYAAKEIKFGVEARALMLKGVEDLADAVKVTMGPKGRNVVIESSYGGPKVTKDGVTVAKSVEFKDRVKNVGASLVKQVANATNDAAGDGTTCATVLTRAIFTEGCKSVAAGMNAMDLRRGITMAVDAVVTSLKSRARMISTSEEIAQVGTISANGEREIGELIAKAMEKVGKEGVITIADGKTLDNELEVVEGMKLDRGYISPYFITNQKNQNVSWKTTNSYP

SEQ ID NO: 6228 - protein, 575 aa, Gossypium hirsutum
MYRHLTSLASKARLAKNRIQLNGTRLSWSRNYAAKDIKFGVEARALMLGGVQELADAVKVTMGPKGRNVVLEQSFGAPKVTKDGVTVAKSIEFKDRVKNIGASLVKQVANATNDVAGDGTTCATVLTRAIFVEGCKSVAAGMNAMDLRRGITMAVDAVVTNLKSRARMISTSEEIAQVGTISANGEREIGELIAKAMEKVGKEGVITIADGKTLYNELEVVEGMKLDRGYISPYFITNQKNQKCELENPLILIHEKKISNLPALVKFLELSLTKQRPLLIVAEDLESEALATLILNKLRAGIKVCAIKAPGFGENRKAGLQDLAALTGGEVITEELGLDIEKVGAEVLGSCKKVTVSKDDTIILDGAGDKATIEERCDQIRSAIESSTSDYDKDKLQERLAKLSGGVAVLKIGGASEAEVGEKKDRVTDALNATKAAVEEGIVPGGGAALLYASKELENLETANFDQKIGVQIIQNALKMPVHTIASNAGVEGAVVVGKLLEQDNPDLGYDAAKGEYVDMVKAGIIDPLKVIRTALVDAASVSSLMTTTEAIVTELPKDDKEGAATAGGMGGLDY

SEQ ID NO: 6229 - protein, 575 aa, Gossypium raimondii
MYRHLTSLASKARLAKNRIQLNGTRLSWSRNYAAKDIKFGVEARALMLSGVQELADAVKVTMGPKGRNVVLEQSFGAPKVTKDGVTVAKSIEFKDRVKNIGASLVKQVANATNDVAGDGTTCATVLTRAIFVEGCKSVAAGMNAMDLRRGITMAVDAVVTNLKSRARMISTSEEIAQVGTISANGEREIGELIAKAMEKVGKEGVITIADGKTLYNELEVVEGMKLDRGYISPYFITNQKNQKCELENPLILIHEKKISNLPALVKFLELSLTKQRPLLIVAEDLESEALATLILNKLRAGIKVCAIKAPGFGENRKAGLQDLAALTGGEVITEELGLDIEKVGAEVLGSCKKVTVSKDDTIILDGAGDKATIEERCDQIRSAIESSTSDYDKDKLQERLAKLSGGVAVLKIGGASEAEVGEKKDRVTDALNATKAAVEEGIVPGGGAALLYASKELENLETANFDQKIGVQIIQNALKMPVHTIASNAGVEGAVVVGKLLEQDNPDLGYDAAKGEYVDMVKAGIIDPLKVIRTALVDAASVSSLMTTTEAIVTELPKDDKEGAATAGGMGGLDY

SEQ ID NO: 6230 - protein, 207 aa, Allium cepa
KARSACISGKQVGSRLSWRRNYAAKDIRFGVDARALMLKGVEELADAVKVTMGPKGRNVVIEQSFGAPKVTKDGVTVAKSIEFKDRVKNMGASLVKQVANATNDSAGDGTTCATVLTKAMFSEGCKSVAAGMNAMDLRRGITMAVDSVVTNLKSRARMISTSEEIAQVGTISANGDREIGELIAKAMEKVGKEGVITIQDGKRYIMN

SEQ ID NO: 6231 - protein, 578 aa, Cephalotaxus harringtonia
MHRAASALVSRAGSRSSRSRLQSASRLGWSRNYAAKEIRFGSDARIAMLQGVEQLADAVKVTMGPKGRNVIIEQSFGAPKVTKDGVTVAKSIEFKDRVKNVGASLVKQVANATNDVAGDGTTCATVLTRAIFTEGCKSVAAGMNAMDLRRGINMAVDVVVTHLKSRARMISTSEEIAQVGTISSNGDREIGELLARAMEKVGKEGVITVADGKTLYNELEVVEGMKLDRGYISPYFITNQKTQKCEMENPLILIHEKKVSSLQAVVRVMELALERQRPLLIVAEDVESEALATLILNKLRAGVKVCAIKTPGFGENRKNNLQDLAALTGGQVISEDLGMKLDKVELGMLGSAKKVTVSKDDTIILDGGGDKKAIEERCEQIRSTIEASTSDYDKEKLQERLAKLSGGVAVLKIGGASELEVGEKKDRVTDALNATKAAVEEGILPGGGVALLYATKELDKIQTANFDQKIGVQIIQNALKSPVHIIASNAGVEGAVVVGKLLEQENLDYGYDAAKGEYVDMIKAGIIDPLKVIRTALVDAASVSSLLTTTEAVVVELPKDEKASPGMGGMPPMGGMDF

SEQ ID NO: 6232 - protein, 566 aa, Chrysanthemum coronarium
MYRLAASLASKSRIARNNAQQLRYYAAKDIHFGVGARALMLKGVEELADAVKVTMGPKGRNVVIEQSYGAPKVTKDGVTVAKSIEFKDRVKNVGASLVKQVANATNDAAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELDDPLILIHEKKISSLNAIVKVLELALKNQRSLLIVAEDIESEALATLILNKLRAGIKVCAIKAPGFGENRKSNLQDLATLTGGEVITDELGMNLEKMSPEMLGTCKRVTISKDDTVILDGAGDKKGIEERCEQLRSSIELSTSDYDKEKLQERLAKLSGGVAVLKIGGASEAEVGEKKDRVTDALNATKAAVEEGIVPGGGVALLYASKELDKLVTANFDQKIGVQIIQNALKSPVHTIASNAGVEGAVIVGKLLEQDNPDLGYDAAKGQYVDMVKEGIIDPLKVIRTALVDAASVSSLLTTTEAVIVESPKDEKESAAMSPGMGDY

SEQ ID NO: 6233 - protein, 563 aa, Avena sativa
MYRAAASLASKARQAGSGARQVGSRLAWSRNYAAKDIKFGVEARALMLRGVEELADAVKVTMGPKGRTVIIEQSFGAPKVTKDGVTVAKSIEFNNRVKNVGANLVKQVANATNDTAGDGTTCATVLTKAIFTEGCKSVAAGMNAMDLRRGISMAVDDVVTNLKGMAKMISTSEEIAQVGTISANGEREIGELIAKAMEKVGKEGVITIADGNTLYNELEVVEGMKLDRGYISPYFVTNPKTQKCELEDPLILIHDKKISNMHAVVKVLEMALKKQRPLLIVAEDLESEALGTLIINKLRAGIKVCAVKAPGFGENRKANLQDLAVLTGGEVISEEIGMNLENFDSQMLGTCKKVTVSKDDTVILDGAGDKKNIEERADQIRSAIEQSTSDYDKEKLQERLAKLSGGVAVLKIGGASEAEVSEKKDRVTDALNATKAAVEEGIVPGGGVALLYASKALDKLQTANFDQRIGVQIIQNALKTPVYTIASNAGVEGAVVVGKLLEQDNTELGYDAAKGEYVDMVKVGIIDPLKVIRTALVDAASVSSLMTTTEAIIVEIPKEEKEA

SEQ ID NO: 6234 - protein, 575 aa, Pinus taeda
MYRAAAALASRIGSRSSGYGQNFSRLGWRRNYAAKDIRFGVDARAAMLQGVEQLADAVKVTMGPKGRNVVIEQSYGAPKVTKDGVTVAKSIEFSDKLKNVGASLVKQVANATNDAAGDGTTCATILTRAIFTEGCKSVAAGMNAMDLRRGISMAIDAVVAHLKSRARMISTSEEIAQVGTISANGEREIGELIAKAMEKVGKEGVITIADGKTLYNELEVVEGMKLDRGYISPYFITNEKAQKCELENPLILIHEKKISNLNAVVRAMELALKKQRALLIVSEDVESDALATLILNKIRAGVKVCAIKAPGFGENRKANLDDLAVLTGGQMITEELGMKLEKVEADMFGSAKKVTVSKDDTIVLDGGGDKKAIEERCEQIRAAIEASTTDYDKDKYQERLAKLSGGVAVLKIGGASEAEVGEKKDRVTDALNATKAAVEEGIVPGGGVALLYATKELEKHQTANFDQKIGVQIIQNALKMPAYTIAANAGVEGAVVVGKLLEQDNLDLGYDAAKGEYVDMVKAGIIDPLKVIRTALVDAASVSSLLTTTECVVVEIPKDEKEGPAMGGGMGGMDY

SEQ ID NO: 6235 - protein, 548 aa, Plantago ovata
RNYAAKDIRFGVEARALMLKGVEELADAVKVTMGPKGRTVVIEQSWGAPKVTKDGVTVAKSIEFKDKVKNIGASLVKQVANATNDVAGDGTTCATVLTRAIFAEGCKSVAAGMNAMDLRRGITMAVDAVVTNLKSRARMISTSEEIAQVGTISANGEREIGELIAKAMEKVGKEGVITIQDGKTLYNELEVVEGMKLDRGYISPYFITNQKNQKCELDDALVLIHEKKITSLNAIVKVLELALKRQRPLLIVAEDVESEALATLILNKLRAGLKICAIKAPGFGENRKANLQDLAVLTGGQVITEELGMNLDDVDLDILGSCKKVTISKDDTVVLDGAGEKKSIEERCEQIRNGIELSTSDYDKEKLQERLAKLSGGVAVLKIGGASEAEVGEKKDRVTDALNATKAAVEEGIVPGGGVALLYASKELDKLPTANFDQKIGVQIIQNALKTPVYTIAANAGVEGAVVVGKLMESDNPDLGYDAAKDQYVDMVKAGIIDPLKVIRTALTDAASVSSLMTTTEAVVVEQPKDETAAPAPGMGGGMGGMDY

SEQ ID NO: 6236 - protein, 576 aa, Secale cereale
MYRAAASLASKARLAGSSARQVGSRLAWSRNYAAKDIRFGVEARALMLKGVEDLADAVKLTMGPKGRTVIIEQSFGAPKVTKDGVTVAKSIEFSDRVKNVGASLVKQVANATNDTAGDGTTCATVLTRAIFTEGCKSVAAGMNAMDLRRGISMAVDSVVANLKGMARMINTSEEIAQVGTISANGEREIGELIAKAMEKVGKEGVITIADGNTLYNELEVVEGMKLDRGYISPYFITNQKNQKCELDDPLILIHDKKVSNLRSLVKVLEFALQKQKPLLIVAEDLESEALGTLILNKLRGGFKVCAIKAPGFGENRKSNLQDLAILTGGEVITEELGMNLENFEPNMLGTCKKVTISKDDTVILDGAGDKKAIEERAELLRSSIEQCTSDYDKEKIQERLAKLSGGVAVLKIGGASEAEVGEKKDRVTDALNATKAAVEEGIVPGGGVALLYASKDLDKLPTANFDQKIGVQIIQNALKTPVHTIATNAGVEGAVIVGKLLEQDNTDLGYDAAKGEYVDMVKAGIIDPLKVIRTALVDAASVSSLMTTTEAIIVEIPKEDKAAPAMGGGGMGGMDF

SEQ ID NO: 6237 - protein, 539 aa, Vinca minor
KFGVEARALYVVRVVEDLAAAVQVTMGPKGRNVVIEQSWGAPKVTKDGVTVAKSIEFKDRVKNVGASLVKQVANATNDNAGDGTTCATILTRAIFAEGCKSVAAGMNAMDLRRGINSAVDSVVTHLKSRARMISTSEEIAQVGTISANGEREIGELIAKAMGKVGKEGVITIQDGKTLYNELEVVEGMKLDRGYISPYFITNQKTQKCELEDPLIVIYEKKISSINAIVKVLELALKRQRPLLIISEDVESDALATLILNKLRAGIKVCAVKAPGFGENRKASLHDLAALTGAQVITEELGLNLDNLELEMLGSCKKVTISKDDTVLLDGAGEKKALEERCEQIRSSIELSTSDYDKEKLQERLAKLSGGVAVLKIGGASEAEVGEKKDRVTDALNATKAAVEEGILPGGGVALLYASKELEKLSTANFDQKIGVQIIQNALKMPVHTIASNAGVEGAVVVGKLLEQDNPDLGYDAAKGEYVDMVKSGIIDPLKVIRTALVDAASVSSLLTTTEAVVVELPKDEKAAPAMGGGMGDMDY

SEQ ID NO: 6238 - protein, 576 aa, Triticum aestivum
MYRAAASLASKARLAGSSARQVGSRLAWSRNYAAKDIRFGVEARAMMLKGVEDLADAVKLTMGPKGRTVIIEQSFGAPKVTKDGVTVAKSIEFSDRVKNVGASLVKQVANATNDTAGDGTTCATVLTKAIFTEGCKSVAAGMNAMDLRRGISMAVDSVVTNLKGMARMINTSEEIAQVGTISANGEREIGELIAKAMEKVGKEGVITIADGNTLYNELEVVEGMKLDRGYISPYFITNQKNQKCELDDPLILIHDKKVSNLRSLVKVLEFALQKQRPLLIVAEDLESEALGTLILNKLRGGFKVCAIKAPGFGENRKSNLQDLAILTGGEVITEELGMNLENFEPNMLGTCKKVTISKDDTVILDGAGDKKAIEERAELLRSSIEQCTSDYDKEKIQERLAKLSGGVAVLKIGGASEAEVGEKKDRVTDALNATKAAVEEGIVPGGGVALLYASKDLDKLPTANFDQKIGVQIIQNALKTPVHTIATNAGVEGAVIVGKLLEQENTDLGYDAAKGEYVDMVKAGIIDPLKVIRTALVDAASVSSLMTTTEAIIVEIPKEDKAAPAMGGGGMGGMDF

SEQ ID NO: 6239 - protein, 432 aa, Artemisia annua
MYRFAVNLASKSRIATKTTQQIGSRLNISRNYAAKDIRFGVDARALMLRGVEELADAVKVTMGPKGRNVVIEQSYGAPKVTKDGVTVAKAIEFNDKVKNVGASLVKQVANATNDVAGDGTTCATVLTRAIFSEGCKSVAAGMNAMDLRRGITMAVDSVVTNLKSRARMISTSEEITQVGTISANGEREIGELIAKAMERVGKEGVITIQDGKTLYNELEVVEGMKLDRGYISPHFITNTKNQKCELDNPIVLIYEKKMSTVTSVDKVLDLALMHQRPLLIVAEDVESEALATIILDILRIGVKVCAIKAPGFGENRKANLQDLATLTGGQIITEELDINLDNVELEMLGLGSCKMVTVSKDDTVMLYGDGDMTSIEERCEQIRSAIESSTSDYDREKFQERLAKLSGGVAVIKIGGASDTEVSERKTGLLML

SEQ ID NO: 6240 - protein, 579 aa, Saccharum officinarum
KHRSGIPRSTARVRARQAGSSSAARQVGSRLAWSRKYAAKDSKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKSMARMISTSEEIAQVGTISANGEREIGELIAKAMEKVGKEGVITIADGNTLYNELEVVEGMKLDRGYISPYFITNSKTQKCELDDPLILIHDKKVTNMHAVVKVLEMALKKQKPLLIVAEDVESEALGTLIINKLRAGIKVCAVKAPGFGENRKANLQDLAILTGGEVITEELGMNLENVEPHMLGTCKKVTVSKDDTVILDGAGDKKSIEERAEHIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQGNTDLGYDAAKGEYVDMVKAGIIDPLKVIRTALVDAASVSSLMTTTESIIVEIPKEEAPAPAMGGMGGMDY

SEQ ID NO: 6241 - protein, 569 aa, Mimulus guttatus
MNADFWGKSHPCVWVGNSRLLWSRNYAAKEIRFGVEARARMLRGVEELADAVKVTMGPKGRNVVLEQSYGAPKVTKDGVTVAKSIEFKDKVMNVGASLVKQVANATNDVAGDGTTCATILTRAIYSEGCKSVAAGMNAMDLRRGINMAVDAVVNNLKSRARMISTSEEIAQVGTISANGEREIGELIAKAMEKVGKDGVITIADGKTLYNELEVVEGMKLDRGYISPYFITNQKNQKCEMEDALILIHEKKINNLNAMVKVLELAMKRQKPLLIVSEDVESEALATLILNKLRVGLKVCAIKAPGFGENRKAYLQDLAVITGGQVITSELGMDLENLTGEMLGSCKKVTVSKDDTVILDGAGDKKSIEERCEQLRSGIEVSTSEYDKEKLQERLAKLSGGVAVLKIGGASEVEVGEKKDRVTDALNATKAAVEEGIVPGGGVALLYASKELEKLQTANFDQKVGVQIIQNALKAPVHTIASNAGVEGSVVVGKLLEQDNPDLGYDAAKGEYVDMVKAGIIDPLKVIRTALVDAASVSSLLTTTEAVVVELPKDEKESPPTGPGMGGMGY

SEQ ID NO: 6242 - protein, 289 aa, Abies balsamea
LASRIGSRSSSYRKSASGLNWRRNYAAKDIRFGVDARAAMLQGVEHLADAVKVTMGPKGRNVVIEQSYGAPKVTKDGVTVAKSIEFSDKLKNVGASLVKQVANATNDVAGDGTTCATILTRAIFTEGCKSVAAGMNAMDLRRGISMAIDAVVTHLKSRTRMISTSEEIAQVGTISSNGEREIGELIAKAMEKVGKEGVITIADGKTLYNELEVVEGMKLDRGYISPYFITNEKTQKCELENPLILIHEKKISNLNAVVRAMELALKKQRALLIVSEDVESDALATLITK

SEQ ID NO: 6243 - protein, 428 aa, Artemisia annua
MYRLAASLASKSRIARNNAQQLRHYAAKDIHFGVGARALMLKGVEELADAVKVTMGPKGRNVVIEQSYGAPKVTKDGVTVAKSIEFKDRVKNVGASLVKQVANATNDAAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELDDPLILIHEKKISSLNSIVKVLELALKNQRSLLIVAEDIESEALATLILNKLRAGIKVCAIKAPGFGENRKSNLQDLATLTGGEVITDELGMNLEKMSPEMLGTCKRVTISKDDTVILDGAGDKKGIEERCEQLRSSIELSTSDYDKEKLQERLAKLSGGVAVLKIGGASEAEVGEKKDRVTDALNATS

SEQ ID NO: 6244 - protein, 331 aa, Podocarpus macrophillus
MYRAAAVIASRLGSRNSRSHLQSASRLGWSRNYAAKEIRFGSDARAAMLQGVEQLADAVKVTMGPKGRNVIIEQSYGAPKVTKDGVTVAKSIEFKDKVKNVGASLVKQVANATNDVAGDGTTCATVLTRAIFTEGCKSVAAGMNAMDLRRGINMAVDAVVIHLKSRARMISTSEEIAQVGTISSNGEREIGELIARAMEKVGKEGVITVADGKTLYNELEVVEGMKLDRGYISPYFITNQKTQKCELENPLILIYEKKISSLPAVVRVMELALERQRPLLIVAEDVESEALATLILNKLRAGVKVCAIKAPGFGENRKIICRTLLHSLVVR

SEQ ID NO: 6245 - protein, 551 aa, Chrysanthemum coronarium
GSRLNLSRNYAAKDIRFGVDARALMLRGVEELADAVKVTMGPKGRNVVIEQSYGAPKVTKDGVTVAKSIEFKDRVKNVGASLVKQVANATNDAAGDGTTCATVLTRAIYSEGCKSVAAGMNAMDLRRGITMAVDSVVTNLKSRARMISTSEEIAQVGTISANGEREIGELIAKAMEKVGKEGVITISDGKTLYNELEVVEGMKLDRGYISPYFITNTKNQKCELDDPLILIHEKKISSLNAIVKVLELALKNQRSLLIVVEDIESEALDTLILNKLRAGIKVYAIKAPGFGENRKSNLQDLATLTGGEVITDELGMNLEKMSPEMLGTCKRVTISKDDTVILDGAGDKKGIEERCEQLRSSIELSTSDYDKEKLQERLAKLSGGVAVLKIGGASEAEVGEKKDRVTDALNATKAAVEEGIVPGGGVALLYASKELDKLVTANFDQKIGVQIIQNALKSPVHTIASNAGVEGAVIVGKLLEQDNPDLGYDAAKGEYVDMVKEGIIDPLKVIRTALVDAASVSSLLTTTEAVIVESPKDEKESAAMNPGMGDY

SEQ ID NO: 6246 - protein, 575 aa, Avena sativa
MYRAAASLASKARQAGSSARQVGSRLAWSRNYAAKDIRFGVDARAQMLRGVEELADTVKLTMGPKGRTVIIEQSFGAPKVTKDGVTVAKSIEFSDRVKNVGASLVKQVANATNDTAGDGTTCATVLTRAIFTEGCKSVAAGMNAMDLRRGISMAVDSVVTNLKGMARMINTSEEIAQVGTISANGEREIGELIAKAMEKVGKEGVITIADGNTLYNELEVVEGMKLDRGYISPYFVTNQKTQKCELDDPLILIHDKKVSNLQALVKVLEYAHQKQKPVLIVAEDLESEALGMLILNKLRAGLKVCAVKAPGFGENRKSSLQDLAILTGGEVITEELGMNLEKFEPTMLGTCKKVTVSKDDTVILDGAGDKKAIEERAELLRSAIEQSTSDYDKEKIQERLAKLSGGIAVLKIGGASEAEVGEKKDRVTDALNATKAAVEEGIVPGGGVALLYASKDLDKLETANFDQKIGVQIIQNALKTPVHTIATNAGVEGAVIVGKLLEQDNIDLGYDAAKGEYVDMVKAGIIDPLKVIRTALVDAASVSSLMTTTEAIIVESPKEEKAAPAMGGGMGGMDF

SEQ ID NO: 6247 - protein, 508 aa, Pseudotsuga menziesii
MLLLNKVMVLPKVTKDGVTVAKSIEFSDKLKNIGASLVKQVANATNDAAGDGTTCATILTRAIFTEGCKSVAAGMNAMDLRRGITMAINAVVTHLKSRARMISTSEEIAQVGTISANGEREIGELIAKAMEKVGKEGVITIADGKTLYNELEVVEGMKLDRGYISPYFITSEKTQKCELENPLILIHEKKISNLNAVVRAMELALKKQRALLIVSEDVESDALATLILNKIRAGVKVCAIKAPGFGENRKSNLQDLAVLTGGQMITEELGMKLENVEADTFGTAKKVTVSKDDTIILDGGGDKKAIEERCEQIRAAIEASTTDYDKEKYKERLAKLSGGVAVLKIGGASEAEVGEKKDRVTDALNATKAAVEEGIVPGGGVALLYATKELEKLQTANFDQKIGVQIIQNALKMPAYTIAANAGVEGAVVVGKLLEQDNLDLGYDAAKGEYVDMVKAGIIDPLKVIRTALGDAASVSSLLTTTECVVAELPKDEKEGPGMGGGMGGMDY

SEQ ID NO: 6248 - protein, 576 aa, Pseudotsuga menziesii
MYRAAATVASSIGRRSSRIQNAGRFGWSRNYAAKEIRFGVDARSAMLQGIEQLADAVKVTMGPKGRNVIIEQSFGAPKVTKDGVTVAKSIEFKDRVKNVGASLVKQVANATNDVAGDGTTCATILTRAIFTEGCKSVAAGMNAMDLRRGISMAVDSVVTHLKSRARMISTSEEIAQVGTISANGEREIGELIAKAMEKVGKEGVITVADGKTLYNELDVVEGMKLDRGYISPYFITNQKTQKCELENPLILIHEKKISGLQAVVRVMELAVERQKSLLIVAEDVESEALATLILNKLRAGVKVCAVKAPGFGDNRKNNLQDLAALTGGQVITEDLGLKLEKVQIEMLGSAKKVTVSKDDSIILDGGGDKKGLEERCEQIRSSIEASTSDYDKEKLQERLARLSGGVAVLKIGGASELEVGEKKDRVTDALNATKAAVEEGILPGGGVALLYAARELDKLQSANFDQKIGVQIIQNALKTPVHTIASNAGVEGAVVVGKLLEQENFDYGYDAAKGEYVDMVKAGIIDPLKVIRTALVDAASVSSLLTTTEAVVVELPKDDKPSPAMGGMPPMGGMDF

SEQ ID NO: 6249 - protein, 557 aa, Citrullus lanatus
PNEGFQINSRLNSSRNYAAKDIKFGVEARTLMLRGVEELADAVKVTMGPKGRNVVLEQSFGGPKVTKDGVTVAKSIEFKDKVKNIGASLVKQVANATNDVAGDGTTCATVLTRAIFTEGCKSVASGVNAMDLRRGITMAVDSVITTLKSRVQMISTSEEIAQVGTISANGEREIGELIAKAMEKVGKDGVITISDGNTLDNELEIVEGMKLDRGYISPYFITNQKNQKCELEDPLILIHEKKISNLNAVVKVLELALKRQRPLLIVAEDVESEALATLILNKLRAGIKVCAIKAPGFGDNRKASMQDLAILTGGQVITEELGLALEKVSFESLGSCKKVTVSKDDTVILDGAGDKKAIEEQSEQLRSLIELSTSDYDKEKLQERLAKLSGGVAVLKIGGASEAEVGEKKDRVTDALNATKAAVEEGIVAGGGVALLYASKELEKLQTANFDQKIGVQIIQNALKMPIYTIASNAGIEGAVVIGKLLEQDNSDLGYDAAKGEYVDMIKAGIIDPLKVIRTALVDAASVSSLMTTTEAVVVEQPNDEKEATPSMGGMGY

SEQ ID NO: 6250 - protein, 576 aa, Festuca arundinacea
MYRAAASLASKARQAGTSARQVGSRLAWSRNYAAKDIRFGVEARAQMLRGVEELADAVKLTMGPKGRTVIIEQSFGAPKVTKDGVTVAKSIEFSDRVKNVGASLVKQVANATNDTAGDGTTCATVLTKAIFTEGCKSVAAGMNAMDLRRGISMAVDSGVTNLKGMARMINTSEEIAQVGTISANGEREIGELIAKAMEKVGKEGVITIADGNTLYNELEVVEGMKLDKGYISPYFITNQKTQKCELDDPIILIHDKKVSNLQALIKVLEYSHQKQKPLLIVAEDLESEALGMLILNKLRAGLKVCAVKAPGFGENRKSSLQDLAILTGGEVISEELGMNLEKFEPNMLGTCKKVTVSKDDTVILDGAGDKKAIEERAELLRSAIEQSTSDYDKEKIQERLAKLSGGIAVLKIGGASEAEVGEKKDRVTDALNATKAAVEEGIVPGGGVALLYASRNLDKLETANFDQKIGVQIIQNALKTPVHTIATNAGVEGAVIVGKLLEQENTDLGYDAAKGEYVDMVKAGIIDPLKVIRTALVDAASVSSLMTTTEAIIVESPKEEKAAPAMGGGGMGGMDF

SEQ ID NO: 6251 - protein, 576 aa, Festuca arundinacea
MYRAAASLASKARQAGTSARQVGSRLAWSRNYAAKDIRFGVEARAQMLRGVEELADAVKLTMGPKGRTVIIEQSFGAPKVTKDGVTVAKSIEFSDRVKNVGASLVKQVANATNDTAGDGTTCATVLTKAIFTEGCKSVAAGMNAMDLRRGISMAVDSVVTNLKGMARMINTSEEIAQVGTISANGEREIGELIAKAMEKVGKEGVITIADGNTLYNELEVVEGMKLDRGYISPYFITNQKTQKCELDDPIILIYDKKVSNLQALIKVLEYSHQKQKPLLIVAEDLESEALGMLILNKLRAGLKLCAVKAPGFGENRKSSLQDLAILTGGEVISEELGMNLEKFEPSMLGTCKKVTVSKDDTVILDGAGDKKAIEERAELLRSAIEQSTSDYDKEKIQERLAKLSGGIAVLKIGGASEAEVGEKKDRVTDALNATKAAVEEGIVPGGGVALLYASRNLDKLETANFDQKIGVQIIQNALKTPVHTIATNAGVEGAVIVGKLLEQDNTDLGYDAAKGEYVDMVKAGIIDPLKVIRTALVDAASVSSLMTTTEAIIVESPKEDKAAPAVGGGGMGGMDF

SEQ ID NO: 6252 - protein, 545 aa, Helianthus annuus
MRNYAAKDIKFGVDARALMLRGVEELADAVKVTMGPKGRNVVIEQSYGAPKVTKDGVTVAKSIEFKDRVKNVGASLVKQVANATNDVAGDGTTCATVLTKAIHSEGCKSVAAGMNAMDLRRGITMAVDSVVTNLKSRARMISTSEEIAQVGTISANGEREIGELIAKAMEKVGKEGVITISDGKTLINELEVVEGMKLDRGYISPYFITNTKNQKCELDDPLILIHEKKISSLNSIVKVLELALKNQRSLLIVAEDIESEALATLILNKLRAGIKVCAIKAPGFGESRKSNLQDLAILTGGEVITDELGMNLEKMSPDMLGTCKRVTISKDDTVILDGAGDKKAIEERCEQLRSSIELSTSDYDTEKLQERLAKLSGGVAVLKIGGASEAEVGEKKDRVTDALNATKAAVEEGIVPGGGVALLYASKELEKLQTANFDQKIGVQIIQNALKAPVHTIASNAGVEGAVVVGKLLEQDNPDIGYDAAKGQYVDMVKEGIIDPLKVIRTALVDAASVSSLLTTTEAVIVELPKDEKESPAMSPGMGDY

SEQ ID NO: 6253 - protein, 182 aa, Secale cereale
MSGVWVFRNGVVKLVENHPASAAGPQGGGAVRRKALLHTPTGEWSPHTPRWSASSSRSAGSATTPAGAAPPATACSGSTSAPPSTSSPSPRTSASSAPSTCTTSSSRTATPSASSTSSPEDSAIRSKKARLARARRRPPPSHPCRHRFPLVNLPTLCMCVYVSMCVRTLYVYTCVCICTTYI

SEQ ID NO: 6254 - protein, 115 aa, Lolium multiflorum
MSGVWVFRNGVVKLVENPASAAAAAGGVVRRKALLHTPTGEVVASYASLERKLTALGWERYYAGGGGAAGDCMLRFHKRSSVDLISLPKDFGHFSSVHMYDVVIKNRDAFRVIDV

SEQ ID NO: 6255 - protein, 119 aa, Brachypodium distachyon
MSGVWVFRNGVVKLVENPSSASAAPGGGVVRRKALLHTPTGEVVSSYASLERRLLGLGWERYYGGGSSGHGADGGGMLRFHKRSSVDLISVPKDFAHFSSVHMYDVVIKNRESFRVIDV

SEQ ID NO: 6256 - protein, 115 aa, Brachypodium distachyon
MSGVWVFRNGVVRLVENPASAVTGGTGGGGGGRRKALLHTPTGEVVASYASLERKLLGLGWERYYGGGDDGKMLQFHKRSSVDLISLPKDFGKFNSMQMYDVVVKNRDAFRVIDV

SEQ ID NO: 6257 - protein, 138 aa, Avena sativa
MSGVWVFRNGVVKLVENHPASAATAAPPPPPPPPPPPPPPPPPPPPGPSGARPCCTRPRGRWSPPTRRWSASCSRSAGSATTPAAVGRPATACSGSTSAPPSTSSPSPRTSPTSAPSTCTTSSSRTATPSASSTSRLA

SEQ ID NO: 6258 - protein, 340 aa, Secale cereale
MELFAHAKAVRLKSRHDKFLYADEDELHVTQDRNGSSPSARWTVEPVPHAPGAVRLRSRYGRYLAASTEPFLLGMTGRKVLQAAAAPGGRPDASVEWEPVRDGFQVRFKSRAGGVRGGGDKYLRANGGVPPWRNSVTHDVPHRTATQDWVLWDVEIVQVLTPGPATPAPEKAVSAPPAALAPDSPPAPKLRPAPTPYEAHHRPTKSQTSPPPPDYAPPPPPKPKPEPRLSKLESSDSFSAPLHKVQGRAIHYHIADDKGDVDDDIERRSFTFNGSNLEELTQKLQEETGIDDLIVCTRSPISGKLTPLLLQLPPNNAAMHIVLVRESSKVAKTFPWPYGS

SEQ ID NO: 6259 - protein, 343 aa, Brachypodium distachyon
MELFAHAKAVRLKSRHDKFLYADEDELHVTQDRNGSSPNARWAVEHAAPGCVRLRSRYGRYLAASSEPFLLGMTGRKVLQAAAPAPGAGARPDASVEWEPVRDGFQARLKTRQGGNYLRANGGLPPWRNSVTHDVPHRTATQDWVLWDVEIVQVLTPGPAEHAASAPAAVLAPESPPAPKLRPPPTPHEAHHRPTKSYAAATPPPEYAPPPPPPKRAEHAAPPPPARPDPRLSKLESSNSFSAPLHKVEGRAIHYLIADDKGNVDDDVERHSFTFNGSNLEELTHKLQEETGLDDLIICTRSPINGKLTPLLLQLPPNNAAMHIVLVRESSKVAKTFPWPYGS

SEQ ID NO: 6260 - protein, 627 aa, Secale cereale
MASSPAKPYCCSSLNPAPSTPLARRAALSALPAAKPCRFSYGLAAVAANPRASRSAVLRPVHACLAPPRRPEYVPDRIDDPNYVRIFDTTLRDGEQSPGATMTSAEKLVVARQLARLGVDIIEAGFPASSPDDLDAVRSIAIEVGNTPVGEDGHVPVICGLSRCNKRDIDAAWEAVRHARKPRIHTFIATSEIHMQHKLRKTPDQVVAIAREMVAYARSLGCPDVEFSPEDAGRSNREFLYHILEEVIKAGATTLNIPDTVGYTLPHEFGKLIADIKANTPGIENAIISTHCQNDLGLASANTLAGAYAGARQLEVTINGIGERAGNASLEEVVMAIKCRRELLGGLYTGINSQHITMTSKMVQEHSGLHVQPHKAIVGANAFAHESGIHQDGMLKFKGTYEIISPDDIGLTRANEFGIVLGKLSGRHAVRTKLVELGYEINDKEFEDFFKRYKEVAEKKKRVTDEDIEALLSDEIFQPKVIWSLGDVQATCGTLGLSTATVKLITIDGEEKIGCSVGTGPVDAAYKAVDQIIQIPTVLREYSMTSVTEGIDAIATTRVVISGDVSADKPALTSNSNRSFSGSGAAMDVVVSSVRAYLSALNKMSSYVGAVKASSEAPETTSVQSTA

SEQ ID NO: 6261 - protein, 606 aa, Triticum aestivum
IARRAALSALPAAKPRRFSHGLAAVAANPRASRSAVLRPVRACLAAPRRPEYVPDRIDDPNYVRIFDTTLRDGEQSPGATMTSAEKLVVARQLARLGVDIIEAGFPASSPDDLDAVRSIAIEVGNTPVGEDGHVPVICGLSRCNKRDIDAAWEAVRHARKPRIHTFIATSEIHMQHKLRKTPDQVVAIAREMVAYARSLGCPDVEFSPEDAGRSNREFLYHILEEVIKAGATTLNIPDTVGYTLPHEFGKLIADIKANTPGIENAIISTHCQNDLGLASANTLAGAYAGARQLEVTINGIGERAGNASLEEVVMAIKCRRELLGGLHTGINSQHITMTSKMVQEHSGLHVQPHKAIVGANAFAHESGIHQDGMLKFKGTYEIISPDDIGLTRANEFGIVLGKLSGRHAVRTKLVELGYEINDKEFEDFFKRYKEVAEKKKRVTDEDIEALLSDEIFQPKVIWSLGDVQATCGTLGLSTATVKLITIDGEEKIGCSVGTGPVDAAYKAVDQIIQIPTVLREYSMTSVTEGIDAIATTRVVIAGDVSADKPALTSNSNRSFSGSGAAMDVVVSSVRAYLSALNKMSSYVGAVKASSEAPETISVQTTE

SEQ ID NO: 6262 - protein, 633 aa, Brachypodium distachyon
MAASPAKPCCFSSLNPASSTPLARRSRTLSSSAAAAKPHRFSHGLAAAAVAANPRAAALRRPVRACLAAGAAPRRPEYVPDRIDDPNYVRIFDTTLRDGEQSPGATMTSAEKLVVARQLARLGVDIIEAGFPASSPDDLDAVRSIAIEVGNTPLGGDGHVPVICGLSRCNKRDIDAAWEAVRHARKPRIHTFIATSEIHMQHKLRKTPEQVVAIAREMVAYARSLGCPDVEFSPEDAGRSNREFLYHILEEVIKAGATTLNIPDTVGYNLPHEFGKLIADIKANTPGIENAIISTHCQNDLGLASANTLAGAYAGARQLEVTINGIGERAGNASLEEVVMAIKCRRELLGGLYTGISTQHITMSSKMVQEHSGLHVQPHKAIVGANAFAHESGIHQDGMLKHKGTYEIISPEDIGLVRVNEFGIVLGKLSGRHAVKTKLVELGYEISDKEFEDFFKRYKEVAEKKKRVTDEDIEALLSDEIFQPKVIWSLGDVQATCGTLGLSTATVKLIAIDGEEKIGCSVGTGPVDAAYKAVDQIIQIPTVLREYSMTSVTEGIDAIATTRVVITGDVSNSKNALIGQNNRSFSGSGAALDVVVSSVRAYLSALNKMSSYVGAVKASSEAPESIRTVQTAE

SEQ ID NO: 6263 - protein, 635 aa, Oryza sativa
MASSLLSSPKPSSFSSANPTSTPRPRAQTLSPFRAAAPRFSHGLATAAAAANPSASRRCYHRAFARPVRASMAQPRRPEYVPNRIDDPNYVRIFDTTLRDGEQSPGATMTSAEKLVVARQLARLGVDIIEAGFPASSPDDLDAVRSIAIEVGNTPVGEDGHVPVICGLSRCNKRDIDAAWEAVRHARRPRIHTFIATSEIHMQHKLRKTPEQVVAIAKEMVAYARSLGCPDVEFSPEDAGRSNREFLYHILEEVIKAGATTLNIPDTVGYTLPYEFGKLIADIKANTPGIENAIISTHCQNDLGLATANTLAGAHAGARQLEVTINGIGERAGNASLEEVVMAIKCRRELLGGLYTGINTQHITMSSKMVQEHSGLHVQPHKAIVGANAFAHESGIHQDGMLKYKGTYEIISPDDIGLTRANEFGIVLGKLSGRHAVRSKLVELGYEITDKEFEDFFKRYKEVAEKKKRVTDEDIEALLSDEIFQPKVFWSLADVQATCGTLGLSTATVKLIGPDGDEKIACAVGTGPVDAAYKAVDDIIQIPTVLREYSMTSVTEGIDAIATTRVVVTGDVSDSKHALTGHSFNRAFSGSGAALDIVVSSVRAYLSALNKMSSFVGAIKASSEVSESQRVQTTE

SEQ ID NO: 6264 - protein, 635 aa, Oryza sativa
MASSLLSSPKPSSFSSANPTSTPRPRAQTLSPFRAAAPRFSHGLATAAAAANPSASRRCYHRAFARPVRASMAQPRRPEYVPNRIDDPNYVRIFDTTLRDGEQSPGATMTSAEKLVVARQLARLGVDIIEAGFPASSPDDLDAVRSIAIEVGNTPVGEDGHVPVICGLSRCNKRDIDAAWEAVRHARRPRIHTFIATSEIHMQHKLRKTPEQVVAIAKEMVAYARSLGCPDVEFSPEDAGRSNREFLYHILKEVIKAGATTLNIPDTVGYTLPYEFGKLIADIKANTPGIENAIISTHCQNDLGLATANTLAGAHAGARQLEVTINGIGERAGNASLEEVVMAIKCRRELLGGLYTGINTQHITMSSKMVQEHSGLHVQPHKAIVGANAFAHESGIHQDGMLKYKGTYEIISPDDIGLTRANEFGIVLGKLSGRHAVRSKLVELGYEITDKEFEDFFKRYKEVAEKKKRVTDEDIEALLSDEIFQPKVFWSLADVQATCGTLGLSTATVKLIGPDGEEKIACAVGTGPVDAAYKAVDDIIQIPTVLREYSMTSVTEGIDAIATTRVVVTGDVSDSKHALTGHSFSRAFSGSGAALDIVVSSVRAYLSALNKMSSFVGAIKASSEVSESQRVQTTE

SEQ ID NO: 6265 - protein, 585 aa, Lolium multiflorum
MASAPAKPYCCSSLNPAASAPLPRRAALSPFPFPAAKPRRLSHGLAAAANPRHPRAAVRACLAAAPRRPEYVPDRIDDPNYVRIFDTTLRDGEQSPGATMTSAEKLVVARQLARLGVDIIEAGFPASSPDDLDAVRSIAIEVGNTPVGDDGHVPVICGLSRCNKRDIDAAWEAVRHARKPRIHTFIATSEIHMQHKLRKTPEQVVAIAKEMVAYARSLGCPDVEFSPEDAGRSNREFLYHILEEVIKAGATTLNIPDTVGYTLPHEFGKLIADIKANTPGIENAIISTHCQNDLGLASANTLAGADAGARQLEVTINGIGERAGNASLEEVVMAIKCRRELLDGLYTGINSQHITMTSKMVQEHSGLHVQPHKAIVGANAFAHESGIHQDGMLKFKGTYEIISPDDIGLTRANEFGIVLGKLSGRHAVRTKLVELGYEINDKEFEDFFKRYKEVAEKKKRVTDEDIEALLSDEIFQPKVIWSLGDVQATCGTLGLSTATVKLIGLDGEEKIGCSVGTGPVDAAYKAIDQIIQIPTVLKEYGMTSVTEGIDAIATTRVLITRDVTGDEHSASGYSSRSFSGSGAAM

SEQ ID NO: 6266 - protein, 316 aa, Avena sativa
RAAVRACLAAPRRPEYVPHRIDDPNYVRIFDTTLRDGEQSPGATMTSTEKLVVARQLARLGVDIIEAGFPASSPDDLDAVRSIAIEVGNTPVGEEGHVPVICGLSRCNKRDIDAAWEAVRHARKPRIHTFIATSEIHMQHKLRKTPEQVVAIAKEMVAYARSLGCPDVEFSPEDAGRSNREFLYHILEEVIQAGATTLNIPDTVGYTLPHEFGKLIADIKANTPGIENAIISTHCQNDLGLASANTLAGAYAGARQLEVTINGIGERAGNASLEEVVMAIKCRRELLDGLYTELIPTYYYVEQNGTRAQWTYCAAA

SEQ ID NO: 6267 - protein, 431 aa, Saccharum officinarum
MAFSAKPYGSTTTTHLSPSPSLSLSVRAAAAPRAPRSAHGLSAAAAAGKATPSIVRLRAFAQRIRASQQQRRRPEYVPNRIDDPNYVRIFDTTLRDGEQSPGATMTSAEKLVVARQLARLGVDIIEAGFPASSPDDLDAVRSIAIEVGNPPAGADHVPVICGLSRCNRRDIDAAWEAVRHARRPRIHTFIATSEIHMQHKLRKTPEQVVAIAKEMVAYARSLGCPDVEFSPEDAGRSNREFLYHILEEVIKAGATTLNIPDTVGYTLPYEFGKLIADIKANTPGIENAIISTHCQNDLGLATANTLAGARAGARQLEVTINGIGERAGNASLEEVVMAIKCRGELLDGLYTGINSQHITLTSKMVQEHSGLHVQPHKAIVGANAFAHESGIHQDGMLKYKGTYEIISPDDIGLTRSNEFGMFLGNLVEGMQ

SEQ ID NO: 6268 - protein, 631 aa, Setaria italica
MASAAKPFCSTSQTPTPIANRFPSQSPSLSSRAAPRFAHGLSAAAVRASPGARRRLGALARPIRASSQQQQQPPRRPEYVPGRIDDPNYVRIFDTTLRDGEQSPGATMTSAEKLVVARQLARLGVDIIEAGFPASSPDDLDAVRSIAIEVGNTPVGEDGHVPVICGLSRCNRKDIDAAWEAVRHARRPRIHTFIATSEIHMQHKLRKTPEQVVAIAREMVAYARSLGCPDVEFSPEDAGRSNREFLYHILEEVIKAGATTLNIPDTVGYTLPYEFGNLIADIKANTPGIENAIISTHCQNDLGLATANTLAGARAGARQLEVTINGIGERAGNASLEEVVMAIKCRGELLNGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKKRVTDEDIEALLSDQIFQPKVIWSLADVQATCGTLGLSTATVKLIAPDGEEKIACCVGTGPVDAAYKAVDEIIQIPTVLREYGMTSVTEGIDAIATTRVIITGDLSNNSKHALTGHSFNRSFSGSGASMDVVVSSVRAYLSALNKMCSFAGVVKASSEVPESTSV

SEQ ID NO: 6269 - protein, 761 aa, Sorghum bicolor
YTGVLCCGTLGQVECTTARVGCGGARARVQAAHDHGTAPHRSRVLAAAAAVLVSCHSQQLAPTTSDPCRLRNHHPSGSSRIYTSQLVIPLLAAAFSKSTHIFHIHRRFNTVPRRRRPPVRPLLNPATTLSEPEPSPRRPTTMAFTAKPYCSTTTKPPTLSARAPRSAHGLSAAAAATPSTVRLRAFAQRIRAQSQQQQQRRRRPEYVPHRIDDPNYVRIFDTTLRDGEQSPGATMTSAEKLVVARQLARLGVDIIEAGFPASSPDDLDAVRSIAIEVGNPVEEGAHVPVICGLSRCNKRDIDAAWEAVRNARRPRIHTFIATSEIHMQHKLRKTPEQVVAIAKEMVAYARSLGCPDVEFSPEDAGRSNREFLYHILEEVIKAGATTLNIPDTVGYTLPYEFGKLIADIKANTPGIENAIISTHCQNDLGLATANTLAGARAGARQLEVTINGIGERAGNASLEEVVMAIKCRGELLDGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKKRVTDEDIEALLSDEIFQPKVIWSLADVQATCGTLGLSTATVKLIAPDGEEKIGCSVGTGPVDAAYKAVDQIIQIPTVLREYGMTSVTEGIDAIATTRVVVTGDVTNNSKHALTGQSFNRSFSGSGAAMDIVVSSVRAYLSALNKMCSFAGAAKASSEVPESASVQRTE

SEQ ID NO: 6270 - protein, 635 aa, Setaria italica
MAASAKPFCSTTQQPPTPIANRLPSPSQPPALSSRAAPRFAHGLSAAAGVRASPSARRLRALARPIRASSQHQQQQQLPRRRPEYVPSRIDDPNYVRIFDTTLRDGEQSPGATMTSAEKLVVARQLARLGVDIIEAGFPASSPDDLDAVRSIAIEVGNTPVGEEGHVPVICGLSRCNRKDIDAAWEAVRHARRPRIHTFIATSEIHMQHKLRKTPEQVVAIAREMVAYARSLGCPDVEFSPEDAGRSNREFLYHILEEVIKAGATTLNIPDTVGYTLPYEFGNLIADIKANTPGIENAIISTHCQNDLGLATANTLAGARAGARQLEVTINGIGERAGNASLEEVVMAIKCRGELLDGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKKRVTDEDIEALLSDEIFQPKVIWSLAAVQATCGTLGLSTATVKLIAPDGEEKIACCVGTGPVDAAYKAVDEIIQIPTVLREYGMTSVTEGIDAIATTRVVITGDVSSNSKHALTSLNRSFSGSGASMDVVVSSVRAYLSALNKMCSFAGAVKASSEVPESTSV

SEQ ID NO: 6271 - protein, 564 aa, Avena sativa
SLAAPRRPEYVPNRIDDPNYVRIFDTTLRDGEQSPGATMTSTEKLVVARQLARLGVDIIEAGFPASSPDDLDAVRSIAIEVGNTPVGEEGHVPVICGLSRCNKRDIDAAWEAVRHARKPRIHTFIATSEIHMQHKLRKTPEQVVAIAKEMVAYARSLGCPDVEFSPEDAGRSNREFLYHILEEVIQAGATTLNIPDTVGYTLPHEFGKLIADIKANTPGIENAIISTHCQNDLGLASANTLAGAYAGARQLEVTINGIGERAGNASLEEVVMAIKCRRELLDGLYTGINTQHITMSSKMVQEHSGLIVQPHKAIVGANAFAHESGIHQDGMLKFKGTYEIISPDDIGLTRSNEFGIVLGKLSGRHAVRTKLVELGYEINDKEFEDFFKRYKEVAEKKKRVTDEDIEALLSDEIFQPKVIWSLGDVQATCGTLGLSTATVKLIALDGEEKIGCSVGTGPVDAAYKAVDQIIQIPTILREYSMTSVTEGIDAIATTRVLITRDVSGDEHTTPGYSNRSFSGSGAAMDVVVSSVRAYLSALNKMSSFIGAINASNEAPETISVQSSE

SEQ ID NO: 6272 - protein, 645 aa, Panicum virgatum
MASSTLSSPAKPCYSAAKTPAPIGNRLPTQNPATTTLPSRAAAPRFAHGLSAAAVRASPSARRLRALARPVRASQQQPQPPPPRRRPEYVPNRIDDPNYVRIFDTTLRDGEQSPGATMTSAEKLVVARQLARLGVDIIEAGFPASSPDDLDAVRSIAIEVGNAPLGEDGHVPVICGLSRCNRKDIDAAWEAVRHARRPRIHTFIATSEIHMQHKLRKTPEQVVAIASEMVAYARSLGCPDVEFSPEDAGRSNREFLYHILEEVIKAGATTLNIPDTVGYTLPYEFGNLIADIKANTPGIENAIISTHCQNDLGLATANTLAGARAGARQLEVTINGIGERAGNASLEEVVMAIKCRGELLDGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKKRVTDEDIEALLSDEIFQPKVIWSLADVQATCGTLGLSTATVKLIGPDGEEKIACSVGTGPVDAAYKAVDQIIQIPTVLREYGMTSVTEGIDAIATTRVVVTGDVTNNSKHALTGHSFNRSFSGSGASMDVVVSSVRAYLSALNKMCSFAGAVKASSEVSESTRVQSKE

SEQ ID NO: 6273 - protein, 645 aa, Panicum virgatum
MALFPILSSSAKPCYSATKTPTPIANRLPPPPPSPTTTLPSRAAASRFAHGLYAAAVRASPGARRLRALARPVRASQQHHQQQPRRRPEYVPNRIDDPNYVRIFDTTLRDGEQSPGATMTSAEKLVVARQLARLGVDIIEAGFPASSPDDLDAVRSIAIEVGNAPVGEDGHVPVICGLSRCNKKDIDAAWEAVRHARRPRIHTFIATSEIHMQHKLRKTPEQVVAIAREMVAYARSLGCSDVEFSPEDAGRSNREFLYHILGEVIKAGATTLNIPDTVGYNLPYEFGNLIADIKANTPGIENAIISTHCQNDLGLATANTLAGARAGARQLEVTINGIGERAGNASLEEVVMAIKCRPELLDGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKKRVTDEDIEALLSDEIFQPKVIWSLADVQATCGTLGLSTATVKLIGPDGEEKIACSVGTGPVDAAYKAVDQIIQIPTVLREYGMTSVTEGIDAIATTRVVVTGDVSNNSKHALTGHSFNRSFSGSGASMDVVVSSVRAYLSALNKMCSFAGAVKATAVSESTRVQSKE

SEQ ID NO: 6274 - protein, 641 aa, Zea mays
MAFNAKPYCSTTAKPPTPAAHRSPSGPSPCISVRAAAVSPRARHSAYGLSAAGNASSSTVRLRALAQRTRAQPQPPRRRPEYVPNRIDDPNYVRIFDTTLRDGEQSPGATMTSAEKLVVARQLARLGVDVIEAGFPASSPDDLDAVRSIAIEVGNPPPGDDGGAHVPVICGLSRCNRRDIDAAWEAVRHARRPRIHTFIATSEIHMQHKLRKTPDQVVAVAREMVAYARSLGCADVEFSPEDAGRSNREFLYHILEEVIKAGATTLNIPDTVGYTLPYEFGKLISDIKENTPGIENAIISTHCQNDLGLATANTLAGAHAGARQLEVTINGIGERAGNASLEEVVMAIKCRGELLDGLYTGINSQHITLTSKMVQEHSGLHVQPHKAIVGANAFAHESGIHQDGMLKYKGTYEIISPDDIGLARANEFGIVLGKLSGRHAVRSKLVELGYEISDKEFEDFFKRYKEVAEKKKRVTDEDIEALLSDEIFQPKVIWSLADVQATCGTLGLSTATVKLIGPDGEERIACSVGTGPVDAAYKAVDQIIQIPTVLREYGMTSVTEGIDAIATTRVVVTGDVANNSKHALTGHSFNRSFSGSGAAMDIVVSSVRAYLSALNKMCSFAGAARASSTEVPGSASVQRAE

SEQ ID NO: 6275 - protein, 640 aa, Zea mays
MAFSAKPHCSCSTTTKPPTPVAHLSPPPSLSVRAAACAPRSAYGLSAAGVGGGKASPSTVRLRARAQRIRASQQQPRRRPEYVPNRIDDPNYVRIFDTTLRDGEQSPGATMTSAEKLVVARQLARLGVDIIEAGFPASSPDDLDAVRSIAIEVGNPPTAGAGTAHVPVICGLSRCNRKDIDAAWEAVRHARRPRIHTFIATSEIHMQHKLRKTPEQVVAIAREMVAYARSLGCPDVEFSPEDAGRSNREFLYHILEEVIKAGATTLNIPDTVGYTLPYEFGKLIADIKANTSGIENAIISTHCQNDLGLATANTLAGARSGARQLEVTINGIGERAGNASLEEVVMAIKCRGELLDGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKKRVTDEDIEALLSDEIFQPKVIWSLADVQATCGTLGLSTATVKLIAPDGEERIACSVGTGPVDAAYKAIDQIIQIPTVLREYGMTSVTEGIDAIATTRVVVTGDVTNNSKHALTGRAFNRSFSGSGAAMDIVVSSVRAYLSALNKMCSFAGAAKASGEVPESASVQSAE

SEQ ID NO: 6276 - protein, 592 aa, Panicum virgatum
PLRRRRQSRAPSARRLRALAYPVRASQQQPPRRRPEYVPNRIDDPNYVRIFDTTLRDGEQSPGATMTSAEKLVVARQLARLGVDIIEAGFPASSPDDLDAVRSIAIEVGNAPVGEDGHVPVICGLSRCNKKDIDAAWEAVRHARRPRIHTFIATSEIHMQHKLRKTPEQVVAIAREMVAYARSLGCSDVEFSPEDAGRSNREFLYHILGEVIKAGATTLNIPDTVGYNLPYEFGNLIADIKANTPGIENAIISTHCQNDLGLATANTLAGARAGARQLEVTINGIGERAGNASLEEVVMAIKCRPELLDGLYTGINSQHITLTSKMVQEHSGLHVQPHKAIVGANAFAHESGIHQDGMLKYKGTYEIISPDDIGLTRANEFGIVLGKLSGRHAVRSKLVELGYEISDKEFEDFFKRYKEVAEKKKRVTDEDIEALLSDEIFQPKVIWSLADVQATCGTLGLSTATVKLIGPDGEEKIACSVGTGPVDAAYKAVDQIIQIPTVLREYGMTSVTEGIDAIATTRVVVTGDVSNNSKHALTGHSFNRSFSGSGASMDVVVSSVRAYLSALNKMCSFAGAVKATAVSESTRVQSKE

SEQ ID NO: 6277 - protein, 86 aa, Echinochloa colona
MTSVTEGIDAIATTRVVITGDVTTNSKHALTGRSFNRSFSGSGADMDVVVSSVRAYLSALNKMCSFAGAVKASSEVPESASVQSKE

SEQ ID NO: 6278 - protein, 626 aa, Zea mays
MASSLLSSPAKPTITTTTKTTPAPRPARSAHVHVLSAARCLRLRLRASSQHPPPPPTPRSRRPDYVPNRIDDPNYVRIFDTTLRDGEQSPGATMTSAQKLVVARQLARLGVDIIEAGFPASSPDDLDAVRSIAIEVGNPAPGPAGEEDAVHVPVICGLSRCNRKDIDAAWEAVRHARRPRIHTFIATSDIHMQHKLRKTPDQVVAIAREMVAYARSLGCTDVEFSPEDAGRSNREFLYHILGEVIKAGATTLNIPDTVGYNLPYEFGKLIADIKANTPGIEKAIISTHCQNDLGLATANTLAGARAGARQLEVTINGIGERAGNASLEEVVMAIKCRRELLDGLYTGIDSRHITLTSKMVQEHSGLHVQPHKAIVGANAFAHESGIHQDGMLKYKGTYEIISPDDIGLTRANEFGIVLGKLSGRHAVRSKLVELGYEIGDKEFEDFFKRYKEVAEKKKRVTDEDLEALLSDEIFQPKVIWSLADVQATCGTLALSTATVKLVAPDGEEKIACSVGTGPVDAAYKAVDKIIQIPTVLREYSMTSVTEGIDAIATTRVVVTGDVSNNAKHALTGQSFNRSFSGSGASMDIVVSSVRAYLSALNKICSFAGAVKASSDVAETASVPSTE

SEQ ID NO: 6279 - protein, 633 aa, Sorghum bicolor
MASSLLSSPAKPFCSTTKTTPAPKATRFPSPRFLSSAHVLSAARRLRAVSARASQQQPPPPRGQQQRRPEYVPNRIDDPNYVRIFDTTLRDGEQSPGATMTSAQKLVVARQLARLGVDIIEAGFPASSPDDLDAVRSIAIEVGNPAPAGDDGGADATHVPVICGLSRCNRKDIDAAWEAVRHARLPRIHTFIATSDIHMQHKLRKTPEQVAAIARDMVAYARSLGCTDVEFSPEDAGRSNREFLYHILGEVIKAGATTLNIPDTVGYNLPYEFGKLIADIKANTPGIENAIISTHCQNDLGLATANTLAGARAGARQLEVTINGIGERAGNASLEEVVMAIKCRRELLNGLYTGIDSRHITLTSKMVQEHSGLIVQPHKAIVGANAFAHESGIHQDGMLKNKGTYEIISPDDIGLTRANEFGIVLGKLSGRHAVRSKLVELGYEIGDKEFEDFFKRYKEVAEKKKRVTDEDLEALLSDEIFQPKLIWSLADVQATCGTLSLSTATVKLIGPDGEERIACSVGTGPVDAAYKAVDQIIQIPTVLREYSMTSVTEGIDAIATTRVVVTGDVSINAKHALTGRSFNRSFSGSGASMDIVVSSVRAYLSALNKICSFAGAVKASSEVPEIASVPSTE

SEQ ID NO: 6280 - protein, 557 aa, Echinochloa colona
YVPNRIDDPNYVRIFDTTLRDGEQSPGATMTSAEKLVVARQLARLGVDIIEAGFPASSPDDLDAVRSIAIEVGNTPVGEDGHVPVICGLSRCNKRDIDAAWEAVKHARRPRIHTFIATSEIHMQHKLRKTPEQVVAIAKEMVAYARSLGCPDVEFSPEDAGRSNREFLYHILEEVIKAGATTLNIPDTVGYTLPYEFGNLIADIKANTPGIENAIISTHCQNDLGLATANTLAGARAGARQLEVTINGIGERAGNASLEEVVMAIKCRGELLHGLYTGINTQHITLSSKMVQEHSGLYVQPHKAIVGANAFAHESGIHQDGMLKYKGTYEIISPEDIGLTRANEFGIVLGKLSGRHAVRSKLVELGYEISDKEFEDFFKRYKEVAEKKKRVTDEDIEALLSDEIFQPKVIWSLAAVQATCGTLGLSTATVKLIAPGGEEKIACCMGTGPVDAAYKAVDEIIQIPTVLREYGMTSVTEGIDAIATTRVVITGDVTTNSKHALTGRSFNRSFSGSGADMDVVVSSVRAYLSALNKMCSFAGAVKTSSEVPESASVQSKE

SEQ ID NO: 6281 - protein, 197 aa, Secale cereale
AFNLLLCGGKGAKPPHATSSNGYQVPKEEEALRPQPLYRRQEAQTPETRRGARHGGQEAESEEAEGGQGGLCEEAEGAEGGQGGLCQEAEEAEGEQRDRRDLRGHQEAQAAAGGGGGGVRGDKKPKKGKAEGASKRRARRRLGAKAGSPARMTRSRRSGRGGAPNDGLTIYSADELGFGKADAGGTALCPFDCDCCF

SEQ ID NO: 6282 - protein, 175 aa, Secale cereale
MATRSQKKKTLSAPNPSIDAKKPKPQKPVEERETAAAAVAAKKPKPKKQKEGSAKKPKEQKEGSAKKPKKQKESNEIDEIFEATKKRKLQQQEEEESEGDKKPKKGKAEGASKKKSKKETGGKAWEPGHDDEVEEKRPRRRTNDGLTIYSADELGFGKADAGGTALCPFDCDCCF

SEQ ID NO: 6283 - protein, 192 aa, Triticum aestivum
MATKSQKKKLSAPNPSIDAKAPSPKQKPTPQKPAEEPETAAAAAKKPKPKKQKVGKEVSAKKPKEGKQVSAKKQKESKEVSAKKPKKQKESNEIDEIFEATKKRKLQEEEEEESEGDKKPRKGKAEGASKKKSKKETGGKGWEPGHDDEVEEKRPRRRTNDGLTIYSADELGFGKADAGGTALCPFDCDCCF

SEQ ID NO: 6284 - protein, 248 aa, Triticum aestivum
MASSDEKPVPTPASTGGDGGPPGKPTTTSTMLLDKGAAALQSLRPVKQMKQHVCTFALYAHDPHRQVETHHYVSRLNQDVLQCPVYDSDDKHARLIGVEYIVSRKIFESLPAEEQKLWHSHAHEIKTGLWANPWVPSMLGKAELDHMAGTFGKFWCTWQVDRGDRLPLGAPALMVSPQGERDGAVRPDLVRKRDQKYSFSTEELKVARADVEVPPEPRPGQADYWVRHHKGFAVDVVPHEMKRHAPFP

SEQ ID NO: 6285 - protein, 248 aa, Pseudoroegneria spicata
MASSDEKPVPTPASIGDDGGPPGKPTTTSTMLLDKGAAALQSLRPVKQIKQHVCMFALYAHDPHRQVETHHYVSRLNQDVLQCPVYDSDDKHARLIGVEYIVSRKIFESLPAEEQKLWHSHAHEIKTGLWANPWVPSMLGKAELDHMAGTFGKFWCTWQVDRGDRLPLGAPALMVSPQGERVAAVRPDLVRKRDQKYSFSTEELKAARVDVEVPAEPRPGQADYWVRHHKGFAVDVVPHEMKRHAPFP

SEQ ID NO: 6286 - protein, 247 aa, Avena sativa
MASSDEKPVPTPASTGGDGGPPGKPTTTSTMLLDKGAAALQSLRPVKQLKQQCARSPCTRTTRTGRWRPTTTSPASTRTSSSAPSTTPTTSTPPHRRGVHRVEEDLRVAAGGGGRSVALARARDQDGAVGEPVGAQHAGEGGAGPHGRHVRQVLVHLAGGPRRPPAARRARAHGVAAGGARRRRAPGPGAEARPEVQLLHGGAQGRQGRRGGAARAAPGPGRLLGPPPQGLRRRRRAARDEAPRAVP

SEQ ID NO: 6287 - protein, 248 aa, Brachypodium distachyon
MASSDEKPVPTPASTGGDGGPPGKPTATSSVLLDKGAAALQSLRPVKQMKQHVCTFALYAHDPHRQLETHHFVSRLNQDVLQCAVYDSDDKNARLIGVEYIVSRKMFESLPGEEQRLWHSHAHEIKEGLWTTPRVPGLLSKTEMETMAGTFGKFWCTWQVDRGDRLPLGAPALMVSPQREREGAVRPDLVRKRDTKYGFSTEELKAERAGVEAPADPRPGQADCWVRHHKGFAVDVVPHDMKRHAPLP

SEQ ID NO: 6288 - protein, 252 aa, Oryza sativa
MASSNEKPLPTPISAAAGGSGGNAPPGRPTTVDSMLLDKGAAMLQALRPVKHIKQHVCTFALYAHDPRRQVETHHFVSRLNQDVLQCAVYDADDKHARLIGVEYIVSRKIFDSLPAEEQRLWHSHAHEIKAGLWVSPHVPGMLEKAELEKMAGTFGKFWCTWQVDRGDRLPLGAPALMVSPQDDPAADVRPDLVRNRDDKYRYSTTELRAARADVAVPAEPRPGQADYWLRHRKGFAVDVVPHEMKCHAPFP

SEQ ID NO: 6289 - protein, 512 aa, Brachypodium distachyon
MGCFQSKPAGKPLPPDADAALPADDPADPEAANGVDGPAGVAEGDEKDGGAAAAKRAVPVFREFGLAELRAATKGFSADLIVSESGEKAPNVVYRGRLDGGRLIAVKRFSRLSWPDPQQFLAEAGGVGKVRHKRLVNLIGCCAEGDERLLVAEYMPNDTLSKHLFHWDKQPLPWEMRLRVAHYIAQALDHCNAENRKIYHDLNAYRVLFDEEGDPRLSSFGLMKNSRDGKSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKTTSVLPTILSPLGKACAGMDLTAVHDILLKTGYKDDEGAENELSFQEWTQQVQEMLNTKKFGDISFRDKDFKSAIDYYTKLVGMMSVPSATVFARRSFSYLMNGQSELALRDAMQAQVCMPEWPTAFYLQALALSKLGMETDAQDMLNDGATFEAKKQNSWRG

SEQ ID NO: 6290 - protein, 512 aa, Oryza sativa
MGCFLSKPAGAGLLPPNDAAALPADNPADPEAAAANGGADSAAADGGGDDKDAAKRAVPVFREFGLAELRAATKGFSADLIVSESGEKAPNVVYRGRLDGGRLIAVKRFSRLSWPDPQQFLAEAAGVGKVRHKRLVNLIGCCAEGDERLLVAEYMPNDTLSKHLFHWDKQPLPWEMRLRVAYYIAQALDHCNAENRKIYHDLNAYRVLFDEEGDPRLSSFGLMKNSRDGKSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKATAVLPTILSPLGKACSGMDLTAVHDILLKTGYKDEEGAENELSFQEWTQQVQEMLNTKKFGDIAFRDKDFKTAIDYYSKLVGMMSVPSATVFARRSFSYLMNGQSELALRDAMQAQVCMPEWPTAFYLQALALSKLGMETDAQDMLNDGATFEAKKQNSWRG

SEQ ID NO: 6291 - protein, 505 aa, Setaria italica
MGCFQSKVAGPLPPNDAAALPADNPADPEAANGGADGGDAGDDKEAAKRAVPVFREFALAELRAATKGFSADLIVSESGEKAPNVVYRGRLDGGRLIAVKRFSRVSWPDPQQFVAEAAGVGKVRHKRLVNLIGCCAEGDERLLVAEYMPNDTLSKHLFHWDKQPLPWEMRLRVAYFIAQALDHCNAENRKIYHDLNAYRVLFDEEGDPRLSSFGLMKNSRDGKSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKATSVLPAILSPLGKACSVLDLTAVHDILLKTGYKDDEGAENELSFQEWTQQVQEMLNTKKVGDIAFRDKDFKTAIDYYSKLVAMMSTPSATVFARRSFSYLMNEQAELALRDAMQAQVCMQEWPTAFYLQALALSKLGMETDAQDMLNDGATFEAKKQNSWRS

SEQ ID NO: 6292 - protein, 505 aa, Sorghum bicolor
MGCFQSKVAGPLPPKDAAALPADKPADPEAANGGPDGGGDGDDKEAVKRAVPVFREFALAELRAATKGFSADLIVSESGEKAPNAVYRGRLDGGRLIAVKRFSRLSWPDPQQFLAEAAGVGKVRHKRLVNLIGCCAEGDERLLVAEYMPNDTLSKHLFHWDKQPLPWEMRLRVAYFIAQALDHCNAENRKIYHDLNAYRVLFDEEGDPRLSSFGLMKNSRDGKSYSTNLAYTPPEFLRTGRVIPESVIYSYGTVLLDLLSGKHIPPSHALDLIRGKNILLLMDSSLEGQYANEDASKLVDLASKCLQFESRDRPNIKYLLSSVGPLQKQKEVASHVFMGITKATSVLPTIYSPLGKACAGMDLSAVHDILLKTGYKDDEGAENELSFQEWTQQVQEMLNTKKFGDIAFRDKDFKTAIDYYSKLVAMMSTPSATVFARRSFSYLMNGQAELALRDAMQAQVCMPEWPTAFYLQALALSKLGMETDAQDMLNDGATFEAKKQNGWRS

SEQ ID NO: 6293 - protein, 505 aa, Zea mays
MGCFQSKVAGPLPPNDAAALPADKPADPEAANGGADGEGDGDDKEAVKRAVPVFREFALAELRAATKGFSADLIVSESGEKAPNAVYRGRLDGGRLIAVKRFSRLSWPDPQQFLAEAAGVGKVRHKRLVNLIGCCAEGDERLLVAEYMPNDTLSKHLFHWDKQPLPWEMRLRVAYFIAQALDHCNAENRKIYHDLNAYRVLFDEEGDPRLSSFGLMKNSRDGKSYSTNLAYTPPEFLRTGRVIPESVIYSYGTVLLDLLSGKHIPPSHALDLIRGKNILLLMDSSLEGQYANEDASKLVDLASKCLQFESRDRPNIKYLLSSVGPLQNQKEVASHVFMGITKATSVLPTICSPLRKACTGMDLSAVHDILLKTGYKDDEGAENELSFQEWTQQVQEMLNTKKFGDIAFRDKDFKTAIDYYSKLVAMMSTPSATVFVRRSFSYLMNGQAELALRDAMQAQVCMPEWPTAFYLQALALSKLGMETDAQDMLNDGATFEAKKQNGWRS

SEQ ID NO: 6294 - protein, 505 aa, Zea mays
MGCFQSKVAGPLPPNDAAALPADKPADPEAANGAADGGGDGDDKEAVKRAVPVFREFALAELRAATKGFSADLIVSESGEKAPNAVYRGRLDGGRLIAVKRFSRLSWPDPQQFLADAVGVGKVRHKRLVNLIGCCAEGDERLLVAEYMPNDTLSKHLFHWDKQPLPWEMRLRVAYFIAQALDHCNLENRKIYHDLNAYRVLFDEEGDPRLSSFGLMKNSRDGKSYSTNLAYTPPEFLRTGRVIPESVIYSYGTVLLDLLSGKHIPPSHALDLIRGKNILLLMDSSLEGQYANEDASKLVDLASKCLQFESRDRPNIKYLLSSVGPLQNQKEVASHVFMGITKATSVLPAIYSPLGKACAGMDLSAVHDILLKTGYKDDEGAENELSFQEWTQQVQEMLNTKKFGDIAFRDKDFKTAIDYYSKLVAMMSTPSATVFARRSFSYLMNEQAELALRDAMQAQVCMPEWPTAFYLQALALSKLGMETDAQDMLNDGATFEAKKQNGWRS

SEQ ID NO: 6295 - protein, 484 aa, Echinochloa colona
TTTPADPEAANGGADGSDAADDKEAAKRAVPVFREFALAELRAATKGFSADLIVSESGEKAPNVVYRGRLDGGRLIAVKRFSRLSWPDPQQFLAEAGGVGKVRHKRLVNLIGCCAEGDERLLVAEYMPNDTLSKHLFHWDKQPLPWEMRLRVAYFIAQALDHCNAENRKIYHDLNAYRVLFDEEGDPRLSSFGLMKNSRDGKSYSTNLAYTPPEFLRTGRVIPESVIYSYGTVLLDLLSGKHIPPSHALDLIRGKNILLLMDSSLEGQYANEDASKLVDLASKCLQFEARDRPNIKYLLSSVGPLQKQKEVASHVLMGITKATSVLPTILSPLGKACSVMDLTAVHDILLKTGYKDDEGAENELSFQEWTQQVQEMLNTKKFGDIAFRDKDFKTAIDYYSKLVAMMSAPSATVFARRSFSYLMNEQAELALRDAMQAQVCMPEWPTAFYLQALALSKLGMETDAQDMLNDGATFEAKKQNSWRT

SEQ ID NO: 6296 - protein, 899 aa, Setaria italica
MIWKLAETGMNVARLNMSHGDHQSHQKVIDLVKEYNAQNTDGNIIAIMLDTKGPEVRSGDVPEPIMLKEGGMMALAVKSKSADTVKCEVVDGGELKSRRHLNVRGKSATLPSITEKDWEDIKFGVENGVDFYAVSFVKDARVIHELKDYLKGANADIHVIPKIESADSIPNLQSIIAASDGAMVARGDLGAELPIEDVPLLQAEIVQTCRSMEKPVIVATNMLESMINHPTPTRAEVSDIAIAVREGADAIMLSGETAHGKYPLKAVKVMHTVALRTESSLYNPTTSPGLVAPAQALHNECSPSQLSKMFGSHSTMMANTLRTPIIVFTQTGSMAVLLSHYRPASTIFAFTNEERVKQRLALYQGVIPIHMQFSDDAEETFSRAISSLLKAQHVKKGDYVTLVQSGVASIWRDESTHHIQVRKAANGGADGGDAGDDKEAAKRAVPVFREFALAELRAATKGFSADLIVSESGEKAPNVVYRGRLDGGRLIAVKRFSRVSWPDPQQFVAEAAGVGKVRHKRLVNLIGCCAEGDERLLVAEYMPNDTLSKHLFHWDKQPLPWEMRLRVAYFIAQALDHCNAENRKIYHDLNAYRVLFDEEGDPRLSSFGLMKNSRDGKSYSTNLAYTPPEFLRTGRVIAESVIYSYGTVLLDLLSGKHIPPSHALDLIRGKNILLLMDSSLEGQYANEDASKLVDLASKCLQFEARDRPNIKYLLSSVGPLQKQKEVASHVLMGITKATSVLPAILSPLGKACSVLDLTAVHDILLKTGYKDDEGAENELSFQEWTQQVQEMLNTKKVGDIAFRDKDFKTAIDYYSKLVAMMSTPSATVFARRSFSYLMNEQAELALRDAMQAQVCMQEWPTAFYLQALALSKLGMETDAQDMLNDGATFEAKKQNSWRS

SEQ ID NO: 6297 - protein, 449 aa, Panicum virgatum
FALAELRAATKGFSADLIVSESGEKAPNVVYRGRFDGGRLIAVKRFSRLSWPDPQQFLAEAAGVGKVRHKRLVNLIGCCAEGDERLLVAEYMPNDTLSKHLFHWDKQPLPWEMRLRVAYFIAQALDHCNAENRKIYHDLNAYRVLFDEEGDPRLSSFGLMKNSRDGKSYSTNLAYTPPEFLRTGRVIPESVIYSYGTVLLDLLSGKHIPPSHALDLIRGKNILLLMDSSLEGQYANEDASKLVDLASKCLQFEARDRPNIKYLLSSVGPLQKQKEVASHVLMGITKAASVLPAILSPLGKACSVMDLTAVHDILLKTGYKDDEGAENELSFQEWTQQVQEMLNTKKFGDIAFRDKDFKTAIDYYSKLVAMMSAPSATVFARRSFSYLMNEQAELALRDAMQAQVCMPEWPTAFYLQSLALSKLGMETDAQDMLNDGATFEAKKQNSWRS

SEQ ID NO: 6298 - protein, 491 aa, Elaeis guineensis
MGCLHSKTSNVHSPDDDSVPGDKPDLPNGDGGLQDEVPAFKEYGLADLRAATKGFSPEMIVSESGEKAPNVVYRGKLDGGRPVAVKRFSKQSWPDAQQFVAEAAGVGKVRHKRLVNLIGCCAEGDERLLVAEFMPNDTLSKHLFHWDKQPLPWEMRVRVAYYIAQALDHCNTENRKIYHDLNAYRVLFDEDGDPRLSSFGLMKNSRDGKSYSTNLAYTPPEFLRTGRVIPESVIYSYGTVLLDLLSGKHIPPSHALDLIRGKNMLLIMDSSLEGQYANEDATQLVELASKCLQFEARDRPNSKFLLSAAAPLQTQKEVASHVLMGLTKTPAILPTMLSPLGKACARMDLTAVHDILLKTGYKDEEGAENELSFQEWTQQVQEMLNTKKFGDIAFRDKDFKSAIEYYSKLVVMMSVPSATVFARRALSYLMNGQPELALRDAMQAQVCMPEWPTAFYLQALALSKLGMETDAQDMLNDGATFEVKRQNSWRG

SEQ ID NO: 6299 - protein, 495 aa, Vitis vinifera
MGCFQSKTAHLHSPDDPSSTPEPTAKPDSANGDQSDQEHQVPAFKEYGLSELRKATNGFSSDHIVSESGEKAPNVVYRGKLDSNRLVAVKRFSKLSWPDAQQFVAEAAGVGKVRHKRLVNLIGCCAEGDERLLVAEYMPNDTLSKHLFHWDKQPLPWDMRVRVAYYIAQALDHCNTENRKIYHDLNAYRVLFDEDGDPRLSSFGLMKNSRDGKSYSTNLAYTPPEFLRTGRVIPESVIYSYGTVLLDLLSGKHIPPSHALDLIRGKNVLLLMDSSLEGQYANDDATKLVELASKCLQSEARDRPDTNFLLTAVAPLQKQKEVASHVLMGLTKTTVVLPTMLSPLGKACARMDLTAVHDILLKTGYKDEEGAENELSFQEWTQQVQEMLNTKKFGDIAFRDKDFKSAIDYYSKLVVMMPVPSATVFARRALSYLMIGQAELALRDAMQAQVCIPEWPTAFYLQALALSKLGMETDAQDMLNDGAAFEAKRHNSWRN

SEQ ID NO: 6300 - protein, 489 aa, Phalaenopsis aphrodite
MGCLQSKTSNVQSPEEESPPAEKEDSREKGEQDRVPVFREFNLAELRAATKGFSSELIVSESGEKAPNVVYRGKLEGGRLVAVKRFSRQSWPDAQQFVVEAAGVGKLRHKRLVNLIGCCAEGDERLLIAEFMPNDTLSKHLFHWDKQPLPWEMRVRVAYYIAQALDHCNIENRKIYHDLNAYRVLFDEDGDPCLSSFGLMKNSRDGKSYSTNLAYTPPEFLRTGRVIPESVIYSYGTVLLDLLSGKHIPPSHALDIIRGKNILMLMDSSLEGQYANEDATKLVELASECLQFEAKDRPNSKFLLSAVEPLLKQKEVASLVLMGISKATVVLPTLLSPLGKACARMDLVAVHDILLKAGYKDDEGAENELSFQEWTQQVQEMLNTKKFGDIAFRDKDFKSAIEYYSKLVVMMSVPSATVFARRALSYLMNGQPELALRDAMQAQVCLPEWPTAFYLQALALSKLGMETDAQDMLNDGAAFEAKKQNNWRG

SEQ ID NO: 6301 - protein, 492 aa, Amsonia hubrichtii
MGCFQSKTANVQSPDQEPSQPDSKPDLANGDQIDQDQAPAFKEFGLVELRAATNGFSSELIVSESGEKAPNVVYRGKLRSNRLVAIKRFSKQSWPDPQQFVAEAAGVGKVRHRRLVNLIGCCAEGDERLLVAEYMPNDTLSKHLFHWDKQPLPWEMRVRVAYHIAQALDHCNSENRKIYHDLNAYRVLFDEEGDPRLSSFGLMKNSRDGKSYSTNLAYTPPEFLRTGRVIPESVIYSYGTVLLDLLSGKHIPPSHALDLIRGKNVLLLMDSSLEGQYANEDATALVELASKCLQYEARDRPDIKFLLSAVTPLQKQKEVASHVLMALTKSPVVLPTMLSPLGKACTRMDLTAVHDILLKTGYKDEEGAENELSFQEWTQQVQDMLNTKKFGDIAFRDKDFKSAIDYYSKLVSMMSVPSGTVFVRRALSYLMIGQPELALRDAMQAQVCLPEWPTAFYMQALALSKLGMETDAQDMLNDGASFEAKKQNSWRN

SEQ ID NO: 6302 - protein, 492 aa, Vinca minor
MGCFQSKTANVQSPDQEPSQPDSKPDLANGDQADQDQAPAFKEFKLVELRAATNGFSSDLIVSESGEKAPNVVYRGKLKSNRLVAIKRFSRQSWPDSQQFVAEAAGVGKVRHKRLVNLIGCCAEGDERLLVAEYMPNDTLSKHLFHWDKQPLPWEMRVRVANHIAQALDHCNTENRKIYHDLNAYRVLFDEEGDPRLSSFGLMKNSRDGKSYSTNLAYTPPEFLRTGRVIPESVIYSYGTVLLDLLSGKHIPPSHALDLIRGKNVLLLMDSSLEGQYANEDATALVELASKCLQYEARDRPDIKFLLSAVTPLQKQKDAASLVLMGLTKTPVVLPTMLSPLGKACTRMDLTAVHDILLKTGYKDEEGAENELSFQEWTQQVQDMLNTKKFGDIAFRDKDFKNAIDYYSKLVSMMPVPSGTVFVRRALSYLMIGQPELALRDAMQAQVCLPEWPIAFYMQALALSKLGMETDAQDMLNDGASFEAKKQNSWRN

SEQ ID NO: 6303 - protein, 492 aa, Vinca minor
MGCFQSKTANVQSPDQEPSQPDSKPDLENGDQTDQDQAPAFKEFGLVELRAATNGFSSDLIVSESGEKAPNVVYRGKLKRNRLVAIKRFSRQSWPDPQQFVAEAAGVGKVRHKRLVNLIGCCAEGDERLLVAEYMPNDTLSKHLFHWDKQPLPWEMRVRVAYHIAQALDHCNTENRKIYHDLNAYRVLFDEEGDPRLSSFGLMKNSRDGKSYSTNLAYTPPEFLRTGRVIPESVIYSYGTVLLDLLSGKHIPPSHALDLIRGKNVLLLMDSSLEGQYANEDATALVELASKCLQYEARDRPDIKFLLSAVTPLQKQKDAASLVLMGLTKTPVVLPTMLSPLGKACTRMDLTAVQDILLKTGYKDEEGAENELSFQEWTQQVQDMLNTKKFADIAFRDKDFKSAIDYYSKLVSMMSVPSGTVFVRRALSYLMIDQPELALRDAMQAQVCLPEWPTAFYMQALALSKLGMETDAQDMLNDGASFEAKKQNSWRN

SEQ ID NO: 6304 - protein, 492 aa, Eucalyptus grandis
MGCIQSKTAHLPSPDQEPSQADPKPDPANGEQVDQDQVPAFKEFPLADLRAATNGFSSELIVSECGEKAPNVVYRGKLRNNCLVAIKRFSKQSWPDPQQFVTEASGVGKVRHKRLVNLIGCCAEGDERLLVAEYMPNDTLSKHLFHWEKQPLPWEMRVRVGYYIAQALDHCNTENRKIYHDLNAYRVLFDEDGDPRLSSFGLMKNSRDGKSYSTNLAYTPPEFLRTGRVIPESVIYSYGTVLLDLLSGKHIPPSHALDLIRGKNSLLLMDSSLEGQYVNEDASELVELASKCLQYEARDRPDVKFLLSSVAPLQKQKEVASHVLMRITKTPVVLPTMLSPLGKACVRMDLTAVHDILLKTGYKDEEGAENELSFQEWTQQVQDMLNTKKFGDIAFRDKDFKNAIDYYSKLVSMMSVPSGTVFVRRALSYLMIGQAELALRDAMQAQVCLPEWPTAFYMQALALSKLGMETDAQDMLNDGASFEAKKQNSWRG

SEQ ID NO: 6305 - protein, 498 aa, Cicer arietinum
MGCFHSKTAHLHSPEDPPTDLPDPNKPDPGDEGGDGDQESQVPAFKEYGLNELRRATHEFSTDYIVSESGEKAPNVVYRGKLENNRLVAVKRFSKHSWPDAQQFLAEAAGVGKVRHKRMVNLIGCCAEGDERLLVAEYMPNDTLSKHLFHWDKQPLPWEMRVRVAYHVAQALDHCSMENRKIYHDLNAYRILFDEDGDPRLSSFGLMKNSRDGKSYSTNLAYTPPEFLRTGRIIAESVIYSYGTVLLDLLSGKHIPPSHALDLIRGKNALLLMDSSLEGQYANDDATKLVELASKCLQFEARDRPDIKFLLTAVTPLQKQKEVASHVLMGLTKTAAVLPLPTMLSPLGKACARMDLTAIHDILLKTGYKDEEGAENELSFQEWTQQVQDILNTKKFGDIAFRDKDFKNAIEYYSKLVVMMSVPSATVFARRAFSYLMNDQAELALRDAMQAQVCIPDWPTAFYLQALALSKLGMETDAQDMLNDGAAFEAKRTNSWRG

SEQ ID NO: 6306 - protein, 492 aa, Musa acuminata
MGCFHSKTTNLHSPEDDPDHADKPDHETNGEAGDQDQVPAFKEYGLAELRAATKGFSPDLIVSESGEKAPNVVYRGKLDGGRLVAVKRFSKQSWPDAQQFVAEAAGVGKVRHKRLVNLIGCCAEDDERLLVAEFMPNDTLSKHLFHWDKQPLPWAMRVRVAYYIAQALDHYNTENRRIYHDLNSYRVLFDEDGDPRLSSFGLMKNSRDGKSYSTNLAYTPPEFLRTGRVIPESVIYSYGTVLLDLLSGKHIPPSHALDLIRGKNMLMIMDSSLEGQYANDDATNFVELASKCLQFEARDRPNSKFLLSALAPLQTQKEIPSHALMGITKTEQVLPVMLSPLGKACARMDLTAVHDILLKTGYKDEEGAENELSFQEWTQQVQEMLNTKKFGDIAFRDKDFKSAIDYYSKLVMMMSVPSATVFARRSLSYLMNGQPELALRDAMQAQVCMPEWPTAFYLQALALSKLGMEKDAQDMLNDGAALEVKKQSSWRG

SEQ ID NO: 6307 - protein, 492 aa, Lippia dulcis
MGCLQSKTANVQSPDQEPSQPDSKPDLANGEQVDQDQVPAFKEFGLSELRAATNGFSSELIVSESGEKAPNVVYRGKLRSNRLVAIKRFSKQSWPDPQQFVAEAAGVGKVRHKRVVNLIGCCAEGDERLLVAEYMPNDTLSKHLFHWDKQPLPWEMRVRVAHNIAQALEHCNAENRKIYHDLNAYRVLFDEDGDPRLSSFGLMKNSRDGKSYSTNLAYTPPEFLRTGRVIPESVVYSYGTVLLDLLSGKHIPPSHALDLIRGKNVLLLMDSSLEGQYANEDATALVELASKCLQYEARDRPVIKFLITAVEPLQKQKEVASHVLMGLTKTPVILPTMLSPLGKACARMDLTAVHDIMLKTGYKDEEGAENELSFQEWTQQVQDMLNTKKFGDIAFRDKDFKGAIDYYSKLVSMMSVPSGTVFVRRALSYLMIGQPELALRDAMQAQVCLPEWPLAFYMQALALSKLGMETDAQDMLNDGASFEAKKQNSWRN

SEQ ID NO: 6308 - protein, 496 aa, Cajanus cajan
MGCFHSKTAHIHSPEDPPAALPDSKHPDPGHGGDDADQECLVPAFKEYGLSELRRATNEFSTDYIVSESGEKAPNVVYRGKLENNRLVAVKRFSKLSWPDAQQFMAEAAGVGKVRHKRLVNLIGCCAEGDERLLVAEYMPNDTLSKHLFHWDKQPLPWEMRVRVAYHVAQALDHCSMENRKIYHDLNAYRILFDEDGDPRLSSFGLMKNSRDGKSYSTNLAYTPPEFLRTGRIIPESVIYSYGTVLLDLLSGKHIPPSHALDLIRGKNVLLLMDSSLEGQYANDDATKLVELASKCLQFEARERPDIKFLLTAVAPLQKQKEVASHVLMGLTKNTTVLPTMLSPLGKACARMDLTAVHDILLKTGYKDEEGAENELSFQEWTQQVQDILNTKKFGDIAFRDKDFKNAIEYYSKLVVMMSVPSATVFARRAFSYLMNDQAELALRDAMQAQVCIPEWPTAFYLQALALSKLGMETDAHDMLNDGAAFEAKRSNSWRG

SEQ ID NO: 6309 - protein, 492 aa, Solanum lycopersicum
MGCLQSKTVNVQSPDKEPSQDDSKTDLANGDQVDQDQVPVFKEFSLAELRAATNGFSSELIVSESGEKAPNVVYRGKLRSNRLAAIKRFSRQSWPDAQQFVAEAAGVGKVRHKRLVNLIGCCAEGDERLLVAEYMPNDTLSKHLFHWEKQPLPWEMRVRVAYYIAQALDHCNTENRKIYHDLNAYRILFDEEGDPRLSSFGLMKNSRDGKSYSTNLAYTPPEFLRTGRVIAESVMYSYGTVLLDLLSGKHIPPSHALDLIRGKNVLLLMDSSLEGQYANEDATALVELASKCLQYEARDRPEIKFILNAVEPLQKQKEAASHVLMGLTKTPVVLPTMLSPLGKACARMDLTAVHDILLKTGYKDEEGAENELSFQEWTQQVQDMLNTKKFGDIAFRDKDFKNAVDYYSKLVSMMSVPSGTVFVRRALSYMMNGQPELALRDAMQAQVCLPEWPTAFYMQALALSKLGMETDAQDMLNDGASFEAKKLNSWRN

SEQ ID NO: 6310 - protein, 498 aa, Trifolium pratense
MGCFHSKTAHLHSPEDPPTALPDSKKPDPGDDGGDGDQEIQVPAFKEYGLNELRRATHEFSTDYIVSESGEKAPNVVYKGKLENNRLVAVKRFSKQSWPDAQQFLAEAAGVGKVRHKRMVNLIGCCAEGDERLLVAEYMPNDTLSKHLFHWDKQPLPWEMRVRVAYHVAQALDHCSMENRKIYHDLNAYRILFDEDGDPRLSSFGLMKNSRDGKSYSTNLAYTPPEFLRTGRIIAESVIYSYGTVLLDLLSGKHIPPSHALDLIRGKNALLLMDSSLEGQYANDDATKLVELASKCLQFEARERPDIKFLLTAVTPLQKQKEVASHVLMGLTKTAAVLPLPTMLSPLGKACARMDLTAIHDILLKTGYKDEEGAENELSFQEWTQQVQDILNTKKFGDIAFRDKDFKNAIEYYSKLVVMMSVPSATVFARRAFSYLMNDQAELALRDAMQAQVCIPDWPTAFYLQALALSKLGMETDAQDMLNDGAAFEAKRSNSWRG

SEQ ID NO: 6311 - protein, 358 aa, Catharanthus roseus
MPNDTLSKHLFHWDKQPLPWEMRVRVAYHIAQALDHCNSENRKIYHDLNAYRVIFDEEGDPRLSSFGLMKNSRDGKSYSTNLAYTPPEFLRTGRVIPESVIYSYGTVLLDLLSGKHIPPSHALDLIRGKNVLLLMDSSLEGQYTNEDATALVELASKCLQYEARDRPDIKFLLSAVAPLQKQKDVASHVLMGLTKTPVVLPTMLSPLGKACTRMDLTAVHDILLKTGYKDEEGAENELSFQEWTQQVQDMLNTKKFGDIAFRDKDFKNAIDYYSKLVSMMSVPSGTVFVRRALSYLMIGQPELALRDAMQAQVCLPEWPTAFYMQALALSKLGMETDAQDMLNDGASFEAKKQNSWRN

SEQ ID NO: 6312 - protein, 492 aa, Solanum phureja
MGCLQSKTVNVQSPDKEPSQDDSKTDLANGDQVDQDQVPAFKEFSLAELRAATNGFSSELIVSESGEKAPNVVYRGKLRSNRLAAIKRFSRQSWPDAQQFVAEAAGVGKVRHKRLVNLIGCCAEGDERLLVAEYMPNDTLSKHLFHWEKQPLPWEMRVRVAYYIAQALDHCNAENRKIYHDLNAYRILFDEEGDPRLSSFGLMKNSRDGKSYSTNLAYTPPEFLRTGRVIAESVVYSYGTVLLDLLSGKHIPPSHALDLIRGKNVLLLMDSSLEGQYANEDATALVELASKCLQYEARDRPEIKFILNAVEPLQKQKEAVSHVLMGLTKTPVVLPTMLSPLGKACARMDLTAVHDILLKTGYKDEEGAENELSFQEWTQQVQDMLNTKKFGDIAFRDKDFKNAVDYYSKLVSMMSVPSGTVFVRRALSYMMNGQPELALRDAMQAQVCLPEWPTAFYMQALALSKLGMETDAQDMLNDGASFEAKKLNSWRN

SEQ ID NO: 6313 - protein, 492 aa, Vinca minor
MGCFQSKTANVQSPDQEPSQPDSKPDLADGEQTDQDQAPAFMEFGLVELRAATHGFSSDLIVSESGEKAPNVVYRGKLKSNRLVAIKRFSRQSWPDPQQFVAEAAGVGKVRHKRLVNLIGCCAEGDERLLVAEYMPNDTLSKHLFHWDKQPLPWEMRLRVTYHIAQALDHCNTENRKIYHDLNAYRVLFDEEGDPRLSSFGLIKNSRDGKSYSTNLAYTPPEFLRTGRVIPESVIYSYGTVLLDLLSGKHIPPSHALDLIRGKNVLLLMDSSLEGQYANEDATALVELASKCLQYEARDRPDIKFLLSAVTPLQKQKDAASLVLMGLTKTPVVLPTMLSPLGKACTRMDLTAVHDILLKTGYKDEEGAENELSFQEWTQQVQDMLNTKKFGDIAFRDKDFNSAIDYYSKLVSMMPVPSGTVFVRRALAYLMIDQPELALRDAMQAQVCLPEWPTAFYMQALALSKLGMETDAQDMLNDGASFEDKKQNSWRN

SEQ ID NO: 6314 - protein, 498 aa, Trifolium pratense
MGCFHSKTAHLHSPEDPPTALPDSKKPDPGDDGGDGDQEIQVPAFKEYGLNELRRATHEFRTDYIVSESGEKAPNVVYKGKLENNRLVAVKRFSKQSWPDAQQFLAEAAGVGKVRHKRMVNLIGCCAEGDERLLVAEYMPNDTLSKHLFHWDKQPLPWEMRVRVAYHVAQALDHCSMENRKIYHDLNAYRILFDEDGDPRLSSFGLMKNSRDGKSYSTNLAYTPPEFLRTGRIIAESVIYSYGTVLLDLLSGKHIPPSHALDLIRGKNALLLMDSSLEGQYANDDATKLVELASKCLQFEARERPDIKFLLTAVTPLQKQKEVASHVLMGLTKTAAVLPLPTMLSPLGKACARMDLTAIHDILLKTGYKDEEGAENELSFQEWTQQVQDILNTKKFGDIAFRDKDFKNAIEYYSKLVVMMSVPSATVFARRAFSYLMNDQAELALRDAMQAQVCIPDWPTAFYLQALALSKLGMETDAQDMLNDGAAFEAKRSNSWRG

SEQ ID NO: 6315 - protein, 493 aa, Mimulus guttatus
MGCFQSKTANVQSPDQDPSLPDSKPDLANGEQVDPDQVPAFREFGLAELRGATNGFSSELIVSESGEKAPNVVYKGKLRSNRLVAIKRFSKQSWPDPQQFAAEAAGVGKVRHKRLVNLIGCCAEGDERLLVAEYMPNDTLSKHLFHWEKQPLPWEMRVRVAYHMAQALEHCTAENRKIYHDLNAYRVLFDEEGDPRLSSFGLMKNSRDGKSYSTNLAYTPPEFLRTGRVIPESVIYSYGTVLLDLLSGKHIPPSHALDLIRGKNVLLLMDSSLEGQYANEDATALVELASKCLQYEARDRPDVKFLVTSVAPLEKQKEVASLVLMGLTKTPVVSLPTMLSPLGKACARMDLTAIHDILLKTGYKDEEGAENELSFQEWTQQVQDMLNTKKFGDIAFRDKDFKSAIEYYSKLVLMMPVPSGTVFVRRALSYLMIGQPELALRDAMQAQVCLSEWPTAFYMQALALSKLGMETDAQDMLNDGASFEAKKQNSWRH

SEQ ID NO: 6316 - protein, 498 aa, Trigonella foenum-graecum
MGCFHSKTAHLHSPEDPPTALPDSKKPDPGDDGGDGDQESQVPVFKEYGLNELRRATHEFSTDYIVSESGEKAPNVVYKGKLENNRLVAVKRFSKQSWPDAQQFLAEAAGVGKVRHKRMVNLIGCCAEGDERLLVAEYMPNDTLSKHLFHWDKQPLPWEMRVRVAYHVAQALDHCSMENRKIYHDLNAYRILFDEDGDPRLSSFGLMKNSRDGKSYSTNLAYTPPEFLRTGRIIAESVIYSYGTVLLDLLSGKHIPPSHALDLIRGKNALLLMDSSLEGQYANDDATKLVELASKCLQFEARERPDIKFLLTAVTPLQKQKEVASHVLMGLTKTPAVLPLPTMLSPLGKACARMDLTAIHDILLKTGYKDEEGAENELSFQEWTQQVQDILNTKKFGDIAFRDKDFKNAIEYYSKLVVMMSVPSATVFARRAFAYLMNDQAELALRDAMQAQVCIPDWPTAFYLQALALSKLGMETDAQDMLNDGAAFEAKRSNSWRG

SEQ ID NO: 6317 - protein, 496 aa, Phaseolus vulgaris
MGCLHSKTAHLHSPEDPPTALPDAKKPDPGNGGDDVDQEVQVPAFKEYGLSELRRATNEFNTDYIVSESGEKAPNVVYRGKLENNRLVAVKRFSKLSWPDAQQFMAEAAGVGKVRHKRLVNLIGCCAEGDERLLVAEYMPNDTLSKHLFHWDKQPLPWEMRVRVAYHVAQALDHCSMENRKIYHDLNAYRILFDEDGDPRLSSFGLMKNSRDGKSYSTNLAYTPPEFLRTGRIIPESVIYSYGTVLLDLLSGKHIPPSHALDLIRGKNVLLLMDSSLEGQYANDDATKLVELASKCLQFEARERPEIKFLLTSVTPLQKQKEVASHVLMGLTKNTAVLPTMLSPLGKACARMDLTAVHDILLKTGYKDEEGAENELSFQEWTQQVQDILNTKKFGDIAFRDKDFKNAIEYYSKLVVMMSVPSATVFARRAFSYLMNDQAELALRDAMQAQVCIPDWPTAFYLQALALSKLGMETDAHDMLNDGAAFEAKRSNSWRG

SEQ ID NO: 6318 - protein, 489 aa, Theobroma cacao
MGCFQSKTTHLPSPDQDPPPQTKPDLDGDGEQSSLPAFKEFGLVELRAATNGFSSELIVSESGEKAPNVVYRGKLKNNRVVAIKRFSRQSWPDPHQFVNEAAGVGKVRHKRLVNLIGCCAEGDERLLVAEYMPNDTLSKHLFHWEKQPLPWEMRLRVAYHIAQALDHCNAENRKIYHDLNAYRVLFDEDGDPRLSSFGLMKNSRDGKSYSTNLAYTPPEFLRTGRVIPESVIYSYGTVLLDLLSGKHIPPSHALDLIRGKNLLLLMDSSLEGQYANEDASELVELASKCLQYEARDRPDIEFLLSAVVPLQKQKEVASHVLMGLSRTPSLLPTMLSALGKACARMDLTAVHDILLKTGYRDEEGAENELSFQEWTQQVQDMLNTKKFGDIAFRDKDFKNAIDYYSKLVSMMSVPSGTVFVRRALSFLMIGQPEFALRDAMQAQVCLPEWPTAFYMQALALSKLGMETDAQDMLNDGASFEAKKQNGWRV

SEQ ID NO: 6319 - protein, 489 aa, Panax ginseng
MGCFQSKTANVQSPDQEPEPKPDLENGDQLDQDQVPAFKEFALTELRTATNGFSSDLIVSESGEKAPNVVYRGRLRSNRVVAIKRFSKQSWPDPQQFVTEASGVGKVRHSRLVNLIGCCAEGDERLLVAEYMPNDTLSKHLFHWDKQPLPWEMRVRVAHHIAQALDHCNAENRKIYHDLNAYRVLFDEEGDPRLSSFGLIKNSRDGKSYSTNLAYTPPEFLRTGRVVAESVIYSYGTVLLDLLSGKHIPPSHALDLIRGKNVLLLMDSSLEGQYANEDATALVELASKCLQYEARDRPDIKFLLTAVAPLQKQKEVASHVLMCLTKTTVVLPTMLSPLGKACARMDLTAVHDILLKTGYRDEEGAENELSFQEWTQQVQDMLNTKKFGDIAFRDKDFTSAVDYYSKLVSMMSVPSGTIFVRRAISYLMIGQPELALRDAMQAQVCLPEWPTAFYMQALALSKLGMETDAQDMLNDGAAFEAKKQNSWRN

SEQ ID NO: 6320 - protein, 492 aa, Solanum tuberosum
MGCLQSKTVNVQSPDKEPSQDDSKTDLANGDQVDQDQVPAFKEFSLAELRAATNGFSSELIVSESGEKAPNVVYRGKLRSNRLAAIKRFSRQSWPDAQQFVAEAAGVGKVRHKRLVNLIGCCAEGDERLLVAEYMPNDTLSKHLFHWEKQPLPWEMRVRVAYYIAQALDHCNAENRKIYHDLNAYRILFDEEGDPRLSSFGLMKNSRDGKSYSSNLAYTPPEFLRTGRVIAESVVYSYGTVLLDLLSGKHIPPSHALDLIRGKNVLLLMDSSLEGQYANEDATALVELASKCLQYEARDRPEIKFILNAVEPLQKQKEAVSHVLMGLTKTPVVLPTMLSPLGKACARMDLTAVHDILLKTGYKDEEGAENELSFQEWTQQVQDMLNTKKFGDIAFRDKDFKNAVDYYSKLVSMMSVPSGTVFVRRALSYMMNGQPELALRDAMQAQVCLPEWPTAFYMQALALSKLGMETDAQDMLNDGASFEAKKLNSWRN

SEQ ID NO: 6321 - protein, 498 aa, Trifolium pratense
MGCFHSKTAHLHSPEDPPTALPDSKKPDPGDDGGDGDQEIQVPAFKEYGLNELRRATHEFSTDYIVSESGEKAPNVVYKGKLENNRLVAVKRFSKQSWPDAQQFLAEAAGVGKVRHKRMVNLIGCCAEGDERLLVAEYMPNDTLSKHLFHWDKQPLPWEMRVRVAYHVAQALDHCSMENRKIYHDLNAYRILFDEDGDPRLSSFGLMKNSRDGKSYSTNLAYTPPEFLRTGRIVAESVIYSYGTVLLDLLSGKHIPPSHALDLIRGKNALLLMDSSLEGQYANDDATKLVELASKCLQFEARERPDIKFLLTAVTPLQKQKEVASHVLMGLTKAAAVLPLPTMLSPLGKACARMDLTAIHDILLKTGYKDEEGAENELSFQEWTQQVQDILNTKKFGDIAFRDKDFKNAIEYYSKLVVMMSVPSATVFARRAFSYLMNDQAELALRDAMQAQVCIPDWPTAFYLQALALSKLGMETDAQDMLNDGAAFEAKRSNSWRG

SEQ ID NO: 6322 - protein, 498 aa, Medicago truncatula
MGCFHSKTAHLHSPEDPPTALPDSKKTDPGDDGGDGDQESQVPVFKEYGLNELRRATHEFSTEYIVSESGEKAPNVVYKGKLENNRLVAVKRFSKQSWPDAQQFLAEAAGVGKVRHKRMVNLIGCCAEGDERLLVAEYMPNDTLSKHLFHWDKQPLPWEMRVRVAYHVAQALDHCSMENRKIYHDLNAYRILFDEDGDPRLSSFGLMKNSRDGKSYSTNLAYTPPEFLRTGRIIAESVIYSYGTVLLDLLSGKHIPPSHALDLIRGKNALLLMDSSLEGQYANDDATKLVELASKCLQFEARERPDIKFLLTAVTPLQKQKEVASHVLMGLTKTPAVLPLPTMLSPLGKACARMDLTAIHDILLKTGYKDEEGAENELSFQEWTQQVQDILNTKKFGDIAFRDKDFKNAIEYYSKLVVMMSVPSATVFARRAFAYLMNDQAELALRDAMQAQVCIPDWPTAFYLQALALSKLGMETDAQDMLNDGAAFEAKRSNSWRG

SEQ ID NO: 6323 - protein, 493 aa, Panax ginseng
MGCFHSKTTHLPYPDDPSKLDSVNGDNCGGEEDQDNNQVPVFKEYVLNELKKATNGFSSDCLVSESGERAPNVVYRAKLDNNRFVAVKRFSKLSWPDPQQFLAEAAGVGKVRHKRLVNLIGGCAEGDERLLVAEYMPNDTLSKHLFHWDKQPLPWEMRVRVGCHVAQALDHCNSENRKIYHDLNAYRVLFDEDGDPRLSSFGLMKNSRDGKSYSTNLAYTPPEFLRTGRVIPESVIYSYGTVLLDLLSGKHIPPSHALDLIRGKNVLLLMDSSLEGQYANDDATKFVELASKCLQAEARDRPDTKFLITAVSPLQKQKEVASHVLMGLTKTATVVPTILSPLGKACARMDLTAVHDILLKTGYKDEEGAENELSFQEWTQQVQDMLNTKKFGDIAFRDKDFKSAIEYYTKLVVMMSVPSATVFARRALSYLMNDQAELALRDAMQAQVCIPEWPTAFYLQALALSKLGMETDAQDMLNDGAAFDTKKQNSWRN

SEQ ID NO: 6324 - protein, 497 aa, Quercus alba
MGCFQSKTAHLASPDQDPPLPHPSPDPANGGGGEEELEQNDGVPAFKEFELAELRAATNGFSSELIVSESGEKAPNVVYKGKLRNNGLVAIKRFSKLSWPDPHQFVTEACGVGKVRHKRMVNLIGCCAEGDERLLVAEFMPNDTLSKHLFHWDKQPLPWEMRVRVAYYIAQALGHCNTENRKIYHDLNAYRVLFDEDGDPRLSSFGLMKNSRDGKSYSTNLAYTPPEFLRTGRVIPESVVYSYGTVLLDLLSGKHIPPSHALDLIRGKNLLLLLDSSLEGQYAEEDATELVELASKCLQYEAKDRPEIKFLLSSVTPLQKQKEVASHVLLGLTKTPVVLPTMLSPLGKACVRMDLTAVHDILLKTGYKDEEGAENELSFQEWTQQVQDMLNTKKFGDIAFRDKDFKNAIEYYSKLVSMMPVPSATIFVRRALSYLMTGQAELALRDAMQSQVCLPEWPTAFYMQALALSKLGMETDAQDMLNDGASFEAKKQNSWRI

SEQ ID NO: 6325 - protein, 492 aa, Capsicum annuum
MGCLQSKTANVQSPDKEPSQDDSKTDLANGDQVDQDQVPAFKEFNLAELRAATNGFSSELIVSESGEKAPNVVYRGKLRSNRLVAIKRFSRQSWPDAQQFVAEAAGVGKVRHKRLVNLIGCCAEGDERLLVAEYMPNDTLSKHLFHWEKQPVPWEMRVRVAYYIAQALDHCSAENRKIYHDLNAYRVLFDEEGDPRLSSFGLMKNSRDGKSYSTNLAYTPPEFLRTGRVIAESVMYSYGTVLLDLLSGKHIPPSHALDLIRGKNVLLLMDSSLEGQYADEDATALVELASKCLQYEARDRPEIKFILNAVEPLQKQKEVASHVLMGLTKTPVVLPTMLSPLGKACARMDLTAVHDILLKTGYKDEEGAENELSFQEWTQQVQDMLNTKKFGDIAFRDKDFKSAVDYYSKLVSMMPAPSGTVFVRRALSYMMNGQAELALRDAMQAQVCLPEWPTAFYMQALSLSKLGMETDAQDMLNDGASFEAKKLNSWRN

SEQ ID NO: 6326 - protein, 496 aa, Glycine max
MGCLHSKTAHLHSPEDPPTALPDSKKPDPGNGGDDVDQECQVPAFKEYGLIELRRATNEFSTDYIVSESGEKAPNVVYRGKLENNRLVAVKRFSKLSWPDAQQFMAEAAGVGKVRHKRLVNLIGCCAEGDERLLVAEYMPNDTLSKHLFHWDKQPLPWEMRVRVAYHVAQALDHCSLENRKIYHDLNAYRILFDEDGDPRLSSFGLMKNSRDGKSYSTNLAYTPPEFLRTGRIIPESVIYSYGTVLLDLLSGKHIPPSHALDLIRGKNVLLLMDSSLEGQYANDDATKLVELASKCLQFEARERPEIKFLLTAVAPLQKQKEVTSHVLMGLTKNTAVLPTMLSPLGKACARMDLTAVHDILLKTGYKDEEGAENELSFQEWTQQVQDILNTKKFGDIAFRDKDFKNAIEYYSKLVVMMSVPSATVFARRAFSYLMNDQAELALRDAMQAQVCIPDWPTAFYLQALALSKLGMETDAHDMLNDGAAFEAKRSNSWRG

SEQ ID NO: 6327 - protein, 500 aa, Musa acuminata
MGCFHSKTTNVQSPDEESLPADKPDLPNGDAGEQDQVPAFKEYGLAELRAATKGFSPEMIVSESGEKAPNVVYRGNLDGGRLVAVKRFSKQSWPDAQQFVTEAAGVGKLRHTRLVNLIGCCAEGDERLLVAEFMPNDTLSKHLFHWDKHPLPWQMRVRVAFYIAQALDHCNTENRRIYHDLNAYRVLFDENYIIRDLHQDGDPRLSSFGLIKNSRDGKSYSTNLAYTPPEFMRTGRVIPESVIYSYGTILLDLLSGKHIPPSHALDLIRGKNMLLIMDSSLEGQYANEDATKLVELASKCLQFEARDRPNSKFLLSSVEPLQTQKEVPSHVLMGITKAPQVLPTMLSPLGKACAKMDLTAVHDILLKTGYKDEEGAENELSFQEWTQQVQEMLNTKKFGDIAFRDKDFKSAIEYYSKLVAMMSVPSATVFARRGLSYLMSGQPELALRDAMQAQVCMPEWPTAFYLQALALSKLGMETDAQDMLNDGAAFEAKRQNGWHG

SEQ ID NO: 6328 - protein, 492 aa, Allium cepa
MGCLQSKTANIHSPENEPITQESKPDLQNGEAVDQEQVPAFKEFGLSELRIATKGFSSDLIVSESGEKAPNIVFKGKLDNGKIVAVKRFSRQSWPDAQQFVSEAAGVGKLRHRRIVNLIGCCTEGDERLLVAEFMPNDTLSKHLFHWDKQPLPWEMRARIAYYIAQALDHCNTENRKIYHDLNAYRVLFDEDGDPRLSSFGLMKNSRDGKSYSTNLAYTPPEFLRTGRVIPESVIYSYGTVLLDLLSGKHIPPSHALDMIRGKNILLLMDSSLEGQYTDEDASKLIDLASKCLQFEARDRPNSKFLLSAVASLQKQKEVASHVLMGLSKAPVALPTTLSPLGKACARMDLTAVHDILLKTGYKDEEGAENELSFQEWTQQVQEMLNTKKFGDIAFRDKDFKNAIDYYTKLVGLMSVPSATVFARRGLSYLMNGQPELALRDAMQAQVCMPEWPTAFYLQALALSKLGMETDAQDMLNDGAAFEAKKQNGWRS

SEQ ID NO: 6329 - protein, 498 aa, Manihot esculenta
MGCFQSKTTHIASPDQEPLPPQEPKADLANGATDLDHHQDLDQVPTFREFSLAELRTATNGFSSDLIVSESGEKAPNVVYRGKLNANRLVAIKRFSRLSWPDPHQFVTEASGVGKVRHKRLVNLIGCCAEGDERLLVAEFMPNDTLSKHLFHWEKQPLPWEMRVRVAYYIAQALGHCNAQNRKLYHDLNAYRVLFDEDGDPRLSSFGLMKNSRDGKSYSTNLAYTPPEFLRTGRVIPESVIYSYGTVLLDLLSGKHIPPSHALDLIRGKNLLLLMDSSLEGQYANEDATELVELASKCLQYEAKDRPDIQFLLTAVTPLQKQKEVASLVLMGLSKTPVVLPTMLSPLGKACVRMDLTAVHDILLKTGYKDEEGAENELSFQEWTQQVQDMLNTKKFGDIAFRDKDFKNAVDYYSKLVAMMSVPSGTVFVRRALSYLMIGQAELALRDAMQAQVCLPEWPTAFYMQALALSKLGMESDAQDMLNDGASFEAKKQSSWRI

SEQ ID NO: 6330 - protein, 495 aa, Quercus alba
MGCLHSKTTHLHSPDDPSSLPDSNKPDPTGNGDEVNEELQVPAFKEYGLNELRKATNGFSTDYIVSESGEKAPNVVYRGKLDSNRLVAVKRFSKQSWPDAQQFVEEAAGLGKMRHKRLVNLIGCCAEGDERLLVAEYMPNDTLSKHLFHWDKKPLPWEMRVRVAYFIAQALDHCNTENRKIYHDLNAYRVLFDEDGDPHLSSFGLMKNSRDGKSYSTNLAYTPPEFLRTGRVIPESVIYSYGTVLLDLLSGKHIPPSHALDLIRGKNVLLLMDSSLEGQYANDDATKLVELASKCLQSEPRDRPDTKFLLAAVTPLQKQKEVASHVLMGLSKNTVVMPTMLSPLGKACTRMDLTAVHDILLKTGYKDEEGAENELSFQEWTQQVQEMLNTKKFGDIAFRDKDFKSAIEYYSKLVVMMSVPSATVFARRAFSYLMNGQAELALRDAMQAQVCIPEWPTAFYLQALALSKLGMETDAQDMLNDGATFETKRQNSWRG

SEQ ID NO: 6331 - protein, 491 aa, Olea europaea
MGCFQSKTANVQSPDQEPPQPESKPDLANGDQGDQDLVPAFQEFGLADLRSATNEFSSDLIVSESGEKAPNVVYRGKLRNNRLVAIKRFSKQSWPDRQQFVAEAAGVGKVRHKRLVNLIGCCAEGDERLLVAEFMPNDTLSKHLFHWDKQPLPWEMRVRVAYHMAQALDHCNAENRKIYHDLNAYRVLFDEDGDPRLSSFGLMKNSRDGKSYSTNLAYTPPEFLRTGRVIPESVIYSYGTVLLDLLSGKHIPPSHALDLIREKNVLLLLDSSLEGQYANEDATALVELASKCLQYEARDRPDMKFLLTSVAPLQKQEVASHVLMGLTKTPVVIPTLLSPLGNACARMDLTAVHDILLKTGYKDEEGAENELSFQEWTQQVQDMLNTKKFGDIGFRDKDFKSAIDNYSKLVSMMSVPSGTVFVRRALSYLMIGQPEHALRDAMQAQVCLPEWPTAFYMQALALSKLGMETDAQDMLNDGAAFEAKKQNSRRI

SEQ ID NO: 6332 - protein, 492 aa, Tripterygium wilfordii
MGCFHSKTRHLSSPDQEPPPPEAKPDLANVETDEEGQVPPFKEYSLSELRAATNGFSSDLIVSESGEKAPNVVYRGKLKNSRLVAIKRFSRLSWPDPQQFVTEAAGLGKVRHKRVVNLIGCCAEGDERLLVAEYMPNDTLSKHLFHWEKQPLPWEMRVRVAYYIAQALDHCSAQDRKIYHDLNAYRVLFDEDGDPRLSSFGMMKNSRDGKSYSTNLAYTPPEFLRTGRVIPESVIYSYGTVLLDLLSGKHIPPSHALDLIRGKNVLLLMDSSLEGQYANEDATELVELASKCLQYEARDRPDIKFLLSAVAPLQKQTEVASHVLLGLPKTPVVPQTILSPLGKACARMDLTAVHDILLKTGYKDEEGAENELSFQEWTQQVQDMLNTKKFGDIAFRDKDFKNAIEYYSKLVSMMSVPSGTVFVRRALSYLMIGQPELALRDAMQAQVCLPEWPTAFYMQALALSKLGMDSDAQDMLNDGASFEAKKQNSWRI

SEQ ID NO: 6333 - protein, 489 aa, Prunus mume
MGCFQSKTAHLPSPDQDPPVTDPANGEELEDEQAVPAFKEFSLAELRAATNGFNSELIVSESGEKAPNVVYRGKLRNNRLVAIKRFSKQSWPDPHQFLAEAAGFGKVRHKRLVNLIGCCAEGDERLLVAEYMPNDTLSKHLFHWEKQPLPWDMRVRVAYYIAQALDHCNTENRKLYHDLNAYRVLFDEDGDPRLSSFGLIKNSRDGKSYSTNLAYTPPEFLRTGRVIPESVIYSYGTVLLDLLSGKHIPPSHALDLIRGKNLLLLMDSSLEGQYANEDATELVELASKCLQYEAKDRPEITFLLSAVAPLQKQTEVASLVLMGLTKTPVVLPTMLSPLGKACVRMDLSAVHEILLKTGYRDEEGAENELSFQEWTQQVQDMLNTKKFGDIAFRDKDFKNAVEYYSKLVSMMSVPSGTVFVRRALAYLMNGQPELALRDAMQAQVCLPEWPTAFYMQALALSKLGMETDAQDMLNDGASFEAKKQNSWRN

SEQ ID NO: 6334 - protein, 489 aa, Prunus persica
MGCFQSKTAHLPSPDQDPPVTDPANGEELEDEQAVPAFKEFSLAELRAATNGFNSELIVSESGEKAPNVVYRGKLRNNRLVAIKRFSKQSWPDPHQFLAEAAGVGKVRHKRLVNLIGCCAEGDERLLVAEYMPNDTLSKHLFHWEKQPLPWDMRVRVAYYIAQALDHCNTENRKLYHDLNAYRVLFDEDGDPRLSSFGLIKNSRDGKSYSTNLAYTPPEFLRTGRVIPESVIYSYGTVLLDLLSGKHIPPSHALDLIRGKNLLLLMDSSLEGQYANEDATELVELASKCLQYEAKDRPEITFLLSAVAPLQKQTEVASLVLMGLTKTPVVLPTMLSPLGKACVRMDLSAVHEILLKTGYRDEEGAENELSFQEWTQQVQDMLNTKKFGDIAFRDKDFKNAVEYYSKLVSMMSLPSGTVFVRRALAYLMNGQPELALRDAMQAQVCLPEWPTAFYMQALALSKLGMETDAQDMLNDGASFEAKKQNSWRN

SEQ ID NO: 6335 - protein, 498 aa, Glycine max
MGCLHSKTAHLHSPEDPPTALPDSKKPDPGNGGDDVDQECQVQAFKEYGLIELRRATNEFSTDYIVSESGEKAPNVVYRGKLENNRLVAVKRFSKLSWPDAQQFMAEAAGVGKVRHKRMVNLIGCCAEGDERLLVAEYMPNDTLSKHLFHWDKQPLPWEMRVRVAYHVAQALDHCSLENHKIYHDLNAYRILFDEDGDPRLSSFGLMKNSRDGKSYSTNLAYTPPEFLRTGRIIPESVIYSYGTVLLDLLSGKHIPPSHALDLIRGKNVLLLMDSSLEGQYANDDATKLVELASKCLQFEARERPEIKFLLTAVAPLQRQKEVASLVLMGLTKNTAVAVLPTMLSPLGKACARMDLTAVHDILLKTGYKDEEGAENELSFQEWTQQVQDILNTKKFGDIAFRDKDFKNAIEYYSKLVVMMSVPSATVFARRAFSYLMNDQAELALRDAMQAQVCIPDWPTAFYLQALALSKLGMETDAHDMLNDGAAFEAKRSNSWRG

SEQ ID NO: 6336 - protein, 494 aa, Chrysanthemum coronarium
MGCFQSKTANVQSPDQVPESKPDPGDGEQVAGQQDQEQAVPVFKEFELTELRAATNGFSSELIVSESGEKAPNVVYRGKLKNNKVVAIKRFSKLSWPDPQQFVAEAAGVGKVRHNRLVNLIGCCAEGDERLLVAEYMPNDTLSKHLFHWDKQPLPWEMRVRVAYHIAQALEHCNAENRKIYHDLNAYRVLFDEEGDPRLSSFGLMKNSRDGKSYSTNLAYTPPEFLRTGRVIPESVIYSYGTVLLDLLSGKHIPPSHALDLIRGKNVLLLMDSSLEGQYADEDATVLVELASKCLQYEGRDRPDVKFLLTAVAPLQKQKEVASHVLMGLTKTPVVVPTLLSPLGKACARMDLTAVHDILLKTGYRDEEGAENELSFQEWTQQVQDMLNTKKFGDIAFRDKDFNGSVEYYSKLVTMMSVPSGTIFVRRALSYLMIGQPELALRDAMQAQVCLPEWPTAFYMQALALSKLGMETDAQDMLNDGSSFEAKRQNSWRN

SEQ ID NO: 6337 - protein, 496 aa, Citrus sinensis
MGCFQSKTAHLASPDKEAPEAKPDLGEGEGEGEGEEGEEEQVPAFKEFVLADLRAATNGFSSELIVSESGDKAPNVVYRGRLKNNRLVAIKRFSRQSWPDPHQFVTEAAGLGNVRHKRLVNLIGCCAEGDERLLVAQYMPNDTLSKHLFHWDKQPLPWEMRVRVAYYIAQALDHCNSQNRKLYHDLNAYRVLFDEDGDPRLSSFGLMKNSRDGKSYSTNLAYTPPEFLRTGRVIPESVIYSYGTVLLDLLSGKHIPPSHALDVIRGKNLLLLMDSSLEGQYANEDATQLVELASKCLQYEAKDRPDVKFLLSAVAPLQKQTEVASHVLMGLSKAPVVLPTMLSSLGKACARMDLTAVHDILLKTGYKDEEGAENELSFQEWTQQVQDMLNTKKFGDIAFRDKDFKNAIEYYSKLVSMMSVPSGTVFVRRALSYLMIEQAELALRDAMQAQVCLPEWPTAFYMQALALNKLGMETDAQDMLNDGASFEAKKQNSWRI

SEQ ID NO: 6338 - protein, 492 aa, Ocimum basilicum
MGCLQSKTANVQSPDQEPSHSDSKPDLANGEQVDPEQVPAFKEFELAELRAATNGFSSELIVSESGEKAPNVVYRGKLRSNRLVAIKRFSKQSWPDAQQFTTEAAGVGKVRHKRLVNLIGCCAEGDERLLVAEYMPNDTLSKHLFHWDKQPLPWEMRVRVAYHMAQALDHCNAENRKIYHDLNAYRILFDEEGDPRLSSFGLMKNSRDGKSYSTNLAYTPPEFLRTGRVIPESVIYSYGTVLLDLLSGKHIPPSHALDLIRGKNVLLLMDSSLEGQYANEDATTLVELASKCLQYEAKDRPDVKFLLTAATPLQKQEVASHVLMGLTKSNPVVAPTLLSPLGKACARLDLTAVHDILLKTGYKDEEGAENELSFQEWTQQVQDMLNTKKFGDIAFRDKDFKGAIDYYSKLVSMMSVPSGTVFVRRAISYLMIGQPELALRDAMQAQVCLPEWPTAFYMQALALSKLGMETDAQDMLNDGAAFEAKKLNSWRN

SEQ ID NO: 6339 - protein, 505 aa, Cirsium arvense
MGCFQSKTANVQSPDQVPQSKPDPGDGGEQGLGLGQQDQEQAVPVFKEFELTELRAATNGFSSDLIVSESGEKAPNVVYRGKLRSNRVVAIKRFSKLSWPDPQQFVAEAAGVGKVRHDRLVNLIGCCAEGDERLLVAEYMPNDTLSKHLFHWDKQPLPWEMRVRVAYHIAQALEHCNAENRKIYHDLNAYRVLFDEDGDPRLSSFGLMKNSRDGKSYSTNLAYTPPEFLRTGRVIPESVIYSYGTVLLDLLSGKHIPPSHALDLIRGKNVLLLMDSSLEGQYADEDATAMVELASKCLQYEGRDRPDVKFLLTAVAPLQKQKEVASHVLMGLTKTPVVVPTLLSPLGKACARMDLTAVHDILLKTGYRDEEGAENELSFQEWTQQVQDMLNTKKFGDIAFRDKDFSGAVEYYSKLVTMMSVPSGTIFVRRALAYLMLGQPELALRDAMQAQVCLPEWPTAFYMQALALSKLGMETDAQDMLNDGSSFEAKRTKQLAQTKNYVICD

SEQ ID NO: 6340 - protein, 191 aa, Panax ginseng
MGCFHSKTTHLPYPDDPSKLDSVNGDNCGGEEDQDNNQVPVFKEYVLNELKKATNGFSSDCLVSESGERAPNVVYRAKLDNNRFVAVKRFSKLSWPDPQQFLAEAAGVGKLRHKRLVNLIGGCAEGDERLLVAEYMPNDTLSKHLFHWDKQPLPWEMRVRVGCHVAQALDHCNSENRKIYHDLNAYRVLFV

SEQ ID NO: 6341 - protein, 492 aa, Petroselinum crispum
MGCFSSKTAHLPSPDNPSKPESVNGDDSGVEEVEVNQVQVFKEYELNELRKATNGFSSDCIVSESGERAPNVVYRAKLENNHFVAVKRFSRQSWPDPQQFLAEAAGVGKLRHKRLVNLIGACAEGDERLLVAEYMPNDTLSKHLFHWDKQPLPWEMRVRVAYHIAQALDHCNMEDRKIYHDLNAYRVLFDEDGEPCLSSFGLMKNSRDGKSYSTNLAYTPPEFLRTGRVIPESVIYSYGTVLLDLLSGKHIPPSHALDLIRGKNVLLLMDSSMEGQYANDDATKFVELASKCLQAEARDRPDSKFLLSAVSPLQKQKEVASHVLMGLTKSAPVVPTIFSPLGKACVRMDLTAVHDILLKTGYKDEEGAENELSFQEWTQQVQEMLNTKKFGDIAFRDKDFKSAIDYYSKLVVMMPAPSATIFARRALSYLMNDQAELALRDAMQAQVCIQEWPTAFYLQALALSKLGMETDAQDMLNDGAAFDSKKQNSWRN

SEQ ID NO: 6342 - protein, 495 aa, Centaurea maculosa
MGCFQSKTANVQSPDQVPQSKPDPGDGEQQGLGQQEQEQAVPAFKEFELTELRAATNGFSSDLIVSESGEKAPNVVYRGKLRSNRVVAIKRFSKLSWPDPQQFVAEAAGVGKVRHDRLVNLIGCCAEGDERLLVAEYMPNDTLSKHLFHWDKQPLPWEMRVRVAYHIAQALEHCNAENRKIYHDLNAYRVLFDEDGDPRLSSFGLMKNSRDGKSYSTNLAYTPPEFLRTGRVIPESVIYSYGTVLLDLLSGKHIPPSHALDLIRGKNVLLLMDSSLEGQYADEDATAMVELASKCLQYEGRDRPDVKFLLTAVAPLQKQKEVASHVLMGLTKTPVVVPTLLSPLGKACARMDLTAVHDILLKTGYRDEEGAENELSFQEWTQQVQDMLNTKKFGDIAFRDKDFNGAVEYYSKLVTMMSVPSGTIFVRRALAYLMLGQPELALRDAMQAQVCLPEWPTAFYMQALALSKLGMETDAQDMLNDGSSFEAKRQNSWRN

SEQ ID NO: 6343 - protein, 494 aa, Nicotiana benthamiana
MGCLQSKFKTANVQSPDKEPSQPDSKTDLANGDQVDLDQVPAFKEFSLAELRSATNGFSSELIVSESGEKAPNVVYRGKLRCNRIVAIKRFSRQSWPDAQQFAAEAAGVGKVRHKRLVNLIGCCAEGDERLLVAEYMPNDTLSKHLFHWEKQPLPWEMRVRVAYYIAQALDHCNDENRNIYHDLNAYRVLFDKEGDPRLSSFGLMKNSRDGKSYSTNLAYTPPEFLRTGRVIAESVMYSYGTVLLDLLSGKHIPPSHALDLIRGKNALLLMDSSLEGQYVDEDATALVELASKCLQYEARDRPDIKFILNAVEPLQKQEVVASHVLMGLTKTPVVLPTMLSPLGKACARMDLTAVHDILLKTGYKDEEGAENELSFQEWTQQVQDMLNTKKFGDIAFRDKDFKSAVDYYSKLVSMMSVPSGTVFVRRALSYMMIGQPELALRDAMQAQVCLPEWPTAFYMQALALSKLGMETDAQDMLNDGASFEAKKLNSWRN

SEQ ID NO: 6344 - protein, 492 aa, Plantago ovata
MGCLQSKTANVQSPDQEPPQPDPKSDLANGEQVDTEQVPAFKEFGLAELRAATNGFSGELIVSESGEKAPNVVYRGKLRSNRLVAIKRFSKQSWPDSQQFVAEASGVGKLRHKRLANLIGCCAEGDERLLVAEYMPNDTLSKHLFHWDKQPLPWEMRVRIAYHVAQALDHCNTENRKIYHDLNAYRILFDEEGDPRLSTFGLMKNSRDGKSYSTNLAYTPPEFLRTGRVIPESVVYSYGTVLLDLLSGKHIPPSHALDLIRGKNVLMLMDSSLEGQYANEDATALVELASKCLQYEARDRPDIKFLLTSVTPLQKQQEVASLVLMGLTKTPVVLPTMLSPLGKACARMDLTAVHEILLKTGYKDEEGAENELSFQEWTQQVQDMLNTKKSGDISFRDKDFKNAIESYSKLVSMMSVPSGTVFVRRALSYLMIGQPELALRDAMQAQVCLPEWPTAFYMQALALSKLGMETDAQDMLNDGASFEAKKQNSWRN

SEQ ID NO: 6345 - protein, 498 aa, Arachis hypogaea
MGCLHSKTAHLQSPEDPPTDLPDPNKPDPGDGVGGDDGEESEVPAFKEYSLSELRRATNEFNAKNIVSESGEKAPNVVYKGKLENNRFVAVKRFSKLSWPDAQQFMVEAAGVGKVRHKRLVNLIGCCAEGDERLLVAEFMPNDTLSKHLFHWDKQPLPWEMRVRVAYHVAQALDHCSNENRKIYHDLNAYRILFDEDGDPRLSSFGLMKNSRDGKSYSTNLAYTPPEFLRTGRIIPESVIYSYGTVLLDLLSGKHIPPSHALDLIRGKNVLMLMDSSLEGQYANDDATKLVELASKCLQFEARERPDINFLLTAVTPLQKQKEVASHVLMGLTVNNTPVLPTILSPLGKACARMDLTAVHDILLKTGYKDEEGAENELSFQEWTQQVQDILNTKKFGDIAFRDKDFKNAIEYYSKLVVMMSVPSATVFARRSFSYLMNDQAELALRDAMQAQVCICDWPTAFYLQALALSKLGMDTDAQDMLNDGAAFEAKRSNSWRG

SEQ ID NO: 6346 - protein, 494 aa, Chrysanthemum coronarium
MGCFQSKTANVQSPDQVPESKPDPGDGEQVAGQQDQEQAVPVFKEFELTELRAATNGFSSELIVSESGEKAPNVVYRGKLKNNKVVAIKRFSKLSWPDPQQFVAEAAGVGKVRHNRLVNLIGCCAEGDERLLVAEYMPNDTLSKHLFHWDKQPLPWEMRVRVAYHIAQALEHCNAENRKIYHDLNAYRVLFDEDGDPRLSSFGLMKNSRDGKSYSTNLAYTPPEFLRTGRVIPESVIYSYGTVLLDLLSGKHIPPSHALDLIRGKNVLLLMDSSLEGQYADEDATVMVELASKCLQYEGRDRPDVKFLLTAVAPLQKQKEVASHVLMGLTKTPVVVPTLLSPLGKACARMDLTAVHDILLKTGYRDEEGAENELSFQEWTQQVQDMLNTKKFGDIAFRDKDFNGSVEYYSKLVTMMSVPSGTIFVRRALSYLMIGQPELALRDAMQAQVCLPEWPTAFYMQALALSKLGMETDAQDMLNDGSSFEAKRQNSWRN

SEQ ID NO: 6347 - protein, 496 aa, Citrus clementina
MGCFQSKTAHLASPDKEAPEAKPDLGEVEGEGEGEEGEEEQVPAFKEFVLADLRAATNGFSSELIVSESGDKAPNVVYRGRLKNNRLVAIKRFSRQSWPDPHQFVTEAAGLGNVRHKRLVNLIGCCAEGDERLLVAQYMPNDTLSKHLFHWDKQPLPWEMRVRVSYYIAQALDHCNSQNRKLYHDLNAYRVLFDEDGDPRLSSFGLMKNSRDGKSYSTNLAYTPPEFLRTGRVIPESVIYSYGTVLLDLLSGKHIPPSHALDVIRGKNLLLLMDSSLEGQYANEDATQLVELASKCLQYEAKDRPDVKFLLSAVAPLQKQTEVASHVLMGLSKAPVVLPTMLSSLGKACARMDLTAVHDILLKTGYKDEEGAENELSFQEWTQQVQDMLNTKKFGDIAFRDKDFKNAIEYYSKLVSMMSVPSGTVFVRRALSYLMIEQAELALRDAMQAQVCLPEWPTAFYMQALALNKLGMETDAQDMLNDGASFEAKKQNSWRI

SEQ ID NO: 6348 - protein, 505 aa, Populus trichocarpa
MGCFQSKTTHLASPDLDPPLPEEAKPDLPANDQPDSQENHDQDQLVPPFREFSLAELRGATNGFSSDLIVSESGEKAPNVVYRGKLKSNNNNSHRLVAVKRFSRLSWPDPNQFLTEASGVGKVRHNRLVNLIGCCAEGDERLLVAEYMPNDTLSKHLFHWEKQPLPWEMRVRVAYYIAQVLDHCNAQNRKIYHDLNAYRVLFDEDGDPRLSSFGLMKNSRDGKSYSTNLAYTPPEFLRTGRVIPESVVYSYGTVLLDLLSGKHIPPSHALDLIRGKNLLLLMDSSLEGQYANEDGTALVELASKCLQYESKDRPDIKFLLTAVAPLQKQKEVASHVLMGLSKTPAALPTMLSPLGKACARMDLTAVHEILLKTGYKDEEGAENELSFQEWTQQVQDMLNTKKFGDIAFRDKDFKNAIEYYTKLVSMMSVPSGTIFVRRALSYLMIGQEEHALRDAMQAQVCLPEWPTAFYMQALALSKLGMESDAQDMLNDGASFEAKKQNSWRI

SEQ ID NO: 6349 - protein, 491 aa, Musa acuminata
MGCFHSKTTNVQSPDDESLVAVKTDPLNGDTREQDQVPVFKEYGLAELRAATKGFSPETIVSESGEKAPNVVYRGKLEGGRLVAVKRFSKQSWADAQQFVAEAAGVGKLRHKRLVNLIGCCAEGDERLLVSEFMPNDTLSKHLFHWDKHPLPWQMRVRVAYYIAQALDHCNTENRRIYHDLNAYRVLFDEDGDPRLSSFGLIKNSRDGKSYSTNLAYTPPEFMRTGRVIPESVTYSYGTVLLDLLSGKHIPPSHALDLIRGKNMLLIMDSSLEGQYANEDATKLVELASTCLQFEARDRPNSKSLLSALEPLQNQKEVPSHVLMGITKATQVLPTMLAPLGKACVNMDLTAVHDILLKTGYKDEEGAENELSFQEWTQRVQEMLNTKKFGDIAFRDKDFKSAIEYYSQLVAMMSVPSATVFARRGLSYLMNGQPELALRDAMQAQVCMPEWPVAFYLQALSLSKLGMETDAQDMLNDGVALELKRQSSWRG

SEQ ID NO: 6350 - protein, 494 aa, Cichorium intybus
MGCFQSKTANVQSPDQVPESKPDPGDGEQGLGQQDQEHAVPAFKEFELTELRAATNGFSSELIVSESGEKAPNVVYRGKLRSNKVVAIKRFSKLSWPDPQQFVAEASGVGKVRHNRLVNLIGCCAEGDERLLVAEYMPNDTLSKHLFHWDKQPLPWEMRVRVAYHIAQALEHCNAENRKIYHDLNAYRVLFDEDGDPRLSSFGLMKNSRDGKSYSTNLAYTPPEFLRTGRVIPESVIYSYGTVLLDLLSGKHIPPSHALDLIRGKNVLLLMDSSLEGQYADEDATVMVELASKCLQYEGRDRPDVKFLLTAVAPLQKQKEVASHVLMGLTKTPVIVPTLLSPLGKACARMDLTAVHDILLKTGYRDEEGAENELSFQEWTQQVQDMLNTKKFGDIAFRDKDFNGAVEYYSKLVTMMSVPSGTIFVRRALSYLMIGQPELALRDAMQAQVCLPEWPTAFYMQALALSKLGMETDAQDMLNDGSSFEAKKQNSWRN

SEQ ID NO: 6351 - protein, 507 aa, Aquilegia formosa
MGCLQSKTSNVQSPDDDNEEEETIQVDLKPADADADVDVDHQVGGVVVLLDQIPIFKEYSLSELRNATNGFSSDYIVSESGEKAPNVVYRAKLENNRLVAVKRFSKLSWPDAHQFIVEAAGVGKLRHKRLVNLIGCCAEGDERLLVAEFMPNDTLSKHLFHWDKQPLPWEMRLRVTQYIAQALDHCNTENRRIYHDLNAYRILFDEDGDPRLSSFGLMKNSRDGKSYSTNLAYTPPEFLRTGRVIPESVIYSYGTILLDLLSGKHIPPSHALDLIRGKNVLLLMDSSLEGQYANEDATKLVELASKCLQSEARDRPNTKFLVTSVAPLQKQREVASYVLMGLQKNTAVLPTMLSPLGKACARMDLTAVHDILLKTGYKDEEGAENELSFQEWTQQVQDMLNTKKFGDIAFRDKDFKSAIDYYSKLVVMMSVPSATIFARRALAYLMSGQPELALRDAMQAQVCIPEWPTAFYLQALALSKLGMETDAQDMLNDGAAFESKKQNSWRG

SEQ ID NO: 6352 - protein, 494 aa, Artemisia annua
MGCFQSKTANVQSPDQVPESKPDPGDGEQVAGQQDQEHAVPVFKEFELTELRAATNGFSSELIVSESGEKAPNVVYRGKLKNNKVVAIKRFSKLSWPDPQQFVAEAAGVGKVRHNRLVNLIGCCAEGDERLLVAEYMPNDTLSKHLFHWDKQPLPWEMRVRVAYHIAQALEHCNVENRKIYHDLNAYRVLFDEDGDPRLSSFGLMKNSRDGKSYSTNLAYTPPEFLRTGRVIPESVIYSYGTVLLDLLSGKHIPPSHALDLIRGKNVLLLMDSSLEGQYADEDATVMVELASKCLQYEGRDRPDVKFLLTAVAPLQKQKEVASHVLMGLTKTPVVVPTLLSPLGKACARMDLTAVHDILLKTGYRDEEGAENELSFQEWTQQVQDMLNTKKFGDIAFRDKDFNGSVEYYSKLVTMMSVPSGTIFVRRALSYLMIGQPELALRDAMQAQVCLPEWPTAFYMQALALSKLGMETDAQDMLNDGSSFEAKRQNSWRN

SEQ ID NO: 6353 - protein, 496 aa, Fragaria vesca
MGCLQSKTAHLHSPDDPSPLPEPLKLDPADGDQAEAGDQVPAFKEYSLHELRKATNGFSSDFIVSESGEKAPNVVYKGKLENNRLVAVKRFSKQSWPDAQQFVAEAAGVGKLRHKRLVNLIGCCAEGDERLLVAQYMSNDTLSKHLFHWDKQPLPWEMRVRVAYYIAQALDHCNTENRKIYHDLNAYRVLFDEDGDPRLSSFGLMKNSRDGKSYSTNLAYTPPEFLRTGRVIPESVIYSYGTVLLDLLSGKHIPPLHALDLIRGKNVLLLLDSSLEGQYENDDATKLVELASKCLQSEARDRGDIKSLLTAVAPLQKQKEVASHVLMGLPKNKNTVVVPTMLSPLGKACARMDLTAVHDILLKTGYRDEEGAENELSFQEWTQQVQDMLNTKKFGDIAFRDKDFKNAIEYYSKLIVMMSVPSATVFARRAFSYLMNGQAELALRDAMQAQVCIPEWPTAFYLQALALSKLGMETDAQDMLNDGAAFEAKRYSIWRG

SEQ ID NO: 6354 - protein, 472 aa, Amorphophallus konjac
WGGGTRRRRDGGRAGGGAGRFREYGLAELRAATNDFSSKLIVSESGEKAPNVVYRGRLDASRVVAVKRFSKQAWPDAQQFVAEAAGVGKVRHKKLVNLIGCCAEGDERLLVAEYMPNDTLSKHLFHWDKQPLPWEMRMRVAYHIAQALDHCNIENRQIYHDLNAYRVLFDEDGDPRLSSFGLMKNSRDGKSYSTNLAYTPPEFLRTGRVIPESVIYSFGTILLDLMSGKHIPPSHALDLIRGNNMLLLLDSSLEGQYANEDATKLVELASKCLQFEPRDRPSCKFLLAAVSPLQKQTEVASHVLMGLPKVAAVLPTLLSPLGKACAKMDLTAVHDILLKTGYRDEEGAENELSFQEWTQQVQEMLNTKKFGDIAFRDKDFKNAIDYYSKLVGLMSVPSATVFARRSLSYLMNDQAELALRDAMQAQVCMPEWPTAFYLQALALSKLGMETDAQDMLNDGAAFEAKKQSGWRG

SEQ ID NO: 6355 - protein, 495 aa, Prunus persica
MGCLHSKTTHLHLSPDDPSSLPDTHKPDSANGDQAELEAQAPVFKEYSLDELRKATNGFSSECIVSESGEKAPNVVYRGKLDNNRLVAVKRFSKQSWPDAQQFVVEAVGVGKLRHKRLVNLVGCCAEGDERLLVAEYMPNDTLSKHLFHWDKKPLPWEMRVRVAYYIAQALDHCNIENRKIYHDLNAYRVLFDEDGDPRLSTFGLMKNSRDGKSYSTNLAYTPPEFLRTGRVIPESVIYSYGTVLLDLLSGKHIPPSHALDLIREKNVLLLMDSSLEGQYVNDDATKLVELASKCLQSEARDRGDIKFLLTVVAPLQKQKEAASHVLMGLPRNTVVVPTMLSPLGKACARMDLTAVHDILLKTGYKDEEGAENELSFQEWTQQVQDMLNTKKFGDIAFRDKDFKNAIEYYSKLVAMMSGPSATVFARRAFSYLMNGQAELALRDAMQAQVCIPEWPTAFYLQALALSKLGMETDAQDMLNDGAAFEAKRHNTWRS

SEQ ID NO: 6356 - protein, 203 aa, Cirsium arvense
MGCFQSKTANVQSPDQVPESKPDPGDGEQGLGQQDQEQAVPAFKEFELTELRAATNGFSSELIVSESGEKAPNVVYRGKLRSNKVVAIKRFSKLSWPDPQQFVAEAAGVGKVRHNRLVNLIGCCAEGDERLLVAEYMPNDTLSKHLFHWDKQPLPWEMRVRVAYHIAQALEHCNAENRKIYHDLNAYRVLFDEDGDPAYLVLV

SEQ ID NO: 6357 - protein, 494 aa, Cichorium intybus
MGCFQSKTANVQSPDQVPESKPDPGDGEQGLGQQDQEHAVPAFKEFELTELRAATNGFSSELIVSESGEKAPNVVYRGKLRSNKVVAIKRFSKLSWPDPQQFVAEASGVGKVRHNRLVNLIGCCAEGDERLLVAEYMPNDTLSKHLFHWDKQPLPWEMRVRVAYHIAQALEHCNVENRKIYHDLNAYRVLFDEDGDPRLSSFGLMKNSRDGKSYSTNLAYTPPEFLRTGRVIPESVIYSYGTVLLDLLSGKHIPPSHALDLIRGKNVLLLMDSSLEGQYADEDATVMVELASKCLQYEGRDRPDVKFLLTAVAPLQKQKEVASHVLMGLTKTPVIVPTLLSPLGKACARMDLTAVHDILLKTGYRDEEGAENELSFQEWTQQVQDMLNTKKFGDIAFRDKDFNGAVEYYSKLVTMMSVPSGTIFVRRALSYLMIGQPELALRDAMQAQVCLPEWPTAFYMQALALSKLGMETDAQDMLNDGSSFEAKRQNSWRN

SEQ ID NO: 6358 - protein, 496 aa, Malus domestica
MGCLHSKTAHLLRSPDHPSSLPDTHKPDPANGDPAAAADPLVPAFKEYGVDELRKATNGFSSECIVSESGEKAPNVVYRGKLDGNRLVAVKRFSKQSWPDAQQFVAEASGVGKLRHKRLVNLIGCSAEGDERLLVAEYMPNDTLSKHLFHWDKKPLPWEMRVRVAYHIAEALDHCNTENRKIYHDLNAYRVLFDEDGDPRLSTFGLMKNSRDGKSYSTNLAYTPPEFLRTGRVIPESVIYSYGTVLLDLLSGKHIPPSHALDLIRGKNVLLLMDSSLEGQYANDDATKLVELASKCLQSEARDRGDIKFLLTAIAPFQKQKEVASHVLMGLPKNTVVVPTMLSPLGKACARMDLTAVHDILLKTGYKDEEGAENELSFQEWTQQVQDMLNTKKFGDIAFRDKDFKNAIEYYSKLVAMISGPPATVFARRAFSYLMNGQAELALRDAMQAQVCIPEWPTAFYLQALALSRLGMETDAQDMLNDGAAFDTKKHNAWRN

SEQ ID NO: 6359 - protein, 491 aa, Musa acuminata
MGCFHSKTTNVQSPDDESLVAVKTDPLNGDTREQDQVPVFKEYGLAELRAATKGFSPETIVSESGEKAPNVVYRGKLEGGRLVAVKRFSKQSWADAQQFVAEAAGVGKLRHKRLVNLIGCCAVGDERLLVSEFMPNDTLSKHLFHWDKHPLPWQMRVRVAYYIAQALDHCNTENRRIYHDLNAYRVLFDEDGDPRLSSFGLIKNSRDGKSYSTNLAYTPPEFMRTGRVIPESVTYSYGTVLLDLLSGKHIPPSHALDLIRGKNMLLIMDSSLEGQYANEDATKLVELASTCLQFEARDRPNSKSLLSALEPLQNQKEVPSHVLMGITKATQVLPTMLAPLGKACVNMDLTAVHDLLLKTGYKDEEGAENELSFQEWTQRVQEMLNTKKFGDIAFRDKDFKSAIEYYSQLVAMMSVPSATVFARRGLSYLMNGQPELALRDAMQAQVCMPEWPVAFYLQALSLSKLGMETDAQDMLNDGVALELKRQSSWRG

SEQ ID NO: 6360 - protein, 893 aa, Secale cereale
MAAITAIPAFLRAAELRLLRCTLSSPISQPAPPSPPPAHPLGPAVASALAAVEAGDYAATIASAVPHIFHSSAFAEVAHGSPAQVYDDLTAAAEAFLRGDGGGAAGEGFQCRCALVLSTAVSALLAFTQQNVTGPSGKFSPFPFQTPPLDGGEYSDSGGKWDDWASDHLASFGSHVHGKFALLPFVVFAELLFTSIKGLDSSDCWSVSWWLCRISLSQQNILDELSSSLFDQVQVYKNEMLTHFGELEKVSSYWGSLLCDGEGFSFVSAAFLEAGIVEYKYGRVDASRLHLDSAQEACGIHLSLTGILGFRTIHQVDAKSQMVLVAKTSKPAADDGQSTELAGPQGDGVAFRSATSSVPDESDEFCDILRTPRLAENGNDSSSESMTSANIHISLSAIQQAAVLAQCLHVSRRSRSDEMSGWEMAPYIESIDSQDKSYFVVRSLCDVLRIRWESTRSRTKQRALLMMENLVEDIAKEFPVVSQRAKMVFGVHMPPIPALRKEYGELLISCGLLGEALNVFRELELWDNLIYCYQLSGKVADAVSLINTRLSVTPNDPRLWCSLGDATNNDDHYKKALEVSNNKSARALRSLARSAYNKNDFHTSKILWGSALALNSLYPDGWFAYGTAAWKDKDLEKAVDAFSRAVQIDPENGEAWNNIACLHMIRGKSQAAVQAFKEAVKFKRNSWEVWENYSKVALDTGNMRLTLEAVKMVLNLSSNKRFNVDLLDKVMASVEEQGTHLTQEAKSISNASDDANKETRLPNQLLDIIGDILQQIVRSGASNAEIWGLYARWHKSKGNLMACSEALLKQVRSLQGSGLWHDQKKFTKYAQASLQLCKVYIEISSTTGSRRELLSAEMHLKSSLKQATDFSGTEEYKSLNDCLDQLRGLIGAA

SEQ ID NO: 6361 - protein, 889 aa, Brachypodium distachyon
MAAFIREAELRLLRCTLPSPASQPPPPSPSQSNSLGHVAASVLAAVEAGDYAAALASAAPHLLHASATTEDLHGSPAKFYADLAAAAEVFLRGDGGGTADEGYECRCAIVLSIGVAALLAFTQQNVTGPLGKFSPFPFWTSSLDEGWNSDPGGKWDAWASDRLASFGSHVHGKFSLLQYIVFAELLFTSIKSLDSSDCWSVSWWLCRISISQQNILDELSSSLFDQLQVYKNKMLTHFGEPEKVSSYWGPLLCDGEDSSFVSAAFLEAGIVEYKYGRVDASRLHLDSAQEACGIHLSLTGILGFRTIHQVESKSQMVLVAKTTIPAGGKSTELTGAQSDGLAMRNERSSVPGESDEFCDILRMPRLAQNGNDSSSEITTCESTQISLTAIQQAAVLAQCLHVSRRSRSDEMSGWEMAPYIESIDSQDESYFAVRSLCDVLRIRWESTRSRTKQRALLMMENLVEDISKEFPVASQRAKLVFGVHMPTLPALRKEYGELLISCGVIGEALDVFKDLELWDNLIYCYRLLGKIADAVSLINDRLSVSPCDPRLWCSLGDATNNDDHYRKALEVSNNKSARALRSLARSAYNKNDFNASKILWESALALNSLYPDGWFAYGTVAWKDKDLGKAVDAFSRAVQIDPENGEAWNNIACLHMIRGKSPAAVQAFKEAVKFKRNSWEVWENYSKVALDTGNIQLTLEAVKMVLNLSLNKRFNVDLLEKAMAALDEQGTHLFDPQEAESASNTSDDASKETRRSNQLLDIIGDILQQIVRSGASNAEIWGLYARWHKNKGNLMACSEALLKQVRSLQGSGLWNDQKKFTKYAQASLQLCKVYMEISSLTGSRRELLSAEMHLKSSLKQATDFSGTEEYQALDDCLVELKDLIGAAKT

SEQ ID NO: 6362 - protein, 804 aa, Brachypodium distachyon
MKGAMQPRPFMMHGPMPPPPQQFGLVETRPPLAAMLRPRFNIPGLNPSAAAASAAGKISSTYDLVEPMRFLYVHVVKARDLPAVSPTGSIDPFVEVKLGNFKGHTSVHGANHNPSWQQVFAFSATHLQSHLLEVSIKAKDLAGGDDLIGRMAFDLSEVPVRVPPDSPLAPQWYRLEGKRGEKLPRGEIMLSVWLGTQADEAFPEAWHSDAHGAAGPAAVLSTRAKVYFSPKLVYLRVAAIGAQDLMPHDTSRPMSASVKLQLAGQVRRTRPGGPPGTPNPMWNEEFMFVASEPFDEPLVVTVEDRVAPGRDEPLGRIILPLNAAMPRHDHFGKPVEPRWYSLGRPSDDGEKKEGKFASKIQLRMSLDFGYHVLDESTYYSSDLQPSSKHTRKPSIGILEVGVLGARNLIPMKAKDGRTTDAYCVAKYGPKWVRTRTILNTLNPQWNEQYTWEVFDPCTVITVVVFDNSQIGSKSADARDESIGKVRIRLSTLETDRVYTHFYPLLALKPSGLKKTGELHLAVRFTCTAWVNMMAMYGRPLLPKMHYTQPISVMQLDYLRHQAMQIVSARLSRAEPPLRREVVEYTLDVGSHMFSLRRSKANFYRITSLFCCFAAMAKWYDGIRSWRNPITTMLVHMLFLILICYPELILPTIFLYMFMIGLWNYRYRSRHPPHMDTKLSQAEFTHPDELDEEFDTFPTNRSADIVRLRYDRLRSVGGRVQTVVGDLATQGERAHALLSWRDPRATAIFIFLSLVVAIVLYVTPFQVLLVITMLYLLRHPRFRSRMPSVPFNFYRRLPAKSDLLL

SEQ ID NO: 6363 - protein, 804 aa, Oryza sativa
MKGAMPPRPFMMPGPGGPMPPPQQFGLVETRPPLAAVLRPRFNIPGLHPSAAAASAAGKIASTYDLVESMRFLYVHVVKAKDLPAVSAAGTIDPFVEVKLGNFKGTTPVLGGNHNPSWKQVFAFSATHLQAHVLEVAVKAKDLAGGDDLIGRVGFDLSEVPIRVPPDSPLAPQWYRLENKRGEKTRGEIMLSVWLGTQADEAFPDAWHSDAHAAAGPGAVASTRAKVYFSPKLVYLRVAAIGAQDLVPLDASRPANACVKLQLAGQVRRTRPGAPPGTLNPIWNEEFMFVVSEPFDEPLFVTVEDRVGPGRDEPLGRIMLPLNAAMPRHDHFGKPVEPRWYSLARPSDDPDKKEGKFASKIQLRMSLDFGYHVLDESTYYSSDLQPSSKHTRKPSIGILELGILGARNLIPMKGKDGRTTDAYCVAKYGPKWVRTRTILNTLNPQWNEQYTWEVFDPCTVITVVVFDNNQIGKNGDARDESIGKVRIRLSTLETDRVYTHFYPLLALKPSGLKKTGELHLAVRFTCTAWVNMIALYGRPLLPKMHYTQPISVMQLDYLRHQAMQIVAARLSRAEPPLRREVVEYMLDVGSHMFSLRRSKANFYRITSLFCGFAATAKWYDGIRSWRNPITTVLVHMLFLILICYPELILPTIFLYMFMIGLWNYRYKPRHPPYMDTKLCHAEFTNPDELDEEFDSFPSSRPADIVRMRYDRLRSVGGRVQTVVGDLATQGERAHALLSWRDPRATAIFIFLSLVVAIVLYVTPFQVLLVIAMLYLLRHPRFRSRMPSVPFNFYRRLPAKSDMLL

SEQ ID NO: 6364 - protein, 809 aa, Zea mays
MKGATPPRPFMVPGPGGPMPPPQQQFGLVETRPPLAAVLRPRFNIPGLHPSAAAAAAASGAGKIASTYDLVEPMRFLYVHVVKARDLPAVSATGSIDPFVEVKLGNFKGTTPVRAASHSPSWQQVFAFSAAHLQSHLLEVALKAKDLAGDDLVGRVAFDLSEVPVRVPPDSPLAPQWYRLETKRGEKLPHGEIMLSVWLGTQADEAFPDAWHSDAHAAAGPAAVASTRAKVYFSPKLVYLRVAAIAAQDLVPHDASRPMTACVKLQLAGQVRRTRPGAPPGTPNPIWNEEFMFVASEPFDEPLLVTVEDRVAPGRDEILGRIVLPLKAAMPRHDHFGKPVEPRWYSLMRHSDDPDKKEVKFASKIQIRMSLDFGYHVLDESTYYSSDLQPSSKPARKPSIGMLELGVLGARNLIPMKPKDGRTTDAYCVAKYGPKWVRTRTILDTLNPQWNEQYTWEVFDPCTVITVVVFDNGQIGSKNGGGPDQRIGKVRIRLSTLETDRVYTHFYPLLVLHPSGLKKTGELHLAVRFTCTAWVNMMALYGRPLLPKMHYTHPIAVMQLDYLRHQAMQIVAARLSRAEPPLRREVVEYMLDVDSHMFSLRRSKANFHRITSLFFGFVAMLKWYHSIRSWCNPITTMLVHMLFLILICYPELILPTIFLYMFMIGLWNYRYRPRHPSHMDTKLSHAELTHPDELDEEFDTFPSSRPAEIVRMRYDRLRSVGGRVQAVVGDLATQGERAHALLSWRDPRATAIFIFLSLVIAVVLYVTPFQVLMVIAMLYLLRHPRFRSRMPSVPFNFYRRLPAKSDMLL

SEQ ID NO: 6365 - protein, 1009 aa, Sorghum bicolor
MKGAMPPRPFMMPGPGGPMPPPQQQFGLVETRPPLAAVLRPRFNIPGLHPSAAAAAAATGAGKIASTYDLVEPMRFLYVHVVKARDLPAVSATGAIDPFVEVKLGNFKGTTAVKAASHNPSWQQVFAFSATHLQSHLLEVALKAKDLAGDDLVGRVVFDLAEVPVRVPPDSPLAPQWYRLEAKRGDKLPHGEIMLSVWLGTQADEAFPDAWHSDAHAAAGPAAVASTRAKVYFSPKLVYLRVAAIGAQDLIPHDTSRPMSACVKLQLAGQVRRTRPGAPPGTPNPIWNEEFMFVASEPFDEPLVVTVEDRVAPGRDEMLGRIVLPLAAAMPRHDHFGKPVEPRWYSLMRPSDDPDKKEIKFASKIQIRMSLDFGYHVLDESTYYSSDLQPSSKPARKPSIGMLELGVLGARNLIPMKPKDGRTTDAYCVAKYGPKWVRTRTILDTLNPQWNEQYTWEVFDPCTVITVVVFDNGQIGKNGGGPDQRIGKVRIRLSTLETDRVYTHFYPLLVLHPSGLKKTGELHLAVRFTCTAWVNMMALYGRPLLPKMHYTQPIAVMQLDYLRHQAMQIVAARLSRAEPPLRREIVEYMLDVDSHMFSLRRSKANFHRITSLFFGFLAMLKWYDGIRSWRNPITTMLVHMLFLILICYPELILPTVFLYMFMIGLWNYRYRPRHPSHMDTKLSHAELTHPDELDEEFDTFPSSRPAEIVRMRYDRLRSVGGRVQTVVGDLATQGERAHALLSWRDPRATAIFIFLSLVVAIVLYVTPFQVLMACELVSGSDLVIGEGDDSVSAYLFKAVKNNNGTGILLLSDIFGFEDSATRDFAYRVACNGYNVLVPDLFRGNPWKLNLPFDGDSFQQWLAGHAPGRVSGDIDACTRWLVDEFKAAGVSKKLGVVGFCYGGGRLVETLARDADSCFSAGVCFYGSRMDASLGDRIAAPVLFVCGDGDPLCAVETVRELERRARGGARAAVYAGRGHGFAHRPQSVEEDADAENAFNVMRGWLHDHLLA

SEQ ID NO: 6366 - protein, 762 aa, Setaria italica
GLHPSAAAAAAASGAGKIASTYDLVEPMRFLYVNVVKARDLPVTATGAIDPFVEVKLGNFKGTTPVKAASHSPAWQQVFAFSASHLQAHVLEVAVKAKDLGGDDLVGRVGFDLAEVPVRVPPDSPLAPQWYRLETKRGEKLPHGEIMLSVWLGTQADESFPDAWHSDAHAAAGPAAVASTRAKVYFSPRLVYLRVAAMGAQDLIPHDTSRPMSACVKLQLAGQVRRTRPGAPPGAPNPIWNEEFMFVVSEPFDEPLVVTVEDRVAPGRDEMLGRIVLPLQAAMPRHDHFGKPVEPRWYNLMRPSDDPEKKEMKFASKIQIRMSLDFGYHVLDESTYYSSDLQPSSKPARKPSIGMLELGVLGARNLIPMKPKDGRTTDAYCVAKYGPKWVRTRTILDTLNPQWNEQYTWEVFDPCTVITVVVFDNGQIGSKNGGGPDQRIGKVRIRLSTLETDRVYTHFYPLLVLHPSGLKKTGELHLAVRFTCMAWVNMMALYGRPLLPKMHYTQPIPVMQLDYLRHQAMQIVAARLSRAEPPLRREVVEYMLDVDSHMFSLRRSKANFYRITSLFYGFLAMLKWYEGIRSWRNPITTMLVHMLFLILICYPELILPTFFLYMFMIGLWNYRYRPRHPSHMDTKLSHAEMTHPDELDEEFDTFPTSRPADIVRMRYDRLRSVGGRVQTVVGDLATQGERAHALLSWRDPRATAIFIFLSLVVAIVLYVTPFQVLMVITMLYLLRHPRFRSRMPSVPFNFYRRLPAKSDMLL

SEQ ID NO: 6367 - protein, 790 aa, Avena sativa
PKPAGGGAAPAPAPGSAYGLVETKPPLPAKMGPRSGAAKIASTYDMVEPMKYLYVSVVKARDLPTMDITGSLDPYVEVKLGNFKGVTRHLQKNSNPVWRQTFAFSGAHLQASQIEVIVKDKDVVQDDFVGRVIFDMSDVPSRLPPDSPLAPQWYRLSDAHGNKLRHGSHHGFGEIMLAVWLGTQADEAFPEAWHSDAHSLSQEGLTNTRAKVYYSPKLIYLKFNVIAAQDLVAADKDRPLAATITKIQMGNQIRRTKPQSGTANPTWNEEFMFVASEPFDEPLFITVEDRVGPGRDEPLGRIVLPLNVAMPRHDHYGKPVEPRWFSLGRPSDDPDKKEGKFASKIQIRMSLDFGYHVLDESTYYSSDLQPSSKHTRKPSIGILEVGVLGARNLIPMKAKDGRSTDAYCVAKYGPKWVRTRTILNTLNPQWNEQYTWEVFDPCTVITVVVFDNSQIASKNGEARDEHIGKVRIRLSTLETDRVYTHFYPLLALKPSGLKKTGELHLAVRFTCTAWVNMIAMYGRPLLPKMHYSANPISVMQLDYLRHQATQIVSARLSRAEPPLRREVVEYTLDVGSHMFSLRRSKANFYRITSLFYGCAAMAKWYDGIRSWRNPITTMLVHMLFLILICYPELILPTIFLYMFMIGLWNYRFRSRHPPHMDTKLSQAEFTHPDELDEEFDTFPTNRPADIVRLRYDRLRSVGGRVQTVVGDLATQGERAHALLSWRDPRATAIFIFLSLVVAIVLYVTPFQVLMVITMLYLLRHPRFRSRMPSVPFNFYRRLPAKSDLLI

SEQ ID NO: 6368 - protein, 151 aa, Secale cereale
MSIVRRSNVFDPFADLWADPFDTFRSIVPAISGNNSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIEISG

SEQ ID NO: 6369 - protein, 151 aa, Avena sativa
  Sequence also found in Organisms: Secale cereale, Triticum aestivum
MSIVRRSNVFDPFADLWADPFDTFRSIVPAISGGSSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIEISG

SEQ ID NO: 6370 - protein, 151 aa, Triticum aestivum
MSIVRRSNVFDPFADLWADPFDTFRSIVPAISGGNSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIQISG

SEQ ID NO: 6371 - protein, 150 aa, Hordeum vulgare
MSIVRRSNAFDPFADLWADPFDTFRSIVPAFSSNSETAAFANARVDWKETPEAHVFKADLPGVKKEEVKVEVEDGNVLVVSGERTKEKEDKNDKWHRVERSSGKFVRRFRLPEDAKVEEVKAGLENGVLTVTVPKTEVKKPEVKAIEISG

SEQ ID NO: 6372 - protein, 151 aa, Secale cereale
MSIVRRSNVFDPFADLWADPFDTFRSIVPAISGGSSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIEIAG

SEQ ID NO: 6373 - protein, 151 aa, Secale cereale
MSIVRRSNVFDPFADLWADPFDTFRSIVPAISGGSSETAAFANARMDWKETPEAHVFKADLPGVKKEEVKVEVEDGNMLVVSGERTKEKEDKNDKWHRVERSSGKFVRRFRLPEDAKVEEVKAGLENGVLTVTVPKAEVKKPEVKAIEISG

SEQ ID NO: 6374 - protein, 151 aa, Secale cereale
MSIVRRSNVFDPFADLWADPFDTFRSIVPVISGGNSETAAFANARVDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIEISG

SEQ ID NO: 6375 - protein, 151 aa, Triticum aestivum
MSIVRRSNVFDPFADLWADPFDTFRSIVPAISGGSSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIQISG

SEQ ID NO: 6376 - protein, 151 aa, Pseudoroegneria spicata
MSIVRRSNVFDPFADLWADPFDTFRSIVPAISGGNSETAPFANARVDWKETPEAHVFKADLPGVKKEEVKVEVEDGNVLVVSGERTKEEEDKNDKWHRVERSSGKFVRRFRLPEDAKVEEVKAGLENGVLTVTVPKAEVKKPEVKAIEISG

SEQ ID NO: 6377 - protein, 63 aa, Secale cereale
MSIVRRSNVFDPFADLWADPFDTFRSIVPAISGGNSETAAFANARVDWKETPEAHVFKADSPA

SEQ ID NO: 6378 - protein, 64 aa, Secale cereale
MSIVRRSNVFDPFADLWADPFDTFRSIIPAISGGNSETAVFANARMDWKETPEAHVGQGLTSPA

SEQ ID NO: 6379 - protein, 151 aa, Secale cereale
MSIVRRSNVFDPFADLWADPFDTFRSIVPAISGGNNETAVFANARVDWKETPEAHVFKADLPGVKKEEVKVEVEDGNVLVVSGERTKEKEDKNDKWHRVERSSGKFVRRFRLPEDAKVEDVKAGLENGVLTVTVPKAEVKKPEVKAIEISG

SEQ ID NO: 6380 - protein, 151 aa, Secale cereale
MSIVRRSNVFDPFADLWADPFDTFRSIVPAISGGSNETAAFANARVDWKETPEAHVFKADLPGVKKEEVKVEVEDGNVLVVSGERTKEKEDKNDKWHRVERSSGKFVRRFRLPEDAKVEEVKAGLENGVLTVTVPKAQVKKPEVKAIEISG

SEQ ID NO: 6381 - protein, 151 aa, Secale cereale
MSIVRRSNMFDPFADLWADPFDTFRSIIPAISGGNSETAAFANARMDWKETPEAHVFKADLPGVKKEEVKVEVEDGNVLVVSGERTKEKEDKNDKWHRVERSSGKFVRRFRLPEDAKVEEVKAGLENGVLAVTVPKAQVKKPEVKAIEISG

SEQ ID NO: 6382 - protein, 151 aa, Secale cereale
MSIVRRSNVFDPFADLWADPFDTFRSIVPAISGGSSETAAFANARVDWKETPEAHVFKADLPGVKKEEVKVEVEDGNMLVVSGERTKEKEDKNDKWHRVERSSGKFVRRFRLPEDAKVEEVKAGLKNGVLTVTVPKAEVKKPEVKAIEISG

SEQ ID NO: 6383 - protein, 151 aa, Triticum aestivum
MSIVRRSNVFNPFADLWADPFDTFRSIVPAISGGNSETAAFANARVDWKESPEAHVFKADLPGVKKEEVKVELEDGNVLVVSGERTKEKEDKNDKWHRVERSSGKFVRRFRLPEDAKVEEVKAGLENGVLTVTVPKAEVKKPEVKAIEISG

SEQ ID NO: 6384 - protein, 151 aa, Triticum aestivum
MSIVRRSSVFDPFADLWADPFDTFRSIIPAISGGNSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKAQVKKPEVKAIQISG

SEQ ID NO: 6385 - protein, 151 aa, Hordeum vulgare
MSIVRRSNVLDPFADLWADPLDTFRSIFPAISGGNSETAAFANARMDWKETPEAHVFKADLPGVKKEEVKVEVEDGNVLIVSGERTKEKEDKNDKWHRVERSSGKFVRRFRLPEDAKVDEVKAGLENGVLTVTVPKAEVKKPEVKAIEISG

SEQ ID NO: 6386 - protein, 151 aa, Triticum aestivum
MSIVRRSNVFDPFADLWADPFDTFRSIVPAISGGSSETAAFANARVDWKETPEAHVFKVDLPGVKKEEVKVEVEDGNVLVVSGERSREKEDKNDKWHRVERSSGKFVRRFRLPEDAKVEEVKAGLENGVLTVTVPKAEVKKPEVKAIEISG

SEQ ID NO: 6387 - protein, 153 aa, Secale cereale
MSIVRRSNVFDFDPFADLWADPFDTFRSIVPAISGGSNETAAFANARVDWKETPEAHVFKADLPGVKKEEVKVEVEDGNVLVVSGERTKEKEDKNDKWHRVERSSGKFVRRFRLPEDAKVEEVKAGLENGVLTVTVPKAQVKKPEVKAIEISG

SEQ ID NO: 6388 - protein, 147 aa, Hordeum vulgare
MSIVRRSNAFDPFADLWADPFDTFRSIVPAFSSNSETAAFANARVDWKETPEAHVFKADLPGVKKEEVKVEVEDGNVLVVSGERTKEEEDKNDKWHRVERSSGKFVRRFRLPEDAKVEEVKAGLENGVLTVTVPKAEVKKPEVKAIE

SEQ ID NO: 6389 - protein, 152 aa, Hordeum vulgare
MSIVRRSNVFDPLAGLWADPFDAFRSIVPPAIAGGNSETAAFASARVDWKETPEAHVFKADLPGVKKEEVKVEVEDGNVLVVSGERTKEKEDKNDKWHRVERSSGKFVRRFRLPEDAKVEEVKAGLENGVLTVTVPKAQVKKPEVKAIEISG

SEQ ID NO: 6390 - protein, 148 aa, Hordeum vulgare
MSIVRRSNVLDPFADLWADPLDTFRSIFPAISGGNSETAAFANARMDWKETPEAHVFKADLPGVKKEEVKVEVEDGNVLIVSGERTKEKEDKNDKWHRVERSSGKFVRRFRLPEDAKVDEVKAGLENGVLTVTVPKAEVKKPEVKAIE

SEQ ID NO: 6391 - protein, 149 aa, Festuca arundinacea
MSIVRRSNVFDPFADLWANPFDAFRSIVPTMSDSDTTAFANARMDWKETPEAHVFKADLPGVKKEEVKVEVEDGNVLVVSGERTKEKEDKNEKWHRVERSSGKFVRRFRLPENAKVEEVKAGLENGVLTVTVPKAEVKKPEVKAIEISG

SEQ ID NO: 6392 - protein, 99 aa, Hordeum vulgare
MSIVRRSNVFDPFADLWADPFDTFRSIIPAISGNSETAAFANARMDWKETPEAHVFKADLPGVKKEEVKVEASSAASAVRRRRTRMISGTVWSAAAAGL

SEQ ID NO: 6393 - protein, 151 aa, Avena sativa
MSMVRRSNVFDPFSMDLWADPFEAFRSIVPAASGNSETAAFANARVDWKETPEAHVFKADLPGVKKEEVKVEVEDGNVLVVSGERTKEKEDKNDKWHRVERSSGKFARRFRLPDNAKVEEVKAGLENGVLTVTVPKAEVKKPETKAIEISG

SEQ ID NO: 6394 - protein, 149 aa, Hordeum vulgare
MSIVRRSNVFDPLAGLWADPFDAFRSIVPPAIAGGNSETAAFASARVDWKETPEAHVFKADLPGVKKEEVKVEVEDGNVLVVSGERTKEKEDKNDKWHRVERSSGKFVRRFRLPEDAKVEEVKAGLENGVLTVTVPKAQVKKPEVKAIE

SEQ ID NO: 6395 - protein, 151 aa, Festuca arundinacea
MSIVRRNSVFDPFSFDLWADPFDAFRSIVPAASGNSETAAFANARVDWKETPEAHVFKADLPGVKKEEVKVEVEDGNVLVVSGERSREKEDKNDKWHHVERSSGKFVRRFRLPENAKVEEVKAGLENGVLTVTVPKVEVKKPEVKAIDISG

SEQ ID NO: 6396 - protein, 139 aa, Secale cereale
FADLWADPFDTFRSIVPAISGGSSETAAFANARMDWKETPEAHVFKADLPGVKKEEVKVEVEDGNVLVVSGERTKEKEDKNDKWHRVERSSGKFVRRFRLPEDAKVEEVKAGLENGVLTVTVPKAEVKKPEVKAIEISG

SEQ ID NO: 6397 - protein, 151 aa, Festuca arundinacea
MSIVRRSSVFDPFSLDLWADPFDAFRSIVPAVSGNSEAAAFTNARMDWKETPKAHVFKADLPGVKKEEVRVEVEDGNVLVVSGERTRDKEDKNDKWHRVERSSGKFVRRFRLPENAKVDEVKAGLENGVLTVTVPKAEVKKPEAKAIEISG

SEQ ID NO: 6398 - protein, 149 aa, Avena sativa
MSIVRRSNVFGPFADFWVDPFNAFRSIVPAASDSDTAAFVNARMDWKETPEAHVFKADLPGVKKEEVKVEVEDGNMLVVSGERTMEKEDKNDKWHRVERSSGKFVRRFRLPENVKVEEVKAGLENGVLTVTVPKAEVKKPEVKAIEISG

SEQ ID NO: 6399 - protein, 149 aa, Lolium multiflorum
MSIVRRSNVFDPFASLWADPFDAFRSIVPDMSDSDTAAFANARMDWKETPEAHVFKADLPGVKKEEVKVEVEDGNILVVSGERTKEKEDKNEKWHHVERSSGKFVRRFRLPENTKIEEVKAGLENGVLTVTVPKVETKKPEVKAIEISG

SEQ ID NO: 6400 - protein, 151 aa, Avena sativa
MSIVRRSNVFDPFSMDLWADPFDAFRSIIPAASGNSEMAAFTNARFDWKETPEAHVFKADLPGVKKEEVKVEVEDGNVLLVSGERSREKEDKNDKWHHVERSSGKFVRRFRLPENAKVDEVKAGLENGVLTVTVPKAEIKKPEVKAIEISG

SEQ ID NO: 6401 - protein, 151 aa, Festuca arundinacea
MSIVRRSNVIDPFSLDLWADPFEALRSIVPAASGNNETAAFANARVDWKETPEAHVFKADLPGVKKEEVKVEVEDGNVLVVSGERSREKEDKNDKWHHVERSSGKFVRRFRLPENAKVEEVKAGLENGVLTITVPKVEAKTPEVKAIEISG

SEQ ID NO: 6402 - protein, 151 aa, Festuca arundinacea
MSIVRRSNVFDPFSLDLWADPFDSFRSIIPAVSGNNDTAAFANARVDWKETPEAHVFKADLPGVKKEEVKVEVEDGNVLVVSGERSREKEDKNDTWHRVERSSGKFVRRFRLPENAKVEDVKAGLENGVLTVTVPKVDMKKPEVKAIDISG

SEQ ID NO: 6403 - protein, 151 aa, Avena sativa
MSIVRRSSVFDPFSMDLWADPFDAFRSILPAAAGNSETAAFTNARFDWKENPEAHVFKADLPGMKKEEVKVEVEDGNVLVVSGERTKEKEDKNDRWQHVERSSGKFVRRFRLPENAKVEEVKAGLENGVLTVTVPKAEIKKPEVKAIEISG

SEQ ID NO: 6404 - protein, 152 aa, Avena sativa
MSMVRRSNVFGPFADLWVDPFNAFRSIIVPAAASSDSDTAAFVNARMDWKETPEAHVFKADLPGVKKEEVKVEVEDGNTLVVSGERSREKEDKNDKWHRVERSSGKFVRRFRLPENAKVEEAKAGLENGVLTVTVPKAEVKKPEAKAIEISG

SEQ ID NO: 6405 - protein, 151 aa, Avena sativa
MSMVRRSNVFDPFSMDLWADPFEAFRSIIPAASGNSETAAFANARVDWKETPEAHVFKADLPGVQKEEVKVELEDDNVLVVSGERTKEKEDNNDKWHRMERSSGKFVRRFRLPDNAKVEEAKAGLENGVLTVTVPKAEVKKPETKAIEISG

SEQ ID NO: 6406 - protein, 147 aa, Brachypodium distachyon
MSLVRRSAFDPFADFWDPLDVFRSIVPAASGSETAAFANARVDWKETPEAHVFKADLPGVKKEEVKVEVEDGNVLVISGERSKEKEEKSDKWHRVERSSGAFVRRFRLPENAKVEQVKAGLENGVLTVTVPKAEVKKPEVKAIEISG

SEQ ID NO: 6407 - protein, 149 aa, Festuca arundinacea
MSIVRRSNVFDPFTDLWVDPFDAFRSIIPAASDSDTVAFANVRMDWKETPEAHVFKADLPGVKKEEVKLEVEDGNVLVVSGERTKEKEDKNDKWHRVERSSGKFVRRFRLPENAKLEEVKAGLENGVLTVTVPKAEIKKPKVKPIKISG

SEQ ID NO: 6408 - protein, 152 aa, Avena sativa
MSMVRRSNAFDPFADLWVDPFHAFRSIVPAAASSDSDTAAAFVNARMDWKETPEAHVFKADLPGVKKEEVKVEVEDGNTVVVSGERSREKEDKNDKWHRVERSSGKFVRRFRLPENAKVEEAKAGLENGVLTVTVPKAEVKKPEAKAIEISG

SEQ ID NO: 6409 - protein, 151 aa, Panicum virgatum
MSLVRRSNVFDPFADFWDPFDGVFRSLVPSVAPSGRDTAAFANARIDWKETPEAHVFKADLPGVKKEEVKVEVEDGNVLVISGERSKEKEDKNDKWHRVERSSGKFLRRFRLPENAKTDEVKAGLENGVLTVTVPKAEVKKPEVKAIEISG

SEQ ID NO: 6410 - protein, 149 aa, Festuca arundinacea
MSLVRQSNVFNPFADLWVDPFKAFRSVIPAASDSDTAAFVNAQMDWKETPEAHVFKADLPGVKKEEVKVEVEDGNVLVVSGERTKEKEDKNDKWHRVERSKGKFVRRFRLPENAKVEEVKAGMENGVLTITVPKAEVKKPQVKAIEISG

SEQ ID NO: 6411 - protein, 153 aa, Brachypodium distachyon
MSLVRRGSVFDPFSQDLWDPIDSIFRSIVPAAAASSDFDTAAFVNARMDWKETPEAHVFKADLPGVKKEEVKVEVEDGNVLVVSGERSREKEDKNDKWHRVERSSGKFVRRFRLPENAKVEQVKAGLENGVLTVTVPKSEVKKPEVKAIEISG

SEQ ID NO: 6412 - protein, 151 aa, Sorghum bicolor
MSLVRRSNVFDPFSLDLWDPLDNMFRSIVPSASGDSETAAFANARIDWKETPEAHVFKADLPGVKKEEVKVEVEDGNVLVISGQRSREKEDKNDKWHRVERSSGQFLRRFRLPENAKTEEVKAGLENGVLTVTVPKAEEKKPEVKAIEISG

SEQ ID NO: 6413 - protein, 150 aa, Saccharum officinarum
MSLVRRSSVFDPFSLDLWDPFDNMFRSIVPSASGDSETAAFANARIDWKETPEAHVFKADLPGVKKEEVKVEVEDGNVLVISGERSKEEDKNDKWHRVERSSGKFMRRFRLPENAKTEEVKAALENGVLTVTVPKAEVKKPEVKSVEISG

SEQ ID NO: 6414 - protein, 144 aa, Brachypodium distachyon
MSLVRRSAFDPFADFWDPLDVFRSIVPAASGSETAAFANARVDWKETPEAHVFKADLPGVKKEEVKVEVEDGNVLVISGERSKEKEEKSDKWHRVERSSGAFVRRFRLPENAKVEQVKAGLENGVLTVTVPKAEVKKPEVKAIE

SEQ ID NO: 6415 - protein, 150 aa, Setaria italica
MSLVRRSNVFDPFADFWDPFDVFRSLVPSVASSDRDTAAFANARVDWKETPEAHVFKADLPGVKKEEVKVEVEDGNILVISGERSKEKEDKNDKWHRVERSSGKFLRRFRLPEDAKTDQVKAGMENGVLTVTVPKAEVKKPEVKAIEISG

SEQ ID NO: 6416 - protein, 149 aa, Setaria italica
MSLVRRSNVFDPFADFWDPFDVFRSVVPAASPDRDAAAFAAARIDWKETPEAHVFKADLPGVKKEEVKVEVEDGNVLVISGERSKEKEDKNDKWHRVERSSGKFLRRFRLPENAKTDQVKAGLENGVLTVTVPKAEVKKPEVKAIEISG

SEQ ID NO: 6417 - protein, 149 aa, Panicum virgatum
MSLVRRSNVFDPFADFWDPFDVFRSVVPAASTDRDTAAFANARIDWKETPEAHVFKADLPGVKKEEVKVEVEDGNVLVISGERSKEEEDKYDKWHRVERSSGKFLRRFRLPENAKTDQVKAGLENGVLTVTVPKAEVKKPEVKAIEISG

SEQ ID NO: 6418 - protein, 156 aa, Zea mays
MSLVSRRSSNVFDPFSLDLWWDPFDMFRSIVPSAASSGGGSETAAFANARVDWKETPEAHVFKADLPGVKKEEVKVEVEDGNVLVISGKRSREEEDKNDKWHRVERSSGQFMRRFRLPENAKVDEVKAGLENGVLTVTVPKTEVKKPEVKAIEISG

SEQ ID NO: 6419 - protein, 152 aa, Zea mays
MSLVRRSNVFDPFSMDLWDPFDTMFRSIVPSATSTNSETAAFASARIDWKETPEAHVFKADLPGVKKEEVKVEVEDGNVLVISGQRSREKEDKDDKWHRVERSSGQFVRRFRLPENAKVDQVKAGLENGVLTVTVPKAEEKKPEVKAIEISG

SEQ ID NO: 6420 - protein, 150 aa, Cynodon dactylon
MSLVRRSNVFDPFADFWDPFDVFRSVVPAAASSDSNTAAFANARIDWKETPEAHVIKADIPGVKKEEVKVEVEDGNVLVISGERCKEKEDKDDKWHRIERSSGKFMRRFRLPENAKVDEVKAGLENGVLTVTVPKAEVKKPEVKTIQISG

SEQ ID NO: 6421 - protein, 149 aa, Panicum virgatum
MSLVRRSNVFDPFADFWDPFDVFRSVVPAASNDRDTVAFAGARIDWKETPEAHVFKADLPGVKKEEVKVEVEDGNVLVISGERSREKEDKNDKWHRVERSSSKFLRRFRLPENAKTEEVKAGLENGVLTITVPKAEVKKPEVKAIEISG

SEQ ID NO: 6422 - protein, 151 aa, Setaria italica
MSLVRRSNVFDPFSLDLWDPFDNMFRSIVPSAGSDSDTAAFAAARIDWKETPEAHVFKADLPGVKKEEVKVEVEDGNVLVISGQRSKEKEDKNDRWHRVERSSGQFMRRFRLPENAKTEQVKAGLENGVLTVTVPKAEEKKPEVKAIEISG

SEQ ID NO: 6423 - protein, 151 aa, Setaria italica
MSLVRRSNVFDPFSMDLWDPFDNMFRSIVPSAGSDSDTAAFANARIDWKETPEAHVFKADLPGVKKEEVKVEVEDGNVLVISGQRSKEKEDKNDRWHRVERSSGQFMRRFRLPEDAKTEQVKAGLENGVLTVTVPKAEGKKPEVKSIQISG

SEQ ID NO: 6424 - protein, 148 aa, Sorghum bicolor
MSLVRRSNVFDPFSLDLWDPFDNMFRSIVPSASGDSETAAFANARIDWKETPEAHVFKADLPGVKKEEVKVEVEDGNVLVISGQRSREKEDKNDKWHRVERSSGQFLRRFRLPENAKTEEVKAGLENGVLTVTVPKAEEKKPEVKAIE

SEQ ID NO: 6425 - protein, 152 aa, Saccharum officinarum
MSLVRRSNVFDPFSMDLWDPFDNMFRSIVPSASSTDSETAAFANARIDWKETPEAHVFKADLPGVKKEEVKVEVEDGNVLVISGQRSREKEDKNDKWHRVERSSGQFMRRFRLPENAKTEEVKAALENGVLTVTVPKAEVKKPEVKSIQISG

SEQ ID NO: 6426 - protein, 152 aa, Saccharum officinarum
MSLVRRSTNVFDPFADFWDPFDVFRSVVPAAAASADRDTAAFTNARIDWKETPEAHVFKADLPGVKKEEVKVEVEDGNVLVISGERSKEKEDKNDKWHRVERSSGKFMRRFRLPENAKTEEVKAALENGVLTVTVPKAEVKKPEVKSIQISG

SEQ ID NO: 6427 - protein, 151 aa, Panicum virgatum
MSLVRRGNVFDPFSMDLWDPFDSMFRSIVPSSSSDSDTAAFANARIDWKETPEAHVFKADFPGVKKEEVKVEVEDGNVLVISGQRSKEKEDKNDKWHRVERSSGQFMRRFRLPEDAKVEQVKAGLENGVLTVTVPKAEGKKPEVKSIQISG

SEQ ID NO: 6428 - protein, 152 aa, Panicum virgatum
MSLVRRSNVFDPFSMDLWDPFDSMFRSVVPSSSSSDSDTAAFANARIDWKETPEAHVFKADLPGVKKEEVKVEVEDGNVLVISGQRSKEKEDKNDRWHRVERSSGQFMRRFRLPEDAKVEQVKAGLENGVLTVTVPKAEGKKPEVKSIQISG

SEQ ID NO: 6429 - protein, 140 aa, Avena sativa
PFSMDLWADPFDAFRSIIPAASGNGETAAFATARFDWKETPEAHIFKADLPGVKKEEVKVEVEDGNVLVVSGERTKEKEDKNDKWHRVERSSGKFVRRFRLPENAKVEEVKAGLENGVLTVTVPKAEVKKPETKAIEISG

SEQ ID NO: 6430 - protein, 150 aa, Sorghum bicolor
MSLVRRSTNVFDPFADFWDPFDVFRSIVPAASTDRDTAAFANARIDWKETPEAHVFKADVPGVKKEEVKVEVEDGNVLVISGERRKEKEDKDDKWHRVERSSGRFMRRFRLPENAKTEEVKAGLENGVLTVTVPKAEVKKPEVKSVEIAG

SEQ ID NO: 6431 - protein, 148 aa, Panicum virgatum
MSLVRRSNVFDPFADFWDPFDGVFRSLVPSVAPSGRDTAAFANARIDWKETPEAHVFKADLPGVKKEEVKVEVEDGNVLVISGERSKEKEDKNDKWHRVERSSGKFLRRFRLPENAKTDEVKAGLENGVLTVTVPKAEVKKPEVKAIE

SEQ ID NO: 6432 - protein, 150 aa, Panicum virgatum
MSLARRSNVFDPFADFWDPFDVFRSVVPAASTDRDTVAFANARIDWKETPEAHVFKADLPGVKKEEVKVEVEDGNVLVISGERSKEEEDKNDKWHRVERSSGKFLRRFRLPENAKTDQQVKAGLENGVLTVTVPKAEVKKPEVKAIEISG

SEQ ID NO: 6433 - protein, 145 aa, Festuca arundinacea
MSMVRRCPFADLWVDPFDGFCSIVPASWDSDTAGFPNARVDWKETPEAHVFKADLPGVKKEEVKVEVEDGNVLVVSGERTKEKEDKKEKWHRVERSSGKFVRRFQLPENAKLEEVKAGLENGVLTVTVPKVEVKKPEVKAIEISG

SEQ ID NO: 6434 - protein, 154 aa, Brachypodium distachyon
MSLVRRSSVFDPRSDFWFDPMDTIDGIFRSVVPAAATDSDAAAFANARMDWKETPEAHVFKADLPGVKKEEVKVEVEDGNVLVVSGERSKEKEDKNDKWHRVERSSGKFVRRFRLPDNAKVEQVKAGLENGVLTVTVPKAEVKKPQVKAIEISG

SEQ ID NO: 6435 - protein, 150 aa, Cenchrus ciliaris
MSLVRRGNVFDPFSMDLWDPFDNMFRSIVPSSSSSDTAAFANARIDWKETPEVHVFKADLPGVKKEEVKVEVEDGNVLVISGQRSKEKEDKNDRWHRVERSSGQFVRRFRLPEDAKTDQVNAGLENGVLTVTVPKAEGKKPEVKAIEISG

SEQ ID NO: 6436 - protein, 152 aa, Zea mays
MSLVRRSNVFDPFSMDLWDPFDTMFRSIVPSATSTNSETAAFASARIDWKETPEAHVFKADLPGVKKEEVKVEVEDGNMLVISGQRSREKEDKDDKWHRVERSSGQFVRRFRLPENTKVDQVKAGLENGVLTVTVPKAEEKKPEVKAIEISG

SEQ ID NO: 6437 - protein, 150 aa, Oryza sativa
MSLVRRSNVFDPFSLDLWDPFDSVFRSVVPATSDNDTAAFANARIDWKETPESHVFKADLPGVKKEEVKVEVEEGNVLVISGQRSKEKEDKNDKWHRVERSSGQFMRRFRLPENAKVDQVKAGLENGVLTVTVPKAEVKKPEVKAIEISG

SEQ ID NO: 6438 - protein, 152 aa, Sorghum bicolor
MSLVRRSNVFDPFSLDLWDPLDNMFRSIVPSAASGDSETAAFANARIDWKETPEAHVFKADLPGVKKEEVKVEVEDGNVLVISGQRSREKEDKNDKWHRVERSSGQFTRRFRLPENAKTEEVKAGLENGVLTVTVPKAEVKKPEVKSIQISG

SEQ ID NO: 6439 - protein, 149 aa, Sorghum bicolor
MSLVRRSTNVFDPFADFWDPFDVFRSIVPAASTDRDTAAFANARIDWKETPEAHVFKADVPGVKKEEVKVEVEDGNVLVISGERRKEKEDKDDKWHRVERSSGRFMRRFRLPENAKTEEVKAGLENGVLTVTVPKAEVKKPEVKSVEIA

SEQ ID NO: 6440 - protein, 125 aa, Avena sativa
MSIVRRSNVFDPLADLWADPFDTFRSIVPAISGGNSETAAFANARMDWKETPEAHVFKADLPGVKKEEVKVEVEDGNVLVVSGERTKEEEDKNDKWHRVERSSGKFVRRFRLARGRQGGGGERPV

SEQ ID NO: 6441 - protein, 146 aa, Setaria italica
MSLVRRSNVFDPFADFWDPFDVFRSVVPAASPDRDAAAFAAARIDWKETPEAHVFKADLPGVKKEEVKVEVEDGNVLVISGERSKEKEDKNDKWHRVERSSGKFLRRFRLPENAKTDQVKAGLENGVLTVTVPKAEVKKPEVKAIE

SEQ ID NO: 6442 - protein, 150 aa, Pennisetum glaucum
MSLVRRSSVFDPFSMDLWDPFDNMFRSIVPSSSSDSDTAAFAAARIDWKETPEAHVFKADLPGVKKEEVKVEVEDGNVLVISGERSKEKEDKNDKWHRVERSSGKFRRRFRLPENAKTDQVKAGMENGVLTVTVPKAEEKKPEVKSIEIS

SEQ ID NO: 6443 - protein, 150 aa, Oryza sativa
MSLVRRSNVFDPFSLDLWDPFDSVFRSVVPATSDNDTAAFANARIDWKETPESHVFKADLPGVKKEEVKVEVEEGNVLVISGQRSKEKEDKNDKWHRVERSSGQFMRRFRLPENAKVDQVKAGMENGVLTVTVPKAEVKKPEVKAIEISG

SEQ ID NO: 6444 - protein, 152 aa, Panicum virgatum
MSLVRRSNVFDPFSMDLWDPFDSMFRSVVPSSSSSDSDTAAFANARIDWKETPEAHVFKADLPGVKKEELKVEVEDGNVLVISGQRSKEKEDKNDRWHRVERSSGQFMRRFRLPEDAKVEQVKAGLENGVLTVTVPKAEGKKPVVKSIQISG

SEQ ID NO: 6445 - protein, 149 aa, Oryza sativa
MSLVRRSNVFDPFADFWDPFDGVFRSLVPATSDRDTAAFANARVDWKETPESHVFKADLPGVKKEEVKVEVEEGNVLVISGQRSKEKEDKNDKWHRVERSSGQFMRRFRLPENAKVDQVKASMENGVLTVTVPKAEVKKPEVKAIEISG

SEQ ID NO: 6446 - protein, 147 aa, Avena sativa
MSIVRRCPFFSDLWVDPFDAFRSIIPAADNNDATAAFVNARVDWKETPEAHVFKADLPGVKKEEVKVEVEDGNVLVVSGERSREKEDKNDKWHHVERSSGKFVRRFRLPENSKVEEVKAGLEDGVLTVTVPKAEVKKPVVKAIDISG

SEQ ID NO: 6447 - protein, 146 aa, Panicum virgatum
MSLVRRSNVFDPFADFWDPFDVFRSVVPAASNDRDTVAFAGARIDWKETPEAHVFKADLPGVKKEEVKVEVEDGNVLVISGERSREKEDKNDKWHRVERSSSKFLRRFRLPENAKTEEVKAGLENGVLTITVPKAEVKKPEVKAIE

SEQ ID NO: 6448 - protein, 152 aa, Sorghum bicolor
MSLVRRSNIFDPFADFWDPFDGVFRSLVVPSVASSGRDTAAFANARIDWKEMPEAHVFKADLPGVKKEEVKVEVEDGNVLVISGERSKEKEDKNDKWHRVERSSGKFMRRFRLPENAKTDQVNAGLENGVLTVTVPKAEVKKPEVKTIEISG

SEQ ID NO: 6449 - protein, 149 aa, Sorghum bicolor
MSLVRRSNVFDPFSMDLWDPFDNMFRSIVPSAASGDSETAAFANARIDWKETPEAHVFKADLPGVKKEEVKVEVEDGNVLVISGQRSREKEDKNDKWHRVERSSGQFTRRFRLPENAKTEEVKAGLENGVLTVTVPKAEVKKPEVKSIQ

SEQ ID NO: 6450 - protein, 152 aa, Panicum virgatum
MSLVRRSSVFDPFSLDLWDPFDSMFRSVVPSAGASDSETAAFANARIDWKETPEAHVFKADLPGVKKEEVKVEVEDGNVLVISGQRSKEKEDKNDKWHRVERSSGQFMRRFRLPENAKVDQVKAGLENGVLTVTVPKAEEKKPEVKSIQISS

SEQ ID NO: 6451 - protein, 156 aa, Setaria italica
MSLVRRSNVFDPFADFWDPFDVFRSLVPSVASSDRDTAAFANARVDWKETPEAHVFKADLPGVKKEEVKVEVEDGNILVISGERSKEKEDKNDKWHRVERSSGKFLRRFRLPEDAKTDQVKAGMENGVLTVTVPKAEVKKPEVKAIEISGAGDNAV

SEQ ID NO: 6452 - protein, 147 aa, Panicum virgatum
MSLARRSNVFDPFADFWDPFDVFRSVVPAASTDRDTVAFANARIDWKETPEAHVFKADLPGVKKEEVKVEVEDGNVLVISGERSKEEEDKNDKWHRVERSSGKFLRRFRLPENAKTDQQVKAGLENGVLTVTVPKAEVKKPEVKAIE

SEQ ID NO: 6453 - protein, 147 aa, Avena sativa
MSIVRRCPFFSDLWVDPFDAFRSIIPAADNNDATAAFVNARVDWKETPEAHVFKADLPGVKKEEVKVEVEDGNVLVVSGERSREKEDKNEKWHHVERSSGKFVRRFRLPENSKVEEVKAGLEDGVLTVTVPKAEVKKPVVKAIDISG

SEQ ID NO: 6454 - protein, 148 aa, Panicum virgatum
MSLVRRGNVFDPFSMDLWDPFDSMFRSIVPSSSSDSDTAAFTNARIDWKETPEAHVFKADFPGVKKEEVKVEVEDGNVLVISGQRSKEKEDKNDKWHRVERSSGQFMRRFRLPEDAKVEQVKAGLENGVLTVTVPKAEGKKPEVKSIQ

SEQ ID NO: 6455 - protein, 150 aa, Panicum virgatum
MSLVRRSSVFDPFSLWDPFDSMFRSVVPSAGASDSETAAFANARIDWKETPEAHVFKADLPGVKKGEVKVEVEDGNVLVISGQRSKEKEDKNDKWHRVERSSGQFMRRFRLPENAKVDQVKAGLENGVLTVTVPKAEEKKPEVKSIQISS

SEQ ID NO: 6456 - protein, 106 aa, Pennisetum glaucum
MSLVRRSSVFDPFSMELWTPSTTCSAPSCRRRPPTPIPPPSPPRASTGRRPPRRTSSRPTSPGSRRRRSRSRWRTATSSSSAANAARRRRTRTTGGTASSAAAASS

SEQ ID NO: 6457 - protein, 152 aa, Pennisetum glaucum
MSLVSRSSVFDPFSMDLWDPFDSMFRSIVQSAGSPDSDTAAFAAARIDWKETPEAHVFKADLPGVKKEEVKVEVEDGNVLVISGQRSKEKEDKNDRWHRVERSSGQFMRRFRLPENAKVDQVKAGLENGVLTVTVPKAEEKKPEVKAIEISG

SEQ ID NO: 6458 - protein, 150 aa, Sorghum bicolor
MSLVRRSNIFDPFADFWDPFDGVFRSLVVPSVASSGRDTAAFANARIDWKEMPEAHVFKADLPGVKKEEVKVEVEDGNVLVISGERSKEKEDKNDKWHRVERSSGKFMRRFRLPENAKTDQVNAGLENGVLTVTVPKAEVKKPEVKTIEI

SEQ ID NO: 6459 - protein, 145 aa, Festuca arundinacea
MSMVRRCPFADLWVDPFDGFCSIVPASWDSDSAGFANARVDWKETPEAHVFKADLPGVKKEEVKVEVEDGNVLVVSGERTKEKEDKKEKWHRVERSSGKFIRRFQLPENAKMEEVKAGLENGVLTVTVPKVDIKKPDVKAIDISG

SEQ ID NO: 6460 - protein, 152 aa, Cenchrus ciliaris
MSLVSRSSVFDPFSMDLWDPFDSMFRSIVQSAGSPDSDTAAFAAARIDWKETPEAHVFKADLPGVKKEEVKVEVEDGNVLVISGQRSKEKEDKNDRWHRVERSSGQFMRRFRLPGNAKVDQVKAGLENGVLTVTVPKAEEKKPEVKAIEISG

SEQ ID NO: 6461 - protein, 152 aa, Saccharum officinarum
MSLVRRSNIFDPFADFWDPFDGVFRSLVPSVVASSDRDTTAFANVRIDWKETPEAHVFKADLPGVKKEEVKVEVEDDNVLVISGERSKEKEDKNDKWHRVERSSSKFLRRFRLPENAKTDQVNAGLENGVLTVTVPKAEVKKPEVKTIEISG

SEQ ID NO: 6462 - protein, 254 aa, Brachypodium distachyon
MAATHPASPTAAGDKSSPSPPPPVRLATAVAAIQPSSPRFFFSSLAASSSPHRRIGIAVDLSDESAFAVKWAVQNYLRPGDAVVLLHVRPTSVLYGADWGSIPVSVDDDDGGEAPAGDEPEDARKKREEDFDTFTSTKSQDLAQPLVAAQIPFKIHIVKDHDMKERLCLEAERLGLSAMIMGSRGFGAFRRGDKGRLGSVSDYCVHHCVCPVVVVRYPDDAGAAGGAEAAGDELRTVPENEVVFHEAPEGQKEN

SEQ ID NO: 6463 - protein, 259 aa, Avena sativa
MASPTHHPASPNGGGKSSPSPPPPVRPSTAQAAAVAAIQPSSPRYFFSSLAASSSPHRRIAIAVDLSDESAFAVKWAVQNYLRPGDAVVLLHVRPTSVLYGADWGSIPVSVSDDDGEEAAPSAEELQKKREEDFDTFTSTKSEDLAQPLVAAQIPFKIHIVKDHDMKERLCLEAERLGLCAMIMGSRGFGASRKGGKGRLGSVSDYCVHHCVCPVVVVRYPDDAAGVAGEAAPATADELHTVPEDEPVYHDAPDAHKDN

SEQ ID NO: 6464 - protein, 480 aa, Triticum aestivum
MGKKGKWLGAVKKVFSPESKEKKEEKLRKKLAARDPSPPDLTPSTSLEVNVSMPPPLPPPAVPSPHQTEEVQVRDVELEQEQEQSKHVTVEAAPDAPAQTSSALPPGVSREELAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSTSLNLGEGEITKAFNRRGSKPDKSSPTTPKLIRPASRLSPSTPTAKVTPIVVKKKPATPKNGISQVDDDARSVLSVQSERPRRHSIATSTVRDDESLASSPSVPSYMAATKSARAKSRLQGSPLIDSAETTPEKGGSISVGSAKKRLSFPAGGVPPSPMRRHSGPPKVESVVKDIAVTPQPEALAISG

SEQ ID NO: 6465 - protein, 481 aa, Secale cereale
MGKKGKWLGAVKKVFSPESKEKKEEKLRKKLAARDPSPLDLTPSTSLEVNVSMPPPPPAVPSPRQTEEVQVRDIELELEQEQEQSKHVTVEAAPDAPAQASSALPPGVSREELAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSTSLNLGEGEITKAFNRRGSKPDKSSPTTPKLTRPASRLSPSTPTAKVTPIVVKKKSATPKNGISQVDDDARSVLSVQSERPRRHSIATSTVRDDESLASSPSVPSYMAATKSARAKSRLQGSPLIDSAETTPEKGGSVSVGSAKKRLSFPAGGVPPSPMRRHSGPPKVAESMVKDIPETPQPEALAISG

SEQ ID NO: 6466 - protein, 478 aa, Triticum aestivum
MGKKGKWLGAVKKVFSPESKEKKEEKLRKKLAARDPSPPDLTPSTSLEVNVSMPPPPPAVPSPHQTEEVQVRDVELEQEQEQSKHVTVEAVPDAPVQTSSALPPGVSREELAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSTSLNLGEGEITKAFNRRGSKPDKSSPTTPKLTRPASRLSPSTPTAKVTPIVVKKKSATPKNGISQVDDDARSVVSVQSERPRRHSIATSTVRDDESLTSSPSVPSYMAATKSARAKSRLQGSPLIDSAETTPEKGGSVSVGSAKKRLSFPAGGVPPSPMRRHSGPPKVESMVKDIAETPQPEALAISG

SEQ ID NO: 6467 - protein, 478 aa, Triticum aestivum
MGKKGKWLGAVKKVFSPESKEKKEEKLRKKLAARDPSPPDLTPSTSLEVNVLMPPPPPAVPSPHQTEEVQVRDVELEQEQEQSKHVTVEAAPDAPAQTSAALPPGVSREELAAIKIQTAFRGYLARRALRALKGLVRLKSLVEGNSVKRQAASTLRCMQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSTSLNLGEGEITKAFNRRGSKPDKSSPTTPKLTRPASRLSPSTPTAKVTPIVVKKKSATPKNGISQVDDDARSVLSVQSERPRRHSIATSTVRDDESLASSPSVPSYMAATKSARAKSRLQGSPLIDSVETTPEKGGSVSVGSAKKRLSFPAGGVPPSPMRQHSGPPKVESMVKDIPEALQPEALAISG

SEQ ID NO: 6468 - protein, 309 aa, Triticum aestivum
MQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSTSLNLGEGEITKAFNRRGSKPDKSSPTTPKLTRPASRLSPSTPTAKVTPIVVKKKSATPKNGISQVDDDARSVLSVQSERPRRHSIATSTVQDDESLASSPSVPSYMAATKSARAKSRLQGSPLIDSAETTPEKGGSVSVGSAKKRLSFPAGGVPPSPMRRHSGPPKGGEHGEGHR

SEQ ID NO: 6469 - protein, 469 aa, Secale cereale
MGKKGKWLGAVKKVFSPESKEKKEEKLRKKLAARDPSPLDLTPSTSLEVNVSMPPPPPAVPSPHQTEEVQVRDIELELEQEQEQSKHVTVEAAPDAPAQASSALPPGVSREELAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSTSLNLGEGEITKAFNRRGSKPDKSSPTTPKLTRPASRLSPSTPTAKVTPIVVKKKSATPKNGISQVDDDARSVLSVQSERPRRHSIATSTVRDDESLASSPSVPSYMAATKSARAKSRLQGSPLIDSAETTPEKGGSVSVGSAKKRLSFPAGGVAPLANEAAFWPSKGGGEHGEGHP

SEQ ID NO: 6470 - protein, 440 aa, Secale cereale
MGKKGKWLGAVKKVFSPESKEKKEEKLRKKLAARDSSPLDLTPSTSLEVNVSMPPPPPAVPSPHQTEEVQVRDIELEQEQEQSKHVTVEAAPDAPAQASSALPPGVSREELAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSTSLNLGEGEITKAFNRRGSKPDKSSPTTPKLTRPASRLSPSTPTAKVTPIVVKKKSATPKNGISQVDDDARSVLSVQSERPRRHSIATSTVRDDESLASSPSVPSYMAATKSARAKSRLQGSPLIDSAETTPEKGGSVSVGSSQEEARPS

SEQ ID NO: 6471 - protein, 474 aa, Brachypodium distachyon
MGKKGKWFGAVKKVFSPVSKEKKEEKLRRKFAASDSNPPDLTPSTSLEVNVSALPPPPPAVPSSHQTEEVNVPEAEQEQEQSKHVTVEAAPAAPAQSSSVLPPGDELAAIKIQTAFRGYLARRALRALRGLVRLKSLVEGNSVKRQAASTLRCMQTLARVQSQIRSRRLKMSEENQALQRQLLLKQELDSLRMGEHWDDSTQSKEKIEASLVSRQEAAIRRERALAYAFSHQWKSSSRSSNPMFVDPNNPHWGWSWLERWMAAKPWEGRTGNDKESNIDRGSVKSISLNLGEGEITKAFNRRGSSKPDKSSPTTPKLTRPTSRLSPSTPSAKVTPIIVKKKSATPKNGLSQVDDDARSVLSVQSERPRRHSIATSTVRDDESLVSSPSVPSYMAATQSARAKSRLQGSPLTESAEIPEKVVSVGSAKKRLSFPAGSASPAPTRRHSGPPKVENLVKDIAETPQPVALAVNGGNK

SEQ ID NO: 6472 - protein, 466 aa, Avena sativa
MGKKGKWLGAVKKVFSPESKEKKEEKLRKKLAASDPNPTDLTPSTSLEVDVSMPPPLAPRQIEDFKVPEPEQEQSKHVTVEAAPDSPTQTSSMLPPGVSREEVAAIKIQTAFRGYLARRALRALRGLVRLKSLVEGNSVKRQAASTLRCMQTLARVQSQIRARRLKMSEENQALQRQLLLKQELESLRMGEHWDDSTQSKEKIEASLVNKQEAAIRRERALAYAFSHQWKSSSRSSNPMFVDPNNPHWGWSWLERWMAAKPSEGGRTGTTKESNGDQVSVKSLSLNLGEGEITKAFKSRSIKPDKSSPTTPKLARPASRLSPSTPSAKVTPIVVKKKPATPKNGLSQVDDDARSVLSVQSERPRRHSIATSTVRDDESLASSPSVPSYMAATKSARAKSRLQGSPSIDAAETTPEKVASVGSVKKRLSFPAGAASPMRRHSGPPKVEILVKDIAETPQPEALAISG

SEQ ID NO: 6473 - protein, 466 aa, Avena sativa
MGKKGKWLGAVKKVFSPESKEKKEEKLRKKLAASDPNPTDLTPSTSLEVDVSIPPPPAPRQIEDFKVPEPEQEQSKHVTVEAAPDSPTHTSSMLPPGVSREEVAAIKIQTAFRGYLARRALRALRGLVRLKSLVEGNSVKRQAASTLRCMQTLARVQSQIRARRLKMSEENQALQRQLLLKQELESLRMGEHWDDSTQSKEKIEASLVSKQEAAIRRERALAYAFSHQWKSSSRSSNPMFVDPNNPHWGWSWLERWMAAKPSEGGRTGTTKESNGDQVSVKSISLNLGEGEITKAFKSRSIKPDKSSPTTPKLARPASRLSPSTPSAKVTPIVVKKKPATPKNGLSQVDDDTRSVLSVQSERPRRHSIATSTVRDDESLASSPSVPSYMAATKSARAKSRLQGSPSIDAGETTPEKVASVGSVKKRLSFPAGAASPMRRHSGPPKVEILVKDIAETPQPEALAISG

SEQ ID NO: 6474 - protein, 466 aa, Avena sativa
MGKKGKWLGAVKKVFSPESKEKKEEKLRKKLAASDPIPTDLTPSTSLEVDASIPPPPAPRQIEDFKVPEPEQEQSKHVTVEAAPDSPTHTSSMLPPGVSREEVAAIKIQTAFRGYLARRALRALRGLVRLKSLVEGNSVKRQAASTLRCMQTLARVQSQIRARRLKMSEENQALQRQLLLKQELESLRMGEHWDDSTQSKEKIEASLVSKQEAAIRRERALAYAFSHQWKSSSRSSNPMFVDPNNPHWGWSWLERWMAAKPSEGGRTGTAKESNGDQVSVKSLSLNLGEGEITKAFKSRSIKPDKSSPTTPKLTRPASRLSPSTPSAKVTPIVVKKKPATPKNGLSQVDDDARSVLSVQSERPRRHSIATSTVQDDESLASSPSLPSYMAATKSARAKSRLQGSPSIDAAETTPEKVAAVGSVKKRLSFPAGVASPMRRHSGPPKVESVVKDIAETLQPEALAISG

SEQ ID NO: 6475 - protein, 461 aa, Avena sativa
KWLGAVKKVFSPESKEKKEEKLRKKLAASDPNPTDLTPSTSLEVDASIPPPPAPRQIEDFKVPEAEQEQSKHVTVEAAPDSPAQMSSMLPPGVSREEVAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLVSRQEAAIRRERALAYAFSHQWKSSSRSSNPMFVDPNNPHWGWSWLERWMAAKPSEGGRTGTAKESNGDQVSVKSLSLNLGEGEITKAFKSRSIKPDKSSPTTPKLARPASRLSPSMPSAKVTPIVVKKKPATPKNGLSQVDDDARSVLSVQSERPRRHSIATSTVQDDESLASSPSVPSYMAATKSARAKSRLQGSPSIDAAETTPEKVAAVGSVKKRLSFPAGVASPMRRHSGPPKVESVVKDIAETLQPEALAISG

SEQ ID NO: 6476 - protein, 210 aa, Festuca arundinacea
MGKKGKWLGAVKKVFSPESKEKKEEKLRKKLAASDPTPTDLTPSTSLEVNVSMPPPPPALPVPRQTEDFKVPEAEQEQSKHVTVEAAPEAPAQMSSVLPPGVSSEELSAIKIQTAFRGYLARRALRALRGLVRLRLLVDGNSVKRQAASTLRCMQTLARVQSQIRSRRLKMSEENQALQRQLLLKQELESLRMGSTGMTAPNPRRRLRQV

SEQ ID NO: 6477 - protein, 474 aa, Oryza sativa
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQAAIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 6478 - protein, 474 aa, Saccharum officinarum
MGKKGKWFGAVKKVFSPESKEKKEERLRRKSAASNPTPLDLTPSTSLEVNVSVPPPPAPAPPPVLHQAEEVRIPEAEQEQSKHVTVEEAPAAPAQASVLPPGVPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSKSVNPMFVDPNNLQWGWSWLERWMAAKPWEGRNGADKESNIDRGSVKSMSLNLGEGEITKAFNRRDSKPEKPSPPTPKPTRPASRQSPSTPSAKVAPIPARRKSATPKNGLSQVDDDARSVLSVQSERPRRHSIATSTVRDDESLASSPSLPSYMVPTESARAKSRLQGSAMTNGAETPEKGGSTGPVKKRLSFQGGTAAASPMRRHSGPPKVESAVKDIVAPPQPEALVVNGGSK

SEQ ID NO: 6479 - protein, 177 aa, Pseudoroegneria spicata
MEEEKGFQPHLMGGGRMRGAAGAMGLQKQNSWSPDIERDEAWERRRRGILGRGRRSPLQRAQSVTDDQLDELRGSLDLGFRFEPPSQRCAACDAGRSRLVETLPALDLLYAVAANANAGAGGCAASQCSCGASSEASEPSPIGSPLSILSPDDPPETVKMRLKQWAQVVALSLRSRS

SEQ ID NO: 6480 - protein, 181 aa, Triticum aestivum
MEEERKGFQPHLMGLGGGGRLRGAAGAMGLQKQNSWSPDIERDEAWERRRRGILGRGRRSPLQRAQSVTDDQLDELRGSLDLGFRFDPPSQRCAACDAGRSRLVETLPALDLLYAVAANANAGGCAAGQHQCSCGASSEASEPSPIGSPLSILSPDDPPETVKMRLKQWAQVVALSMRSRS

SEQ ID NO: 6481 - protein, 182 aa, Triticum aestivum
MEEERKGFQPHLMGLGGGSRLRGAAGAMGLQKQNSWSPDIERDEAWERRRRGILGRGRRSPLQRAQSVTDDQLDELRGSLDLGFRFDPPSQRCAACDAGRSRLVETLPALDLLYAVAANANAGGCAGAASHQCSCGASSEASEPSPIGSPLSILSPDDPPETVKMRLKQWAQVVALSMRSRS

SEQ ID NO: 6482 - protein, 215 aa, Secale cereale
GRGRDKLLHRGHCPLSCPQQQPAASSSESGEAGGGHGGGEGVPAPSDGRPGRREDEGRAGAMGLQKQNSWSPDIERDEAWERRRRGILARGRRSPLQRAQSVTDDQLDELRGSLDLGFRFEPPSQRCAACDAGRSRLVQTLPALDLLYAVSANANATATASAANQCSCGASSEASEPSPIGSPLSILSPDDPPETVKMRLKQWAQVVALSLRSRS

SEQ ID NO: 6483 - protein, 181 aa, Secale cereale
MEEEKGFQPHHLMGGLGGARMRGAAGAMGLQKQNSWSPDIERDEAWERRRRGILARGRRSPLQRAQSVTDDQLDELRGSLDLGFRFEPPSQRCAACDAGRSRLVQTLPALDLLYAVSANATATANASAASQCSCGASSEASEPSPIGSPLSILSPDDPPETVKMRLKQWAQVVALSLRSRS

SEQ ID NO: 6484 - protein, 168 aa, Leymus cinereus x Leymus triticoides
MENGFQPHLMGGGKMRGAAGAMGLQKQNSWSPDIERDEAWERRRRGMMHRGRSQLQRAQSVTDDQLDELRGSLDLGFRFEPPSQGCAACGAGRSRLVETLPALDLLYAVAGEGCAARQCSCGASSEASEPSPIGSPLSILSPDDPPETVKMRLKQWAQVVALSLRSRS

SEQ ID NO: 6485 - protein, 562 aa, Brachypodium distachyon
MASVSEDDAASERCSGSYSPSADVSGSETSSDCSAPTTTTRRFPFSSSSASASRGLASSSTSTSQLPTPSAAFYLSKPASDLSEIDMMKERFAKLLLGEDMSGSGKGVCTALAISNAITNLSATVFGELWRLEPLAPARKAMWTREMEWLLSVADSIVELTPSIQELPDGGGQFEVMVPRPRSDLYMNLPALKKLDAMLLAMTDEFKETEFWYVDRGIVVEDSGGPFPSSSSSSSCGRPSSVRQEEKWWLPCPRVPPKGLPEDARRKLQQSRDCANQILKAAMAINSDVLAEMEIPEAYLETLPKSGRSCLGEIIYRYITAEQFSPECLLDCLDLSSEHHTLEVANRIEAAIHVWRLKGQKKSSPQAKSKKSWGGKVKGLVGDTKSNVLSQRADGLLQSLRLRHPGLPQTSLDMNKIQYNKDVGQSILESYSRVLESLAFNTIARIDDVIYVDDATKKSAAAESVSIFNRGVGIPVQKKISPSPFSIQHTPYASPFATPTFCSSTPVTGSPRRAQPPLNKINLQGKQEVKVEKLFSGDLEKVWTYAGNLSARKEAGDAPERD

SEQ ID NO: 6486 - protein, 557 aa, Setaria italica
MASASEDEAASDRCCGSYSPSADVSESETSSDCSAPTTRRFASSSSASATVSRLASSSSSLPTPASAAAFYLSKPAADLSEIDMMKERFAKLLLGEDMSGSGKGVCTALAISNAITNLSATVFGELWRLEPLAPARKAMWTREMEWLLSVADSIVELTPSIQELPEGGGQFEVMVPRPRSDLYMNLPALKKLDAMLLAMIDGFKETEFWYVDRGIVVEDSGGPFPSSSSSSCGRPSVRQEEKWWLPCPRVPPKGLSEDARRKLQQSRDCANQILKAAMAINSDVLAEMEIPEVYLETLPKSGKSCLGEIIYRYITAEQFSPECLLDCLDLSSEHHTLEVANRIEAAIHVWRLKGQKKLTPQAKSKKSWGGKVKGLVGDKEKSHFLSERADGLLQSLRLRYPGLPQTSLDMNKIQYNKDVGQSILESYSRVLESLAFNIIARIDDVIYVDDATKKSAAAESVSIFNRGIGVPVQKRISPSPFSIQNTPYASPFATPTFCSSTPVTGSPGRAQPPLNKNSLGKQEIKVEKLFSGDLEKVWTYAGNLSARKDAGDAPERD

SEQ ID NO: 6487 - protein, 557 aa, Panicum virgatum
MASASEDEAASERCCGSYSPSADVSESETSSDCSAPTTRRFTSSSSASATVSRLASSSSSLPTPASAAAFYLSKPASDLSEIDMMKERFAKLLLGEDMSGSGKGVCTALAISNAITNLSATVFGELWRLEPLAPARKAMWTREMEWLLSVADSIVELTPSIQELPEGGGQFEVMVPRPRSDLYMNLPALKKLDAMLLAMIDGFKETEFWYVDRGIVVEDSGGPFPSSSSSSCGRPSVRQEEKWWLPCPRVPPKGLSEDARRKLQQSRDCANQILKAAMAINSDVLAEMEIPEVYLETLPKSGKSCLGEIIYRYVTAEQFSPECLLDCLDLSSEHHTLEVANRIEAAIHVWRLKGQKKLTPQAKSKKSWGGKVKGLVGDKEKSHVLSERADGLLQSLRLRYPGLPQTSLDMNKIQYNKDVGQSILESYSRVLESLAYNIIARIDDVIYVDDATKKSAAAESVSIFNRGVGVPVQKIISPSPFSIQNTPYASPFATPTFCSSTPVTGSPGRVQPPLNKNSLGKQEIKVEKLFSGDLEKVWTYAGNLSTRKDAGDAPERD

SEQ ID NO: 6488 - protein, 561 aa, Oryza sativa
MASASEDDAGSERCCGSYSPSADVSESETSSDCSAPTTTTTTRRFASSSSRGVASSSSSSLLPTPPPSSAAAFFLSAKPAADLSEVDMMKERFAKLLLGEDMSGSGKGVCTALAISNAITNLSATVFGELWRLEPMASARKAMWTREMDWLLSVADSIVELTPSIQELPDGGGQFEVMVPRPRSDLYMNLPALKKLDAMLLAMIDGFKETEFWYVDRGIVVDDSGGPFSSSSSSCGRPSVRQEEKWWLPCPRVPPKGLSEDARRKLQQDRDCANQILKAAMAINSDVLAEMEIPEVYLESLPKSGKSCLGEIIYRYITAEQFSPECLLDCLDLSSEHHTLEVANRIEAAIHVWRLKGQKKSTPQAKSKKSWGGKVKGLVGDTEKSHVLSQRADGLLQSLRLRYPGLPQTSLDMNKIQYNKDVGQSILESYSRVLESLAFNIIARIDDVIYVDDATKKSAAADSVSIFNRGIGVPVQKRISPSPFSIQHTPYASPFATPTFCSSTPVTGSPGRVQPPLNKDNLPTKQEVKVEKLFSGDIEKVWTYAGNLSARKDAGDAPERD

SEQ ID NO: 6489 - protein, 559 aa, Sorghum bicolor
MASASEDEAASDRCSGSYSPSADVSESETSSDCSAPTTRRFASSSSASATVSRLASSSSSLPTPASATAFYLSSKPVSDLSEIDMMKERFAKLLLGEDMSGSGKGVCTALAISNAITNLSATVFGELWRLEPLATARKAMWTREMEWLLSVADSIVELTPSIQELPEGGGQFEVMVPRPRSDLYMNLPALKKLDAMLLAMIDGFKGTEFWYVDRGVMVEDSGGPFPSSSSSSSCGRPSVRQEEKWWLPCPRVPPKGLSEDARRKLQQSRDCANQILKAAMAINSDVLAEMEIPDVYLETLPKSGKSCLGEIIYRYITAEQFSPECLLDCLDLSSEHHTLEVANRIEAAIHVWKLKGQKKSTPQTKSKKSWGGKVKGLVGDKEKSHTLSERADGLLQSLRLRYPGLPQTSLDMNKIQYNKDVGQSILESYSRVLESLAFNIIARIDDVIYVDDATKKSAAAESVSIFNRGTGVPVQKRISPSPFSIQNTPYASPFATPTFCSSTPVTGSPGRGQPPLHKNNLGTQEIKVEKLFAGDLEKVWTYAGNLSARKDAGDAPERD

SEQ ID NO: 6490 - protein, 557 aa, Zea mays
MATASEDEAASDRCSGSYSPSADVSESETSSDCSAPTTRRFASSSSASATVSRLASSSSSLPTPASAAAFYLSKPTPDLSEIDMMKERFAKLLLGEDMSGSGKGVCTALAISNAITNLSATVFGELWRLEPLATARKAMWTREMEWLLSVADSIVELTPSIQELPEGGGQFEVMVPRPRSDLYMNLPALKKLDAMLLAMIDGFKDTEFWYVDRGVMVEDSGGPFPSSSSSSCGRPSVRQEDKWWLPCPRVPPKGLSEDARRKLQQSRDCANQILKAAMAINSDVLAEMEIPEVYLETLPKNGKSCLGEIIYRYITAEQFSPECLLDCLDLSSEHHTLEVANRIEGAIHVWKLKGQKKSTPQAKSKISWGGKVKGLVGDKEKSHTLSERADGLLQSLRLRYPGLPQTSLDMNKIQYNKDVGQSILESYSRVLESLAFNIIARIDDVIYVDDATNRSAAAESVSIFNRGTGVPVQKRISPSPFSIQNSPYGSPFATPTFCSSTPVTGSPGRVQPPLNKNILGTQEIKVEKLFSGDLEKVWTYAGNLSARKDAGDAPERD

SEQ ID NO: 6491 - protein, 564 aa, Zea mays
MATASEDEAASDRCSGSYSPSADVSESETSSDCSAPTTRRFASSSSASASASATVSRRLASSSSSLPTPASAAAFYLSKPPSSDLSEIDMMKERFAKLLLGEDMSGSGKGVCTALAISNAITNLSATVFGELWRLEPLAKARKAMWTREMEWLLSVSDSIVELTPSIQELPEGGGQFEVMVPRPRTDLYMNLPALKKLDAMLLAMIDGFKGTEFWYVDRGVMVEDSGGPFPSSSSSSSCGRPSVRQEEKWWLPCPRVPPKGLSEDSRRKLQQSRDCANQILKAAMAINSDVLAEMEIPEMYLETLPKSGKSCLGEIIYRYITAEQFSPECLLDCLDLSSEHHTLEVANRIEAAIHVWKLKGQKNSTPQARSKKSWGGKVKGLVGDKEKSHTLSERANGLLQSLRLRYPGLPQTSLDMNKIQYNKDVGQSILESYSRVLESLAFNIIARIDDVIYVDDATKKSAAAESVSIFNRGTGVPIQKRISLSPFSIQNTPYASPFATPTFCSSTPVTCSPGRVQPPLNKTNLGRPEIKVEKLFSGDLEKVWTYAGNLSARKDAGDAPERD

SEQ ID NO: 6492 - protein, 294 aa, Cajanus cajan
MEFFHRAKAVRLRSHHDKYLHADDDEESVTQDRNGTSRNAKWTVELIPEFDSIIRLKSCYGKYLTASNMPLLLGVTGRKVVQSVPRRLDSSVEWEPVRDGAQVKLKTRYGNFLRANGGLPPWRNSVTHDIPHRSATQDWILWDVDVLEIHVESPAPPPIPHSDSLDFDSSTPSAVSIKSTTFSRQESTDSNVGSPPKMEGRTIYYHVAEDNGDVDDENVQGYSLNFKGNGVEQLTRKFEEETGLEGVIVCTRSPLNGRLYPLRLQLPPNNVTMQVVLVLPSSKVAKDFKEQGLL

SEQ ID NO: 6493 - protein, 294 aa, Glycine max
MELFHRAKAVRLRSHHDKYLLADEDEESVTQDRNGSSRNAKWTVELIPEFDNIIRLKSCYGKYLTASNQPLLLGVTGRKVVQSVPRRLDSSVEWEPVRDGAQVKLKTRYGNFLRANGGVPPWRNSVTHDIPHRTTTQDWILWDVDVLEIHVVFPAPPPIPHSDSLDFESNTPSAVNIKSTTFSRQESTDSNVSSPPKVEGRTIYYHVAEDNGDVDDENVQGYSLNFKGNGVEQLARKFEEETGLEGVIVCTRSPLNGKLYPLRLQLPPNNVTMQVVLVLPSSKVAREFEEQGIL

SEQ ID NO: 6494 - protein, 487 aa, Medicago truncatula
MEYFNKSKAVKLRSHLGKYLVADEDNNNIRQSRNGTTKKSLWFIEPVETKPHHIRLRSHHGRYLTATDTPFLLGMTGNKVVQADYDAGLGWKYEWEPIKEGFNVKLRSWCGKYLRGNGGTPPWRNSITHDDPTSATHNWILWGVEFVELSLANQENVELLNQISFASISSFDSRDEVNDSELVSSMKSRFTISSMELFQRAKAVRLRSHHDKYLHAEEDEESTNQDRNGSSKNAKWTVEHIPEYDNIIRLKSCYNKYLTASNQPLLLGVTGRKVIQTLPRRLDSSVEWEPVREGAQVKLKTRYGNFLRANGGLPPWRNSVTHDIPHRSATQDWILWDVDVLEIHVGNPPPPPIPHSDSLDFGSSTPSALSFKSDRFSRQESTDSVGSPPKMEGRTIYYHVAEDNGDVDDENVQGYSLVFNGNDVEQLTRKFVEETGLDGVIVCSRSPLNGKLYPLRLHLPPNNVTMQVVLVLPNSKVAKEFEEQGLL

SEQ ID NO: 6495 - protein, 467 aa, Trifolium pratense
SLWLIEIDKTKPNHIRLKSHHGRYLTATDTPFLLGMTGNKVVQADYDAGLSWKYEWEPIKEGISSVKLKSWCGKYLRGNGGTPPWRNSITHDDDPSSATYNWIIWGVEVVESSLHNENNNEILNQISFASNSSFDSCEDVHDSQSVSTSMKKTWSLSKTRQSSKLQKTSNNNNNFTSSMELFQRAKAVRLRSHHDKYLHAEEDEESINQDRNGSSKNAKWIVEHIPEYDNIIRLKSCYGKYLTASNQPLLLGVTGRKVVQTLPRRLDSSVEWEPVREGAQVKLKTRYGNFLRANGGLPPWRNSVTHDIPHRSSTQDWILWDVDILEIHVGNPPPPPIPHSDSLDFGSSTSFKSDRFARQESTDSVGSPPKLEGRTIYYHVAEDNGDVDDENVQGYSLVFNGNDVEQLTRKFVEETGLDGVIVCSRSPLNGKLYPLRLHLPPNNVTMQVVLVLPNSKAAKDFEEQGLL

SEQ ID NO: 6496 - protein, 467 aa, Trifolium pratense
SLWLIEIDKTKPNLVRLRSHHGRYLTATDTPFLLGMTGNKVVQADYDAGLSWKYEWEPIKEGMSSVKLKSWCGKFLRGNGGTPPWRNSVTHDDPSSATYNWILWGVEFVELSLHNNQNNELFNQTSFASNSSFDSCEDIHDSQSVSTTSINKTWSLSKTRQNSKLQKTSNNNNSFTSSMELFQRAKAVRLRSHHDKYLHAEEDEESINQDRNGSSKNAKWTVEHIPEYDNIIRLKSCYGKYLTASNQPLLLGVTGRKVVQTLPRRLDSSVEWEPVREGAQVKLKTRYGNFLRANGGLPPWRNSVTHDIPHRSSTQDWILWDVDILEIHVGNPPPPPIPHSDSLDFGSSTSFKSDRFARQESTDSVGSPPKLEGRTIYYHVAEDNGDVDDENVQGYLLVFNGNDVEQLTRKFSEETGLDGVIVCSRSPLNGKLYPLRLHLPPNNVTMQVVLVLPNSKAAKDFEEQGLL

SEQ ID NO: 6497 - protein, 289 aa, Trifolium pratense
MELFQRAKAVRLRSHHDKYLHAEEDEESINQDRNGSSKNAKWTVEHIPEYDNIIRLKSCYGKYLTASNQPLLLGVTGRKVVQTLPRRLDSSVEWEPVRDGAQVKLKTRYGNFLRANGGLPPWRNSVTHDIPHRSSTQDWILWDVDVLEIHVGNPPPPPIPHSDSLDFGSSTSFKSDRFARQESTDSVGSPPKMEGRTIYYHVAEDNGDVDDENVQGYSLVFNGNDVEQLTRKFSEETGLDGVIVCSRSPLNGKLYPLRLHLPPNNVTMQVVLVLPNSKAAKEFEEQGLL

SEQ ID NO: 6498 - protein, 293 aa, Cicer arietinum
MEFFQRAKAVRLRSHHDKYLHAEDDEESVNQERNGSSKNAKWIVELIPEYDNIIRLKSCYNKYLTASNQPLLLGVTGRKVVQTMPRRLDSSVEWEPIRDGAQVKLKTRYGNFLRANGGLPPWRNSVTHDIPHRSSTQDWILWDVDVLEIQIGNPTPPPIPHSDSLDFESSTPSSPSLHSHRFSRQESTDSVGSPPKMEGRTIYYHVAEDNGDVDDENVQGYSLVFNGNDVEQLTRKFAEETGLDGVIVCSRSPLNGKLYPLRLHLPPNNVTMQVVLVLPSSKVAKEFEEQGLL

SEQ ID NO: 6499 - protein, 289 aa, Lotus japonicus
MELFQRAKAVRLRSHHDKYLQAEEDEESVSQDRNGSSKNAKWIVEHVPEYDNIIRLKSCYGKYLTASNQPLLLGVTGRKVVQSLPRRLDSSVEWEPLRDGAQVKLKTRYGNFLRANGGLPPWRNSVTHDIPHRSSTQDWILWDVDVLEIHVHAPPPPPLPHSDSLDFDSSTPSAANSFKSTNFSRQQSTDSSVGSPPKMEGRTIYYNVAEDTGEVDDENVQGYSLNFNGNGVQQLTRKFEEETGLEGVIVCTRSPLNGKLYPLRLQLPPNNVTMQVVLVLPSSKGKFPL

SEQ ID NO: 6500 - protein, 276 aa, Trifolium pratense
MELFQRAKAVRLRSHHDKYLHAEEDEESINQDRNGSSKNAKWIVEHIPEYDNIIRLKSCYGKYLTASNQPLLLGVTGRKVVQTLPRRLDSSVEWEPVREGAQVKLKTRYGNFLRANGGLPPWRNSVTHDIPHRSSTQDWILWDVDILEIHVGNPPPPPIPHSDSLDFGSSTSFKSDRFARQESTDSVGSPPKLEGRTIYYHVAEDNGDVDDENVQGYSLVFNGNDVEQLTRKFVEETGLDGVIVCSRSPLNGKLYPLRLHLPPNNVTMQVVLVLPN

SEQ ID NO: 6501 - protein, 1350 aa, Cajanus cajan
MDNLSEEEEELGTEQLRSTTFQRLKSFSLHLLDLLQNPHIENQKHSSVTVIPQLLRFLRNSSPSTLQPFFDYTLFPLLLLLDGAIQCRTTQKLESEEKYTMPDVPKTPVQVSDGVAEGVVNCLEELLRKCHLSSVDQMVVLLKKLTYGAMLSPTEASEEFREGILLCVKALFLSLYPCSDVSCLCKKISGLPALSDGIYNNRLHKTFKNDSESEECLLAYLQSQFALAAVGHWLSLLLKTADTEAARGQRGSARIRIEAFKTLRVLVAKVGSADALAFFLPGIVSQLAKVLHNTKTMISGAAGNVESIDHAIRALAEFLMIVLQDDANAPALDIEASSDFDSNECNSTLSLLEELRHLQVKNFDKTKASEYIDVESEKISGSQTQLQEIGNTDPDRENLSFYVNRTKGWMQRTSAHVNKLLSATFPHICIHPSSKVRKGLVDAVKGLLSECFYILGESRLMLLECLCALVVDASNDVSSTAQDFLECLFSQNLKHVVKRNAAEIFIRHLEKLPRVVLGHEESLAVLHAQQLLTIIFYSGPRLLVDHLQSPVEAARFLDLFASCLSHNSVFSGSLEKITSTDRASTLGYLPSIAELKSGANFLNHGFPLINYSLCDVPKHRLIEEKSIEEPVKTAQNNYEVPRMPPWFNYVGSHKLYQPLARILRFVGLSLVADHISEGLLSHVIETLLGYFRKLVSELRLKEYNKESWQSWYDRNGSGQLLRQASTAACMLNEMIFGLSDQATNDFAGIFHSSSVSRGVRVESNKHDCAFQPSFWKMPNDKGVKSYLVECIGGILHEYLSAEVWNVPIDRRIADLQLIAAVEEDISLYFFQDAAMLREVIIDGVGIFNLCLGRDFVSSGFLHSSLYLLLENLSSSNYRVRKAADSVLHILSTTSGCPTVGQLVLENADYVIDSICRQLRHLDLNHHVPNVLASMLSYIGVAHKILPLLEEPMRSVSAELEILGRHQHPDLTVPFLKAVAEIVKASKHEAFLLPQQAESFTRDVRSIISNSEETTQDQWEDILFMLNDSRRYRRTVGSIAGSCITAAIPLLASFKQEICLAALDIIESGTLALAKVESAYKHEREIKEATEEVLQSLSLYQLKDTLDVNEEGADENRLLPAMNKIWPFLVTCIQNRNPVAIRRCLNVISNVVPVCGGDFFTRRFHTDGTHFWKLLTTSPFHKMSYFKDEKAPLQLPYRRSPVSSEDSLAETSYLKVQIAVLNMIADLCRNKSSASALELVLKKVSGLVVGIACSSVVGLRDASLNALHGLASIDPDLVWLLLADIYYTKKIETSPPPTPELPEISEILPPPISPKEHLYVQYGGQSYGFDIDLASLDIVFTKIDSQYQMYS

SEQ ID NO: 6502 - protein, 77 aa, Theobroma cacao
MGLWTILEGFLLLANALAILNEDRFLAPRGWSFTEFSAGRTKSFKGQLIGLIYATQYMRVPLILLNAICIVVKLVSG

SEQ ID NO: 6503 - protein, 77 aa, Gossypium hirsutum
  Sequence also found in Organisms: Gossypium raimondii
MGLWTILEGFLLLANALAILNEDRFLAPRGWSFSEFSAGRTKSFKGQLIGLIYATQYMRVPLILLNAICIFVKLVSG

SEQ ID NO: 6504 - protein, 815 aa, Triticum aestivum
MVVAVANGAKREAAAAANTTAAADADADSPISVLEEEKMAGSKDGKAGELKANGGEAHPIAEALKAEEQLLNSVKDETSVEPLDATSPLPIDLAAKNGDTSLITEVMTKEEEEMYQARIKLEEEEEARKREEAARQAFDPKAKFSKLDELLTQTQLYSEFLLEKMEQITDVKPTAVEIKDEEEPVEEQKKGRGRKRKAANKPQYNDKKAKTAVAAMLSRSREDRSADDGTLTEEEKWEREQANLVPLLTGGKLKSYQIKGVKWLISLWQNGLNGILADQMGLGKTIQTIAFLAHLKGNGLHGPYMVIAPLSTLSNWLNELTRFAPSINGLIYHGDKVARTELRRKHMPKTVGPDFPIIITSYEMAMFDAKFLANYKWKYVVVDEGHRLKNTKCKLLRELRRIPMDNKLLLTGTPLQNNLAELWSLLNFILPDIFSSHEEFESWFDFSGKADEELEEETDEKKRVLVVSKLHAILRPFLLRRMKEDVEHMLPRKKEIIIYANMTEHQKQIQNHLIEQTFDDYLHESADIVLRRPGIKTKLNNLLIQLRKNCGHPDLFHSAFDSNSLYPPVDKLLEQCGKFQLLDRLLNALIKRNHKVLIFSQWTKILDILDYYLSEKGLKVCRIDGNVKLEDRRNQIAAFNDLNSGMNVFILSTRAGGLGINLTSADTCILYDSDWNPQMDLQAMDRCHRIGQTQPVHVYRLATSNSVEGRIIKKAFGKLKLEHVVIGKGQFQQDAAKPNALDEGELLALLRDEQAEEDRMIQTDISDEDLLKVMDRSDLTGARAAADAAPHFPLKGPGWEVVVAAGGGMLSALTS

SEQ ID NO: 6505 - protein, 493 aa, Volvox carteri
MDPSKVRPSSAYNSPYWTTNSGAPVWNNNNSMTVGPRGPILLEDYHLIEKLAQFDRERIPERVVHARGAAAKGFFEVTHNVSHLTAADFLRAPGVQTPVIVRFSTVVHERGSPETLRDPRGFAVKFYTREGNYDMVGNNMPVFFIRDGMKFPDMVHAFKPNPKSHIQEAWRIMDFLSHHPESAHMLTFLLDDAGIPLNYRHMPGFGVHTFKLINRAGKETYVKFHWIPKCGEKYLLDDEAVLVGGANHSHATKDLYDAIAAGDYPEWTLMIQTMDPADEDKFDFDPLDVTKTWPESLFPLQPVGRMVLNRNVDNFFNDNEQVAFCPAIIVPGIGYTDDKLLQTRIFSYADTQRHRLGPNYLLLPVNAPRCPHHNNHHEGFMNIMHRDEEINYFPSRFDPVRNAERVAAVSTAPLSGRREKVVIAKENNFAQAGARWRSFDPARQERLVVRVADMLADPRCTQEIRRIWVGYWSQADPQLGSRIAAKLQGRGCL

SEQ ID NO: 6506 - protein, 476 aa, Volvox carteri
MAGFRPLNLVRPFLSVLPDVQQADRRVPFREKFLYTAVTLFIFLVCSQLPLYGIKTNSSSDPFYWVRVIMASNRGTCMELGISPIVTSGLVMQLLAGSKIIDVDNSVKADRELLNGAQKLLGVLITIGEAVAYVVSGMYGDVRELGPLNAILIITQLFFAGIIVICLDELLQKGYGLGSGISLFIATNICESIIWKAFSPYTIQSARGAEFEGAIIAMFHLIITRTDKVRALKEAFYRTNLPNMTNLLATIAVFLVVIYFQGFRVDLPVRNKRARGQQGNYPIKLFYTSNMPIILQSALVSNLYFISQLLYKRYGGNFLVQLLGRWQQTEYGSGQMIPVGGLVYYISPPSSLAEVAANPLHALFYVTFMLTACALFSKTWIEVSGSSASDVAKQLKEQQMFIQGHRDTTASLKKELNRYIPIAAAFGGMCIGALTIVADFMGAIGSGTGILLAVTIIYQYFETYEKEKAQAPGALF

SEQ ID NO: 6507 - protein, 485 aa, Gnetum gnemon
AAGRFCENAERGFRVLHLVRPFLSILPEVQTADRKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRELGAGNAILIILQLFFAGIIVICLDELLQKGYGLGSGISLFIATNICESIIWKAFSPTTINTGRGAEFEGAVIALFHLLITRTDKVRALREAFYRQNLPNVTNLLATVLVFLVVIYFQGFRVVLPVRSRNARGQQGSYPIKLFYTSNMPIILQSALVSNLYFISQLLYRRYSGNFLVNLLGKWKESEYSSGGQSIPVGGLVYYITPPSSLADMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6508 - protein, 479 aa, Abies balsamea
  Sequence also found in Organisms: Cedrus atlantica, Pinus pinaster, Pinus taeda
MPSGGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLVVIYFQGFRVVLPVRSKNARGQQGSYPIKLFYTSNMPIILQSALVSNLYFISQLLYRKYSGNFLVNLLGKWKESEYSSSGQFVPVGGLVYYITPPSSLADMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6509 - protein, 479 aa, Picea glauca
MPSGGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLVVIYFQGFRVVLPVRSKNARGQQGSYPIKLFYTSNMPIILQSALVSNLYFISQLLYRKYSGNFLVNLLGKWKESEYSSSGQVVPVGGLVYYITPPSSLADMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6510 - protein, 478 aa, Abies balsamea
  Sequence also found in Organisms: Cedrus atlantica
MPSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIADLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLVVIYFQGFRVVLPVRSKNARGQQGSYPIKLFYTSNMPIILQSALVSNLYFISQLLYRKYSGNFLVNMLGKWKESEYSSSGQSVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6511 - protein, 478 aa, Pinus taeda
MPSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIADLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLVVIYFQGFRVVLPVRSKNARGQQGSYPIKLFYTSNMPIILQSALVSNLYFISQLLYRKYSGNFLVNMLGKWKESEYSASGQSVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6512 - protein, 478 aa, Podocarpus macrophillus
MPSGGFRVLHLVRPFLSVLPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLYRRYSGNILVNLLGKWKESEYSSSGQFVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6513 - protein, 478 aa, Pseudotsuga menziesii
MPSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDISDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLVVIYFQGFRVVLPVRSKNARGQQGSYPIKLFYTSNMPIILQSALVSNLYFISQLLYRKYSGNFLVNMLGKWKESEYSSSGQSVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6514 - protein, 479 aa, Pseudotsuga menziesii
MPSGGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINTGRGAEFEGAVIALFHLLITRTDKVRALREAFYRQNLPNVTNLLATVLVFLVVIYFQGFRVVLPVRSKNARGQQGSYPIKLFYTSNMPIILQSALVSNLYFISQLLYRKYSGNFLVNMLGKWKESEYSSSGQFVPVGGLVYYITPPSSLAAMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6515 - protein, 477 aa, Ceratodon purpureus
MGGGFRVLHLVRPFLSVLPEVQTAERRVPFREKVMYTVVSLFIFLVCSQLPLYGIHSATGSDPFYWMRVILASNRGTVMELGITPIVTSGLVMQLLAGSKLIEVDNSVREDRALLNGAQKLLGVLITIGEAVAYVLSGMYGDVRDLGAGNAILIIIQLFFAGIIVICLDELLQKGYGLGSGISLFIATNICENIIWKAFSPTTINSGRGAEFEGAVIALFHLLFTRSDKVRALKEAFYRQNLPNVTNLLATVVVFLIVIYFQGFRVVLPVRSKSARGQQGSYPIKLFYTSNMPIILQSALVSNLYFISQLLFKRYSNNFVVNLLGKWKESEYSQSGQLIPVGGLVYYITPPTSLGDIVANPFHAVFYLTFMLTACALFSKTWIEVSGSSARDVAKQLKEQQMFMPGHRESNLQRELNRYIPTAAAFGGMCIGALTVVADFMGAIGSGTGILLAVTIIYQYFETFDKERASELGFFGF

SEQ ID NO: 6516 - protein, 478 aa, Cephalotaxus harringtonia
MPSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLYRRYSGNVLINLLGKWKESEYSSSGQFIPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6517 - protein, 487 aa, Pinus pinaster
MPSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIADLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLVVIYFQGFRVVLPVRSKNARGQQGSYPIKLFYTSNMPIILQSALVSNLYFISQLLYRKYSGNFLVNMLGKWKESEYSASGQSVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGFSAFVCILYL

SEQ ID NO: 6518 - protein, 470 aa, Distylium racemosum
MPSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLYRRYSGNFLVNMLGKWKESEYSSSGQFVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERA

SEQ ID NO: 6519 - protein, 475 aa, Distylium racemosum
MPSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALVNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLYRRYSGNFLVNMLGKWKESEYSSSGQSVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGF

SEQ ID NO: 6520 - protein, 478 aa, Podocarpus macrophillus
MPSGGFRVLHLVRPFLSILPEVQTAERKVPFREKVLYTVIALFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLHRRYSGNLLVNLLGKWKESEYSSSGQSIPVGGLVYYITPPSSLAEMAANPFHALFYLTFMLTACALFSKTWIEVSGSSARDVAKQLKEQQMVMPGHRESNLQKELNRYIPTAAAFGGICIGALTVMADFMGAIGSGTGILLAVTIIYQYFETFEKERASELGFFGF

SEQ ID NO: 6521 - protein, 477 aa, Sciadopitys verticillata
PSGGFRVLHLVRPFLSILPEVQTAERKVPFREKVLYTVISLFIFLVCSQLPLYGIHTATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLYRKYSGNFLINMLGKWKESEYSSSGQYVPVGGLVYYITPPSSLAEMASNPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6522 - protein, 478 aa, Sequoia sempervirens
MPSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLHRRYSGNFLINLLGRWKESEYSSSGQSVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6523 - protein, 478 aa, Sequoia sempervirens
MPSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLYRRYSGNFLINLLGKWKESEYSSSGQFVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6524 - protein, 478 aa, Picea glauca
MPSGGFRVLHLVRPFLSILPEVQTADRKVPFREKVLYTVISLFIFLVCSQLPLYGIHSATGADPFYWMRVILASNRGTVMELGITPLVTSGLVMQLLAGSKIIEVDNSVREDRELLNGAQKLLGVLITIGEAVAYVLSGMYGDITDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLYRKYSGNFLVNMLGKWKESEYSSSGQSIPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6525 - protein, 477 aa, Taxus baccata
PSGGFRVLHLVRPFLSILPEVQTAERKVPFREKVLYTVISLFIFLVCSQLPLYGIHSATGADPFYWMRVILASNRGTVMELGITPIVTSGLVMQLLAGSKIIEVDNSVREDRALLNGAQKLLGVLITIGEAVAYVLSGMYGDIRDLGAGNAILIIVQLFFAGIIVICLDELLQKGYGLGSGISLFIATNICESIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILQSALVSNLYFISQLLYRRYSGNFLINMLGKWKESEYSSSGQFVPVGGLVYYITPPSSLAEMAANPFHALFYLTFMLTACALFSKTWIEVSGSSARDVAKQLKEQQMVMPGHRESNLQKELNRYIPTAAAFGGMCIGALTVMADFMGAIGSGTGILLAVTIIYQYFETFEKERASELGFFGF

SEQ ID NO: 6526 - protein, 1037 aa, Volvox carteri
MRRAARLLRGVGQAAQSRSGAVHEAVKLFDINNARLLSTQSTCLLGALSHASTILPSSFAASGVRFIAVDALLPSDDFKPRHNSGSPAEIDAMVNMTGFSSLDALIDATVPKAIVRKDGMDLGKYHEGMTESQFLSYFKSMAGKNKVLKSFLGMGYYDVHVPPVILRNVLENPGWYTQYTPYQAEIAQGRLESLLNFQTMVCDLTGMSISNASLLDEATAAAEAMTMCSAVARGKKPKFLVSSKCHPQTIAVCQTRAEGLGLEAVVADEDKFVYGKDVCGVLVQYPATDGTVSDYKALVAAAHAANVKVCVSTDLLALTMLTPPGEWGADIVVGSAQRFGVPMGYGGPHAAFLACHDEYKRLMPGRIIGMSIDAQGKPALRMAMQTREQHIRRDKATSNICTAQALLANMAALYAVYHGPEGLKTIARRVNGLASVLAAGASKLGHGVPSAPFFDTVTVTLKDGDADKYVKLALNEKMNIRKIAPNAISIAFDETSTLADVDALLRVLNNGQDAPFNAAALAPAVEGGVGPFARQSPFLQQPIFNTYHNEHDMLRYLKRLENKDLSLAHSMIPLGSCTMKLNATSEMMPVTWPELANLHPYCPPDQAEGYNEMFRDLAAQLCSITGFDAVSLQPNSGASGEYAGLMAIRSYHLARGDAHRNICIIPVSAHGTNPASAVMAGMKIVTVSTDAHGNVNIAELKQKAEQHSKNLAALMITYPSTHGVYEEGVDEICRIIHQHGGQVYMDGANMNAQVGLTAPGIIGADVCHLNLHKTFCIPHGGGGPGMGPIGVKAHLAPYLPTHPVIPTGALPVRPAAPQPFGTMAAAPYGSSLILPISFAYISMMGSGGLTMASKLAILKANYMAKRLAGHYPVLFTGPNGTCAHEFILDLRPLKETAGIEAEDVAKRLMDYGFHAPTMSWPVPGTLMIEPTESESKDELDRFCEAMISIREEIREIEQGRADRENNVLKHAPHAPSVVLVDTWDRPYTRERAAYPAPWVWQAKFWPTVSRVDNVYGDRNLVTRWASAEAAEPVAATA

SEQ ID NO: 6527 - protein, 393 aa, Theobroma cacao
MASISSVIAWGSGEDGQLGIGNNEEKEWVCVVKALEPHNVRSVVAGSRNSLAICDDGKLFTWGWNQRGTLGHPPETKTENIPSPVKALANVNIVQAAIGGWHCLAVDDKGRAYAWGGNEYGQCGEEPERKDGTGRPLRRDIVNPQRCAPKLVVRQVAAGGTHSVVLTREGHVWTWGQPWPPGDITQISVPVRVQGLENVRLIAVGAFHNLALQEDGTLWAWGNNEYGQLGTGDTQPRSQPILVQGLSGLTLVDIAAGGWHSTALTDDGEVYGWGRGEHGRLGFGDNDKSSKMVPQRVHLLASEDIVQVSCGGTHSVALTRDGCMFSFGRGDHGRLGYGRKVTTGQPMEVPVNLPAPKNVNGSGAEGHWISKLVACGGRHTLAIVEWKTHESKP

SEQ ID NO: 6528 - protein, 391 aa, Citrus clementina
MASTTSIIAWGSGEDGQLGIGNNEEREWVCVVKALEPYKVRSVVAGSRNSLAICDDGKLFTWGWNQRGTLGHPPETKTENVPSQVNALSNTKIVQAAIGGWHCLAVDDQGRAYAWGGNEYGQCGEEPERKDDTGRILRRDIVIPQRCAPKLIVRQVAAGGTHSVVLTREGHVWTWGQPWPPGDIKQISVPVRVQGLEQVKLIAVGAFHNLALQEDGALWAWGNNEYGQLGTGDTQPRSQPIPVQGLSGLTLVDIAAGGWHSTALTDDGEVYGWGRGEHGRLGFGDNDKSSKMVPQKVNLLAGEDIVQVSCGGTHSVALTRDGHIFSFGRGDHGRLGYGRKVTTGQPMEVPINIPAPRNAGDGVDGRWIAKLVACGGRHTLAIVEWQTEESK

SEQ ID NO: 6529 - protein, 391 aa, Citrus sinensis
MASTTSIIAWGSGEDGQLGIGNNEEREWVCVVKALEPYKVRSVVAGSRNSLAICDDGKLFTWGWNQRGTLGHPPETKTENIPSQVNALSNTKIVQAAIGGWHCLAVDDQGRAYAWGGNEYGQCGEEPERKDDTGRILRRDIVIPQRCAPKLIVRQVAAGGTHSVVLTREGHVWTWGQPWPPGDIKQISVPVRVQGLEQVKLIAVGAFHNLALQEDGALWAWGNNEYGQLGTGDTQPRSQPIPVQGLSGLTLVDIAAGGWHSTALTDDGEVYGWGRGEHGRLGFGDNDKSSKMVPQKVNLLAGEDIVQVSCGGTHSVALTRDGHIFSFGRGDHGRLGYGRKVTTGQPMEVPINIPAPRNAGDGVDRRWIAKLVACGGRHTLAIVEWQTEESK

SEQ ID NO: 6530 - protein, 392 aa, Populus trichocarpa
MATESSVIAWGSGEDGQLGIGNNEEKEWVCIVKALEPYKVRSVVAGSRNSLAICDDGKLFTWGWNQRGTLGHPPETKTENIPSQVKALANVNIVQAAIGGWHCLAVDDQGRAYAWGGNEYGQCGEEPERKDDTGRPLRRDIVIPQRCASKLVVRQVAAGGTHSVVLTREGHVWSWGQPWPPGDIKQISVPVRVQGLERVRLIAVGAFHNLALQEDGTLWAWGNNEYGQLGTGDTQPRSQPITVQGLSGLTLVDIAAGGWHSTALTDDGEVYGWGRGEHGRLGFGDNDKSSKMVPQRVNLLVGEDIVQVSCGGTHSVALTRDGRMYTFGRGDHGRLGYGRKVTTGQPMEVPIDIPPPKNLTDSGDAGRWIAKLVASGGRHTLAIVEWHTGDSK

SEQ ID NO: 6531 - protein, 393 aa, Ricinus communis
MATHTSLIAWGAGEDGQLGIGINEEKEWVCVVNALEPYKVRSVVAGSRNSLAICDDGKLFTWGWNQRGTLGHPAETKTENIPSQVKALNNVNIVQAAIGGWHCLAVDDQGRAYAWGGNEYGQCGEEPERKDDTGKTLRRDIVIPQRCAPKLVVRQVAAGGTHSVVLTREGHVWTWGQPWPPGDIKQISVPVRVQGLEKVKLIAVGAFHNLALQEDGTLWAWGNNEYGQLGTGDTQPRSQPIPVQGLSGLTLVDIAAGGWHSTALTDDGEVYGWGRGEHGRLGFGDNDKSSKMVPQKVNLLAGEDIVQLSCGGTHSVALTQDGRMFSFGRGDHGRLGYGKKVTTGQPVEVPTDIPPPKSLSGTEEAEGHWIAKLVACGGRHTLAIVEWKVDESK

SEQ ID NO: 6532 - protein, 393 aa, Arachis hypogaea
MDSNSHIIAWGSGEDGQLGIGNNEEKEWVCVVKALDHQRVRSVVAGSRNSLAICDDGKLFTWGWNQRGTLGHPPETKTENIPSQVKALANVKIVQAAIGGWHCLAVDDQGRAYAWGGNEYGQCGEEPERKDDTGRPLRRDIVIPQRCAHKLVVRQVAAGGTHSVVLTREGHVWTWGQPWPPGDIKQISVPVRVQGLENVRHIAVGAFHNLALQEDGTLWAWGNNEYGQLGTGDTQPRSQPIPVQGLSGLNLVDIAAGGWHSTALTDEGEVYGWGRGEHGRLGFGDSDKSSKMLPQKVQLLAGEDIIQVSCGGTHSVALTRDGRIFSFGRGDHGRLGYGRKVTTGQPMEVPINIPPPQSSNDNVTEGQWIAKLVACGGRHTLAIVDWEVDESRD

SEQ ID NO: 6533 - protein, 395 aa, Quercus alba
MASNTSAIIAWGSGEDGQLGIGNNEEKEWAYPIKALDSYSVRSVVAGSRNSLAICDDGKLFTWGWNQRGTLGHPPETKTENIPSQVKALANVKIVQAAIGGWHCLAVDEQGRAYAWGGNEYGQCGEEPERKDDTGRPLRRDIVIPKICAPKLVVRQVAAGGTHSVVLTRDGNVWTWGQPWPPGDIKQISVPVRVQGLESVRLIAVGAFHNLALQEDGTLWAWGNNEYGQLGTGDTQPRSQPIPVNGLSGLTLVDIAAGGWHSTALTDDGEVYGWGRGEHGRLGFGDNDKSSKMVPQRVNLLAGEDIVQVSCGGTHSVALTRDGRIFSFGRGDHGRLGYGRKVTTGQPLEVPINIPPPRNLGDAAAEGRWIAKLVACGGRHTLAIVEWKDTDESKQ

SEQ ID NO: 6534 - protein, 393 aa, Manihot esculenta
MATHTSLIAWGSGEDGQLGIGNNEEKEWVCVVKALEPYKVRSVVAGSRNSLAICDDGKLFTWGWNQRGTLGHPPETKTENVPSQVKALANANIVQAAIGGWHCLAVDDQGRAYAWGGNEYGQCGEEPERKDGTGRPLRRDIVIPQRCAPKLVVRQVAAGGTHSVVLTREGYVWTWGQPWPPGDIKQISVPVRVQGLERVKLIAVGAFHNLALQGDGTLWAWGNNEYGQLGTGDTQPRSQPIPVQGLSDLTLVDIAAGGWHSTALTDDGEVYGWGRGEHGRLGFGDNDKSSKMVPQKVHLLAGKKIVQVSCGGTHSVALTHDGQIFSFGRGDHGRLGYGRKVTTGQPMEVPIDIPPPSNLSGSEAEGHWKAKLVACGGRHTLAIVEWQQTDGSK

SEQ ID NO: 6535 - protein, 391 aa, Prunus mume
MASDAAIVTWGSGEDGQLGIGNNEEKEWVCVVEALQSRTVRSVVAGSRNSLAICDDGKLFTWGWNQRGTLGHPPETKTENIPSQVKALANVKIVQAAIGGWHCLAVDDQGRAYAWGGNEYGQCSEEPERKDDTGRPLRRDIVIPQRCAPKLVVRQVAAGGTHSVVLTRDGQVWTWGQPWPPGDIKQISTPVRVQGLDAVKLIAVGAFHNLALQEDGTLWAWGNNEYGQLGTGDTQPRSQPIPVQGLSGLTLVDIAAGGWHSTALTDDGEVYGWGRGEHGRLGFGDNDKSSKMVPQRVHLLAGEDIVQVSCGGTHSVALTRDGRMFSFGRGDHGRLGYGRKVTTGQPMEVPINIPPRNGTEDNGHWIAKLVACGGRHTLAIVVWKADEAEES

SEQ ID NO: 6536 - protein, 391 aa, Prunus persica
MASDAAIVTWGSGEDGQLGIGNNEEMEWVCVVEALQSRTVRSVVAGSRNSLAICDDGKLFTWGWNQRGTLGHPPETKTENIPSQVKALANAKIVQAAIGGWHCLAVDDQGRAYAWGGNEYGQCSEEPERKDDTGRPLRRDIVIPQRCAPKLVVRQVAAGGTHSVVLTRDGQVWTWGQPWPPGDIKQISTPVRVQGLDAVKLIAVGAFHNLALQEDGTLWAWGNNEYGQLGTGDTQPRSQPIPVQGLSGLTLVDIAAGGWHSTSLTDDGEVYGWGRGEHGRLGFGDNDKSSKMVPQRVHLLAGEDIVQVSCGGTHSVALTRDGRMFSFGRGDHGRLGYGRKVTTGQPMEVPINIPPRNGTEDNGHWIAKLVACGGRHTLAIVDWKADEAEES

SEQ ID NO: 6537 - protein, 394 aa, Cicer arietinum
MDSNSHIITWGSGEDGQLGIGSNDDKEWVCAVKALSSQSVRSVVAGSRNSLAICNDGKLFTWGWNQRGTLGHPPETKTENIPSQVKALAHVQIVQAAIGGWHCLAVDDHGRAYAWGGNEYGQCGEEPERKDDTGRPLRRDIMIPQRCAPKLVVRQVAAGGTHSVVLTREGHVWTWGQPWPPGDIKQISVPVRVQGLENVRLIAVGAFHNLALQEDGTLWAWGNNEYGQLGTGDTQPRSQPIPVQGLSGLTLVDIAAGGWHSTALTDEGEVYGWGRGEHGRLGFGDSDKSSKMLPQRVQLLTGEEIVQVSCGGTHSVALSRDGRIFSFGRGDHGRLGYGRKVTTGQPMEVPIDISPPQNFSGSEAAGRWIAKLVACGGRHTLAIVEWKEDDESKD

SEQ ID NO: 6538 - protein, 389 aa, Populus trichocarpa
MATESSVIAWGSGEDGQLGIGNNEDKEWVCVVKALEPYKVRSVVAGSRNSLAICDDGKLFTWGWNQRGTLGHPPETKTENIPSQVKALANVNIVQAAIGGWHCLAVDDQGRAYSWGGNEYGQCGEEPERKNDTGRPLRRDIVIPQRCASNLVVRQVAAGGTHSVVLTREGHVWTWGQPWPPGDIKQISVPVRVQGLERVRLIAVGAFHNLALQEDGTLWAWGNNEYGQLGTGDTQPRSQPILVQGLSGLNLVDIAAGGWHSTALTDDGEVYGWGRGEHGRMGFGDNDKSSKMVPQKVNLLAGEDIIQVSCGGTHSVALTRDGQMFSFGRGDHGRLGYGRNVTTGQPMEVPIDIPPPKKLRDSGDEGHWIAKLVGCGGRHTLAIVEVAET

SEQ ID NO: 6539 - protein, 391 aa, Cajanus cajan
MDSHSHIIAWGSGEDGQLGIGNNEEKEWVSVVKALQPHRLRSVVAGSRNSLAIADDGKLFTWGWNQRGTLGYLSETETKTENIPGQLKALSGVKILQAAIGGWHCLAVDDQGRAYAWGGNEYGQCGEEPKDDTGRLLRRDIVIPQRCAPKLVVRQVAAGGTHSVVLTREGHVWTWGQPWPPGDIKQISVPVRVQGLENVRLIAVGAFHNLALQEDGTLWAWGNNEYGQLGTGDTQPRSQPIPVQGLSDLTLVDIAAGGWHSTALTDEGEVYGWGRGEHGRLGFGDSDKSSKMVPQKVQLLAGEDIVQVSCGGTHSVALTRDGRMFSFGRGDHGRLGYGRKVTTGQPMEVPINIPPPQNLSDSAAEGHWIAKLVACGGRHTLAIVEWKPNES

SEQ ID NO: 6540 - protein, 397 aa, Cannabis sativa
MASDSAIIAWGSGEDGQLGLGSNEDKEWVSVVKALESQNVRSVVAGSRNSLAICEDGKLFTWGWNQRGTLGHPPETKTENIPSQVKALANVKIVEAAIGGWHCLAVDDQGRAYAWGGNEYGQCGEEPERKDDTGRPLRRDIVIPQRCAPKLVVRQVAAGGTHSVVLTREGQVWTWGQPWPPGDIKQISIPVRVQGLEAVRVIAVGAFHNLALQEDGTLWAWGNNEYGQLGTGDTQPRSQPIPVQGLSGLTLVDIAAGGWHSTALTDEGEVYGWGRGEHGRLGFGDNDKSSKMVPQKVNLLAGEDIVQVSCGGTHSVALTRDGRIFSFGRGDHGRLGYGRKVTTGQPMEVPIDLSPPTENTTTDDEEGEERWIAKLVACGGRHTLAIVQWQIHDESNQ

SEQ ID NO: 6541 - protein, 395 aa, Glycine max
MDSHSHIIAWGSGEDGQLGIGSNEEKEWVCLVKALQPHRIRSVVAGSRNSLAIADDGKLFTWGWNQRATLGHPAETKSENKTENTPSQVKALSSVKIVQAAIGGWHCLAVDDQGRAYAWGGNEYGQCGEEPERKDGTGRPLRRDIEIPQRCAPKLVVRQVAAGGTHSVVLTREGHVWTWGQPWPPGDIKQISVPVRVQGLENVRLIAVGAFHNLALQEDGTLWAWGNNEYGQLGTGDTQPRSQPIRVQGLSDLTLVDIAAGGWHSTALTDEGEVYGWGRGEHGRLGFGDSDKSSKMVPQKVQLLAGEDIVQVSCGGTHSVALTRDGHMFSFGRGDHGRLGYGRKVTTGQPMEVPIDLPPPQDPSGTATEGHWIAKLVACGGRHTLAIVEWKSNES

SEQ ID NO: 6542 - protein, 391 aa, Trigonella foenum-graecum
MASHIIAWGSGEDGQLGIGTNDDKERVCAVNALPSQRVRSVVAGSRNSLAISDDGKLFTWGWNQRGTLGHPAETKTENIPSQVKALSHVHIVQAAIGGWHCLAVDDHGRAYAWGGNEYGQCGEEPERKDDNGRPLRRDIVIPQPCAPKLSVRQVAAGGTHSVVLTREGHVWTWGQPWPPGDIKQISVPVRVQGLDNIRLIAVGAFHNLALQEDGTLWAWGNNEYGQLGTGDTQPRSQPIHVQGLSGLTVVDIAAGGWHSTALTDEGEVYGWGRGEHGRLGFGDSDKSSKMLPQRVQLLAGEDIIQVSCGGTHSVALTRDGRIFSFGRGDHGRLGYGRKVTTGQPMEVPINIPPPQNLDDSEAEGNWIAKLVACGGRHTLAIVEWKEDESKD

SEQ ID NO: 6543 - protein, 395 aa, Castanea mollissima
MASNTSAIITWGSGEDGQLGIGNNEEKDWAYPIKALDSYSVRSVVAGSRNSLAICDDGKLFTWGWNQRGTLGHPPETKTENIPSQVKALANVKIVQAAIGGWHCLAVDEQGRAYAWGGNEYGQCGEEPERKDDTGRTLRRDIVIPKICAPKLVVRQVAAGGTHSVVLTRDGNVWTWGQPWPPGDIKQISVPVRVQGLESVRLIAVGAFHNLALQEEGTLWAWGNNEYGQLGTGDTQPRSQPIRVNGLSGLTLVDIAAGGWHSTALTDNGEVYGWGRGEHGRLGFGDNDKSSKMVPQRVNLLAGEDIVQVSCGGTHSVALTRDGRIFSFGRGDHGRLGYGRKITNGQPLEVPINIPPPRNLGDAAAEGRWMAKLVACGGRHTLAIVEWKDTDESKQ

SEQ ID NO: 6544 - protein, 394 aa, Trifolium pratense
MVSSNSHIIAWGSGEDGQLGIGTNEDKEWVCTVKALPSQRVRSVVAGSRNSLAICHDGKLFTWGWNQRGTLGHPAETKTENIPSQVKALSHVHIVQAAIGGWHCLAVDDHGRAYAWGGNEYGQCGEEPERKDDNGRPLRRDIVIPQPCAPKLSVRQVAAGGTHSVVLTREGHVWTWGQPWPPGDIKQISVPVRVQGLENIRLIAVGAFHNLALQEDGTLWAWGNNEYGQLGTGDTQPRSQPIHVQGLSGLNLVDIAAGGWHSTALTDDGEVYGWGRGEHGRLGFGDSDKSSKMLPQRVQLLAGEDIVQVSCGGTHSVALTRDGRIFSFGRGDHGRLGYGRKVTTGQPVEVPIEIPPPQNLSDGDAEGTWIAKLVACGGRHTLAIVEWKEDESKD

SEQ ID NO: 6545 - protein, 266 aa, Fagus grandifolia
MASNSNNPAIIAWGSGEDGQLGIGNNEEKEWACIIKSLQSYSVRSVVAGSRNSLAICDDGKLFTWGWNQRGTLGHPPETKTENIPSQVKALANVNIVQAAIGGWHCLAVDDQGRAYAWGGNEYGQCGEEPERKDDTGRPLRRDIVIPQRCAPKLVVRQVAAGGTHSVVLTRDGHVWTWGQPWPPGDIKQISVPVRVLGLESVRLIAVGAFHNLALQEDGILWAWGNNEYGQLGTGDTQPRSQPIPVHGLSGLTLVDIAAGGCILPY

SEQ ID NO: 6546 - protein, 395 aa, Castanea mollissima
MASNTSAIITWGSGEDGQLGIGNNEEKDWAYPIKALDSYSVRSVVAGSRNSLAICDDGKLFTWGWNQRGTLGHPPETKTENIPSQVKALANVKIVQAAIGGWHCLAVDEQGRAYAWGGNEYGQCGEEPERKDDTGRTLRRDIVIPKICAPKLVVRQVAAGGTHSVVLTRDGNVWTWGQPWPPGDIKQISVPVRVQGLESVRLIAVGAFHNLALQEEGTLWAWGNNEYGQLGTGDTQPRSQPIRVNGLSGLTLVDIAAGGWHSTALTDNGEVYGWGRGEHGRLGFGDNDKSSKMVPQRVNLLAGEDIVQVSCGGTHSVALTRDGRIFSFGRGDHGRLGYGRKITNGQPLEVPINIPPPRNLGDAAAEGRWMAKLVACGGRHTLAIVKWKDTDESKQ

SEQ ID NO: 6547 - protein, 104 aa, Humulus lupulus
MVPQKVNLLAGEDIVQVSCGGTHSVALTRDGRIFSFGRGDHGRLGYGRKVTTGQPMEVPINLSPPTENTTDDEGEERWIAKLVASGGRHTMAIVQWQTHDESKQ

SEQ ID NO: 6548 - protein, 388 aa, Tropaeolum majus
MASPTSIIVWGSGEDGQLGIGNNVEKELVTVVKAVEPYNVRSVVAGSRNSLAICDDGKLFTWGWNQRGTLGHPSETKTENVPSQVKALANVKIVQAAIGGWHCLAVDDQGRAYAWGGNEYGQCGEELERKDDAGRPLRRDIVIPQRCASKLVVKQVAAGGTHSVVLTREGHVWTWGQPWPPGDIKQISVPVRVQGLEGVKVISVGAFHNLALQDDETVWAWGNNEYGQLGTGDTQPRSQPIPVQGLSGLTLVDIAAGGWHSTALTDEGEVYGWGRGEHGRLGFGDNDKSSKMLPQKVNLLAGEDIIQVSCGGTHSVALTRDGHMFSFGRGDHGRLGYGRKVTTGQPMEVPINIPPPRESGEKAEGNWFAKVVACGGRHTLAIVEWKTE

SEQ ID NO: 6549 - protein, 395 aa, Vigna unguiculata
MDSHSCIIAWGSGEDGQLGIGNNEEKEWVCLVEALQPHRFRSVVAGSRNSLAIGEDGKLFTWGWNQRSTLGHPAESKSENKIENIPSQVKALSSVKIVQAAIGGWHCLAVDDQGRAYAWGGNEYGQCGEEPERKDDTGRPLRRDIDIPQRCAPKLVVRQVAAGGTHSVVLTREGHVWTWGQPWPPGDIKQISVPVRVQGLESVRLIAVGAFHNLALQEDGTLWAWGNNEYGQLGTGDTQPRSQPIPVQGLSDLTLVDIAAGGWHSTALTDEGEVYGWGRGEHGRLGLGDSDKSSKMVPQKVQLLAGEDIVQVSCGGTHSVALTRDGRMFSFGRGDHGRLGYGRKVTTGQPMEVPINLPPPHNLTATEAEGHWIAKLVACGGRHTLAIVQWNNRSS

SEQ ID NO: 6550 - protein, 394 aa, Trifolium pratense
MDSTNSHIIAWGSGEDGQLGIGTNEDKEWVCTVKALPSQRVRSVVAGSRNSLAICHDGKLFTWGWNQRGTLGHPAETKTENIPSQVKALSHVHIVQAAIGGWHCLAVDDHGRAYAWGGNEYGQCGEEPERKDDNGRPLRRDIVIPQPCAPKLSVRQVAAGGTHSVVLTREGHVWTWGQPWPPGDIKQISVPVRVQGLENIRLIAVGAFHNLALQEDGTLWAWGNNEYGQLGTGDTQPRSQPIHVQGLSGLNLVDIAAGGWHSTALTDDGEVYGWGRGEHGRLGFGDSDKSSKMLPQRVQLLAGEDIVQVSCGGTHSVALSRDGHIFSFGRGDHGRLGYGRKVTTGQPVEVPIEIPPPQNLNDGEAEGTWIAKLVACGGRHTLAIVEWKEDESKD

SEQ ID NO: 6551 - protein, 393 aa, Amsonia hubrichtii
MAASKTAVIAWGSGEDGQLGIGNNEEKEWVCVIKALEAYNVCSVVAGSRNSLAICDDGKLFTWGWNQRGTLGHPPETKTENIPSQVKALANVKIVQAAIGGWHCLAVDDQGRAYAWGGNEYGQCGEEPERKDDNGKPVRRDIVIPQRCVPKLTVRQVAAGGTHSVVLTREGHVWTWGQPWPPGDIKQISTPVRVQGLESVRLIAVGAFHNLALLDDGILMAWGNNEYGQLGTGDTQPRSQPIPVQGLSGFTLVDIAAGGWHSTALTDEGEVYGWGRGEHGRLGFGDDKSSKMVPQKVQLLVGEDIVQVSCGGTHSVSLTSDGRMFSFGRGDHGRLGYGRKVTTGHPSEVPINVSPPRDLSGEEAEGRWCAKYVACGGRHTLAIVEWHTRVSEQ

SEQ ID NO: 6552 - protein, 393 aa, Phaseolus vulgaris
MDSHSRIIAWGSGEDGQLGIGNNEEKEWVSLVEALEPQRFRSIVAGSRNSLAIGDDGKLFTWGWNQRGTLGHPAENKSENKIENIPSQVKDLSSVKIVQAAIGGWHCLAVDDQGRAYAWGGNEYGQCGEEPERKDRPLRRDIEIPQRCAPKLVVRQVAAGGTHSVVLTREGHVWTWGQPWPPGDIKQISVPVRVQGLESVRLIAVGAFHNLAFQEDGTLWAWGNNEYGQLGTGDTQPRSQPIPVQGLSDLTLVDIAAGGWHSTALTDEGEVYGWGRGEHGRLGFGDSDKSSKMVPQKVQLLAGEDIVQVSCGGTHSVALTRDGRMFSFGRGDHGRLGYGRKVTTGQPMEVPINLPPPHNLTATEAEGHWFAKLVACGGRHTLAIVEWKTDHLN

SEQ ID NO: 6553 - protein, 395 aa, Catharanthus roseus
MAASETKTAVISWGSGEDGQLGIGNNEEKEWVCKIKALEPYNVCSVVAGSRNSLAICDDGKLFTWGWNQRGTLGHPPETKTENVPSQVKALANVKIVQAAIGGWHCLAVDDQGRAYAWGGNEYGQCGEEPERKDDTGKPVRRDIVIPQRCVPKLTVRQVAAGGTHSVVLTREGHVWTWGQPWPPGDIKQISTPVRVQGLESVRVIAVGAFHNLALLNDGILMAWGNNEYGQLGTGDTQPRSQPIPVQGLSGLTVVDIAAGGWHSTALTDEGEVYGWGRGEHGRLGFGDDKSSKMVPQRVQLLVGEDIVQVSCGGTHSVALTRDGRMFSFGRGDHGRLGYGRKVTTGHPSEVPINIPPPEHLSSSEAEGRWCAKYVACGGRHTLAIVEWQNRVSEQ

SEQ ID NO: 6554 - protein, 395 aa, Vitis vinifera
MASKPKAIISWGSGEDGQLGIGNNEEKEWVCAVKALAAQNVCSVVAGSRNSLAICEDGKLFTWGWNQRGTLGHPPETKTENIPSQVKALANAKIVQAAIGGWHCLAVDDQGRAYAWGGNEYGQCGEEPERKDDTGRPLRRDITIPQRCASKLSVRQVAAGGTHSVVLTREGHVWTWGQPWPPGDIKQISTPVRVQGLEKVRLIAVGAFHNLALLEDGILWAWGNNEYGQLGTGDTQPRSQPIAVQGLSDLTLVDIAAGGWHSTALTDDGGVYGWGRGEHGRLGFGDDKSSKMVPQKVQLLVEENIVQISCGGTHSVALTRDGRMFSFGRGDHGRLGYGRKVTTGHPMEVPINLPPATNLSGSGAGGHWCSKLVACGGRHTLAIVEWLAHEPEQLI

SEQ ID NO: 6555 - protein, 394 aa, Trifolium pratense
MDSTNSHIIAWGSGEDGQLGIGTNEDKEWVCTVKALPSQRVRSVVAGSRNSLAICHDGKLFTWGWNQRGTLGHPAETKTENIPSQVKALSHVHIVQAAIGGWHCLAVDDHGKAYAWGGNEYGQCGEEPERKDDNGRPLRRDIVIPQPCAPKLVVRQVAAGGTHSVVLTREGHVWTWGQPWPPGDIKQISVPVRVQGLENIRLIAVGAFHNLALQEDGTLWAWGNNEYGQLGTGDTQPRAQPIHVQGLSGLNLVDIAAGGWHSTALTDDGEVYGWGRGEHGRLGFGDSDKSSKMLPQRVQLLAGEDIVQVSCGGTHSVALSRDGHIFSFGRGDHGRLGYGRKVTTGQPVEVPIEIPPPQNLNDGEAEGTWIAKLVACGGRHTLAIVEWKEDESKD

SEQ ID NO: 6556 - protein, 392 aa, Eucalyptus grandis
MSTLSAVIAWGSGEDGQLGLGDNEEKDCVCDISALYPHEVRSVVAGSRNSLAICEDGQLFTWGWNQRGTLGHPPETKTENTPSQVKALANVKIVQAAIGGWHCLAVDDQGRAYAWGGNEYGQCGEEPGRKDDTGKPLRRDIVIPQRCASQLIVRQVAAGGTHSVVLTHDGQVWTWGQPWPPGDIKQISVPVRVQGLEKVRLISVGAFHNMALQEDGTLLAWGNNEYGQLGTGDTQPRSQPVIVHGLAGLTLVDIAAGGWHSTALTDDGEVYGWGRGEHGRLGFGDNDKSSKMVPQKVHLLTGEDIIQVSCGGTHSVALTRDGRMFSFGRGDHGRLGYGRKVTTGQPGEVPINLPPPGNLNGTEAEGSWVAKLVACGGRHTLAIVEWQTHETK

SEQ ID NO: 6557 - protein, 389 aa, Panax ginseng
MASNTSVIAWGSGEDGQLGIGNNEEKEWVCSIKSLHSQNVRSVVAGSRNSLAICHDGKLFTWGWNQRGTLGHPPETKTENIPSQVKALSTVKIVQAAIGGWHCLAVDDQGRAYAWGGNEYGQCGEEPERKDDTAKPLRRDIVIPQRCAPKLSVRQVAAGGTHSVVLTREGHVWTWGQPWPPGDIKKISTPVRVQGLERVKLIAVGAFHNLALLEDGSLWAWGNNEYGQLGTGDTQPRSQPIPVHGLSDLTLVDIAAGGWHSTAITGEGEVYGWGRGEHGRLGFGDDKSSKMVPQRVQLLVGEEIVQVSCGGTHSVALTRDGRMFSFGRGDHGRLGYGRKVTTGHPSEVPINLPRPNPRDAEAEGHWSAKLVACGGRHTLAISEWCPDDI

SEQ ID NO: 6558 - protein, 390 aa, Lupinus angustifolius
MDDSNSTIIAWGSGEDGQLGIGMNEEKEWVCLIKSLQPYRLLSIVAGSRNSLSISHDGKLFTWGWNQRGTLGHPPETKTENIPSQVKALDSVKIVQAAIGGWHCLAVDDQGRAYAWGGNEYGQCGEEPERKDDTGRPLRRDIVIPQRCAPKLVVRQVAAGGTHSVVLTREGHVWTWGQPWPPGDIKQISVPVRVQGLDNVKVIAVGAFHNLALQEDGTLWAWGNNEYGQLGTGDTQPRSQPIRVQGLSGLTLVDIAAGGWHSTALTEDGEVYGWGRGEHGRLGFGDSDKSSKMLPQKVQLLAGEDIVQVSCGGTHSVALTRDGRMFSFGRGDHGRLGYGRKVTTGQPMEVPIDIPPPQNLSGSAAEGHWISKLVACGGRHTLDEPNETDS

SEQ ID NO: 6559 - protein, 398 aa, Medicago truncatula
MASNIIAWGSGEDGQLGIGTNEDKEWVCSVKALPSQHVRSVVAGSRNSLAILNDGKLFTWGWNQRGTLGHPAETKTENIPSQVKALSHAHIVQAAIGGWHCLAVDDHGKAYAWGGNEYGQCGEEPERKDDNGRPLRRDIVIPQPCAPKLSVRQVAAGGTHSVVLTREGHVWTWGQPWPPGDIKQISVPVRVQGLDNIKLIAVGAFHNLALQEDGTLWAWGNNEYGQLGTGDTQPRSQPVPVQGLSGLTVVDIAAGGWHSTALTDDGEVYGWGRGEHGRLGFGDSDKSSKMLPQRVQLLAGEDIVQVSCGGTHSVALTRDGRIFSFGRGDHGRLGYGRKVTTGQPMEVPIDIPPPQNLGDADGEAEGNWIAKLVACGGRHTLAIVEWKDDESKAESIHD

SEQ ID NO: 6560 - protein, 394 aa, Fragaria vesca
MASDTAIIAWGSGEDGQLGIGCNDDKELVCVVTALESQTVRSVVAGSRNSLAICDDGKLFTWGWNQRGTLGHPPESKTENVPSQVEALSNVKIVQAAIGGWHCLAVDDQGRAYAWGGNEYGQCGEEPERDTGKPLKRDIVIPQRCAPKLVVRQVAAGGTHSVVLTREGHVWTWGQPWPPGDIKQISTPVRVQGLDKVKLIAVGAFHNLALQEDGTLWAWGNNEYGQLGTGDTQPRSQPIPVNGLSGLTLVDIAAGGWHSTALTDDGEVYGWGRGEHGRLGFGDNDKSSKMVPQKVHLLAGEDIVQVSCGGTHSAALTRDGRIFSFGRGDHGRLGYGRKVTTGHPMEVPIELPPKNVTDGEAHGHWIAKLIASGGRHTLAIVEWKSDETTENGDA

SEQ ID NO: 6561 - protein, 400 aa, Malus domestica
MVSDTTIVTWGSGEDGQLGIGNNEEKEWVCAVKALESQTVRSVVAGSRNSLAICDDGKLFTWGWNQRGTLGHPPETKSENIPSQSKTENIPSQVKALANVKIVQAAIGGWHCLAVDDQGRAYAWGGNEYGQCGEEPERKDETSRPLRRDIVIPQRCAPKLKVRQVAAGGTHSVVLTRDGQVWTWGQPWPPGDIKQISTPVRVQGLDAVRLIAVGAFHNLALQEDGALWAWGNNEYGQLGTGDTQPRSQPIPVQGLSGLTLVDIAAGGWHSTALTEDGEVYGWGRGEHGRLGFGDNDKSSKMVPQKVHLLAGEDIVQVSCGGTHSVALTRDGRMYSFGRGDHGRLGYGRKVTTGQPMEVPISIPPRHGTADNGHWIAKLVACGGRHTLAIVEWKADDESES

SEQ ID NO: 6562 - protein, 394 aa, Triphysaria pusilla
MATKSAVIAWGSGEDGQLGIGNNEEKEWVCTITALRPHNVSSVVAGSRNSLAICDDGELFTWGWNQRGTLGHPPETKTENVPCQVKALANVKIVQAAIGGWHCLAVDDQGRAYAWGGNEYGQCGEEPERKDDTGRPVRRDIVIPQRCVPKLSVRQVAAGGTHSAVLTREGHVWTWGQPWPPGDIKQISTPVRVQGLDSVKVIAVGAFHNLALLNDGTVMAWGNNEYGQLGTGDTQPRSQPIAVQGLSALNLVDIAAGGWHSTALTDDGEVYGWGRGEHGRLGFGDDKSSKMVPQRVQLLVGENIVQVSCGGTHSVALTRDGRMYIFGRGDHGRLGYGRKLTTGHPAEVPINIPAPKDLSGTDAEGRWCATLVACGGRHTLAVVEWRDHESEQLL

SEQ ID NO: 6563 - protein, 386 aa, Citrullus lanatus
MAADTAIIAWGSGEDGQLGLGNNEEREWVCAIKALESQNVCSVVAGSRNSLAICEDGKLFTWGWNQRGTLGHPAGTKAENVPSQVKALANVKIVQAAIGGWHCLAVDDQGRAYAWGGNEYGQCGEEPEKKDDTGRPPRRDIAIPQRCAPKLIVRQVAAGGTHSVVLTREGHVWTWGQPWPPGDIKQISVPVRVQGLDMVRLIAVGAFHNLALQEDGTLWAWGNNEYGQLGTGDTQPRSQPIPVQGLSGLTLVDIAAGGWHSTALTDSGEVYGWGRGEHGRLGFGDNDKSSKMVPQKVQLLSGEDIVQVSCGGTHSVALTSDGRMFSFGRGDHGRLGYGRKVTTGQPEEVPIDIAPPLRAEHGRWIAKLVACGGRHTLALVQWKPED

SEQ ID NO: 6564 - protein, 394 aa, Sesamum indicum
MASKTAVIAWGSGEDGQLGIGTNEEKEWVCTVTALRSEKVCSVVAGSRNSLAICENGKLFTWGWNQRGTLGHPPETKTENVPSQVKALSSVKIVQAAIGGWHCLAVDDQGRAYAWGGNEYGQCGEEPERKDDTGRPVRRDIVIPQRCVPKLSVRQVAAGGTHSVVLTREGHVWTWGQPWPPGDIKQISTPVRVQGLDSVKVIAVGAFHNLALLDDGTLMAWGNNEYGQLGTGDTQPRSQPIAVQGLSDLNLVDIAAGGWHSTALTDDGEVYGWGRGEHGRLGFGDDKSSKMVPQRVQLLVGEDIVQVSCGGTHSVALTRDGRMYSFGRGDHGRLGYGRKVTTGHPAEVPINIPPPKDLNGANAEGRWCAKLVACGGRHTLAIVEWRDHEPEQLH

SEQ ID NO: 6565 - protein, 387 aa, Cucumis melo
MAAGTAIIAWGSGEDGQLGLGNNEEREWVCAIKALESQNVCSVVAGSRNSLAICEDGKLFTWGWNQRGTLGHPAGTKSENVPSQVKALSNVKIVQAAIGGWHCLAVDDQGRAYAWGGNEYGQCGEEPEKKDDTGRPPRRDIAIPQRCAPKLIVRQVAAGGTHSVVLTREGHVWTWGQPWPPGDITQISVPVRVQGLDMVRLIAVGAFHNLALQEDGTLWAWGNNEYGQLGTGDTQPRSQPIPVQGLSGLTLVDIAAGGWHSTALTDSGEVYGWGRGEHGRLGFGDNDKSSKMVPQKVQLLSGEEIVQVSCGGTHSVAVTSDGRMFSFGRGDHGRLGYGRKVTTGQPEEVPIDIPPPRGRTENGRWIAKLVACGGRHTLALVQWKPED

SEQ ID NO: 6566 - protein, 390 aa, Solanum lycopersicum
MASRNAVIAWGSGEDGQLGIGNNEEKEWVCSIKALESEKVSSVVAGSRNSLAICEDGRLFTWGWNQRGTLGHPPETKTENIPSQVKALANVKIVQAAIGGWHCLAVDDQGKAYAWGGNEYGQCGEEPERKDDTGRPVKRDIVIPKRCASKLSVRQVAAGGTHSVVLTREGQVWTWGQPWPPGDIKQISTPVRVQGLASVRLIAVGAFHNLALLDDGVLMAWGNNEYGQLGTGDTQPRSQPIAIQGLSGLTLVDIAAGGWHSAALTNEGEVYGWGRGEHGRLGFGDDKSSKMVPQKVQLLAGENIVQVSCGGTHSVALAHDGRMFSFGRGDHGRLGYGRKSTTGHPSEVPINIPAPSDVSSAEGGRWCAKLVACGGRHTLASIEWQTFESE

SEQ ID NO: 6567 - protein, 390 aa, Capsicum annuum
MATRTAVIAWGSGEDGQLGIGNNEEREWVCSIEALNSENVSSVVAGSRNSLAICEDGKLFTWGWNQRGTLGHPPETKTENIPSQVKALANVKIVQAAIGGWHCLAVDDQGKAYAWGGNEYGQCGEEPERKDDTGRPIKRDIVIPKRCAAKLSVRQVAAGGTHSVVLTREGQVWTWGQPWPPGDIKQISTPVRVQGLASVRLIAVGAFHNLALLDDGVLMAWGNNEYGQLGTGDTQPRSQPIAVQGLSGLTLVDITAGGWHSAALTDEGEVHGWGRGEHGRLGFGDDKSSKMVPQKVQLLAGENIVQVSCGGTHSVALTHDGRIFSFGRGDHGRLGYGRKVTTGHPSEVPVNIPPPSDVSSAEGGRWCAKLVACGGRHTMASVEWLTFESE

SEQ ID NO: 6568 - protein, 380 aa, Tabernaemontana elegans
GSGEDGQLGIGDNEEKVWVCTIKALEAHNVCSVVAGSRNSLAICDDGKLFTWGWNQRGTLGHPPETKTENIPSQVKALANVKIVQAAIGGWHCLAVDNQGRAYAWGGNEYGQCGEEPERKDDTGKPVRRDIVIPQRCVPKLTVRQVAAGGTHSVVLTREGHVWTWGQPWPPGDIKQISTSVRVQGLESVRVIAVGAFHNLALLDDGVLMAWGNNEYGQLGTGDTQPRSQPIPVQGLSGLTLVDIAAGGWHSTALTYEGEVYGWGRGEHGRLGFGDDKSSKMVPQMVQLLGGEDIVQVSCGGTHSVALTRDGRMFSFGRGDHGRLGYGRKVTTGHPSEVPINVPPPSNLSGNEGRWVAKYVACGGRHTLAIVEWHPRLSEQ

SEQ ID NO: 6569 - protein, 403 aa, Valeriana officinalis
MSSSQTAVIAWGSGEDGQLGIGNNDEQEWTFPIKALDSYHVRSVVAGSRNSLAICDDGKMFTWGWNQRGTLGHPPETKTENIPTQVKALANVKIVQAAIDGWHCLAVDDQGRAYAWGGNEYGQCGEEPERKDDTGRPLKRDIVIPQRCASKLSVRQVASGGTHSVVLTREGHVWTWGQPWPPGDIKQISTPVRVQGLERVRVIAVGAFHNLALMEDGNLWAWGNNEYGQLGTGDTQPRSQPIPVQGLSDLTLVDIAAGGWHSTALTDEGEVYGWGRGEHGRLGFGDDKSSKMVPQKVQLLVGEDIVQVSCGGTHSVALTRDGRMFSFGRGDHGRLGYGRKVTTGHPSEVPINLPPPKNVTASGEAQGRWCAKLVACGGRHTLAVVEWSTTESTTADDSQNNTD

SEQ ID NO: 6570 - protein, 395 aa, Mimulus guttatus
MASKTAVIAWGSGEDGQLGIGNNEEREWVCTITALRSENVRSVVAGSRNSLAICDDGKLFTWGWNQRGTLGHPPETKTENVPSQVKALANVKIVQAAIGGWHCLAVDDQGRAYAWGGNEYGQCGEEPERKDDSSRPVRRDIAIPQRCVPKLTVRQVAAGGTHSVVLTREGHVWTWGQPWPPGDIKQISTPVRVQGLDRVKVIAVGAFHNLALLDDGTVMAWGSNEYGQLGTGDTQPRSQPIAVQGLSDLNLVDIAAGGWHSTALTDDGEVYGWGRGEHGRLGFGDDKSSKMVPQRVQLLVGEEIVQVSCGGTHSVALTRDGRIYSFGRGDHGRLGYGRKQTTGHPAEVPINIPPPKDFTESSAAEGRWCSTLVACGGRHTLAVMEWRGHESEQLL

SEQ ID NO: 6571 - protein, 389 aa, Amaranthus tuberculatus
MSSAVIAWGSGEDGQLGIGNNEDKEWVCQVKALENYSVSSVVAGSRNSLALCQDGKLFTWGWNQRGTLGHPPETKTENIPSQVKALANVKIVQAAIGGWHCLAVDDQGCTYAWGGNEYGQCGEDPEKDDTGRLLRRDIVIPQRCATQLTVRQVAAGGTHSVVLTRDGHVWTWGQPWPPGDIKQIFVPVRVQGLEKVRLIAAGAFHNLALEEDGTLWAWGNNEYGQLGTGDTQPRSQPIRVQGLSGLTLVDIAAGGWHSTALTNEGEVYGWGRGEHGRLGFGDDKSSKMLPQQVQLLAGEDVIQVSCGGTHSVALTRDGRMFSFGRGDHGRLGFGRKVTTGNPMEVPINLPPPNNISEEDKAEGCWRANLIACGGRHTLAIVEWQPNDPE

SEQ ID NO: 6572 - protein, 389 aa, Daucus carota
MASDTIVIAWGSGEDGQLGISNNEEKEWVCSIESLNSRNVRSVVAGSRNSLAICQDGKLFTWGWNQRGTLGHPPDTKTENIPSQVKALSTVKIVQAAIGGWHCLAVDDQGRAYAWGGNEYGQCGEEPERKDDSSKPLRRDIVIPQRCAPKLSVRQVAAGGTHSVVLTHEGHVWTWGQPWPPGDIKQISTPVRVQGLERVKLIAVGAFHNLALLEDGSLWAWGNNEYGQLGTGDTQPRSQPIPVQGLSDLILVDIAAGGWHSTAITDKGEVYGWGRGEHGRLGFGDDKSSKMVPQKVQLLVEENIVQVSCGGTHSVALTKDGRMFSFGRGDHGRLGYGRKVTTGHPSEVPINLPPPNSDDAEAEGHWSARLVACGGRHTLAIAEWCSDVV

SEQ ID NO: 6573 - protein, 387 aa, Cucumis sativus
MAAGTAIIAWGSGEDGQLGLGNNEEREWVCAIKALESQNVCSVVAGSRNSLAITEDGKLFTWGWNQRGTLGHPAGTKSENVPSQVKALSNVKIVQAAIGGWHCLAVDDQGRAYAWGGNEYGQCGEEPEKKDNTGRPPRRDIAIPQRCAPKLIVRQVAAGGTHSVVLTREGHVWTWGQPWPPGDITQISVPVRVQGLDMVRLIAVGAFHNLALQEDGTLWAWGNNEYGQLGTGDTQPRSQPIPVQGLSGLTLVDIAAGGWHSTALTDNGEVYGWGRGEHGRLGFGDNDKSSKMVPQKVQLLSGEEIVQISCGGTHSVAVTSDGRMFSFGRGDHGRLGYGRKVTTGQPEEVPIDIPPPRGRTENGHWIAKLVACGGRHTLALVQWKSED

SEQ ID NO: 6574 - protein, 391 aa, Solanum tuberosum
MTSRNAVIAWGSGEDGQLGIGNNEEKEWACSIKALKSEKVSSVVAGSRNSLAICEDGKLFTWGWNQRGTLGHPPETKTENIPSQVKALANVKIVQAAIGGWHCLAVDDQGKAYAWGGNEYGQCGEEPERKDDTGTPVKRDIVIPKRCASKLSVRQVAAGGTHSVVLTREGQVWTWGQPWPPGDIKQISTPVRVQGLASVRLIAVGAFHNLALLDDGVLMAWGNNEYGQLGTGDTQPRSQPIAIQGLSGLTLVDIAAGGWHSAALTNEGEVYGWGRGEHGRLGFGDDKSSKMVPQKVQLLAGENIVQVSCGGTHSVALTHDGRMFSFGRGDHGRLGYGRKSTTGHPSEVPINIPPPSGDVSSTEGERWCAKLVACGGRHTLANVEWQTFESE

SEQ ID NO: 6575 - protein, 390 aa, Nicotiana tabacum
MASRTAVIAWGSGEDGQLGIGNNEEKEWVCTIKALKYSEKVSSIVAGSRNSLAICEDGKLFTWGWNQRGTLGHPPETKTENIPSQVKALSNVKIVQAAIGGWHCLAVDDQGRAYAWGGNEYGQCGEEPERKDDTGRPIKRDIIIPKRCASKLSVRQVAAGGTHSVVLTKEGQVWTWGQPWPPGDIKQISTPVRVQGLASVRLIAVGAFHNLALLDDGVLMAWGNNEYGQLGTGDTQPRSQPIAVQGLSGLTLVDIAAGGWHSAALTDEGEVYGWGRGEHGRLGFGDDKSSKMVPQKVHLLAGENIVQISCGGTHSVALTHDGRMFSFGRGDHGRLGYGRKVTTGHPSEVPINIPPPSDVSSTEGGRWCAKLVACGGRHTLAIVEWQAESE

SEQ ID NO: 6576 - protein, 332 aa, Chelidonium majus
MGMEPKRNFGPPTRNQTENTPSQVKALANVKIVQAAIGGWHCLAVDDQGRAYAWGGNEYGQCGEEPEKKDDSGRALRRDIVIPQRCAPKLKVRQVAAGGTHSVVLTQDGHVWTWGQPWPPGDIKQISTPVRVQGLEKVKLIAVGAFHNLALLEDGILWAWGNNEYGQLGTGDTQPRSQPIPVQGLSGLTLVDIAAGGWHSTALTAEGEVYGWGRGEHGRLGFGDDKSSKMVPQRVQLLVGEEIIQVSCGGTHSVALTRDGRIFSFGRGDHGRLGYGRKVTTGHPMEVPINLPKPGDLIGSDDTTEEIWCAKLVACGGRHTLAIAVLQADEES

SEQ ID NO: 6577 - protein, 392 aa, Aquilegia formosa
MADINPIILAWGSGEDGQLGIGDNEDKEWVCSIKSFESQKVSSVVAGSRNSLAICEDGKLFTWGWNQRGTLGHPPETKTENIPSQVKALANVKIVQAAIGGWHCLAVDDQGRAYAWGGNEYGQCGEEPERKDDITRAVRRDIVIPQRCAPKLSVRQVAAGGTHSVVLTHEGHVWTWGQPWPPGDIKQISTPVRVQGLEKVKLIAVGAFHNLALIEDGILWAWGNNEYGQLGTGDTQPRSQPIPVQGLSGLTLVDIAAGGWHSTALTDEGEVYGWGRGEHGRLGFGDDKSSKMVPQRVQLLVGEDIVQVSCGGTHSVALSRDGRIFSFGRGDHGRLGYGRKVTTGHPMDVPINIPQPISNVGTGHWCAKLVACGGRHTLAIATWQNDESEQSQ

SEQ ID NO: 6578 - protein, 393 aa, Cleome spinosa
MAASTTVIAWGSGEDGQLGLGTNDEKEWVCVVEALEPYAVRSVVSGSRNSLAICDDGTLFTWGWNQRGTLGHPPETKTENIPSQVKALANVKIVQAAIGGWHCLAVDDQGRAYAWGGNEYGQCGEEPGKDEMERPLRRDIVIPKRCAPKLVVRQVAAGGTHSVVLTREGHVWSWGQPWPPGDIKQISIPVRVQGLENVRLIAVGAFHNLALEENGTLWAWGNNEYGQLGTGDTQPRSQPIPVQGLDSLTLVDIAAGGWHSTALTDKGEVYGWGRGEHGRLGFGDNDKSSKMLPQKVNLLAGEDIIQVSCGGTHSVALTRDGRIFSFGRGDHGRLGCGRKVTTGQPLDVPVKIPPPEGQFNDAAEDDDGKWVAKVVACGGRHTLAIVEWKSAAI

SEQ ID NO: 6579 - protein, 393 aa, Silene vulgaris
MSSPSTSVIAWGSGEDGQLGIGNNEDRDTVCQVKALQSYHPVSVVAGSRNSLAICHDGKLFTWGWNQRGTLGHPAGTKTENVPTQVKALANVKIVQAAIGGWHCLAVDDQGRAYAWGGNEYGQCGEVPEKKDDAGRPLRRDIVIPQRCAPKLTVRQVAAGGTHSVVLTREGHVWTWGQPWPPGDIKQIFVPVRVQGLERVRLIAVGAFHNLALAEDGTLWAWGNNEYGQLGTGDTQPRSQPILVQGLSGLTLVDIAAGGWHSTTLTSEGEVYGWGRGEHGRLGFGDDKSSKMLPQKVQLLAGEDIVQVSCGGTHSVALTRDGRIFSYGRGDHGRLGYGRKVTTGHPMEVPINLPSPNNTGDDEEAEGHWQAKLVGSGGRHTSAIVQWQPDEGE

SEQ ID NO: 6580 - protein, 392 aa, Chenopodium quinoa
MPSDTAVIAWGSGEDGQLGIGNNEDKEWVCQVKALQNYTVSSVVAGSRNSLALCEDGKLFTWGWNQRGTLGQPPETKAENVPTQVKALANVKIVQAAIGGWHCLAVDDQGRAYAWGGNEYGQCGEDPEKDETGRLLRRDIVIPQRCAPKLKVRQVAAGGTHSVVLTREGHVWTWGQPWPPGDIKQIFVPVRVQGPEKVRLIAVGAFHNLALEEDGTLWAWGNNEYGQLGTGDTQPRSQPIRVQGLSGLTLVDIAAGGWHSTALTSAGEVYGWGRGEHGRLGFGDDKSSKMLPQKVQLLANEDIVQVSCGGTHSVTMTRDGRIFTFGRGDHGRLGYGRKVTTGHPMEVPINLPPPKSVGEEEKAEARWRANLIACGGRHTLAIVKWQADDDEL

SEQ ID NO: 6581 - protein, 396 aa, Arabidopsis thaliana
MASATSVIAWGSGEDGQLGLGTDEEKELASVVDALEPFNVRSVVGGSRNSLAICDDGKLFTWGWNQRGTLGHPPETKTESTPSLVKSLANVKIVQAAIGGWHCLAVDDQGRAYAWGGNEYGQCGEEPSKDETGRPVRRDIVIPKRCAQQLTVRQVAAGGTHSVVLTREGYVWTWGQPWPPGDIKQISVPVRVQGLENVRLIAVGAFHNLALKEDGTLWAWGNNEYGQLGTGDTQPRSYPIPVQGLDDLTLVDIAAGGWHSTALTNEGEVYGWGRGEHGRLGFGDNDKSSKMLPQKVNLLAGEDIIQVSCGGTHSVALTRDGRIFSFGRGDHGRLGYGRKVTTGQPLELPIHIPPPEGRFNHTDEEDDGKWIAKHVACGGRHTLAIVEWKYDQEETE

SEQ ID NO: 6582 - protein, 396 aa, Eutrema parvulum
MASATSVIVWGSGEDGQLGLGTDEEKEWACVVEALEPFTVRSVVGGSRNSLAICDDGKLFTWGWNQRGTLGHPPETKTESIPSLVKSLANVNITQAAIGGWHCLAVDDQGRAYAWGGNEYGQCGEEPSKDETGRPVRRDIVIPKRCAPKLTVRQVAAGGTHSVVLTREGSVWTWGQPWPPGDIKQISVPVRVQGLENVRLIAVGAFHNLALKEDGTLWAWGNNEYGQLGTGDTQPRSYPIPVQGLDDLTLVDIAAGGWHSTALTDEGEVYGWGRGEHGRLGFGDNDKSSKMVPQKVNLLSGEDIIQVSCGGTHSVALTRDGRIFSFGRGDHGRLGYGRKVTTGQPLELPINIPPPEGRFNHADEEDDRKWIAKFVACGGRHTLAIMEWQLDQEETE

SEQ ID NO: 6583 - protein, 395 aa, Eutrema halophilum
MASATSVIAWGSGEDGQLGLGTDEDKEWASVVEALEPFSVRSVVGGSRNSLAICDDGKLFTWGWNQRGTLGHPAETKTESIPSLVESLANVKIVQAAIGGWHCLAVDDQGRAYAWGGNEYGQCGEEPSKDETGRPVRRDIVIPKRCAPKLTVRQVAAGGTHSVVLTREGYVWTWGQPWPPGDIKQISVPVRVQGLENVRLIAVGAFHNLALKEDGTLWAWGNNEYGQLGTGDTQPRSHPIPVQGFDDLTLVDIAAGGWHSTALTDEGEVYGWGRGEHGRLGFGDNDKSSKMVPQKVNLLSGEDIIQVSCGGTHSVALTRDGRIFSFGRGDHGRLGYGRKVTTGQPLELPINIPPPEGRFNHADEEEDGKWLAKFVACGGRHTLAIMEWKLDHEEN

SEQ ID NO: 6584 - protein, 398 aa, Brassica juncea
MASATSVIAWGSGEDGQLGLGTYEEKEWACVVDALHPFTVRSVVGGSRNSLAICDDGKLFTWGWNQRGTLGHPPEKKTESIPSLVKSLANVKITQAAIGGWHCLAVDDQGRAYAWGGNEYGQCGEEPSKDETGRPVRRDIVIPKRCAPKLTVRQVAAGGTHSVVLTREGSVWTWGQPWPPGDIKQISVPVRVQGLENVRLIAVGAFHNLALKEDGTLWAWGNNEYGQLGTGDTQPRSHPIPVQGLDDLTLVDIAAGGWHSTALTEEGEVYGWGRGEHGRLGFGDNDKSSKMVPQKVNLLAGEDIIQVSCGGTHSVALTRDGRIFSFGRGDHGRLGYGRKVTTGQPLELPIDIPPPEGQFNHADEEEDGTWIAKFVACGGRHTLAIMEWKADQEEEETE

SEQ ID NO: 6585 - protein, 381 aa, Ocimum basilicum
MASKTAVIAWGSGEDGQLGIGNNEEKEWVCTIDALSSEQVCSVVAGSRNSLAICDDGKLFTWGWNQRGTLGHPSESKSESVPSQVMALANVKIVQAAIGGWHCLAVDDQGQAYAWGGNEYGQCGEEPERKDDTARPLRRDIVIPQRCVPKLSVRQVAAGGTHSVVLTREGHVWTWGQPWPPGDIKQISTPVRVQGLDSVRVIAVGAFHNLALLDDGTVMAWGNNEYGQLGTGDTQPRSQPIAVQGLSDLNLVDIAAGGWHSTALTDDGEVYGWGRGEHGRLGFGDDKSSKMVPQRVQLLVGEEIVQISCGGTHSVALTRDGRMFSFGRGDHGRLGYGRKLTTGHPAEVPINIPPSEEEGRWCATLVACGGRHTLALVQWQH

SEQ ID NO: 6586 - protein, 393 aa, Nicotiana benthamiana
MACRTAVIAWGSGEDGQLGIGNNEEKEWVCTIKALKSSEKVSSIVAGSRNSLAICEDGKLFTWGWNQRGTLGHPPETKTENIPSQVKALSDVKIVQAAIGGWHCLAVDDQGRAYAWGGNEYGQCGEEPERKDDTGRPIKRDIIIPKRCASKLSVRQVAAGGTHSVVLTKEGQVWTWGQPWPPGDIKQISTPVRVQGLASVRLIAVGAFHNLALLDDGVLMAWGNNEYGQLGTGDTQPRSQPIAVQGLSGLTLVDIAAGGWHSAALTDEGEVYGWGRGEHGRLGFGDDKSSKMVPQKVQLLAGENIVQVSCGGTHSVALTHDGRMFSFGRGDHGRLGYGRKVTTGHPSEVPKNIPPPSDVSSTEGGRWCTKLVACGGRHTLAIVEWQAESEYSV

SEQ ID NO: 6587 - protein, 396 aa, Arabidopsis lyrata
MASATSVIAWGSGEDGQLGLGTDEEKELASVVEALEPFNVRSVVGGSRNSLAICDDGKLFTWGWNQRGTLGHPPETKTESTPSLVKSLASVKIVQAAIGGWHCLAVDDQGRAYAWGGNEYGQCGEEPSKDETGRPVRRDIVIPKRCAPQLTVRQVAAGGTHSVVLTREGYVWTWGQPWPPGDIKQISIPVRVQGLENVRLIAVGAFHNLALKEDGTLWAWGNNEYGQLGTGDTQPRSFPIPVQGLDDLTLVDIAAGGWHSTALTNEGEVYGWGRGEHGRLGFGDNDKSSKMLPQKVNLLAGEDIIQVSCGGTHSVALTRDGRIFSFGRGDHGRLGYGRKVTTGQPLELPIDIPPLEGRFNHTDEEDDGKWIAKHVACGGRHTLAIVEWKFDQEGTE

SEQ ID NO: 6588 - protein, 397 aa, Brassica rapa
MASATSVIAWGSGEDGQLGLGTYEEKEWACVVEALDPFAVRSVVGGSRNSLAICDDGKLFTWGWNQRGTLGHPPEKKTESVPSLVKSLANVKITQAAIGGWHCLAVDDQGRAYAWGGNEYGQCGEEPSKDDSGRPVRRDIVIPKRCAPKLTVRQVAAGGTHSVVLTREGSVWTWGQPWPPGDIKQISVPVRVQGLENVRLIAVGAFHNLALKEDGTLWAWGNNEYGQLGTGDTQPRSHPIPVQGLDDLTLVDIAAGGWHSTALTEEGEVYAWGRGEHGRLGFGDNDKSSKMVPQKVNLLAGEDIIQVSCGGTHSVALTRDGRIFSFGRGDHGRLGYGRKVTTGQPLELPIDIPPPEGQFNHADEEEDGKWIAKFVACGGRHTLAIMEWKADQEEETE

SEQ ID NO: 6589 - protein, 90 aa, Petunia hybrida
MASRTAVITWGSGEDGQLGIGNNEEKEWVCTIKALKSEKVSSVVAGSKNSLAICEDGKLCTWGRNQRGTVGHPPELKLRISLVKSKLLPM

SEQ ID NO: 6590 - protein, 391 aa, Beta vulgaris
MSSDTAVIAWGSGEDGQLGIGNNEERERVCQIKALENYTVSSVVGGSRYSLALCEDGKLFTWGWNQRGTLGKPPETKSENVPSQVKALAKVKIAQAAIGGWHCLAVDDQGRAYAWGGNEYGQCGEDPEKDETGRLLRRDIVIPQRCAPKLKVRQVAAGGTHSVVLTREGHVWTWGQPWPPGDIKQINVPVRVQGPEKVQLIAAGAFHNLALEEDGTLWAWGNNEYGQLGTGDTQPRSQPIRVQGLSGLKLVDIAAGGWHSTALTNEGEVYGWGRGEHGRLGFGDDKSSKMLPQKVQLLAGEDIIQVSCGGTHSVALTRDGRIYSFGRGDHGRLGYGRKVTTGHPMEVPINLPSPKSVSEEDRPEGRWRANLIACGGRHTLAIVKWQPNDNE

SEQ ID NO: 6591 - protein, 398 aa, Brassica oleracea
MASATSVIAWGSGEDGQLGLGTYEEKEWACVVEALDPFAVRSVVGGSRNSLAICDDGKLFTWGWNQRGTLGHPPEKKTESVPSLVKSLANVKITQAAIGGWHCLAVDDQGRAYAWGGNEYGQCGEEPSKDESGRPVRRDIVIPKRCAPKLTVRQVAAGGTHSVVLTREGSVWTWGQPWPPGDIKQISVPVRVQGLENVRLIAVGAFHNLALKEDGTLWAWGNNEYGQLGTGDTQPRSHPIPVQGLDDLTLVDIAAGGWHSTALTEEGEVYAWGRGEHGRLGFGDNDKSSKMVPQKVNLLAGEDIIQVSCGGTHSVALTRDGRIFSFGRGDHGRLGYGRKVTTGQPLELPIDIPPPEGQFNHADEEEDGKWIAKFVACGGRHTLAIMEWKADQEEEETE

SEQ ID NO: 6592 - protein, 189 aa, Cucurbita pepo
MVKLIAVGAFHNLALQEDGTLWAWGNNEYGQLGTGDTQPRSQPIPVQGLSGLTLVDIAAGGWHSTALTDSGEVYGWGRGEHGRLGFGDNDKSSKMVPQKVQLLSGEDIVQVSCGGTHSVAVTSDGRMFSFGRGDHGRLGYGRKVTTGQPEEVPIDIPPPRGTENGRWIAKLVACGGRHTLALVQWKPED

SEQ ID NO: 6593 - protein, 369 aa, Euphorbia peplus
VCVVKALEPYKVRSVVGGSRNSLAICDDGKLFTWGWNQRGTLGHPAETKTENVPSQVKALSNVNIVQAAIGGWHCLAVDDQGRAYAWGGNEYGQCGEEPERKDDTGKPLRRDIVIPQRCAPKLTVRQVAAGGTHSVVLTREGQVWTWGQPWPPGDIKQISVPVRVQGLERVRLIAVGAFHNLALQEDGTLWAWGNNEYGQLGTGDTQPRSQPIPVQGLSGLTLVDIAAGGWHSTALTDDGEVYGWGRGEHGRLGFGDNDKSSKMVPQRVNLLAGEDIVQISCGGTHSVAMTRSGRIFSFGRGDHGRLGNGRKVTTGQPIEVPIEIPPPNHHSESEAEAEADEGYSWIAKLVACGGRHTLAIVEWQTDSS

SEQ ID NO: 6594 - protein, 391 aa, Echinacea purpurea
MAVNHHAVIAWGSGEDGQLGLGDNEEKEWISPVTSLSSVSVRSVVAGSRNSLAVCHDGKLFMWGWNQRGTLGHPPSSKTENIPSQVKALDNVKIVQAAIGGWHCLAVDDQGRAYAWGGNEYGQCGEEPEKKDDSGRTLRRDIVIPQRCAPKLSVRQVAAGGTHSVVLTREGHVWTWGQPWPPGDIKQISTPVRVQGLEKVKLIAVGAFHNLALLEDGNLWVWGNNEYGQLGTGDTQPRSQPVPVQGLSGLKLVDVAAGGWHSTALTDEGEVYGWGRGEHGRLGFGDDKSSKMVPQQVQLLAGEDIIQVSCGGTHSVALTRDGRMFSFGRGDHGRLGYGRKVTTGHPSEVPIDLPSPKDDELGRWCAKYVACGGRHTLAIVEWRAAEADGLI

SEQ ID NO: 6595 - protein, 383 aa, Chenopodium quinoa
MPSDTGVIAWGSGEDGQLGIGNNEDKEWVCQVKALQNYSVSSVVAGSRNSLALCEDGKLFTWGWNQRGTLGQPPETKAENVPTQVKALANVKIVQAAIGGWHCLAVDDQGRAYAWGGNEYGQCGEDPEKDETGRLLRRDIVIPQRCAPKLKVRQVAAGGTHSVVLTREGHVWTWGQPWPPGDIKQIFVPVRVQGPEKVRLIAVGAFHNLALEEDGTLWAWGNNEYGQLGTGDTQPRSQPIRVQGLSGLTLVDIAAGGWHSTALTSAGEVYGWGRGEHGRLGFGDDKSSKMLPQKVQLLANEDIVQVSCGGTHSVTMTRDGRIFTFGRGDHGRLGYGRKVTTGHPMEVPINLPPPRNDGEEEKAEARWRANLIACGGRHTLAIV

SEQ ID NO: 6596 - protein, 333 aa, Ambrosia trifida
MWGWNQRGTLGHQPTTKTENIPSQVKAIDNVKIVQAAIGGWHCLAVDDQGRAYAWGGNEYGQCGEEPEKKDDSGRTLRRDISTPQRCAPKLSVRQVAAGGTHSVVLTREGHVWTWGQPWPPGDIKQISTPVRVQGLEKVKLIAVGAFHNLALLEDGNLWVWGNNEYGQLGTGDTQPRSQPVPVQGLSDVKLVDVAAGGWHSTALTDEGEVYGWGRGEHGRLGFGDDKSSKMVPQQVQLLAGEDIIQVSCGGTHSVALTRDGRMFSFGRGDHGRLGYGRKVTTGHPSEVPIDLPPPKNVNGSGLGQWCAKYVACGGRHTLAIVEWRATEADGLI

SEQ ID NO: 6597 - protein, 394 aa, Flaveria ramosissima
MAVNTTAVIVWGSGEDGQLGLGDDEEKEWVSTVTALSSVTVKSVVAGSRNSLAVCDDGKLFMWGWNQRGTLGHQPTTKTENIPSQVKALDNVKIVQAAIGGWHCLAVDDQGRAYAWGGNEYGQCGEELEKKGDSGRTLRRDIVTPQRCASKLSVRQVAAGGTHSVVLTREGHVWTWGQPWPPGDIKQISTPVRVQGLEKVKLIAVGAFHNLALLEDGNLWAWGNNEYGQLGTGDTQPRSQPVPVQGLSGLRLVDVAAGGWHSTALTDDGEVYGWGRGEHGRLGFGDDKSSKMVPQQVQLLAGEDIVQVSCGGTHSVALTRDGRMFSFGRGDHGRLGYGRKVTTGHPSEVPIDLPPPKDDGESGLGRWCAKYVACGGRHTLAIVEWQATEGDGLI

SEQ ID NO: 6598 - protein, 393 aa, Helianthus annuus
MSVNSHAVIAWGSGEDGQLGLGDNEEKEWVSPVTSLASVAVRSVVAGSRNSLAVCDDGKLFTWGWNQRGTLGHQPTTKTENIPSQVETLNKVKIVQAAIGGWHCLAVDDQGRAYAWGGNEYGQCGEEPEKKDDSGRTLRRDISTPQRCAPKLSVRQVAAGGTHSVVLTREGHVWTWGQPWPPGDIKQISTPVRVQGLEKVKLIAVGAFHNLALLEDGNLWVWGNNEYGQLGTGDTQPRSQPVPVQGLSGLKLVDVAAGGWHSTALTDEGEVYGWGRGEHGRLGFGDDKSSKMVPQQVQLLAGEDIIQVSCGGTHSVALTRDGRMFSFGRGDHGRLGYGRKVTTGHPSEVPIDLPPPKDEDGGLGRWCAKYVACGGRHTLAIVEWRATEADGLI

SEQ ID NO: 6599 - protein, 398 aa, Brassica napus
MASATSVIAWGSGEDGQLGLGTYEEKEWACVVEALDPFAVRSVVGGSRNSLAICDGGKLFTWGWNQRGTLGHPPEKKTESVPSLVKSLANVKITQAAIGGWHCLAVDDQGRAYAWGGNEYGQCGEEPSKDESGRPVRRDIVIPKRCAPKLTVRQVAAGGTHSVVLTREGSVWTWGQPWPPGDIKQISVPVRVQGLENVRLIAVGAFHNLALKEDGTLWAWGNNEYGQLGTGDTQPRSHPIPVQGLDDLTLVDIAAGGWHSTALTEEGEVYAWGRGEHGRLGFGDNDKSSKMVAQKVNLLAGEDIIQVSCGGTHSVALTRDGRIFSFGRGDHGRLGYGRKVTTGQPLELPIDIPPPEGQFNHADEEEDGKWIAKFVACGGRHTLAIMEWKADQEEEETE

SEQ ID NO: 6600 - protein, 393 aa, Brassica oleracea
MVSATSVIAWGSGEDGQLGIGSNEEKEWACVVEALEPYSVRSVVSGSRNSLAICDDGTMFTWGWNQKGTLGHPPETKTENIPSRVKALANVKITQAAIGGWHCLAVDDQGRAYAWGGNEYGQCGEEPLKDEMGRPVRRDIVIPKRCAPKLTVRQVAAGGTHSVVLTRDGHVWTWGQPWPPGDIKQIFVPVRVQGLENVRLIAVGAFHNLALEEDGRLMAWGNNEYGQLGTGDTQPTPHPVPVQGLDGLTLVDIAAGGWHSTALTDEGEVYGWGRGEHGRLGFGDNDKSSKMVPQKVNLLADEDIIQVSCGGTHSVALTRDGRIFSFGRGDHGRLGYGRKVTTGQPLELPIKIPPPEGSLNHADEEEEGKWLATSIACGGRHTLAIVEWKSDDI

SEQ ID NO: 6601 - protein, 393 aa, Arabidopsis thaliana
MVTATSIIAWGSGEDGQLGIGTNEEKEWACVVEALEPYSVRSVVSGSRNSLAICDDGTMFTWGWNQRGTLGHQPETKTENIPSRVKALANVKITQAAIGGWHCLAVDDQGRAYAWGGNEYGQCGEEPLKDEMGRPVRRDIVIPKRCAPKLTVRQVAAGGTHSVVLTREGHVWTWGQPWPPGDIKQISVPVRVQGLENVRLIAVGAFHNLALEEDGRLLAWGNNEYGQLGTGDTQPTSHPVPVQGLDDLTLVDIAAGGWHSTALTDKGEVYGWGRGEHGRLGLGDNDKSSKMVPQKVNLLAEEDIIQVSCGGTHSVALTRDGRIFSFGRGDHGRLGYGRKVTTGQPLELPIKIPPPEGSFNHTDEEEEGKWSAKSIACGGRHTLAIVEWKSDDI

SEQ ID NO: 6602 - protein, 370 aa, Brassica napus
MVSATSVIAWGSGEDGQLGIGSNEEKEWACVVEALEPYSVRSVVSGSRNSLAICDDGTMFTWGWNQKGTLGHPPETKTENIPSRVKALTNVKITQAAIGGWHCLAVDDQGRAYAWGGNEYGQCGEEPLKDEMGRPFRRDIVIPKRCAPKLTVRQVAAGGTHSVVLTRDGHVWTWGQPWPPGDIKQIFVPVRVQGLENVRLIAVGAFHNLALEEDGRLMAWGNNEYGQLGTGDTQPTPHPVPVQGLDGLTLVDIAAGGWHSTALTDKGEVYGWGRGEHGRLGFGDNDKSSKMVPQKVNLLADEDIIQVSCGGTHSVALTRDGRIFSFGRGDHGRLGYGRKVTTGQPLELPINIPPPEGSLNHADEEEEGIG

SEQ ID NO: 6603 - protein, 389 aa, Vinca minor
TQPLSQGVQEKNGQLGIGNNDEKDLVCTIKALHPYNVCSVVSGSRNSLAICDDGKLFTWGWNQRGTLGHPPETKTENVPSQVKSLASVKIVQAAIGGWHCLAVDDQGRAYAWGGNEYGQCGEEPERKDDTGKPVRRDIVIPQRCVPKLNVRQVAAGGTHSVVLTREGHVWTWGQPWPPGDIKQISTPVRVQGLESVRLIAVGAFHNLALLDDGILMAWGNNEYGQLGTGDTQPRSQAIPVQGLAGLTLVDIAAGGWHSTALTNEGEVYGWGRGEHGRLGFGDDKSSKMVPQRVQLLVGEDIVQVSCGGTHSVALTSDGRMFSFGRGDHGRLGYGRKLTTGHPSEVPIDIPPPEHLGDNEAEGRWSAKYVACGGRHTLAIVECQTRISEQ

SEQ ID NO: 6604 - protein, 395 aa, Cirsium arvense
MAVNNTAVIAWGSGEDGQLGLGDNEEKEWVSSITSLNSVTVRSVVAGSRNSLAICDDGKLFMWGWNQRGTLGHQPSTKTENIPSQVKALDNVNIVQAAIGGWHCLAVDDQGRAYAWGGNEYGQCGEELEKKGESGRTLRRDIVIPQRCASKLSVRQVAAGGTHSVVLTREGHVWTWGQPWPPGDIKQISTPVRVQGLERVKLIAVGAFHNLALVEDGNLWVWGNNEYGQLGTGDTQPRSQPVPVQGLSGLTLVDVAAGGWHSTALTDEGEVYGWGRGEHGRLGFGDDKSSKMVPQQVQLLADEDIVQVSCGGTHSVALTRDGRMFSFGRGDHGRLGYGRKVTTGHPSEVPIDLPPPEDDESGNELGRWCAKYVACGGRHTIAIVEWQTTDPDPLI

SEQ ID NO: 6605 - protein, 392 aa, Brassica rapa
MVSATSVIAWGSGEDGQLGIGSNEEKEWACVVEALEPYSVRSVVSGSRNSLAICDDGTMFTWGWNQKGTLGHPPETKTENIPSRVKALANVKITQAAIGGWHCLAVDDQGRAYAWGGNEYGQCGEEPLKDEMGRPVRRDIVIPKRCAPKLTVRQVAAGGTHSVVLTRDGHVWTWGQPWPPGDIKQIFVPVRVQGLENVRLIAVGAFHNLALEEDGRLMAWGNNEYGQLGTGDTQPTPHPVPIQGLDGLTLVDIAAGGWHSTALTDKGEVYGWGRGEHGRLGFGDNDKSSKMVPQKVNLLADEVIIQVSCGGTHSVALTRDGRIFSFGRGDHGRLGYGRKVTTGQPLELPIKIPPPEGSLNHADEEEGKWLATSIACGGRHTLAIVEWKSDDI

SEQ ID NO: 6606 - protein, 395 aa, Nicotiana benthamiana
HSDHSFYYIYICVFRGSGEDGQLGIGNNEEKEWVCSIKALKSSEKVSSIVAGSRNSLAICEDGKLFTWGWNQRGTLGHPPETKTENIPSQVKALSNVKIVQAAIGGWHCLAVDDQGRAYAWGGNEYGQCGEEPERKDDTGRPIKRDIIIPKRCASKLSVRQVAAGGTHSVVLTKEGQVWTWGQPWPPGDIKQISTPVRVQGLASVRLIAVGAFHNLALLDDGVLMAWGNNEYGQLGTGDTQPRSQPIAVQGLSGLTLVDIAAGGWHSAALTDEGEVYGWGRGEHGRLGFGDDKSSKMVPQKVQLLAGENIVQVSCGGTHSVALTHDGRMFSFGRGDHGRLGYGRKVTTGHPSEVPINIPPPSDVSSTQGERWCAKLVACGGRHTLAIVEWQEESE

SEQ ID NO: 6607 - protein, 392 aa, Chrysanthemum coronarium
MAVNTNSAVIAWGSGEDGQLGLGDNEEKEWVSSVTSLHSVTVTSLVAGSRNSLAIANDGKLFMWGWNQRGTLGHQPSTKTENVPSQVKALDNVKIVQAAIGGWHCLAVDDKGRAYAWGGNEYGQCGEELEKKGDSGRRDIVIPQRCASKLTVRQVAAGGTHSVVLTREGHVWTWGQPWPPGDIKQISTPVRVQGLEKVKLIAVGAFHNLALLEDGNLWVWGNNEYGQLGTGDTQPRSQPVPVQGLSGLKLVDIAAGGWHSTALTDEGEVYGWGRGEHGRLGFGDDKSSKMVPQQVQLLAGEDIVQVSCGGTHSVALTRDGRMFSFGRGDHGRLGYGRKVTTGHPSEVPIDLPPPKDASDGEPGRWCAKYVACGGRHTLAIVEWQATESDGLN

SEQ ID NO: 6608 - protein, 391 aa, Aristolochia fimbriata
MTTEATETIVLAWGSGEDGQLGLGNNEEKDLVCSIQALDGEKVTSVVAGSRNSLAICENGKLFTWGWNQRGTLGHPPETKTENVPSQVKALDNVKIVQAAIGGWHCLAVDDQGRAYAWGGNEYGQCGEEPERKDDNTRALRRDIAIPQRCAPKLSVRQVAAGGTHSVVLTNDGHVWTWGQPWPPGDIKQISTPVRVQGLEKVRFIAVGAFHNLALREDGMLWAWGNNEYGQLGTGDTQPRSQPIPVQGLSGLTLVDIAAGGWHSTALMDDGEVYAWGRGEHGRLGFGDDKSSKMVPQRVQLLVSEDIVQFSCGGTHSVACTRGGRMFSFGRGDHGRLGYGRKVTTGHPMEVPINIPARRNLENANGHWCAKVVACGGRHTLAIATWVETQE

SEQ ID NO: 6609 - protein, 395 aa, Artemisia annua
MAVNTNTAVIAWGSGEDGQLGLGDNEEKEWVSAVSSLDSVTVSSVVAGSRNSLAIADDGKLFMWGWNQRGTLGHPPSTKTENVPSQVKALDNVKIVQAAIGGWHCLAVDDQGRAYAWGGNEYGQCGEELDKKGDSGRTMRRDIVIPQRCASKLSVRQVAAGGTHSVVLTREGHVWTWGQPWPPGDIKQISTPVRVQGLEKVKLIAVGAFHNLALLEDGNLWVWGNNEYGQLGTGDTQPRSQPVPVQGLSDLKLVDIAAGGWHSTALTDEGEVYGWGRGEHGRLGFGDDKSSKMVPQQVQLLAGEDIVQVSCGGTHSVALTRDGRMFSFGRGDHGRLGYGRKVTTGHPSEVPIDLPPPKDASDGEPGRWCAKYVACGGRHTLAIVEWQATEADGLI

SEQ ID NO: 6610 - protein, 402 aa, Papaver somniferum
MASENPIVLSWGAGEDGRLGIGENEEKEWVCSIKALQSEKVSSVVGGSRNSLAICEDGKLFTWGWNQRGTLGHPPETKTENTPTQVKALANVKIVQAAIGGWHCLAVDDQGRAYAWGGNEYGQCGEEPEKKDDSGRALRRDIVIPQRCAPKLKVRQVAAGGTHSVVLTQEGHVWTWGQPWPPGDIKQISTPVRVQGLEKVRLIAVGAFHNLALLEEGVLWAWGNNEYGQLGTGDTQPRSQPIPVQGLSDLTLVDIAAGGWHSTALTAEGEVYGWGRGEHGRLGFGDDKSSKMVPQRVQLLVGEHIIQVSCGGTHSVALTRDGRMFTFGRGDHGRLGYGRKVTTGHPMEVPINLSKSKDVPSGSDDDDTLGQRWYAKFVACGGRHTLAIAVLQPDEELAEEET

SEQ ID NO: 6611 - protein, 378 aa, Solanum phureja
MTSRNAVIAWGSGEDGQLGIGNNEEKEWACSIKALKSEKVSSVVAGSRNSLAICEDGKLFTWGWNQRGTLGHPPETKTENIPSQVKALANVKIVQAAIGGWHCLAVDDQGKAYAWGGNEYGQCGEEPERKDDTGTPVKRDIVIPKRCASKLSVRQVAAGGTHSVVLTREGQVWTWGQPWPPGDIKQISTPVRVQGLASVRLIAVGAFHNLALLDDGVLMAWGNNEYGQLGTGDTQPRSQPIAIQGLSGLTLVDIAAGGWHSAALTNEGEVYGWGRGEHGRLGFGDDKSSKMVPQKVQLLAGENIVQVSCGGTHSVALTHDGRMFSFGRGDHGRLGYGRKSTTGHPSEVPINIPPPSGDVSSTEEERWCAKLVACGGRH

SEQ ID NO: 6612 - protein, 184 aa, Ambrosia trifida
MAVNNTAVITWGSGEDGQLGLGDTEEKEWVSPITSLSSVSVRSVVAGSRNSLAVCDDGKLFMWGWNQRGTLGHQPTTKTENIPSQVKSLDNVKIVQAAIGGWHCLAVDDQGRAYAWGGNEYGQCGEEPEKKDDSGRTLRRDISTPQRCASKLSVRQVAAGGTHSVVLTRKDMFGRGVNHGLRGT

SEQ ID NO: 6613 - protein, 393 aa, Arabidopsis lyrata
MVSATSIIAWGSGEDGQLGIGTNEEKEWACVVEALEPYSVRSVVSGSRNSLAICDDGTMFTWGWNQRGTLGHPPETKTENIPSRVKALANVKITQAAIGGWHCLAVDDQGRAYAWGGNEYGQCGEEPLKDEMGRPVRRDIVIPKRCAPKLTVRQVAAGGTHSVVLTREGHVWTWGQPWPPGDIKQIFVPVRVQGLENVSIIAVGAFHNLALEEDGRLLAWGNNEYGQLGTGDTQPTSHPVPVHGLDDLTLVDIAAGGWHSTALTDKGEVYGWGRGEHGRLGFGDNDKSSKMVPQKVNLLAEEDIIQVSCGGTHSVALTRDGRIFSFGRGDHGRLGYGRKVTTGQPLELPIMIPPPEGSFNHADEEEEGKWSAKWIACGGRHTLAIVEWKSDDI

SEQ ID NO: 6614 - protein, 396 aa, Cirsium arvense
MAVNNTTAVIAWGSGEDGQLGLGDNEEKEWVSSVASLNSVTVRSVVAGSRNSLAVCDDGKLFMWGWNQRGTLGHQPSTKTENIPSQVKALDNVNIVQAAIGGWHCLAVDDQGRAYAWGGNEYGQCGEELEKKGESGRTLRRDIVIPQRCASKLSVRQVAAGGTHSVVLTREGHVWTWGQPWPPGDIKQISTPVRVQGLEKVKLIAVGAFHNLALVEDGNLMVWGNNEYGQLGTGDTQPRSQPVPVQGLSGLTLVDVAAGGWHSTALTDEGEVYGWGRGEHGRLGFGDDKSSKMVPQQVQLLAEEDIVQVSCGGTHSVALTRDGRMFSFGRGDHGRLGYGRKVTTGHPSEVPIDLPPPEDAESGSEVGRWCAKYVACGGRHTIAIVEWQTTDPNLIP

SEQ ID NO: 6615 - protein, 393 aa, Eutrema halophilum
MVSATSIIAWGSGEDGQLGIGTNEEREWACVVEALEPYSVRSVVSGSRNSLAICDDGTMFTWGWNQRGTLGHPPEKKTENVPSRVKALASVKITQAAIGGWHCLAVDDQGRAYAWGGNEYGQCGEEPLKDEMGRPVRRDIVIPKRCAPKLTVRQVAAGGTHSVVLTREGHVWTWGQPWPPGDIKQISVPVRVQGLENVRLIAVGAFHNLALEEDGRLLAWGNNEYGQLGTGDTQPSSHPVPVQGLDDLTLVDTAAGGWHSTALTDKGEVYGWGRGEHGRLGFGDNDKSSKMVPQKVNLLGEEDIIQVSCGGTHSVALTRDGRVFSFGRGDHGRLGYGRKVTTGQPLELPIKIPPPEGSFNHADEEEEGNWFAKSIACGGRHTLAIVEWKADDI

SEQ ID NO: 6616 - protein, 392 aa, Chrysanthemum coronarium
MAVNTNSAVIAWGSGEDGQLGLGDNEEKEWASTVTSLHSVTVGSVVAGSRNSLAIANDGKLFMWGWNQRGTLGHQPSTKTENVPSQVKALDNVKIVQAAIGGWHCLAVDDKGRAYAWGGNEYGQCGEELEKKGDSGRRDIVIPQRCASKLTVRQVAAGGTHSVVLTREGHVWTWGQPWPPGDIKQISTPVRVQGLEKVKLIAVGAFHNLALLEDGNLWVWGNNEYGQLGTGDTQPRSQPVPVQGLSGLKLVDIAAGGWHSTALTDEGEVYGWGRGEHGRLGFGDDKSSKMVPQQVQLLAGEDIVQVSCGGTHSVTLTRNGRMFSFGRGDHGRLGYGRKVTTGHPSEVPIDLPPPKDVSDGEPGHWCAKYVACGGRHTLAIVEWQATESDGLI

SEQ ID NO: 6617 - protein, 391 aa, Lactuca sativa
MPVDTTAVIAWGSGEDGQLGLGDNEEKEWVSSVTSLNSATVRSVVAGSRNSLAICDDGKLFTWGWNQRGTLGHQPSTKTENIPSQVKALDNVKIIQAAIGGWHCLAVDDEGRAYAWGGNEYGQCGEELEKKGESGRTLRRDIVIPQRCASKLSVRQVAAGGTHSVVLTNEGHVWTWGQPWPPGDIKQISTPVRVQGLEKVKLIAVGAFHNLALLEDGNLWVWGNNEYGQLGTGDTQPRSQPVPVQGLSGLKLIDVAAGGWHSTALTDEGEVYGWGRGEHGRLGFGDDKSSKMVPQQVQLLAGEDIIQVSCGGTHSVALTRDGRMFSFGRGDHGRLGYGRKVTTGHPCEVPIDLKSPKDGELGRWCATYVACGGRHTLAIVKWKDVEVNEMI

SEQ ID NO: 6618 - protein, 395 aa, Chrysanthemum coronarium
MAVNTNTAVIAWGSGEDGQLGLGDNEEKEWVSTVTSLDSVTVTSVVAGSRNSLAIAHDGKLFMWGWNQRGTLGHQPSTKTENVPSQVKALDNVKIVQAAIGGWHCLAVDDQGRAYAWGGNEYGQCGEELDKKGDSGRTMRRDIVIPQRCASKLSVRQVAAGGTHSVVLTREGHVWTWGQPWPPGDIKQISTPVRVQGLEKVKLIAVGAFHNLALLEDGNLWVWGNNEYGQLGTGDTQPRSQPVPVQGLSDLKLVDIAAGGWHSTALTDEGEVYGWGRGEHGRLGFGDDKSSKMVPQQVQLLAGEDIVQVSCGGTHSVALTRDGRMFSFGRGDHGRLGYGRKVTTGHPSEVPIDLPPPKDASDGEPGRWCAKYVACGGRHTLAIVEWQATEADGLI

SEQ ID NO: 6619 - protein, 394 aa, Fagopyrum esculentum
MPPSPAITAVISWGSGEDGQLGLGNNEEKELVCEVESLKPYSVSSVVAGSRNSLAICQDGKLFTWGWNQRGTLGHPSETKTENVPSQVKALDGVKIIQAAIGGWHCLAVDNQGRAYAWGGNEYGQCGEELERKDDSGRTSLKRDIVIPQRCAPKLSVHQVAAGGTHSAVLTKEGHVWTWGQPWPPGDIKQINVPVRVQGLEKVRLIAVGAFHNLALGEDGTLWAWGNNEYGQLGTGDTQPRSHPIPVLGLSGLTLVDIAAGGWHSMALTKEGEVYGWGRGEHGRLGFGDDKSSKMVPQKVQLLAGEDIIQVSCGGTHSVALTRDGRIFSFGRGDHGRLGYGRRVTTGHPMEVPISLPPKQDEVDGEEGHWRAKFIACGGRHTLAIAQWQPGERE

SEQ ID NO: 6620 - protein, 397 aa, Centaurea maculosa
MAVNNNTTAVIAWGSGEDGQLGLGDNEEKEWVSSVTSLNSVTVRSVVAGSRNSLAVCDDGKLFMWGWNQRGTLGHQPSTKTENIPSQVKALDNVKIVQAAIGGWHCLAVDDQGRAYAWGGNEYGQCGEELEKKGESGRTLRRDIVIPQRCASKLSVRQVAAGGTHSVVLTREGHVWTWGQPWPPGDIKQISTPVRVQGLERVKLIAVGAFHNLALVEDGNLMVWGNNEYGQLGTGDTQPRSQPVPVQGLSGLTLVDVAAGGWHSTALTDEGEVYGWGRGEHGRLGFGDDKSSKMVPQQVQLLAEEDIVQVSCGGTHSVALTRDGRMFSFGRGDHGRLGYGRKVTTGHPSEVPIDLPPPEDAESGSEVGRWCAKYVACGGRHTIAIVEWQTTDPNLIP

SEQ ID NO: 6621 - protein, 376 aa, Fagopyrum esculentum
MGQLGAWKHEEKELICEVGSLKPYSVSSVVAGSRNSLAICQDGKLFTWGWNQRGTLGHPSETKTENVPSQVKALDGVKIIQAAIGGWHCLAVDNQGRAYAWGGNEYGQCGEELERKDDSGRPSPKRDIVIPQRCAPKLSVHQVAAGGTHSAVLTKEGHVWTWGQPWPPGDIKQINVPVRVQGLEKVRLIAVGAFHNLALGEDGTLWAWGNNEYGQLGTGDTQPRSHPIPVLGLSGLTLVDIAAGGWHSMALTKEGEVYGWGRGEHGRLGFGDDKSSKMVPQKVQLLAGEDIIQVSCGGTHSVALTRDGRIFSFGRGDHGRLGYGRRVTTGHPMEVPINLPPKQHELDEEGHWRAKFIACGGRHTLAIAQWQPGERE

SEQ ID NO: 6622 - protein, 395 aa, Musa acuminata
MAAAESAHPVVLAWGSGEDGQLGMGNWEEKDWAYSIKSLEPKNVVAVVAGSRNSLAICGNGQLYTWGWNQRGTLGHPPETKTESVPSLVDALAGVKIVQAAIGGWHCLAVDDQGRAYAWGGNEYGQCGEEPERKEDGSRALRRDIAIPQRCAPKLSVRQVAAGGTHSVVLTQDGHVWTWGQPWPPGDITQISTPVRVQGLERVRLIAVGAFHNLALLEDGTLWAWGNNEYGQLGTGDTQPRSQPIPVQGLSGLTLVDIAAGGWHSTALTNVGEVYAWGRGEHGRLGFGDDKSSKMVPQKVQLLVGEDIVQISCGGTHSVACTRDGRMFSFGRGDHGRLGYGRKVTTGHPMEVPIKLLPPRDSGSTDGQWCAKLVACGGRHTLAMASWVEEPGDSI

SEQ ID NO: 6623 - protein, 392 aa, Chrysanthemum coronarium
MAVNTNSAVIAWGSGEDGQLGLGDNEEKEWVSSVTSLHSVTVTSLVAGSRNSLAIANDGKLFMWGWNQRGTLGHQPSTKTENVPSQVKALDNVKIVQAAIGGWHCLAVDDKGRAYAWGGNEYGQCGEELEKKGDSGRRDIVIPQRCASKLTVRQVAAGGTHSVVLTREGHVWTWGQPWPPGNIKQISTPVRVQGLEKVKLIAVGAFHNLALLEDGNLWVWGNNEYGQLGTGDTQPRSQPVPVQGLSGLKLVDIAAGGWHSTALTDEGEVYGWGRGEHGRLGFGDDKSSKMVPQQVQLLAGEDIVQVSCGGTHSVTLTRNGRMFSFGRGDHGRLGYGRKVTTGHPSEVPIDLPPPKDASDGEPGRWCAKYVACGGRHTLAIVEWQVTESDGLI

SEQ ID NO: 6624 - protein, 393 aa, Eutrema parvulum
MVSATSIIAWGSGEDGQLGIGTNEEKEWACVVEALEPYSVRSVVSGSRNSLAICDDGTMFTWGWNQRGTLGHPPQTKTENVPSRVKALSNVKITQAAIGGWHCLAVDDQGRAYAWGGNEYGQCGEEPLKDEMGRPVRRDIVIPKRCAPKLTVRQVAAGGTHSVVLTREGHVWTWGQPWPPGDIKQIFVPVRVQGLENVRLIAVGAFHNLALEEDGRLLAWGNNEYGQLGTGDTQPTPYPVPVQGLDDLTLVDIAAGGWHSTALTDKGEVYGWGRGEHGRLGLGDNDKSSKMVPQKVNLLAEEDIIQVSCGGTHSVALTRDGRIFSFGRGDHGRLGYGRKVTTGQPLELPIKIPPPEGSFNHADEEEEGKWLAKSIACGGRHTLARVEWKSDDV

SEQ ID NO: 6625 - protein, 399 aa, Elaeis guineensis
MAATPSSHSVVLAWGSGEDGQLGMGDWEEKDWVCSVKSLESENVTAVVAGSRNSLAICDSGHLFTWGWNQRGTLGHAPETKTESVPSLVESLAKANVKIIQAAIGGWHCLAVDDQSRAYAWGGNEYGQCGEEPERKEDGTRALRRDITTPQRCAPKLSVRQVAAGGTHSVVLTQDGHVWTWGQPWPPGDIKQIWTPVRVQGLERVRLIAVGAFHNLALLDDGMLWAWGNNEYGQLGTGDTQPRSQPIPVQGLSGLTLVDIAAGGWHSTALTDNGEVYAWGRGEHGRLGFGDDKSSKMVPQKVQLLVGEDIVQVSCGGTHSVACTRDGRMFSYGRGDHGRLGYGRKVTTGHPMEVPIDLPPPKNCLSTSGRWCAKYVACGGRHTLAIATWIDEPEQSLSS

SEQ ID NO: 6626 - protein, 400 aa, Ananas comosus
MAATQPSPSSLVLAWGSGEDGQLGMGDWEEKDWVRPIKTLEPYNVTAVVAGSRNSLAICDNGHLFTWGWNQRGTLGHPPESKAECVPSLVRSLADSSVKIVQAAIGGWHCLAVDDNGRAYAWGGNEYGQCGEEPERKEDGSKALRRDIPIPQRCAPRLSVRQVAAGGTHSVVLTQDGHVWTWGQPWPPGDIKQIWAPVRVQGLERVRLIAVGAFHNLALLEDGTLWAWGNNEYGQLGTGDTQPRSQPIPVQGLSGLTLVDIAAGGWHSTALTDEGEVYAWGRGEHGRLGFGDDKSSKMVPQKVQLLVGEDIVQVSCGGTHSVACTRDGRMFSFGRGDHGRLGYGKRVTTGHPMEVPINLPPPKDRSGSHGRWCTKLVACGGRHTLAIATWKDEPDQSIPT

SEQ ID NO: 6627 - protein, 382 aa, Brassica napus
GQLGLGTYEEKEWACVVEALDPFAVRSVVGGSRNSLAICDDGKLFTWGWNQRGTLGHPPEKKTESVPSLVKSLANVKITQAAIGGWHCLAVDDQGRAYAWGGNEYGQCGEEPSKDDSGRPVRRDIVIPKRCAPKLTVRQVAAGGTHSVVLTREGSVWTWGQPWPPGDIKQISVPVRVQGLENVRLIAVGAFHNLALKEDGTLWAWGNNEYGQLGTGDTQPRSHPIPVQGLDDLTLVDIAAGGWHSTALTEEGEVYAWGRGEHGRLGFGDNDKSSKMVPQKVNLLAGEDIIQVSCGGTHSVALTRDGRIFSFGRGDHGRLGYGRKVTTGQPLELPIDIPPPEGQFNHADEEEDGKWIAKFVACGGRHTLAIMEWKADQEEETE

SEQ ID NO: 6628 - protein, 399 aa, Cocos nucifera
MAAAPSSHSVVLAWGSGEDGQLGMGDWEEKDCVCSVKSLESENVTAVVAGSRNSLAICDNGHLFTWGWNQRGTLGHAPETKTESVPSLVKSLAEAKVKIVQAAIGGWHCLAVDDQGRAYAWGGNEYGQCGEEPERKEDGTRAMRRDITTPRCCAPKLSVRQVAAGGTHSVVLTQDGHVWTWGQPWPPGDIKQIWTPVRVQGLERVRLIAVGAFHNLALLEDGTLWAWGNNEYGQLGTGDTQPRSQPIPVQGLSGLTLVDIAAGGWHSTALTDNGEVYAWGRGEHGRLGFGDDKSSKMVPQKVQLLAGQDIVQVSCGGTHSVACTRDGRMFSYGRGDHGRLGYGRKVTTGHPMEVPIDLPPPKNCLSTSGLWCAKFVACGGRHTLAIAAWMDEPEQAPPS

SEQ ID NO: 6629 - protein, 379 aa, Cichorium intybus
SGEDGQLGLGDNEEKEWVSSVTSLNSVTVRSVVAGSRNSLAICDDGKLFMWGWNQRGTLGHQPSTKTENIPSQVKALDNVKVVQAAIGGWHCLAVDDQGRAYAWGGNEYGQCGEELEKKGESGRTLRRDIVIPQRCASKLSVRQVAAGGTHSVVLTREGHVWTWGQPWPPGDIKQISTPVRVQGLEKVKLIAVGAFHNLALLEDGSLWVWGNNEYGQLGTGDTQPRSQPVPVQGLSGLKLIDVAAGGWHSTALTEEGEVYGWGRGEHGRLGFGDDKSSKMVPQQVHHLAGEDIVQVSCGGTHSVALTRDGRMFAFGRGDHGRLGYGRKVTTGHPSEVPIDLPPPKDGELGRWCAKYVACGGRHTLAIVEWEGVEVVELI

SEQ ID NO: 6630 - protein, 389 aa, Zea mays
MATPLRATAVLAWGSGEDGQLGMGGNEEKDWPHFVEALGPYAVTAVVAGSRNSLAICDDGRLFTWGWNQRGTLGHPPETKTESSPGPVDALAGFKIVQAAIGGWHCLAVDDKGRAYAWGGNEYGQCGEEPERKEDGTRALRRDIPIPQRCALKLKVRQVAAGGTHSVVLTQEGHVWTWGQPWPPGDIKQISTPVRVQGLEKVRVIAVGAFHNLALTEDVILWAWGNNEYGQLGTGDTQPRSQPIRVEGLSDLSLVDIAAGGWHSTALTIDGEVYAWGRGEHGRLGFGDDKSSHMVPLKVELLAGEDIVQVSCGGTHSVALARDGRMFSYGRGDHGRLGYGRKVTTGHPMELPINLPPLSSSRDGRWQAKYVACGGRHTLAIAEWTEATD

SEQ ID NO: 6631 - protein, 391 aa, Arnica chamissonis
MAVNNTAVVAWGSGEDGQLGLGDNEEKEWVSPVTSLTSVTVRSVVAGSRNSLAVCDDGKLFMWGWNQRGTLGHPPSTKTENIPSHVEAPDDVKIVQAAIGGWHCLAVDDQGRAYAWGGNEYGQCGEELEKKGDSGRRDILTPQRCASNLSVRQVAAGGTHSVVLTREGHVWTWGQPWPPGDIKQISTPVRVQGLEKVKLIAVGAFHNLALLEDGNLWVWGNNEYGQLGTGDTQPRSQPVPVQGLSGLKLVDVAAGGWHSTALTDEGEVYGWGRGEHGRLGFGDDKSSKMVPQQVQLLAGEDIVQVSCGGTHSVALTRDGRMFSFGRGDHGRLGYGRKVTTGHPSEVPIDIPPPNDDGGSGLGRWCAKYVACGGRHTIAIVEWRATEADGLI

SEQ ID NO: 6632 - protein, 397 aa, Musa acuminata
VTCSVFRLKEFRFVLRGSGEDGQLGMGNWEEKDWAYSIKSLEPKNVVAVVAGSRNSLAICGNGQLYTWGWNQRGTLGHPPETKTESVPSLVDALAGVKIVQAAIGGWHCLAVDDQGRAYAWGGNEYGQCGEEPERKEDGSRALRRDIAIPQRCAPKLSVRQVAAGGTHSVVLTQDGHVWTWGQPWPPGDITQISTPVRVQGLERVRLIAVGAFHNLALLEDGTLWAWGNNEYGQLGTGDTQPRSQPIPVQGLSGLTLVDIAAGGWHSTALTNVGEVYAWGRGEHGRLGFGDDKSSKMVPQKVQLLVGEDIVQISCGGTHSVACTRDGRMFSFGRGDHGRLGYGRKVTTGHPMEVPIKLLPPRDSGSTDGQWCAKLVACGGRHTLAMASWVEEPGDSI

SEQ ID NO: 6633 - protein, 407 aa, Gossypium raimondii
MKRVFSAPGDYIYFKSQVPLHRIPIGTKQWRYYDFGPKVVTPLICLPGTAGTADVYYKQIMCLSMKGYRVISVDIPCVWNHQEWIQSFEKFLDAIDVHHIHLYGTSLGGFLAQLFAQHRPRRVKSLILSNTFLETRSFAAAMPWAPFVSWTPSFLLKRYVLTGIRDGPHEPFIADSVDFVVSQVETLSRDELASRLTLTVDSASVKPLLLSDSFITIMDTNDYSAIPQQLKDQLSERYPGARRAYLKTGGDFPFLSRPDEVNLHLQLHLRRVGLEAQPELVQSIPKDGTGGGPSKENDKEDRDDEQKDNGGNPESNSEESQPSPSAPESSESHGLDEQLLSNAEIHYIDQKDSIILKPSAMSMNQHSAAAGILLQSTWEFFIFSLLPLYVDSLYIYSNNAWKLRQLV

SEQ ID NO: 6634 - protein, 407 aa, Gossypium hirsutum
MKRVFSAPGDYIYFKSQVPLHRIPIGTKQWRYYDFGPKVVTPLICLPGTAGTADVYYKQIMCLSMKGYRVISVDIPCVWNHQEWIQSFEKFLDAIDVHHIHLYGTSLGGFLAQLFAQHRPRRVKSLILSNTFLETRSFAAAMPWAPIVSWTPSFLLKRYVLTGIRDGPHEPFIADSVDFVVSQVETLSRDELASRLTLTVDSASVKPLLLSDSFITIMDTNDYSAIPQQLKDQLSERYPGARRAYLKTGGDFPFLSRPDEVNLHLQLHLRRVGLEAQPELVQSIPKDGTGGGPSKENDKEDRDDEQKDDGGNPESNSEESQPSPSAPESSESHGLDEQLLSNAEIHYIDQKDSIIFKPSAMSMNQHGAAAGILLQSTWEFFIFSLLPLYVDSLYIYSNNAWKLRQLV

SEQ ID NO: 6635 - protein, 407 aa, Theobroma cacao
MKGVFSAPGDYIHFKSQVPLHKIPIGTKQWRYYDFGPKVVPPIICLPGTTGTADVYYKQIMSLSMKGYRVISVDIPRVWNHQEWIQSFEKFLDAIDVHHIHLYGTSLGGFLAQLFAQHRPRRVKSLILSNAFLETRSFAAAMPWAPIVGWTPSFLLKRYILTGIRDGPHEPFIADSVDFVVSQVETLSREDLASRLTLTVDSASVGPLLLSDSFITIMDTNDFSAIPQQLKDQLSERYPGARRAYLKTGGDFPFLSRPDEVNLHLQLHLRRVGVEAQPDLVRSIPKDGTGGSPSKENDEKKDSDDPPKDNGGNPESTSEERQLPPAPESSESHGLDDQLLSNAKICSLGHEGAISLRHSALLKNQHTVASKILLQSTWEFFIFSLLPFYVESLYITSSYGWKFRQLV

SEQ ID NO: 6636 - protein, 398 aa, Gossypium raimondii
MKGVSLAPGDYIHFKSQVPLHKIPIGTKQWRYYDFGPKVVSPLICLPGIAGTADIYYKQIMSLSMKGYRVISVDIPQVWNHQEWIQSFEKFLDVINVHHIHLYGTSLGGFLAQLFAQHRPRRVKSLILSNAFLETRSFAAAMPWAPIVGWSPSFLLKRFVLTGIRDGPHEPFIADSVDFVVSQVETLSRDDLASRLTLTVDTATVEPLLLSDSFITIMDTNDYSAIPQQLKDQLSERYPGARRAYLKTGGDFPFLSRPDEVNLHLQLHLRQVGVEARPDLVQSIPKGGTGGSPSKESDKKKDPDDQPKDNGGNPESTSEESQLPPSSEIHSLDDQLLSDAKICSMGHKDAIILMQSQYTVVNRILQSACELFIFSLLPIYVESSYVTSNNVWKFRQLM

SEQ ID NO: 6637 - protein, 400 aa, Gossypium hirsutum
MKGVYSAPGDYIHFKSQVPLHKIPIGTKQWRYYDFGPKVVPPLICLPGTAGTADVYYKQIMSLSMKGYRVISVDIPCVWNHQEWIQSFEKFLDAIDVHHIHLYGTSLGGFLAQLFAQHRPRRVKSLILSNTFLETSSFSAAMRWAPIVGWAPSFLLKRYILTGIHDGPQEPFIADSVDFVVSQVETLSRDDLASRLAFTVDNASVGPLLLSDSFITIMDTNDYSSIPQELKDQLGERYPAARRAYLKTGADFPFLSRPDEVNLHLQLHLRRVGVEAKPDLVRTIPKDGSGGSPGKENDEKKDHDDQPNGNGGNPESTSKESQSPPAPESSEYHGLYDQLLSSAKVISIGRQDSTLMKNQHILATGVLQVTWEFFIFSLLPIYVCSLYITQNNVWKFRKLV

SEQ ID NO: 6638 - protein, 398 aa, Gossypium hirsutum
MKGVSLAPGDYIHFKSQVPLHKIPIGTKQWRYYDFGPKVVSPLICLPGIAGTADIYYKQIMSLSMKGYRVISVDIPQVWNHQEWIQSFEKFLDVINVHHIHLYGTSLGGFLAQLFAQHRPRRVKSLILSNAFLETRSFAAAMPWAPIVGWSPSFLLKRYVLTGIRDGPHEPFIADSVDFVVSQVETLSRDDLASRLTLTVDTATVEPLLLSDSFITIMDTNDYSAIPQQLKDQLSERYPGARRAYLKTGGDFPFLSRPDEVNLHLQLHLRQVGVEARPDLVQSIPKGGTGGSPSKESDKKKDPDDQPKDNGGNPESTSEESQLPPSSEIHSLDDQLLSDARICSMGHEDAIILMQSQYTVVNRILQSACELFIFSLLPIYVESSYVTSNNVWKFSQLM

SEQ ID NO: 6639 - protein, 398 aa, Gossypium raimondii
MKGVYSAPGDYIHFKSQVPLHKIPIGTKQWRYYDFGPKVVPPLICLPGTAGTADVYYKQIMSLSMKGYRVISVDIPCVWNHQEWIQSFEKFLDAIDVHHIHLYGTSLGGFLAQLFAQHRPRRVKSLILSNTFLETSSFSAAMRWAPIVGWAPSFLLKRYILTGIHNGPQEPFIADSVDFVVSQIETLSRDDLASRLAFTVDNASVGPLLLSDSFITIMDTNDYSSIPQELKDQLGERYPAARRAYLKTGGDFPFLSRPDEVNLHLQLHLRRVGVEAKPDLVPKDGSGGSPGKENDEKKDHDDQPNGNGGNPESTSKESQSPPAPESSEYHGLYDQRLSSAKVISIGREDSTLMRDQHILATGVLLQLTWEFFIFSLLPIYVCSLYITQNNVWKFRKLV

SEQ ID NO: 6640 - protein, 612 aa, Gossypium raimondii
MEGSVEETAKAVSDLALDSSAAGETQSKNARKKELKNKQREEERRRKEEEKAAKQAAAKASTQSQKHAAADDEDMDPTQFHENRLKFLAAQKAEGKNPYPHKFFTSMSIVEYIDKYGSLGNGEHIEDATVSLAGRIMSKRASSSKLFFYDLHGGGAKVQVMADASKSGLDEAEFAKFHSTVKRGDIVGVTGFPGKTKRGELSIFPKSFLVLSHCLHMMPRQKAGPDASVKKTDVWIPGSTRNPETYILKDQETRYRQRYLDLMLNLEVRQIFKTRSKIISYVRSFLDNLDFLEVETPMMNMIAGGAAARPFVTHHNELNMKLYMRIAPELYLKELVVGGLDRVYEIGKQFRNEGIDLTHNPEFTTCEFYMAFADYNDLMELTEKMLSGMVKELTGSYKIKYHANGLDNAPIEIDFTPPFRRLDMVEELEKMANLNIPKDFSSDETNKYLADACAKLEIKCPPPQTTARLLDKLVGHFLEETCVNPTFIINHPEIMSPLAKWHRSKPGLTERFELFINKHELCNAYTELNDPVVQRQRFAEQLKDRQSGDDEAMALDETFCTALEYGLPPTGGWGLGIDRLAMLLTDSQNIKEVLLFPAMKPQDEPSTKAPAT

SEQ ID NO: 6641 - protein, 612 aa, Gossypium hirsutum
MEGSVEETAKGVSDLAVDSASPAEIQSKNARKKELKNKQREEERRRKEEEKAAKQAAAKASSHCQKSAGADDEDMDPTQFHENRLKFLAAQKAEGKNPYPHKFFASMSIIEYIDKYGSLANGEHIEDISVSLAGRIMSKRSSSSKLFFYDLHGDGAKVQVMADASKSGLDEAEFAKFHSSVKRGDIVGVTGFPGKTKRGELSIFPKSFTVLSHCLHMMPRQKAGPDASVKKTDLWVPGSTRNPEAYILKDQETRYRQRYLDLMLNLEVRQIFKTRSKIISYVRSFLDNLDFLEVETPMMNMIAGGAAARPFVTHHNELNMKLYMRIAPELYLKELVVGGLDRVYEIGKQFRNEGIDLTHNPEFTTCEFYMAFADYNDLMELTEKMLSGMVKELTGGYKIKYHSNGLENDPIEIDFTPPFRRLDMVEELEKMANLNIPKDFSSDEANKYLVDACAKFEIKCPPPQTTARLLDKLVGHFLEETCVNPTFIINHPEIMSPLAKWHRSKPGLTERFELFINKHELCNAYTELNDPVVQRQRFAEQLKDRQSGDDEAMALDETFCTALEYGLPPTGGWGLGIDRLAMLLTDSQNIKEVLLFPAMKPQDEPSAKAPGT

SEQ ID NO: 6642 - protein, 612 aa, Gossypium raimondii
MEGSVEETAKGVSDLAVDSASPAETQSKNARKKELKNKQREEERRRKEEEKAAKQAAAKASSHCQKSAGADDEDMDPTQFHENRLKFLAAQKAEGKNPYPHKFFASMSIIEYIDKYGSLANGEHIEDISVSLAGRIMSKRSSSSKLFFYDLHGDGAKVQVMADASKSGLDEAEFAKFHSSVKRGDIVGVTGFPGKTKRGELSIFPKSFTVLSHCLHMMPRQKAGPDASVKKTDLWVPGSTRNPEAYILKDQETRYRQRYLDLMLNLEVRQIFKTRSKIISYVRSFLDNLDFLEVETPMMNMIAGGAAARPFVTHHNELNMKLYMRIAPELYLKELVVGGLDRVYEIGKQFRNEGIDLTHNPEFTTCEFYMAFADYNDLMDLTEKMLSGMVKELTGGYKIKYHSNGLENDPIEIDFTPPFRRLDMVEELEKMANLNIPKDFSSDEANKYLVDACAKFEIKCPPPQTTARLLDKLVGHFLEETCVNPTFIINHPEIMSPLAKWHRSKPGLTERFELFINKHELCNAYTELNDPVVQRQRFAEQLKDRQSGDDEAMALDETFCTALEYGLPPTGGWGLGIDRLAMLLTDSQNIKEVLLFPAMKPQDEPSAKAPGT

SEQ ID NO: 6643 - protein, 613 aa, Theobroma cacao
MEGSVEETAKAVSDLAMDSTAHGETQSKNARKKELKNKQREEERRRKEEEKAAKQAAAKVGSQSQKHAGADDEDMDPTQFHENRLKFLAGQKAEGKNPYPHKFFPSMSIIEYIDKYGSLGNGEHIEDLSVSLAGRIMSKRSSSSKLFFYDLHGDGAKVQVMADASKSGLDESEFAKFHSSVKRGDIVGVTGFPGKTKRGELSIFPKSFIVLSHCLHMMPRQKAGPDANVKKTDAWVPGSNRNPETYILKDQETRYRQRYLDLMLNLEVRQIFRTRSKIISYIRSFLDNLDFLEVETPMMNMIAGGAAARPFVTHHNELNMKLYMRIAPELYLKELVVGGLDRVYEIGKQFRNEGIDLTHNPEFTTCEFYMAFADYNDLMELTEKMLSGMVKELTGSYKIKYHANGLDNDPIEIDFTPPFRRLDMVEELEKMANLNIPKDFSGDEANKYLVDACAKFEIKCPPPQTTARLLDKLVGHFLEETCVNPTFIINHPEIMSPLAKWHRSKPGLTERFELFVNKHELCNAYTELNDPVVQRQRFAEQLKDRQSGDDEAMALDETFCTALEYGLPPTGGWGLGVDRLAMLLTDSQNIKEVLLFPAMKPQDEPSVKVSCLA

SEQ ID NO: 6644 - protein, 612 aa, Manihot esculenta
MESSVDETAKQVSNLSMDAESTASGGETVSKNARKKELKNKQREEERRRKEEEKARQAAERTSTHVQKPAAADDEDMDPTQYYENRLKYLASQKAEGKNPYPHKFSVSMSIVEFIEKYGGLSNGEHVEDVNESLAGRIMKKRSSSSKLFFYDLHGGDVKVQVMADASKSGMDEAQFSRFHSSVKRGDIVGVIGFPGKTKRGELSIFPRSFTVLSHCLHMMPREKPGQNPNVKRTDIWAPGQTRNPEAYTLKDQETRYRQRYLDLMLNAEVRQLFKARSKIISYVRSFLDNLDFLEVETPMMNMIAGGAAARPFVTHHNELNMRLYMRIAPELYLKELVVGGLDRVYEIGKQFRNEGIDLTHNPEFTTCEFYMAFADYNDLMELTERLLSGMVKELTGGYKIKYHANGLDNDPIEIDFTPPFRRIDMIEELEKMANLNIPKDLSSDEANKYLVAACERFDVKCPPPQTTARLLDKLVGHFLEETCVNPAFIINHPEIMSPLAKWHRSKPGLTERFELFVNKHELCNAYTELNDPVVQRQRFTEQLKDRQSGDDEAMAYDETFCTALEYGLPPTGGWGMGIDRLAMLLTDSQNIKEVLLFPSMKPQDEPPAKAT

SEQ ID NO: 6645 - protein, 619 aa, Vitis vinifera
MEGAAEEAAKAILDLSVDGSSSETTSKNARKKELKMKQREEEKKRKEEEKAKQAAAVSSSKVQKPMAGDDEDMDPTQYFENRVKYLAAQKAAGKNPYPHKFFVTLSILEYIKKYGALSNGDHLEDVTVSLAGRIMSKRSSSSKLFFYDLHGDGAKVQVMADARSSDMDEAEFSRFHSGVKRGDIVGVTGFPGKTKRGELSIFPKSFIVLSHCLHMMPRQKAGPGSDNANVKKTDVWVPGSTRNPETYILKDQETRYRQRYLDLMLNMEVRQIFKTRAKIISYIRSFLDNLDFLEVETPMMNMIAGGAAARPFVTHHNDLNMKLYMRIAPELYLKELVVGGLDRVYEIGKQFRNEGIDLTHNPEFTTCEFYMAFADYNDVMELTEKMLSGMVKELTGGYKIKYHANGLDKDPIEIDFTPPFRRIDMIEDLEKMADLSIPKDLSSDEANKYLVDACLKFDIKCPPPQTTARLLDKLVGHFLEETCVNPTFITNHPEIMSPLAKWHRSKQSLTERFELFVNKHELCNAYTELNDPVVQRQRFAEQLKDRQSGDDEAMALDETFCMALEYGLPPTGGWGLGIDRLTMMLTDSQNIKEVLLFPAMKPQDEPSVQPPAELSSQAV

SEQ ID NO: 6646 - protein, 621 aa, Citrus clementina
MEGSVDETAKAVSNLAVDSSSSDPAAGEETISKNARKKELKMKQKEEERRRKEEEKRQKEAERAATKASPQSQKPAADDEDMDPTQYLENRKRYLEIQKKEGKNPYPHKFFVSMSIIEYIANYGGLGNGDHLEDISVSLAGRIMSKRSSSSKLFFYDLHGGGAKVQVMADASKSDMDEVEFSKFHASVKRGDIVGVTGFPGKTKRGELSIFPKSFVVLSHCLHMMPRQKPGVDNANVKKVDAWVPGSTRNPETYILKDQETRYRQRYLDLMLNVEVRQIFKTRSKVVSYIRRFLDNLDFLEVETPMMNMIAGGAAARPFVTHHNDLNMRLYMRIAPELYLKELVVGGLDRVYEIGKQFRNEGIDLTHNPEFTTCEFYMAFADYNDLMELTEKMLSGMIKEITGSYKIKYHSNGLDKDPIEIDFTPPFRRIDMIEELEKIANLQIPKDLASVEANKYLADACVKFDIKCPPPQTTARLLDKLVGHFLEETCVNPSFIINQPEIMSPLAKYHRSKPGLTERFELFINKHEVCNAYTELNDPIVQRERFAEQLKDRESGDDEAMALDETFCMALEYGLPPTAGWGLGIDRLAMLLTDSQNIKEVLLFPAMKPQDEPAAAKAATQ

SEQ ID NO: 6647 - protein, 614 aa, Eucalyptus grandis
MEGGPADEAAKAVADLAVDASSGDTQSKNARKKELKNKQREEERRRKEEEKAKLAASKASSQSQKPGAADDEDMDPTQYFQNRLKYLEAQKTDGKNPYPHKFQALMSIPEYINQYGGLKNGEHLEDVSISLAGRIMNKRSSSSKLFFYDLHGGGAKVQVMADASKSGMDDAEFSRFHSNVKRGDIVGISGFPGKTKRGELSIFPRSFIVLSHCLHMMPRQKAAPGSENANVKKTELWVPGSTRNPETYILKDQETRYRQRYLDLMLNLEVRHIFKTRAKVIQYVRKFLDDLDFLEVETPMMNMIAGGAAARPFVTHHNDLNMRLYMRIAPELYLKELVVGGLERVYEIGKQFRNEGIDLTHNPEFTTCEFYMAFADYNDIMELTEKMLSGMVKELTGGYKIKYHANGLDNDPIEIDFTPPFRRIDMIEELEKIANLDIPKDLSSVEANKYLMDACARFDVKCAPPQTTTRLLDKLVGHFLEETCVNPTFIINHPEIMSPLAKWHRSKPGLTERFELFANKHELCNAYTELNDPVVQRERFAEQLKDRQSGDDEAMALDETFCTALEYGLPPTGGWGMGIDRLTMLLTDSQNIKEVLLFPAMKPQDEPPAKAPSS

SEQ ID NO: 6648 - protein, 614 aa, Manihot esculenta
MESSVDETAKEVSNLSMDVEPSASEGETISKNARKKELKNKQREEERRRKEEEKAKQAAERASSKVQKSAAADDEDMDPTQYYENRLRYLASQKAEGGNPYPHKFHVSMSVVEYIEKYGSLSNGEHIEDVTESLAGRIMKKRSSSSKLFFYDLHGGDVKVQVMADASKSGMDEAEFSRFHSSVKRGDIVGVIGFPGKTKRGELSIFPRSFTVLSHCLHMMPREKPGHNANVRRTDIWAPGLARNPEAYILKDQETRYRQRYLDLMLNAEVRQLFKARSKIISYLRGFLDNLDFLEVETPMMNMIAGGAAARPFVTHHNELNMRLFMRIAPELYLKELVVGGLDRVYEIGKQFRNEGIDLTHNPEFTTCEFYMAFADYNDLMELTERLLSGMVKELTGGYKIKYHANGLDNDPIEVDFTPPFRRIDMIEELEKMANLNIPKDLSSDEANKYLVDVCGRFEVKCPPPQTTARLLDKLVGHFLEETCVNPTFIINHPEIMSPLAKWHRLKPGLTERFELFVNKHELCNAYTELNDPVVQRQRFTEQLKDRQSGDDEAMAYDETFCTALEFGLPPTGGWGMGIDRLAMLLTDSQNIKEVLLFPSMKPQDESPAKGIKF

SEQ ID NO: 6649 - protein, 620 aa, Vitis vinifera
MEGAAEEAAKAISDLSMDGSSSETISKNARKKELKMKQREEEKKRKEEEKVKQAAAVSSSKVQKPMAGDDEDMDPTQYFENRVKYLAAQKAAGKNPYPHKFFVTLSILEYIEKYGALSNGDHLEDVTVSLAGRIMSKRSSSSKLFFYDLHGDGAKVQVMADARSSDMDEAEFSRFHSGVKRGDIVGVTGFPGKTKRGELSIFPKSFVVLSHCLHMMPRQKAGPGSDNANVKKTDVWVPGSTRNPETYILKDQETRYRQRYLDLMLNMEVRQIFKTRAKIISYIRSFLDNLDFLEVETPMMNMIPGGAAARPFVTHHNDLNMKLYMRIAPELYLKELVVGGLDRVYEIGKQFRNEGIDLTHNPEFTTCEFYMAFADYNDVMELTEKMLSGMVKELTGGYKIKYHANGLDKDPIEIDFTPPFRRIDMIEDLEKMADLSIPKDLSSDEANKYLVDACLKFDIKCPPPQTTARLLDKLVGHFLEEACVNPTFIINHPEIMSPLAKWHRSKQSLTERFELFVNKHELCNAYTELNDPVVQRQRFAEQLKDRQSGDDEAMALDETFCMALEYGLPPTGGWGLGIDRLTMMLTDSQNIKEVLLFPAMKPQDEPSSVQPPAQPSTQAV

SEQ ID NO: 6650 - protein, 615 aa, Castanea mollissima
MEGSVVDEKEKAVVTDSPAAGETLSKNALKKELKNKQREEERRRKEEEKAKQAASMADSRSKKSAAADDEDMDPTQYFENRLKYLVALRAAGEEPYPHKFPVTMSIPEYVEKYNNIGNGEHLEDDTVNLAGRIMSKRSSSSKLFFYDLHGGAAKVQVMADASKSDLNEEEFSRFHSTVKRGDIVGVKGFPGKTKRGELSIFPKSFIVLSHCLHMMPRQKPKAGSVSDNTNLKKEEAWVPGCTRNPETYVLKDQETRYRQRYLDLMLNMEVRQIFKTRSQIISYIRRFLDSRDFLEVETPMMNMIAGGAAARPFVTHHNDLNMKLFMRIAPELYLKELVVGGLDRVYEIGKQFRNEGIDLTHNPEFTTCEFYMAFADYNDLMELTEIMLSGMVKELTGGYKIKYHANGLDEDPIEIDFTPPFRRIDMIEELEKMANLNIPKDFSSDEANKYLKDVCTKYEIKCAPPETTARLLDKLVGHFLEETCTNPAFIINHPELMSPLAKWHRTKKGLTERFELFINKHELCNAYTELNDPVVQRQRFAEQLKDRQSGDDEAMALDETFCTALEYGLPPTGGWGLGIDRLTMLLTDSQNIKEVLLFPAMKPQDEPSAKGNAGA

SEQ ID NO: 6651 - protein, 617 aa, Quercus alba
MEGSVDEKEKAVLGSVTGSPAAGETVSKNALKKELKNKQREEERRRKEEEKAKQAASMADSRSKKSAAADDEDMDPTQYFENRLKYLAALRAAGEEPYPHKFPVTMSNPEYVEQYKNIGNGEHLEDVTVNLAGRIMSKRSSSSKLFFYDLHGGAAKVQVMADASKSDLNEEEFSRFHSTVKRGDIVGVKGFPGKTKRGELSIFPRSFIALSHCLHMMPRQKPKAGSVSDNANLKKEEAWVPGCTRNPETYILKDQETRYRQRYLDLMLNMEVRQIFKTRSQIISYIRRFLDSRDFLEVETPMMNMIAGGAAARPFVTHHNDLNMKLFMRIAPELYLKELVVGGLDRVYEIGKQFRNEGIDLTHNPEFTTCEFYMAFADYNDLMELTETMLSGMVKELTGGYKIKYHANGLDEDPIEIDFTPPFRRIDMIEELEKMANLNIPKDFSSDEANKYLKDVCTKYEIKCAPPETTARLLDKLVGHFLEETCTNPAFIINHPELMSPLAKWHRTKKGLTERFELFINKHELCNAYTELNDPVVQRQRFAEQLKDRQSGDDEAMALDETFCTALEYGLPPTGGWGLGIDRLTMLLTDSQNIKEVLLFPAMKPQDEPSAKGNAGA

SEQ ID NO: 6652 - protein, 607 aa, Ricinus communis
MEGSVDETAKAVSNLAMEGGPEALSKNALKRELKMKQKEEERRRKEEEKAAKQAALKAQGQKSAAADEEDMDPTQYFENRLKYLASQKAEERNPYPHKFCVTMSIEEYKQKYGGLNDGEHLEDVTVSLAGRIMKKRSAAAKLFFYDLHGGGVKVQVMADFSKSDMEEAEFSKFHSNVKRGDIVGVTGFPGKTKRGELSIFPSSFAVLSHCLHMMPKEKAGPGAVNANRTDVWLPGCPRNPDTYILKDQETRYRQRYLDLMLNLEVRQIFKTRSRIITYIRSFLDSLDFLEVETPMMNMIAGGAAARPFVTHHNELNMRLFMRIAPELYLKELVVGGLDRVYEIGKQFRNEGIDLTHNPEFTTCEFYMAFADYNDLMELTERLLSGMVKELTGGHKIKYHANGLEKDPIEIDFTPPFRRIDMIEELEKMANLNIPKDLTSDEANKYLVAACERFEVKCPPPQTTARLLDKLVGHFLEETCVNPTFIINHPEIMSPLAKWHRSRPGLTERFELFMNKHEVCNAYTELNDPVVQRERFADQLKDRQSGDDEAMALDETFCTALEYGLPPTGGWGMGIDRLAMILTDSQNIKEVLLFPAMKPQDEHPPKAT

SEQ ID NO: 6653 - protein, 635 aa, Panax ginseng
MEGTIEETSKAVADLSVNNSTLTQSEPEVLSKNARKKELKNKQKEEERQRKEAEKEKKGAAVPSSQVQKSLATDDDDIDPTQYFENRQKALAAHKAAGNNPYPHKFLVSMSVPEYIEKFEGLDSGEHLENVEVSLAGRIMNKRSSSSKLFFYDLHGGGAKVQVMTDARRSDLDEAEFSKLHAGVKRGDIVGIIGIPGKSKRGELSIFPKSFIVLSHCLHMMPRQKVSSGSDNANVKKTDVWVPGSGRNPETYILKDQETRYRQRYLDLMLNIEVRHIFKTRAKIISYIRRFLDNLDFLEVETPMMNMIAGGAAARPFVTHHNDLNMKLFMRIAPELYLKELVVGGLDRVYEIGKQFRNEGIDLTHNPEFTTCEFYMAFADYNDLMELTERMLSGMVKELTGGYKVKYHANGLDNDPIEIDFTPPFRRIDMIEDLEKMADLNIPKDLSSNEANKYLADACTNFEIKCPPPQTTARVLDKLVGHFLEETCVNPTFIINHPEIMSPLAKWHRSKPSLTERFELFINKHELCNAYTELNDPVVQRQRFADQLKDRQSGDDEAMALDETFCTALEYGLPPTGGWGLGIDRLAMILTDSQNIKEVLLFPAMKPQDEPPTKAAAAQIIKKGETIPDLFFVKW

SEQ ID NO: 6654 - protein, 635 aa, Panax ginseng
MEGTIEETSKAVADLSVNNSTLTQSEPEVLSKNARKKELKNKQKEEERQRKEAEKEKKCAAVPSSQVQKPLATDDDDIDPTQYFENRQKALAAHKAAGNNPYPHKFLVSMSVPEYIEKFEGLDSGEHLENVEVSLAGRIMNKRSSSSKLFFYDLHGGGAKIQVMTDARSSDLDEAEFSKLHAGVKRGDIVGIIGIPGKSKRGELSIFPKSFIVLSHCLHMMPRQKVSSGSDNANVKKTDVWVPGSGRNPETYILKDQETRYRQRYLDLMLNIEVRHIFKTRAKIISYIRRFLDNLDFLEVETPMMNMIAGGAAARPFVTHHNDLNMKLFMRIAPELYLKELVVGGLDRVYEIGKQFRNEGIDLTHNPEFTTCEFYMAFADYNDLMELTERMLSGMVKELTGGYKVKYHANGLDNDPIEIDFTPPFRRIDMIEDLEKMADLNIPKDLSSNEANKYLADACTNFEIKCPPPQTTARLLDKLVGHFLEETCVNPTFIINHPEIMSPLAKWHRSKPSLTERFELFINKHELCNAYTELNDPVVQRQRFADQLKDRQSGDDEAMALDETFCTALEYGLPPTGGWGLGIDRLAMILTDSQNIKEVLLFPAMKPQDEPPTKAAAAQIIKKGETIPDLFFVKW

SEQ ID NO: 6655 - protein, 617 aa, Panax ginseng
MEGTIEETSKAVADLSVNNSTLTQSEPEVLSKNARKKELKNKQKEEERQRKEAEKEKKGAAVPSSQVQKPLATDDDDIDPTQYFENRQKALAAHKAAGNNPYPHKFLVSMSVPEYIEKFEGLDSGEHLENVEVSLAGRIMNKRSSSSKLFFYDLHGGGAKVQVMTDARRSDLDEAEFSKLHAGVKRGDIVGIIGIPGKSKRGELSIFPKSFIVLSHCLHMMPRQKVSSGSDNANVKKTDVWVPGSGRNPETYILKDQETRYRQRYLDLMLNIEVRHIFKTRAKIISYIRRFLDNLDFLEVETPMMNMIAGGAAARPFVTHHNDLNMKLFMRIAPELYLKELVVGGLDRVYEIGKQFRNEGIDLTHNPEFTTCEFYMAFADYNDLMELTERMLSGMVKELTGGYKVKYHANGLDNDPIEIDFTPPFRRIDMIEDLEKMADLNIPKDLSSNEANKYLADACTNFEIKCPPPQTTARLLDKLVGHFLEETCVYPTFITNHPEIMSPLAKWHRSKPSLTERFELFINKHELCNAYTELNDPVVQRQRFADQLKDRQSGDDEAMALDETFCTALEYGLPPTGGWGLGIDRLAMILTDSQNIKEVLLFPAMKPQDEPPTKAAA

SEQ ID NO: 6656 - protein, 622 aa, Panax ginseng
MGGTIEESSKAIADLSVDNSNPMQSEPEVLSKNARKKELKNKQKEEERRRKEEEKEKKVAAMPSSQVQKPLATEDEDMDPTQYFENRLKALAAHKAAGNNPYPHKFSVSMSVLEYIEKFEGLDSGEHLENVVVSLAGRIMNKRSSSSKLFFYDLHGGGAKVQVMTDARRSDLDEVEFSKFHAGVKRGDIVGITGFPGKSKRGELSIFPKSLIVLSHCLHMMPRQKVAPGSDNTNVKKTDAWVPGSGRNPDTYILKDQETRYRQRYLDLMLNIEVRHIFKTRTKIISYIRRFLDNLDFLEVETPMMNMIAGGAAARPFVTHHNDLNMKLFMRIAPELYLKELVVGGLNRVYEIGKQFRNEGIDLTHNPEFSTCEFYMAFADYNDLMELTERMLSGMVKELTGGYKVKYHVNGLDNDPIEIDFTPPFRRIDMIEDLEKLADLNIPKDLSSDEANKYLANACTKFEIKCPPPQTTARLLDKLVGHFLEETCVNPTFIINHPEIMSPLAKWHRSKPSLTERFELFINKHELCNAYTELNDPVVQRQRFADQLKDRQSGDDEAMALDETFCTALEYGLPPTGGWGLGIDRLAMMLTDSQNIKEVLLFPAMKPQDEPPTKEVGTLLNL

SEQ ID NO: 6657 - protein, 616 aa, Prunus persica
MAGTVDETTKAVSDLTMESEGAMSKNARKKELKNKQKEEEKRRKEEEKAKQAAATASSQVKKIGATEDEEMDPTQYFENRLKYLATQKADNKNPYPHKFFVSMSVLEYVEKYDGLSNGEHRDEISVSLAGRIMSKRSSSSKLFFYDLHGGGPGGGKVQVMADLSKSELDESEFSKFHSSVKRGDIVGVTGFPGKTKRGELSIFPRSFIVLSHCLHMMARQKAGPASDNANVKKIDGWVPGSPRNPETYILKDQETRYRQRYLDLILNTEVRQIFKTRSKIIQYVRRFLDKRDFVEVETPMMNMIAGGAAARPFVTYHNELDMRLFMRVAPELYLKQLVVGGLERVYEIGKQFRNEGIDLTHNPEFTTCEFYMAYADYNDVMTLTEELLSGMVKELTGGYKIKYHSNGLDKDPIEIDFTPPFRRIDMVEELNKIADLNINPADLSSEEANKYLKEACKKFDIKCSPPETTARLLDKLVGHFLEETCVHPAFIINHPEIMSPLAKWHRSKPGLTERFELFINKHELANAYTELNDPVVQRQRFADQLKDRQSGDDEAMALDETFCGALEYGLPPTGGWGLGIDRLSMLLTDSQNIKEVLLFPAMKPQEEPSAKATASS

SEQ ID NO: 6658 - protein, 576 aa, Populus trichocarpa
LKNKKKEKEEEKARQAAAKASTQVQKSAAAADDEDMDPTQYYENRLKYLDAQKGEGKNMYPHKFFVTLSIPEYIDKYGGLSNGEHLEDVSVSLAGRIMSKRSSSSKLFFYDLHGLGAKVQVMADASKSGFDEAEFSKLHSSVKRGDIVGITGFPGKTKRGELSIFPTSFMVLSHCLHMMPRQKAGPGSDASAKKSEVWTPGSVRNPEAYILKDQETRYRQRYLDLMLNSEVRQIFKTRSKIIKYIQNFLDDLDFLEVETPMMNMIPGGAAARPFKTHHNDLNMKLYMRIAPELYLKELVVGGLDRVYEIGKQFRNEGIDLTHNPEFTTCEFYMAYADYNDLMELTEKMLSGMVKELTGGYKIKYHANGLDKDPIEIDFTPPFRRIDMIEELEKMANLNIPKDLSSDEATKYLVAACEKFEVKCPPPQTTTRLLDKLVGHFLEETCVNPSFIINHPEIMSPLAKWHRSKPGLTERFELFVNKHELCNAYTELNDPVVQRQRFEAQLKDRQSGDDEAMALDETFCMALEYGLPPTGGWGLGIDRLAMLLTDSQNIKEVLLFPAMKPQDEPPAKATSGV

SEQ ID NO: 6659 - protein, 625 aa, Citrullus lanatus
MADSIDGAAKAVSDLALGSATAAPDTAHSAPSAEETISKNARKKELKLKQKEEERKRKEELKEKAKQEAPQNKKSVAVDDEEMDPTQYFENRLKYLASQKADGKNPYPHKFQVSMSLPEYIEKYGSLSNGDHLEEVLVSLAGRIMSKRSSSSKLLFYDLHGSGAKIQVMTDARNSELDEAEFARFHASVKRGDIVGVTGFPGKTKRGELSIFPKSFIVLSHCLHMMPRQKAAPGSENANVKKNDTWVPGCTRNPETYILKDQETRYRQRYLDLMLNLEVRQIFKTRAKVIQYVRKFLDDLDFLEVETPMMNMIAGGAAARPFVTFHNDLNMKLFMRIAPELYLKELVVGGLDRVYEIGKQFRNEGIDLTHNPEFTTCEFYMAFADYNDLMELTEKMLSGMVKELTGGYKVKYHSNGLDNDPIEIDFTPPFRRIDMIEELEKMANLNIPKDLSSDEANKYLREACQKFEIKCPPPETTARLLDKLVGHFLEETCVNPAFIINHPEIMSPLAKWHRARPSLTERFELFINKHEVCNAYTELNDPVVQRQRFAEQLKDRQSGDDEAMALDETFCTALEYGLPPTGGWGMGIDRLAMLLTDSQNIKEVLLFPAMKPQDEPPAPKASSGV

SEQ ID NO: 6660 - protein, 197 aa, Panax ginseng
ETSKAVADLSVNNSTLTQSEPEVLSKNARKKELKNKQKEEERQRKEAEKEKKGAAVPSSQVQKPLATDDDDIDPTQYFENRQKALAAHKAAGNNPYPHKFLVSMSVPEYIEKFEGLDSGEHLENVEVSLAGRIMNKRSSSSKLFFYDLHGGGAKVQVMTDARRSDLDEAEFSKLHAGVKRGDIVGIIGIPGKSKRGS

SEQ ID NO: 6661 - protein, 232 aa, Valeriana officinalis
MKHLKLLPIFQLIALLIHLNQKLRAKMLQKKAIKMKQKEEERRRKEEEKEKKEAANPSSQAQKATAAADDEDMDPTQYFENRVKGLTVLKEAGQNPYPHKFHVSISVLQYVDKYGGLESGEHLENEEVYLAGRITNKRSSSSKLFFYDLHGGGAKVQVMADARRSDLDEAEFSRFHSGVKRGDIVGIVGFPGKSKRGELSIFPKSFVVLSHCLHMMPRQKDRWFRECQCQEN

SEQ ID NO: 6662 - protein, 486 aa, Chenopodium quinoa
MASPADDAAKSVANLSMDSNPNPEPELSKNALKKQLKNKQKEEERRRKEEEKAAKQAAMPSSQGQKAQLADDEDMDPTQYFENRVKSLDAQKAAGINPYPHKFFVTLSIPEYIQKYGVLNNGDHLEDVQVSIAGRIMSKRASSSKLFFYDLHGEGVKVQVMADARTSELDEAEFSKFHASVKRGDIVGVTGFPGKTKRGELSIFPKSFVVLSHCLHMMPRQKPGVAAASENANKGEVWVPGSTRNPEMYILKDQETRYRQRYLDLMLNTEVREIFRTRSKIIQYIRRFLDNLGFLEVETPMMNMIPGGAAARPFVTYHNDLNMKLYMRIAPELYLKELVVGGLDRVYEIGKLFRNEGIDLTHNPEFTSCEFYMAFADYNDLMEMTEKLLSGMVKELTGGYVIKFHANGLDKEPIEIDFTPPYRRIDMIEELEKMANLSIPKDLASEETTQYLIDACAKYDVKCPPPQTTTRLLDKLVGLLFGGNLR

SEQ ID NO: 6663 - protein, 615 aa, Chenopodium quinoa
MASPADDAAKSVANLSMDSNPNPEPELSKNALKKQLKNKQKEEERRRKEEEKAAKQAAMPSSQGQKAQLADDEDMDPTQYFENRVKSLDAQKAAGINPYPHKFFVTLSIPEYIQKYGVLNNGDHLEDVQVSIAGRIMSKRASSSKLFFYDLHGEGVKVQVMADARTSELDEAEFSKFHAAVKRGDIVGVTGFPGKTKRGELSIFPKSFVVLSHCLHMMPRQKPGVAAASENANKGEVWVPGSTRNPELYILKDQETRYRQRYLDLMLNTEVREIFRTRSKIIQYIRRFLDNLGFLEVETPMMNMIPGGAAARPFVTYHNDLNMKLYMRIAPELYLKELVVGGLDRVYEIGKLFRNEGIDLTHNPEFTSCEFYMAFADYNDLMEMTEKLLSGMVKELTGGYVIKFHANGLDKEPIEIDFTPPYRRIDMIEELEKMANLSIPKDLASEETTQYLIDACAKYDVKCPPPQTTTRLLDKLVGHFLEETCVNPAFIINHPEIMSPLAKWHRSKPGLTERFELFVNKHELCNAYTELNDPIVQRQRFAEQLKDRQSGDDEAMALDETFCTALEYGLPPTGGWGMGIDRLTMMLTDSQNIKEVLLFPAMKPQDEPTTTPAKA

SEQ ID NO: 6664 - protein, 614 aa, Lactuca sativa
MADVDATISIDNPVSAPPESDVLSKNARKKELKNKQKEEERRRKEEEKEKKAAAMPKSAVQKQSAADDEDMDPTQYFENRLKTLATQKAAGMNPYPHKFHVSMSILEYIEKYESLNSGDHLEDVQVSLAGRLMNKRSSSSKLFFYDLHGTGGKVQVMADARRSDLDEAEFSKYHSGVKRGDIVGIVGFPGKSKRGELSIFPKTFMVLSHCLHMMPRQKSAAVAENANVKKIDAWTPGSGRNPDAYILKDQETRYRQRYLDLMLNSEVRHIFKTRAKIVSYIRRFLDNLDFLEVETPMMNMIAGGAAARPFVTHHNDLNMRLFMRIAPELYLKELVVGGLERVYEIGKQFRNEGIDLTHNPEFTTCEFYMAFADYNDLMEITEQLLSGMVKELTGGYKIKYHANGLDSDPIEIDFTPPFRRIDMIGELEKMANLSIPKDLAGDEANKYLVEACKKFEIKCPPPQTTARLLDKLVGHFLEETCVNPCFIINHPEIMSPLAKWHRSKPGLTERFELFINKHELANAYTELNDPVVQRQRFADQLKDRQSGDDEAMALDETFCTALEYGLPPTGGWGLGVDRLAMLLTDSQNIKEVLLFPAMKPQDEAPVKAAEVVKS

SEQ ID NO: 6665 - protein, 597 aa, Lotus japonicus
MEPPSSEPAASGAGENLSKNALKRELKNKQREEERKRKEEEKAKKAAELQRAQSNKPASADDDDMDPTQYHENRLKYLAAHKAEGNNPYPHKFAVSMSIEQYISKYEGLSDGEHVEDVSVSLAGRIMHKRTSGAKLVFYDLHGGGLKVQVMADASKSDLGEVEFSKFHSNVKRGDIVGITGFPGKSKKGELSIFPKTFVVLSHCLHMMPRAKSAAAAADNANLKKSAWIPGSTRNPETYILKDQETRYRLRHLDLMLNPEVREIFKTRCKIISYIRRFLDDLDFLEVETPMMNMIAGGAAARPFVTHHNDLNMRLYMRIAPELYLKELVVGGLDRVYEIGKQFRNEGIDLTHNPEFTTCEFYMAYMDYNDLMEITEQMLSGMVKELTKGSYKIKYHAEGIDKDPIEIDFTPPFRRIDMIEELEKMAGLSIPKDLSSEETNQYLKNACLKYDIKCPPPETTTRLLDKLVGHFLEETCVNPTFIINHPEIMSPLAKWHRSKPGLTERFELFVNKHELCNAYTELNDPVVQRQRFAEQLKDRQSGDDEAMALDETFCTALEYGLPPTGGWGLGIDRLTMILTDSQNIKEVLLFPAMKPQD

SEQ ID NO: 6666 - protein, 636 aa, Helianthus annuus
MAEPAATVPIDNATSTPEEPETLSKNARKKELKNKQKEEERRRKEEEKEKKAAAMPKSAVQKQSAADDEDMDPTQYFENRLKTLSAQKAAGINPYPHKFEVKMSILDYIEKYDSLGNGDHLEDVEVSLAGRLMNKRSSSSKLFFYDLHGSGGKVQVMADARRSDLDEAEFSKYHSGVKRGDIVGIVGFPGKSKRGELSIFPKTFTVLSHCLHMMPRQKHVAGADNSNVKKIDAWTPGSGRNPDAYILKDQETRYRQRYLDLMVNSEVRHIFKTRSKVVSYIRRFLDSEGFLEVETPMMNMIAGGAAARPFVTHHNDLNMTLYMRIAPELYLKELVVGGLERVYEIGKQFRNEGIDLTHNPEFTTCEFYMAFADYNDLITLTEKMLSGMVKELTGGYKIKYHANGYDNDPIEIDFTPPFRRIDMIEELEKIANLSIPKDLTSEEANKYLADACAKFDIKCPPPRTTTRLLDKLVGHFLEEQCVNPAFIINHPEIMSPLAKWHRSKPGLTERFELFINKHELANAYTELNDPVVQRQRFADQLKDRQSGDDEAMALDETFCTALEYGLPPTGGWGLGIDRLTMLLTDSQNIKEVLLFPAMKPQDEPPVKAVEHLKSELIWLLSSVLSVCQDVPTFCSE

SEQ ID NO: 6667 - protein, 615 aa, Helianthus annuus
MADSSENVVIDNSASPAPAEAETISKNARKKELKNKQKEEERRRKEEEKEKKAAAMPKSGAQKPSAADDEDMDPTQYFENRLKTLDAQKAAGSNPYPHKFHVSMSILEYIEKYETLNSGDHLEDVQVSLAGRLMSKRASSSKLFFYDLHGSGGKVQIMADAKRSELDEAEFSKYHSGVKRGDIVGIVGFPGKSKRGELSIFPKSFTVLSHCLHMMPRQKVAAAADNANAKKIDAWTPGSGRNPDAYVLKDQETRYRQRYLDLMVNSEVRHIFKTRAKVVSYIRRFLDNRDFLEVETPMMNMIAGGAAARPFVTHHNDLNMTLYMRIAPELYLKELVVGGLERVYEIGKQFRNEGIDLTHNPEFTTCEFYMAFADYNDLMDLTEKMLSGMVKELTGGYKIKYHANGLDNDPIEIDFTPPFRRIDMIGELEKIANLNIPKDLAGEEANKYLADACTKFDIKCPPPQTTARLLDKLVGHFLEEQCVNPAFIINHPEIMSPLAKWHRSKPGLTERFELFINKHELANAYTELNDPVVQRQRFADQLKDRQSGDDEAMALDETFCTALEYGLPPTGGWGLGIDRLTMLLTDSQNIKEVLLFPAMKPQDEPPVKAVENLKI

SEQ ID NO: 6668 - protein, 612 aa, Ambrosia trifida
MADSSENVVIDTSAPAEAETLSKNARKKELKNKQKEEERRRKEEEKEKKAAAMPKSGAQKPSAADDEDMDPTQYFENRLKTLDAQKAAGLNPYPHKFHVSMSILEYIEKYETLSSGDHLEDVQVSLAGRLMNKRSSSSKLFFYDLHGTGGKVQVMADARRSDLDEAEFSKYHSGVKRGDIVGIVGFPGKSKRGELSIFPKSFTVLSHCLHMMPRQKNAAAADNPNAKKIDAWTPGSGRNPDAYILKDQETRYRQRYLDLMVNSEVRHIFKTRSKVVSYIRRFLDNLDFLEVETPMMNMIAGGAAARPFVTHHNDLNMTLYMRIAPELYLKELVVGGLERVYEIGKQFRNEGIDLTHNPEFTTCEFYMAFADYNDLMELTEQMLSGMVKELTGGYKIKYHANGLDNDPIEIDFTPPFRRIDMIGELEKIANLNIPKDLAGEEANKYLADACTKFDIKCPPPQTTARLLDKLVGHFLEETCVNPAFIINHPEIMSPLAKWHRSKPGLTERFELFINKHELANAYTELNDPVVQRQRFADQLKDRQSGDDEAMALDETFCTALEYGLPPTGGWGLGIDRLTMLLTDSQNIKEVLLFPAMKPQDELPVKAVENLKI

SEQ ID NO: 6669 - protein, 609 aa, Malus domestica
MAGTPEKTAKAVADLTLESEGAMSKNARKKELKNKQREEERRRKEEEKAAAVASSQVKKDVATEDDEMDPTQYYENRLKYLATQKVDKNPYPHKFSCSITVCECVEKYAGLSDGEHLEDISVSLAGRIMSKRSSSSKLFFYDLHGGGPDGEKVQVMADLRKSELDESEFSKFHSSVKRGDIVGITGFPGKTKRGELSIFPRSFIVLSHCLHMMPRQKPGPASDSANVKKTDRWVPGSPRNPEAYILKDQETRYRQRYLDLILTNEVRQIFKTRFKVIQYIRRFLDNLDFLEVETPMMNMIAGGAAARPFVTYHNELDMKLFMRIAPELYLKQLVVGGLDRVYEIGKQFRNEGIDLTHNPEFTTCEFYMAYADYNDLMTLTEEMLSGMVKELTGGYKIKYHSNGLDKDPIEIDFTPPFRRIDMVEELNKIAGLNINPENLSSAEANQYLKDACKKFDIKCSPPETTTRLLDKLVGHFLEETCVNPAFIINHPEIMSPLAKWHRSKPGLTERFELFVNKHELANAYTELNDPVVQRQRFADQLKDRQSGDDEAMALDETFCRALEYGLPPTGGWGLGVDRLCMWLTDSQNIKEVLLFPAMKPQDEPSAKAI

SEQ ID NO: 6670 - protein, 620 aa, Centaurea maculosa
MADSANNNNNVSIEDSSPASSEPEVVSKNARKKELKNKQKEEERRRKEEEKEKKAASMPKSATQKPAAADDEDMDPTQYFDNRLKALAADKAAGINPYPHKFHVSMSILEYIEKYESLNSGDHLEDVQVSLAGRLMNKRSSSSKLFFYDLHGSGGKVQVMADARRSDLDEAEFSKYHSGVKRGDIVGIVGFPGKSKRGELSIFPKTFTVLSHCLHMMPRQKSGAVAADNANTKKVDVWTPGSVRNPDAYILKDQETRYRQRYLDLMVNSEVRHIFKTRAKVVSYIRRFLDNLDFLEVETPMMNMIAGGAAARPFVTHHNDLNMRLFMRIAPELYLKELVVGGLERVYEIGKQFRNEGIDLTHNPEFTTCEFYMAFADYNDLMEITEKMLSGMVKELTGGYKIKYHANGLEKEPIEIDFTPPFRRIDMIGELEKIANLNIPKDLAGDEANKYLAEACAKFDIKCPPPQTTARLLDKLVGHFLEETCVNPAFIINHPEIMSPLAKWHRSKPGLTERFELFINKHELANAYTELNDPVVQRQRFADQLKDRQSGDDEAMALDETFCTALEYGLPPTGGWGLGIDRLAMLLTDSQNIKEVLLFPAMKPQDEVPPPVKAAEVVKS

SEQ ID NO: 6671 - protein, 619 aa, Centaurea maculosa
MADSANNNNNVSIEDSSPASSEPEVVSKNARKKELKNKQKEEERRRKEEEKEKKAASMPKAAAQKPAAADDEDMDPTQYFDNRLKALAADKAAGINPYPHKFHVSMSILEYIEKYESLNSGDHLEDVEVSLAGRLMNKRSSSSKLFFYDLHGSGGKVQVMADARRSDLDEAEFSKYHSGVKRGDIVGIVGFPGKSKRGELSIFPKTFTVLSHCLHMMPRQKSGAVAADNANTKKVDVWTPGSVRNPNAYILKDQETRYRQRYLDLMVNSEVRHIFKTRAKVVSYIRHFLDNLDFLEVETPMMNMIAGGAAARPFVTHHNDLNMRLFMRIAPELYLKELVVGGLERVYEIGKQFRNEGIDLTHNPEFTTCEFYMAFADYNDLMEITEKMLSGMVKELTGGYKIKYHANGLDKDPIEIDFTPPFRRIDMIGELEKIANLNIPKDLAGDEANKYLAEACAKFDIKCPPPQTTARLLDKLVGHFLEETCVNPAFIINHPEIMSPLAKWHRSKPGLTERFELFINKHELANAYTELNDPVVQRQRFADQLKDRQSGDDEAMALDETFCTALEYGLPPTGGWGLGIDRLTMLLTDSQNIKEVLLFPAMKPQDDVPPVKAAEIVKS

SEQ ID NO: 6672 - protein, 612 aa, Ambrosia trifida
MADSSENVVIDTSAPAEAETLSKNARKKELKNKQKEEERRRKEEEKEKKAAAMPKSGAQKPSAADDEDMDPTQYFENRLKTLDAQKAAGLNPYPHKFHVSMSILEYIEKYETLDSGDHLEDVQVSLAGRLMNKRSSSSKLFFYDLHGSGGKVQVMADARRSDLDEAEFSKYHSGVKRGDIVGIVGFPGKSKRGELSIFPKSFTVLSHCLHMMPRQKNAAAADNPNAKKIDAWTPGSGRNPDAYILKDQETRYRQRYLDLMVNSEVRHIFKTRSKVVSYIRRFLDNLDFLEVETPMMNMIAGGAAARPFVTHHNDLNMTLYMRIAPELYLKELVVGGLERVYEIGKQFRNEGIDLTHNPEFTTCEFYMAFADYNDLMELTEQMLSGMVKELTGGYKIKYHANGLDNDPIEIDFTPPFRRIDMIGELEKIANLNIPKDLAGEEANKYLADACTKFDIKCPPPQTTTRLLDKLVGHFLEETCVNPAFIINHPEIMSPLAKWHRSKPGLTERFELFINKHELANAYTELNDPVVQRQRFADQLKDRQSGDDEAMALDETFCTALEYGLPPTGGWGLGIDRLTMLLTDSQNIKEVLLFPAMKPQDELPVKAVENLKI

SEQ ID NO: 6673 - protein, 614 aa, Echinacea purpurea
MADTTDNVTVDNSTAAPPEAEALSKNARKKELKNKQREEERRRKEEEKEKKAAAMPKSAVQKQSAADDEDMDPTQYFENRLKTLDAQKAAGMNPYPHKFHVSMSILEYIEKYASLKSEDRLEDVQVSLAGRLMNKRSSSSKLFFYDLHGSGGKVQVMADARRSDLDEAEFSKYHSGVKRGDIVGIVGFPGKSKRGELSIFPKSFTVLSHCLHMMPRQKSAAAADNPDAKKIDAWTPGSGRNPDAYILKDQETRYRQRYLDLMVNSEVRHIFKTRAKVVSYIRRFLDNLEFLEVETPMMNMIAGGAAARPFVTHHNDLNMTLYMRIAPELYLKELVVGGLERVYEIGKQFRNEGIDLTHNPEFTTCEFYMAFADYNDLMELTEQMLSGMVKELTGGYKIKYHANGLENDPIEIDFTPPFRRIDMIGELEKIANLNIPKDLAGEEANKYLADACTKFDIKCPPPQTTARLLDKLVGHFLEETCVNPAFIINHPEIMSPLAKWHRSKPGLTERFELFINKHELANAYTELNDPVVQRQRFADQLKDRQSGDDEAMALDETFCTALEYGLPPTGGWGLGIDRLTMLLTDSQNIKEVLLFPAMKPQDELPVKAVENLKI

SEQ ID NO: 6674 - protein, 615 aa, Helianthus annuus
MADSSENVIIDNSASPAPAEAETISKNARKKELKNKQKEEERRRKEEEKEKKAAAMPKSGAQKPSAADDEDMDPTQYFENRLKTLDAQKAAGLNPYPHKFHVSMSILEYIEKYETLNSGDHLEDVQVSLAGRLMSKRASSSKLFFYDLHGSGGKVQIMADAKRSELDEAEFSKYHSGVKRGDIVGIVGFPGKSKRGELSIFPKSFTVLSHCLHMMPRQKVAAAADNANAKKIDAWTPGSGRNPDAYVLKDQETRYRQRYLDLMVNSEVRHIFKTRAKVVSYIRRFLDNRDFLEVETPMMNMIAGGAAARPFVTHHNDLNMTLYMRIAPELYLKELVVGGLERVYEIGKQFRNEGIDLTHNPEFTTCEFYMAFADYNDLMDLTEKMLSGMVKELTGGYKIKYHANGLDNDPIEIDFTPPFRRIDMIGEGEKIANLNIPKDLAGEEANKYLADACTKFDIKCPPPQTTARLLDKLVGHFLEEQCVNPAFIINHPEIMSPLAKWHRSKPGLTERFELFINKHELANAYTELNDPVVQRQRFADQLKDRQSGDDEAMALDETFCTALEYGLPPTGGWGLGIDRLTMLLTDSQNIKEVLLFPAMKPQDEPPVKAVENLKI

SEQ ID NO: 6675 - protein, 614 aa, Helianthus annuus
MAEPAATVPIDNANSTPEEPETLSKNARKKELKNKQKEEERRRKEEEKDKKAAAMPKSAVQKQSAADDEDMDPTQYFENRLKTLSAQKAAGINPYPHKFEVKMSILDYIEKYDSLSDGDHLEDVEVSLAGRLMNKRSSSSKLFFYDLHGSGGKVQVMADARRSDLDEAEFSKYHSGVKRGDIVGIVGFPGKSKRGELSIFPKTFTVLSHCLHMMPRQKHVTGADNSNVKKIDAWTPGSGRNPDAYILKDQETRYRQRYLDLMVNSEVRHIFKTRSKVVSYIRRFLDSENFLEVETPMMNMIAGGAAARPFVTHHNDLNMTLYMRIAPELYLKELVVGGLERVYEIGKQFRNEGIDLTHNPEFTTCEFYMAFADYNDLMKLTEKMLSGMVKELTGGYKIKYHANGYDNDPIEIDFTPPFRRIDMIEELEKIANLSIPKDLTSEEANKYLADACAKFDIKCPPPQTTTRLLDKLVGHFLEEQCVNPAFIINHPEIMSPLAKWHRSKPGLTERFELFINKHELANAYTELNDPVVQRQRFADQLKDRQSGDDEAMALDETFCTALEYGLPPTGGWGLGIDRLTMLLTDSQNIKEVLLFPAMKPQDEPPVKAVENLKI

SEQ ID NO: 6676 - protein, 621 aa, Petroselinum crispum
MDGTIEEASKAVAGLSVGNSTAQPEAGAALSKNALKKELKNKQKEEERRRKEEEKAKKAAAVPSSNAQKSLAADDDDMDPTQYFDNRIKALAALKTAGINPYPHKFHVSMSVIEYVEKYSGLNCGEHLENVEVSLAGRIMNKRSSSSKLLFYDLHGEGAKVQLMTDARISDLSEAEFAKFHGGVKRGDIVGVVGFPGKSKRGELSMFPKSFIVLSHCLHMMPRQKPATSSDIESVKKIDAWIPGSGRNPETYVLKDQETRYRQRYLDLMLNSEVRHIFKTRAKVISYVRRFLDDLDFLEVETPMMNMIAGGAAARPFVTHHNELNMRLFMRIAPELYLKELVVGGLNRVYEIGKQFRNEGIDLTHNPEFTTCEFYMAFADYNDLMEMTEKMLSGMVKELTGGYKVRYHANGLENEAIEIDFTPPFRRIDMIEDLEKMAGLNIPKDLASDEANKYLAEACTKFEIKCAPPLTTARLLDKLVGHFLEETCVNPAFIINQPEIMSPLAKWHRSKPGLTERFELFINKHELCNAYTELNDPVVQRQRFADQLKDRQSGDDEAMALDETFCTALEYGLPPTGGWGMGIDRLAMLLTDSQNIKEVLLFPAMKPQDEAPVKAVQSTTS

SEQ ID NO: 6677 - protein, 610 aa, Flaveria ramosissima
VVNIPINDSTTATDEGETISKNARKKELKNKQKEEERRRKEEEKEKKAASMPKSAVQKQSTADDEDMDPTQYFENRLKVLAAQKAAGMNPYPHKFHVSMSILEYIEKYESLNSGDHLEDVEVSLAGRLMNKRSSSSKLFFYDLHGSGGKVQVMADARRSDLDEVEFSKYHSGVKRGDIVGIVGFPGKSKRGELSIFPKSFTVLSHCLHMMPRQKSAAAADNTNVKKIDAWTPGSGRNPDAYILKDQETRYRQRYLDLMVNSEVRHIFKTRSKVVSYIRRFLDNLDFLEVETPMMNMIAGGAAARPFVTHHNDLNMTLYMRIAPELYLKELVVGGLERVYEIGKQFRNEGIDLTHNPEFTTCEFYMAFADYNDLMELTEQMLSGMVKELTGGYKIKYHANGLDNDPIEIDFTPPFRRIDMIEELEKIANLSIPKDLAGNEANKYLADACTKFDIKCPPPQTTARLLDKLVGHFLEETCVNPAFIINHPEIMSPLAKWHRSKPGLTERFELFINKHELANAYTELNDPVVQRQRFADQLKDRQSGDDEAMALDETFCTALEYGLPPTGGWGLGIDRLTMLLTDSQNIKEVLLFPAMKPQDEPPVKAVENLKI

SEQ ID NO: 6678 - protein, 615 aa, Chenopodium quinoa
MASPADDAAKSVANLSMDSNPNPEPELSKNALKKQMKNKQKEEERRRKEEEKAAKQAAMPSSQGQKAQLADDEDMDPTQYFENRVKSLDAQKAAGINPYPHKFFVTLSIPEYIQKYGVLNNGDHLEDVQVSIAGRIMSKRASSSKLFFYDLHGEGVKVQVMADARTSELDEAEFSKFHASVKRGDIVGVTGFPGKTKRGELSIFPKSFVVLSHCLHMMPRQKPGVAAASENANKGEVWVPGSTRNPELYILKDQETRYRQRYLDLMLNTEVREIFRTRSKIIQYIRRFLDNLGFLEVETPMMNMIPGGAAARPFVTYHNDLNMKLYMRIAPELYLKELVVGGLDRVYEIGKLFRNEGIDLTHNPEFTSCEFYMAFADYNDLMEMTEKLLSGMVKELTGGYVIKFHANGLDKEPIEIDFTPPYRRIDMIEELEKMANLSIPQDLASEETTQYLINACAKYDVKCPPPQTTTRLLDKLVGHFLEETCVNPAFIINHPEIMSPLAKWHRSKPGLTERFELFVNKHELCNAYTELNDPIVQRQRFAEQLKDRQSGDDEAMALDETFCTALEYGLPPTGGWGMGIDRLTMMLTDSQNIKEVLLFPAMKPQDEPTTTPAKA

SEQ ID NO: 6679 - protein, 616 aa, Elaeis guineensis
MADGVEAAAESVAGLSMDSCKAEAPSKNALKKELKKKQKEEEKRLKEEEKKKKAAAMTSLQSQKPSSAEDEDMDPTQYYESRLKALASLKAVGVNPYPHKFLVSMSVVDYVEKYGRLRDGEHLKDVEVSLAGRIMNKRASSSKLYFYDLYGDGVKVQVMADARDSDMDEVEFARYHAGVKRGDIVGICGYPGKSKRGELSIFPKKFIVLSPCLHMMPRQKAAPGADNAAAKKNEGKTPSDVWVPGMTRNPETYVLKDQETRYRQRYLDLMLNHEVRQIFKTRAKIISYIRHFLDNLGFLEVETPMMNMIAGGAAAKPFVTHHNELNMKLYMRIAPELYLKELVVGGLDRVYEIGKQFRNEGIDLTHNPEFTTCEFYMAFADYNDLMALTEQMLSGMVKELTGGYKIKYHANGVDKDPIEIDFTPPFRRLDMIEGLEAMANLSIPKDLSSEAANKYLLDACEKFDVKCPPPQTTARLLDKLVGHFLEETCVNPTFIINHPEIMSPLAKWHRSRPGLTERFELFVNRHEVCNAYTELNDPVVQRERFAGQLKDRQSGDDEAMALDETFCTALEYGLPPTGGWGLGIDRLAMLFTDSQNIKEVLLFPAMKPQDEPSTKA

SEQ ID NO: 6680 - protein, 615 aa, Elaeis guineensis
MADGVEAAVESVGGLSMDSSSAGAPSKNALKKELKKKQKEEEKRLKEEEKKKKAAAMANSQSQKPAAAEDEDMDPTQYYENRLKVLASLKAGGVNPYPHKFHVSMSVVEYVEKYGSLSDGEHLKDVEVNLAGRIMNKRTSSSKLYFYDLYGGGVKVQVMADARDSDMDEVEFARYHAGVKRGDIVGICGYPGKSKRGELSVFPKKFVVLSPCLHMMPRQKSALGADNAGAKKNEGKTTNLWVPGMPRNLETYVLKDQETRYRQRYLDLMLNHEVRQIFKTRAKIISYIRSFLDNLGFLEVETPMMNMIAGGAAARPFVTHHNELNMTLYMRIAPELYLKELVVGGLDRVYEIGKQFRNEGIDLTHNPEFTTCEFYMAYADYNDLMTLTEQMLSGMVKELRGSCKIKYHANGVDQDPIEIDFTPPFRRIDMIEGLEAMANLNIPKDLSSEAANKYLLDACEKFDVKCPPPQTTARLLDKLVGHFLEETCVNPTFIINHPEIMSPLAKWHRSRAGLTERFELFANKREVCNAYTELNDPVVQRERFAEQLKDRQSGDDEAMALDETFCTALEYGLPPTGGWGLGIDRLAMLFTDSQNIKEVLLFPAMKPQDEPSNKA

SEQ ID NO: 6681 - protein, 554 aa, Gossypium raimondii
MASQVSQMPSSSPLSSNKDEMRPKADFQPSIWGDLFLNCPDKNIDAETEKRHQQLKEEVRKMIVAPMANSTQKLAFIDSVQRLGVSYHFTKEIEDELENIYHNNNDAENDLYTTSLRFRLLREHGYNVSCDVFNKFKDEQGNFKSSVTSDVRGLLELYQASYLRVHGEDILDEAISFTTNHLSLAVASLDHPLSEEVSHALKQSIRRGLPRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMVQLVAEHGRQYRVEYAKNAMIRLAQSYLVEAKWTLQNYKPSFEEFKANALPTCGYEMLAITSFVGMGDIVTPETFKWATNNPKIIQASTIICRFMDDVAEHKFKHRREDDCSAIECYMEEYGVTAQEAYDVFNKHVESAWKDVNQEFLKPTEMPTEVLNRSLNLARVMDVLYREGDGYTYVGKAAKGGITSLLIEPIAV

SEQ ID NO: 6682 - protein, 554 aa, Gossypium raimondii
MASQVSQMPSSSPLSSNKDEMRPKADFQPSIWGDLFLNCPDKNIDAETEKRHQQLKEEVRKMIVAPMANSTQKLAFIDSVQRLGVSYHFTKEIEDELENIYHNNNDAENDLYTTSLRFRLLREHGFNVSCDVFNKFKDEQGNFKSSVTSDVRGLLELYQASYLRVHGEDILDEAISFTSNHLSLAVASLDHPLSEEVSHALKQSIRRGLPRVEARHYLSVYQDIESHNKVLLEFAKIDFNMVQLLHRKELSEISRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVTAQEAYDVFNKHVESAWKDVNQEFLKPTEMPTEVLNRSLNLARVMDVLYREGDGYTYVGKAAKGGITSLLIEPIAL

SEQ ID NO: 6683 - protein, 554 aa, Gossypium hirsutum
MASQVSQMPSSSPLSSNKDEMRPKADFQPSIWGDLFLNCPDKNIDAETEKRHQQLKEEVRKMIVAPMANSTQKLAFIDSVQRLGVSYHFTKEIEDELENIYHNNNDAENDLYTTSIRFRLLREHGYNVSCDVFNKFKDEQGNFKSSVTSDVRGLLELYQASYLRVHGEDILDEAISFTTHHLSLAVASLDHPLSEEVSHALKQSIRRGLPRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDEIPEYMKPSYKALLDVYEEMVQLVAEHGRQYRVEYAKNAMIRLAQSYLVEAKWTLQNYKPSFEEFKANALPTCGYAMLAITSFVGMGDIVTPETFKWAASDPKIIQASTIICRFMDDVAEHKFKHRREDDCSAIECYMEEYGVTAQEAYDVFNKHVESAWKDLNQEFLKPTEMPTEVLNRSLNLARVMDVLYREGDGYTYVGKAAKGGITSLLIEPIAL

SEQ ID NO: 6684 - protein, 554 aa, Gossypium raimondii
MASQVSQLPSSSPLTSNKDEMRPKADFQPSIWGDLFLTCPKKDINAETEQRHQQLKEEVRKMVVAPMNNSTQKLNFIDSVQRLGVSYHFTKEIEDELENIYHNNNDAENDIYTTSLRFRLLREHGFNVSCDVFTKFKDEQGNFKSSMTSDVPGLLELYEASYLRVHGEDILDEAISFTTNHLRLVVASLDYPLSEQVSHALKQSIRRGLPRVEARHYLSVYHDIESHNKALLEFAKIDFNMLQLLHRKELSEICRWWKDLDFQKKLPYARDRVVEGYFWISGVYFEPQYSLGRKMLTKVIAMASIVDDTYDSYATYDELIPYTNAIERWDIKCIDQLPEYMKLNYKALLDVYEEMEQLVAEHGRQYCVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVTAQEAYDVFNKHVESAWKDVNQEFMKPTEMPTEVLNRSLNLARVMDVLYREGDGYTYVGKAAKGGITSLLIEPIAL

SEQ ID NO: 6685 - protein, 554 aa, Gossypium hirsutum
MAKQVSQLLSSSPLTSNKDEMRLKADFQPSIWGDLFLTCLDNDIDAETEQRHQQLEGGVRKMIVAPMANSTQKLTFIDSVQRLGVSYRFTKEIEDELENIYHNNNDAENDLYTTSLRFRLLREHGFNVSCEVFNKFKDEQGDFKSSLTSDVRGLLELYEASYLRVHGEDILDEAISFTTDHLTLAVATLEYPLSEHVSHALKKSIRRGLPRIEARHYLSVYQDIESHNTALLEFAKIDFNMLQLLHRKELSEICRWWKDLDFKRKLPYVRDRVVECFFWILGVYFEPQYSLGRKILTKVIAMTSVIDDTYDSYATYDELIPYTNAIERWDIKCIDQLPEYMKLSYKALLDVYEEMEQLMAEDGRQYRVEYAKNIMIQLAQAFLMEAKWTLQNHKPSFEEFKATALQTTGYAMLAITALVDMGDIVTPETFTWAANNPKIIQASTIICRFMDDVAEHKFKQRREDDFSGIECYMEEYGVMVQEAYNVFYKHIESAWKDVNKGFLKPIEMPIEVLNRILNLARVMNVLYNEGDGYTYVGKATKGIISILLIEPVTL

SEQ ID NO: 6686 - protein, 77 aa, Gossypium hirsutum
MASQVSQLPSSSPLTSNKDEMRPKADFQPSIWGDLFLTCPKKDINAETEQRHQQLKEEVRKMVVAPMNNSTQKLKLH

SEQ ID NO: 6687 - protein, 550 aa, Gossypium hirsutum
MASQVSQKLSSSPFSSNKDEMRPKSNIPPPSIWGDVFLNCPDKNIDAETEKHHQQLKEEVRKMIVAPMANSTQKLPFIDSVQRLGVSYHFTKEIEDELENIYHNDNDAENDLYTTSLRFRILREHGFNVSCNAFNKFNDEQGNFKSSVTNDVRGLLELYEASYMRVHGEDILDEAISFTTNHLSLVVASLDYPLSEQVSHALKQSIRRGLPRVEARHYLSVYQDIESHNKALLEFAKIDFNMLQLLHRKELSEICRWWKDLDFQRKLPYTRDRVVECYFWILGVYFEPHYSLGRKMMTKVIIMTSILDDTYDSYATYDELILYTSAIERWEIKCIDQLPEYMKLSYKALLDVYEEMKQLVAEHGRQYRVEYAKNAIIRLAQSYFVEAKWTLQNYKPSFEEFKINALSSCGYAMLAIASFVGMGDIVTPETFKWATSEPKIIQASTIICRFMDDIAEHKFKHRREDDWSVIDYYMKEYNVTAQEAYDVFNKYIESAWKDMNQELLKPTEMPTEVMNRSLNLSRVMDVVYKEGDGYTYVRKSDERCNHFIVD

SEQ ID NO: 6688 - protein, 529 aa, Gossypium raimondii
MAKQVSQLLSSSPLTSNKDEMRPKADFQPSIGEISSLLDIDAETKQRHQQLEGGVRKMIVAPMANSTLKLTFIDSVQRLGNIYHNNNNAENDLYTTSLRFRLLREHGFNVSCEVFNKFKDEKGDFKSSLTSDVQGLLELYEASYLRVHGEDILDESISFTTDHLTLAVATLDYPLSEHVSHALKQSIRRGLPRIEARHYLSVYQDIESHNRALLEFAKIDFNMLQLLHRKELSEICRWWKDLDFQRKLPYARDRVVEDYFWILGVYFEPQYSLGRKILTKVAAMTSIMDDTYDSYATYDELVPYTNAIERWDIKCIDQLPEYMKLSYKALLDVYKEMEQLMAKDGRQYRVEYAKNAMIPLAQSYLVEARWTLQNYKPSFEEFKANALATCGYAMLSITSFVGMGDIITPETFKWAANDPKIIQASTIICSEEFKQRREDDYSGIECYMEEYGVIAQEAYDVFNKHVESAWKDVNKGFLKPTEMPTEVLNRVLNLARVINVLYKEGDGYTYVGKAAKGGISSLLMELITL

SEQ ID NO: 6689 - protein, 556 aa, Gossypium raimondii
MASQVSQILASPHTSIPCNMENRPKADFHPGIWGDIFLNCPNEDIDTATQLRYEELKEEVRRMLVAPMGDSSNQKLSLIDAVQRLGVYYHFEEEIEDALEAIYHDNNDVDNDLYTTSLRFRLLREHGFNVSCEVFDKFKDEEGNFMSSITTDVQGLLELYEASYMRVHGEDILDEAISFTTTHLTLAAPTLEYPLSEQVAHALKQSIRRGLPRVEARRYISIYQDIESHNKALLEFAKIDFNLLQLLHRKELSEICRWWKDLDFTKKLPFARDRVVEGYFWIMGVYFEPQYSLGRKMMTKVIAMASIVDDTYDSYATYDELIPYTNAIERWDIKCMDELPEFMKISYKALLDVYEEMEQLTAEQGRQYRVEYARKAMIRLAQAYLLEAKWTHQNYKPTFEEFRDNALPTSGYGMLAITAFVGMGDAITPETFAWATNDPKIIKASTIICRFMDDIAEHKFKHRREDDCSAIECYMEQYGVTAQEAYDEFNKHIESSWKDINEEFLKPTEMPVPVLNRSLNLARVMDVLYREGDGYTHVGKAAKGGITSLLIDPIPL

SEQ ID NO: 6690 - protein, 556 aa, Gossypium raimondii
MASQVSQILASPHTSIPCNMENRPKADFHPGIWGDIFLNCPNEDIDTATQLRYEELKEEVRRMLVAPMGDSSNQKLPLIDAVQRLGVYYHFEEEIEDALEATYHDNNDVDNDLYTTSLRFRLLREHGFTVSCEVFDKFKDEEGNFMSSITTDVKGLLELYEASYMRVHGEDILDEAISFTTTHLTLAAPTLEYPLSEQVAHALKQSIRRGLPRVEARRYISIYQDIESHNKALLEFAKIDFNLLQLLHRKELSEICRWWKDLDFTKKLPFARDRVVEGYFWIMGVYFEPQYSLGRKMMTKVIAMASIVDDTYDSYATYDELIPYTNAIERWDIKCMDELPEFMKISYKALLDVYEEMEQLTAEQGRQYRVEYARKAMIRLAQAYLLEAKWTHQNYKPTFEEFRDNALPTSGYGMLAITAFVGMGDVITPETFAWATNDPKIIKASTIICRFMDDIAEHKFKHRREDDCSAIECYMEQYGVTAQEAYDEFNKHIESSWKDVNEEFLKPTEMPVPVLNRSLNLARVMDVLYREGDGYTHVGKAAKGGITSLLIDPIPL

SEQ ID NO: 6691 - protein, 352 aa, Theobroma cacao
MMQAPYDATVRLMLASLERNLLPDAVIRRLTRLLLASRLRSGYRPSIELQLSDLLQFAHSLKEMPIAIKTDKPKTQHYELPTSFFKLVLGKNFKYSCCYFSDGSRTLEDAEEAMLELYCERSQLKDGHTVLDVGCGWGSLSLHIARKYPNCRVTGICNSTTQKAFIEEQCRDHQLQNVEIIVADISSFEMEASYDRIYSIEMFEHMKNYQDLLKTLSKWMKQDSLLFVHYFCHKAFAYHFEDINEDDWITRYFFTGGTMPSANLLLYFQDDVSVVNHWLVNGKHYAQTSEEWLKRMDHNLASIKPIMESTYGKDQAVKWTVYWRTFFIAVAELFGYNNGEEWMVALFLFKKK

SEQ ID NO: 6692 - protein, 404 aa, Quercus alba
MNKITQVPYEATVRLMLGSLERNLLPDAVIRKLTRLLLATRLRSGYKPSAQLQLSHLLQFVLSLREMPIAIKTDDPKTQHYELPTSFFKLVLGNNLKYSCCYFSDNSKTLENAEETMLELYCERSQLKDGHTVLDVGCGWGSLSLYIARKYSNCRVTGICNSTTQKAHIEEQCRDLQLQNVEIIVADISVFEMEASYDRIFSIEMFEHMKNYEDLLKKISKWLKEDSFLFIHHFCHKAFAYHFEDINEDDWITRYFFSGGTMPSANLLLYFQDDVSVVNHWLVNGKHYAQTSEEWLKRMDKNLSSIKPIMESTYGKDSAVKWTVYWRTFFIAVAELFGYNDGEEWMVAHFLFKKNKSRSQSFFLIDFQFFVRLSNLSMVSRNQSTIICNKCHLFCSGNNSLLSF

SEQ ID NO: 6693 - protein, 113 aa, Quercus alba
MNKITQVPYEATVRLMLGSLERNLLPDAVIRKLTRLLLATRLRSGYKPSAQLQLSHLLQFVLSLREMPIAIKTDDPKTQHYELPTSFFKLVLGNNLKYSCCYFSDNSKNPREC

SEQ ID NO: 6694 - protein, 355 aa, Populus trichocarpa
MERLMQVPYEATVKVMLASLERNLLPDAVIRRLTRMLLADRLRSCYKTSSELQLADLLQFVHSLKEMPIAIKTDKPKTQHYELPTSFFKLVLGKNLKYSCCYFSDKSNTLEDAEKAMLELYCERSQLKDGHTVLDVGCGWGSLSLYIAQKYSNCKITGICNSTTQKVHIDEQCRDLQLQNVEIIVADISTFEMQASYDRIYSIEMFEHMKNYGDLLNKISKWMKQDGLHFVHYFCHKQFAYHFEDVNEDDWITRYFFTGGTMPSANLLLYFQDDVSIVDHWLVNGKHYSQTSEEWLKRMDRNLAAIKPIMESTYGKDQAVKWTVYWRTFFIAVAELFGYNNGEEWMVAHFLFNKK

SEQ ID NO: 6695 - protein, 387 aa, Quercus alba
MNKITQVPYEATVRLMLGSLERNLLPDAVIRKLTRLLLATRLRSGYKPSAQLQLSHLLQFVLSLREMPIAIKTDDPKTQHYELPTSFFKLVLGNNLKYSCCYFSDNSKTLENAEETMLELYCERSQLKDGHTVLDVGCGWGSLSLYIARKYSNCRVTGICNSTTQKAHIEEQCRDLQLQNVEIIVADISVFEMEASYDRIFSIEMFEHMKNYEDLLRKISKWLKEDSFLFIHHFCHKAFAYHFEDINEDDWITRYFFSGGTMPSANLLLYFQDDVSVVNHWLVNGKHYAQTSEEWLKRMDKNLSSIKPIMESTYGKDSAVKWTVYWRTFFIAVAELFGYNDGEEWMVAHFLFKKNKSRSQSFFLIDFQFFVRLSILRWYQGINLLSF

SEQ ID NO: 6696 - protein, 355 aa, Manihot esculenta
MKDLIQLPYDASVRVILASLERNLLPDAVVRRFTRLLLASRLRSGYKPSSELQLADLLHFVHSLKQMPIAIMTEKPKAQHYELPTSFFKLVLGKNFKYSCCYFSDKSNTLEDAEEAMLELYCERSQLKDGHTVLDIGCGWGSLSIYIARKYRNCRITGICNSTTQKAFIEEQCRENQLQNVEIIVADISTLEMEASYDRIFSIEMFEHMKNYKDLLHKISKWMKEDSLLFVHYFCHKTFAYHFEDINEDDWITRYFFSGGTMPAANLLLYFQDDVSVVNHWLVNGKHYAQTSEEWLKRMDKNLGLIKPIMESTYGKEQSLKWTVYWRTFFIAVAELFGYNNGEEWMVALFLFKKK

SEQ ID NO: 6697 - protein, 356 aa, Euonymus alatus
MEGLVQVPYDATVKLMLASLERNLLPDAVVRRLTRLLLASRLRSGYKPSSEQQLSDLVHFAHSLKEMPIAIKTEKPKTQHYELPTSFFKLVLGKHLKYSCCYFTDDKSSTLEDAEKAMFELYCKRSQLKDGQTVLDVGCGWGSLSLYIAQKYRNCKVTGICNSTTQKAHIEEQCRNLQLQNVEIIVADISTFEMDASYDRIFSIEMFEHMKNYKELLKKISKWMKEDSLLFIHYFCHKAFAYHFEDINEDDWITRHFFTGGTMPSSNLLLYFQDDVSVVDHWLLNGKHYAQTSEEWLKRMDQNSASIKPIMESTYGNDQAVKWTVYWRTFFIAVAELFNYNDGEEWMVALFLFRRK

SEQ ID NO: 6698 - protein, 355 aa, Tripterygium wilfordii
MEGLVQVPYDATVKLMLASLERNLLPDAVVRRLTRLLLASRLRSGYKSSSELQLSDVVHFAHSLKEMPIAIKTDEPKTQHYELPTSFFKLVLGKHLKYSCCYFPDKSRTLEDAEKAMFELYCERSKLKDGQTVLDVGCGWGSLSLYIAQKYRNCKVTGICNSTTQKAHIEEQCRNLQLQNVEIIVADISTFEMDASYDRIFSIEMFEHMKNYKDLLKKISKWMNEDSLLFIHYFCHKAFAYHFEDINDDDWITRHFFTGGTMPSSNLLLYFQDDVSVVDHWLVNGKHYAQTSEEWLKRMDQNLASIKPIMESTYGNDQAVKWIVYWRTFFIAVAELFNYNDGEEWMVALFLFRRK

SEQ ID NO: 6699 - protein, 355 aa, Eucalyptus grandis
MEKMMQVPYEATVKVMMASLERNLLPDAVIRRLTRLLLAGRLRSCYRPSSDLQLSDLLHFAHSLKEMPIAITTEKPKEQHYELPTSFFKLVLGKHLKYSCCYFSDKSMTLEDAEKAMLELYCEKSQLKDGHTVLDVGCGWGSLTLYIAQKYSNCKITGICNSTTQKAHIEEQCRNLQLQNVEIIVADISTYEMEASYDRIFSIEMFEHMKNYKDLLQKISKWMEEDGLLFVHHFCHKAFAYHFEDINEDDWITRYFFTGGTMPSANLLLYFQDDVSVVNHWLVNGKHYAQTSEEWLKRMDQNLASIKPIMEGTYGKEQAVKWTVYWRTFFIAVAELFGYNDGEEWMVALFLFKKK

SEQ ID NO: 6700 - protein, 357 aa, Citrus sinensis
MEGIMHAAYDATVRLMLSSLERNLLPDAVIRRLSRLLLGGRLRSGYKPSAELQLSDLLQFAHSLREMPIAIQTDKAKEQHYELPTSFFKLVLGKYFKYSCCYFSDASKTLEDAEKAMLELYCERSRLEDGHTVLDVGCGWGSLSLYIAQKYSNCKITGICNSKTQKEFIEEQCRVLELQNVEIIVADISTFEMEASYDRIYSIEMFEHMKNYQNLLKKISKWMKEDTLLFVHHFCHKTFAYHFEDTNDDDWITKYFFTGGTMPSANLLLYFQDDVSVVDHWLVNGKHYAQTSEEWLKRMDNNLASIKPIMESTYGKDQAVKWTVYWRTFFIAVAELFGYNNGEEWMVTHFLFRKKME

SEQ ID NO: 6701 - protein, 355 aa, Malus domestica
MNRVMQAPYDATVRFALASLERNLLPDAVVRRLTRLLLASRLRSGYRPSSELQLSDLLQFVQSLKEMPIAIKTDDPKAQHYEVPTSFFKMVLGKNLKYSCCYFNDESSTLEDAEKAMLELYCERSQIRDGHTVLDVGCGWGSLSLYIAQKYNNCKVTGICNSTTQKAFIEEQCRNLQLQNVEIIVGDISTFEMEASFDRIFSIEMFEHMKNYKDLLKKISGWMKDDGLLFVHHFCHKAFAYHFEDKSEDDWITRYFFSGGTMPSANLLLYFQDDVSIVNHWLVNGKHYAQTSEEWLKRMDRNTASIKPIMESTYGKDSAVKWTVYWRTFFISVAELFGYNNGEEWMVVHFLFKKK

SEQ ID NO: 6702 - protein, 357 aa, Citrus clementina
MEGIMHAAYDATVRLMLSSLERNLLPDAVIRRLSRLLLGGRLRSGYKPSAELQLSDLLQFAHSLREMPIAIQTDKAKEQHYELPTSFFKLVLGKYFKYSCCYFSDASKTLEDAEKAMLELYCERSRLEDGHTVLDVGCGWGSLSLYIAQTYSNCKITGICNSKTQKEFIEEQCRVLELQNVEIIVADISTFEMEASYDRIYSIEMFEHMKNYQNLLKKISKWMKEDTLLFVHHFCHKTFAYHFEDTNDDDWITKYFFTGGTMPSANLLLYFQDDVSVVDHWLVNGKHYAQTSEEWLKRMDNNLASIKPIMESTYGKDQAVKWTVYWRTFFIAVAELFGYNNGEEWMVTHFLFRKKME

SEQ ID NO: 6703 - protein, 355 aa, Prunus persica
MNRIMQPTYDATVRFALSSLERNLLPDAVVRRLTRLLLASRLRSGYKPTSELQLSDLLQFVQSLKEMPIAIKTDDPKAQHYEVPTSFFKIVLGKNLKYSCYYFTDGSSTLEEAEKAMLELYCERSQIKNGHTVLDVGCGWGSLSLYIAQKYSNCKVTGICNSTTQKAFIEEQCRNLQLRNVEIIVADISTFEMEASYDRIFSIEMFEHMKNYKDLLKKISRWMKQDGLLFVHHFCHKAFAYHFEDKNEDDWITRYFFSGGTMPSANLLLYFQDDVSIVNHWLVNGKHYAQTSEEWLKRMDQNVASIKPIMESTYGKDSAVKWTVYWRTFFISVAELFGYNNGEEWMVAHFLFKKK

SEQ ID NO: 6704 - protein, 355 aa, Trifolium pratense
MEGMMQLPYNTTVKLMLGSLERNLLPDAVIRRLTRLLLATRLRSSYKSSSELQLSDLLQFAHSLQEMPIAVNTDIPKSQHYELPTSFFKLVLGKNLKYSSCYFSSASKTLEDAEEEMLKLYCERSNLKDGHTVLDVGCGWGSLTLYIAKNFSNSRVTGICNSTTQKAFIEEKCLELQLQNVDIIVADISTFEMEASYDRIFSIEMFEHMKNYKDLLKKISKWMKEDGLLFVHYFCHKTFAYHFEDKNEDDWITRYFFTGGTMPAANLLLYFQDDVTVINHWLVNGKHYAQTSEEWLKRMDKNMKSIKPIMESTYGQDSATKWTVYWRTFFIAVAELFGYNNGEEWMVAHFLFKKK

SEQ ID NO: 6705 - protein, 355 aa, Prunus mume
MNRIMQAPYDATVRFALSSLERNLLPDAVVRRLTRLLLASRLRSGYKPTSELQLSDLLQFVQSLKEMPIAINTDDPKAQHYEVPTSFFKIVLGKNLKYSSCYFTDGSSTLEEAEKAMLELYCERSQIKDGHTVLDVGCGWGSLPLYIAQKYSNCKVTGICNSTTQQAFIEEQCRNLQLQNVEIIVADISTFEMEASYDRIFSIEMFEHMKNYKYLLKKISRWMKQDCLLFVHHFCHKAFAYHFEDKSEDDWITRYFFSGGTMPSANLLLYFQDDVSIVNHWLVNGKHYAQTSEEWLKRMDQNMASIKPIMESTYGKDSAVKWTVYWRTFFISVAELFGYNNGEEWMVAHFLFEKK

SEQ ID NO: 6706 - protein, 355 aa, Sarracenia psittacina
MAALVQVPYDATVRLMLTSLERNLLPDGVIRRLTRMLLSTRLRSGYKPSSELQLSDLLHFARSLREMPIAIKTEEPKSQHYELPTSFFKLVLGKHLKYSCCYFTDASNTLEDAEKAMLELYCERAQIKDGHSVLDIGCGWGSLSLYIAQKYRNCKVTGFCNSTTQKAYIEEQSRDLQLQNLEVVVGDISTFDMDASYDRIFSIEMFEHMKNYKDLLKKISKWMNPDSLLFVHYFCHKAFAYHFEDVNDDDWITRYFFTGGTMPAANLLLYFQDDVSVVNHWLVNGKHYAKTSEEWLKRMDKNLTSIKPIMESTYGKDSAIKWTVYWRTFFIAVAELFGYNNGEEWMVALFLFKKK

SEQ ID NO: 6707 - protein, 133 aa, Platanus occidentalis
MNQDSLLFIHYFCHKAFAYHFEDKNEDDWITRYFFTGGTMPSANLLLYFQDDVSIVNHWLVNGTHYARTSEEWLKRMDQNMSSIKPIMESTYGKDSAVKWTVYWRTFFISVAELFGYNNGEEWMVALFLFKKK

SEQ ID NO: 6708 - protein, 355 aa, Nicotiana benthamiana
MDAIVQVPYNATVRLMLSSLERNLLPDAVIRRLTRLLLAARLRSSYKPSAELQLSDLLHFVHSLREMPIAVMTEKAKSQHYELPTSFFKFVLGKHFKYSCCYFHDKSSTLEDAEKAMMELYCERSQLKDGHTVLDVGCGWGSLSLYIAQKYSSCKITGICNSVTQKAHIEEQCRELQLQNVEIIVADISTFEMEGSYDRILSIEMFEHMKNYGDLLKKISRWMKPDSLLFVHHFCHKAFAYHFEDVNDDDWITRYFFSGGTMPSANLLLYFQDDVSVVNHWLVNGKHYAQTSEEWLKRMDQNKTSIKPIMESTYGKDSAVKWTVYWRTFFISVAELFGYNNGEEWMVAHFLFKKK

SEQ ID NO: 6709 - protein, 352 aa, Trigonella foenum-graecum
MEGMMQLPYNTTVKLMLGSLERNLLPDAVIRRLTRLLLSTRLRSSYKPSSELQLSDLLQFAHSLQEMPIAVSTDVPKSQHYELPTSFFKLVLGKNLKYSSCYFSSASKTLEDAEEEMLKLYCERSNLKDGHTVLDVGCGWGSLTLYIAKNYSSSRVTGICNSTTQKAFIEEKCRELQLQNVEIIVADISTFEMEASYDRIFSIEMFEHMKNYKDLLNKISKWMKEDGLLFVHHFCHKTFAYHFEDKNEDDWITRYFFTGGTMPAANLLLYFQDDVTVVNHWLVNGKHYAQTSEEWLKRMDQNKTSIKPIMESTYGKDSATKWTVYWRTFFIAVAELFGYNNGEEWMVAHFLF

SEQ ID NO: 6710 - protein, 117 aa, Trifolium pratense
MEEIMQLPYNTTVKLMLGSLERNLLPDAVIRRLTRLLLATRLRSSYKSSSELQLSDLLQFAHSLQEMPIAVNTDIPKSQHYELPTSFLSWFLERISNTVLVISLLPQRHWKMLKKKC

SEQ ID NO: 6711 - protein, 355 aa, Solanum tuberosum
MDAIVQLPYDATVRVMLGSLERNLLPDTVIRRLIRLLLAARLRSGYKPSSELQLSDLLQFVHSLKEMPIAVMTEKPKSQHYELPTSFFKIVLGKHLKYSCCYFKDKLSTLEDAEKAMMELYCERSQLKDGHTVLDVGCGWGSLSLYIAQKYSACKVTGICNSVTQKAHIEEQCRELQLQNLEIIVADISTFEMEESYDRILSIEMFEHMKNYGDLLKKMSRWMKADSLLFVHYFCHKAFAYHFEDVNDDDWITRYFFSGGTMPSANLLLYFQDDVSVVNHWLVNGKHYAQTSEEWLKRMDENKSSIKPIMESTYGKDSAVKWTVYWRTFFLSVAELFGYNNGEEWMVAHFLFKKK

SEQ ID NO: 6712 - protein, 355 aa, Fragaria vesca
MDRVMQAPYDATVRFALASLERNLLPDAVIRRFTRLLLASRLRTGYQPSSELQLSQLLQFVKSLKEMPIAIKTDDAKAQHYEVPTSFFKMVLGNNLKYSCCYFTDKSSSLEDAEKAMLEMYCERSQIKDGDSVLDVGCGWGSLSLYIAEKYKNCKVTGICNSATQKAFIEEQCRNRQLENVEIIVADISTFEMEASYDRIFSIEMFEHMKNYKDLLKKISGWMKQDGLLFVHHFCHKAFAYHFEDKSDDDWITRYFFSGGTMPSANLLLYFQDDVSVVDHWLVNGKHYAQTSEEWLKRMDHNSAAIKPIMESTYGKDSAVKWTVYWRTFFIAVAELFGYNNGEEWMVALFLFKKK

SEQ ID NO: 6713 - protein, 355 aa, Cicer arietinum
MEGMMQLPYKTTVKLMLGSLERNLLPDAIIRRFTRLLLATRLRSGYKSSSQLQLSHLLQFVHSLQELPIAVNTDKPKSQHYELPTSFFRLVLGNNLKYSCCYFSSASKTLEDAEEEMLKLYCERSNLEDGHTVLDVGCGWGSLTLYIAKNYSNSRVTGICNSTTQKAYIEEKCLELQLQNVDIIVADISTFEMEASYDRVFSIEMFEHMKNYKDLLNKISKWMKEDSLLFVHHFCHKAFAYHFEDNNEDDWITRYFFTGGTMPAANLLLYFQDDVSVVNHWLVNGKHYAQTSEEWLKRMDKNMSSIKPIMESTYGIDSATKWTVYWRTFFIAVAELFGYNNGEEWMVAHFLFKKK

SEQ ID NO: 6714 - protein, 355 aa, Euphorbia peplus
  Sequence also found in Organisms: Euphorbia esula
MESLMQLPYDTTVKVMLGSLERNLLPDAVIRRLTRLLLATRLRSGYKSTSELQLSDLLQFVHSLKEMPIAIKTDDAKSQHYELPTAFFKLVLGNNLKYSCCYFSDKSNNLEDAEKAMLELYCERSQLKDGHSVLDVGCGWGSLCLYIAHKYSNCRVTGICNSKTQKAHIDDQARARNLQNVEIIVGDITTFEMEGSYDRIYSIEMFEHMKNYKDLLHKISKWMKEESLLFVHHFCHKTFAYHFEDVNDDDWITRYFFSGGTMPAANLLLYFQDDVSVVNHWLLNGKHYAQTSEEWLKRMDQKMGLIKPIMESTYGKDEAVKWTVYWRTFFISVAELFGYNNGEEWMVTLFLFKKK

SEQ ID NO: 6715 - protein, 355 aa, Mesembryanthemum crystallinum
MEKLMQMPYEATVKLMLTSLEKNLLPDAVIRRLTRLLLASRLRSSYKSSTEIQFSDLLHFAHSLREMPIAIQTEKPKSQHYELPTSFFKLVLGQHFKYSCCYFSDKHTSLDDAEKAMLEMYCKRSEIKDGHTVLDVGCGWGSLALYIAQKYSKCQVTGICNSVTQKEFIEEQCRDRHLQNVEIIVADISTFEMEGSYDRIFSIEMFEHMKNYRDLLKKISNWMKPDGFLFVHYFCHKAFAYHFEDVNEDDWITRYFFTGGTMPSANLLLYFQDDVTVVNHWLVNGKHYAQTSEEWLKRMDNNLVSIRPIMESTYGKDSATKWTVYWRTFFIAVAELFGYNDGEEWMVAHFLFKKK

SEQ ID NO: 6716 - protein, 355 aa, Glycine max
MEGTMQLAYETVVKLMLAALERNVLPDVITRRLTRLLLATRLRSAYKPSSQLQLSDLLYFAHSLQEMPIAINTDKPKSQHYELPTAFFKLVLGNNLKYSCCYFSSASMTLDDAEEAMLKLYCERSNLKDGHTVLDVGCGWGSLALYIAKNYTNCRVTGICNSTTQKAYIEEKCRDLQLQNLNIIVADISTFEMETSYDRIFSIEMFEHMKNYKDLLKKISKWMKEDSLLFVHYFCHKAFAYHFEDKNEDDWITRYFFTGGTMPSANLLLYFQDDVTVTNHWLVNGKHYAQTSEEWLKRMDQRMTFIKPIMQSTYGKDSATKWTAYWRTFFIAVAELFGYNNGEEWMVAHFLFKKK

SEQ ID NO: 6717 - protein, 355 aa, Citrullus lanatus
MAELIQMPYDVTVRLALASLERNLLPDAVVRRFTRLLLASRLRSGYKPSSQLQLSELLHFVHSLREMPIAIKTDKPKAQHYEVPTSFFKLVLGKNLKYSCCYFNDKSSTLEDAEDAMLRMYCERSQLKDGHTVLDVGCGWGSLSLYIAQKYKNCTVTGICNSTTQKAYIEEQCRDLQLHNLNIIVADISTFEMEAEYDRIFSIEMFEHMKNYKDLLKKISGWMKQDSLLFVHHFCHKVFAYHFEDVNEDDWITRYFFEGGTMPSANLLLYFQDDVSIVDHWLVNGKHYSQTSEEWLKRMDENAALIKPIMAITYGKDSAVKWTVYWRTFFIAVAELFGYNNGEEWMVSHFLFKKK

SEQ ID NO: 6718 - protein, 117 aa, Trifolium pratense
MEGMMQLPYNTTVKLMLGSLERNLLPDAVIRRLTRLLLATRLRSSYKSSSELQLSDLLQFVHSLQEMPIAVNTDIPKSQHYELPTSFLSWFLERISNTVLVISLLPQRHWKMLKKKC

SEQ ID NO: 6719 - protein, 358 aa, Panax ginseng
MNTIVQLPYDATVRMMLASLERNLLPDALIRRLTRLLLASRLRSGYKSSAELQLSDLLQFAHSLREMSIAIKTEEPKYQHYELPTSFFKLVLGKNLKYSCCYFPDKSSTLDDAEKAMLEMYCDRSQLEDGHTVLDVGCGWGSLSIYIAQKYNKCKITGICNSTTQKAFIEEQCRDLQLQNVEVIVADISTFDMEASYDRIFSIEMFEHMKNYKELLKKISRWMHPDSLLFVHHFCHKAFAYHFEDINEDDWITRYFFTGGTMPSANLLLYFQDDVSVVNHWLVNGKHYAQTGEEWLKRMDNNWSSVRPIMESTYGKDSAVKWTVYWRTFFIAVAELFGYNNGEEWMVAHFLFKRNEVN

SEQ ID NO: 6720 - protein, 357 aa, Arachis hypogaea
MEGKGLLKLPYDTTVKFMLASLERNLLPDALIRTLTRVLLSTRLRSSYRPSSHLQLSDLLHFAHSLREMPIAVNTDKPKSQHYELPTSFFKLVLGTNLKYSCCYFSSDSQTLEDAEEAMLELYCERSNLKDGHTVLDVGCGWGSLALYIAKKYSNCKVTGICNSATQKAHIDEQSRDLQLQNLDIIVADISTFEMEGSYDRIFSIEMFEHMKNYKDLLKKISSWMKEDSLLFVHYFCHKVFAYHFEDKNDDDWITRYFFTGGTMPSANLLLYFQDDVTVLNHWLVNGKHYAQTSEEWLKRMDKNITTIKPIMESTYGKDSAVKWTVYWRTFFIAVAELFGYNDGEEWMVAHFLFKKK

SEQ ID NO: 6721 - protein, 363 aa, Sesamum indicum
MAEVNGRIIDTIVQMPYDATVRFMLASLERNLLPDAVVRRLTRLLLASRLRSGYRSSAELQLSDLLQFAHSLREMPIAIKTEKPKSQHYEVPTSYFKLVLGKHLKYSCCFFPNKSSTLEDAEKAMLELYCERSQIKDGQSVLDVGCGWGSLSIYIAQKYPNCQVTGICNSITQKAHIEEQCRELQLQNVEIIVADISTFDMEASYDRIFSIEMFEHMKNYQDLLKKISKWMKPDSFLFVHYFCHKTFAYHFEDVNEDDWITRYFFTGGTMPSANLLLYFQDDVSIVNHWLVNGKHYAQTSEEWLKRMDQNLNSIKPIMECTYGKDSAVKWTVYWRTFFIAVAELFGYNNGEEWMVAHFLFKKK

SEQ ID NO: 6722 - protein, 354 aa, Amsonia hubrichtii
MDAVLQAPYDATVRLMLASLERNLLPDAVIRRLTRLLLASRLRSGYKPTSELQLSDLLHFAHSLREMPIAIKTEDPKSQHYELPTSFFKLVLGKHLKYSCCLFSDKSKSLEDAEKAMLELYCERAQLKDGHTVLDVGCGWGSLSLYIGQKYSNCKVTGICNSLTQKAHIEERCRDHQLQNVEIIVADISTFDMEASYDRIFSIEMFEHMKNYRDLLKKISTWMKPDGLLFIHHFCHKAFAYHYEDVNEDDWITRYFFSGGTMPSANLLLYFQDDVSVVDHWLVNGNHYAQTSEEWLKRMDQNMSSIRPIMDSTYGKDSAVKWTVYWRTFFIAVAELFAYNNGEEWMVVHFLFKK

SEQ ID NO: 6723 - protein, 355 aa, Nicotiana tabacum
MDAIVQVPYNATVRLMLSSLERNLLPDAVIRRLTRLLLAARLRSSYKPSAELQLSDLLHFVHSLKEMPIAVMTEKAKSQHYELPTSFFKFVLGKHFKYSCCYFRDKSSTLEDAEKAMMELYCGRSQLKDGHTVLDVGCGWGSLSLYIAQKYCSCNVTGICNSVTQKAHVEEQCREFQLQNVEIIVADISTFEMEGSYDRILSIEMFEHMKNYGYLLKKISRWMKPDSLLFVHHFCHKAFAYHFEDVNDDDWITRYFFSGGTMPSANLLLYFQDDVSVVNHWLVNGKHYAQTSEEWLKRMDQNKTSIKPIMESTYGKDSAVKWTVYSRTFFISVAELFDYNNGEEWMVAHFLFKKK

SEQ ID NO: 6724 - protein, 355 aa, Solanum lycopersicum
MDAIVQLPYDATVRLMLRSLERNLLPDTVIRRLTRLLLAARLRSGYKPSSELQLSDLLQFVQSLKEMPIAVMTEKPKSQHYELSTSFFKIVLGKHLKYSCCYFKDKLSTLEDAEKAMMELYCERSQLKDGHTVLDVGCGWGSLSLYIAQKYSACKVTGICNSVTQKAHIEEQCRELQLQNLEIIVADISTFEMEGSYDRILSIEMFEHMKNYGDLLKKISRWMKADSLLFVHYFCHKAFAYHFEDVNDDDWITRYFFSGGTMPSANLLLYFQDDVSVVDHWLVNGKHYAQTSEEWLKRMDENKSSIKPIMESTYGKDSAVKWTVYWRTFFLSVAELFGYNNGEEWMVAHFLFKKN

SEQ ID NO: 6725 - protein, 358 aa, Panax ginseng
MNTMVQLPYDATVRMMLASLERNLLPDALIRRLTRLLLASRLRSGYKSSAELQLSDLLQFAHSLREMSIAIKTEEPKYQHYELPTSFFKLVLGKNLKYSCCYFPDKSSTLDDAEKAMLEMYCDRSQLEDGHTVLDVGCGWGSLSIYIAQKYNKCKITGICNSTTQKAFIEEQCRDLQLQNVEVIVADISTFDMEASYDRIFSIEMFEHMKNYKELLKKISRWMHPDSLLFVHHFCHKAFAYHFEDINEDDWITRYFFTGGTMPSANLLLYFQDDVSIVNHWLVNGKHYAQTGEEWLKRMDNNWSSVRPIMESTYGKDSAVKWTVYWRTFFIAVAELFGYNNGEEWMVAHFLFKRNEVN

SEQ ID NO: 6726 - protein, 355 aa, Medicago truncatula
MEEMMHLPYNTTVKLMLGSLERNLLPDTVIRRLTRLLLSTRLRSSYKPSSELQLSDLLQFAHSLQDMPIAVSTDVPKSQHYELPTSFFKLVLGNNLKYSSCYFSSASKTLEDAEEEMLKLYCERSNLKDGHTVLDVGCGWGSLTLFIAKNYSSSRVTGICNSTTQKAFIEEKCRELQLQNVDIIVADISTFEMEASYDRIFSIEMFEHMKNYKDLLKKISIWMKEDGLLFVHHFCHKAFAYHFEDKNEDDWITRYFFTGGTMPAANLLLYFQDDVTVINHWLVNGKHYAQTSEEWLKRMDKNKTSIKPIMESTYGKDSATKWTVYWRTFFIAVAELFGYNNGEEWMVAHFLFKKK

SEQ ID NO: 6727 - protein, 355 aa, Vinca minor
MEAIIKAPYDVTVRLMLSSLERNLLPDAVIRRFTRLLLASRLRSGYKPTSQLQLSDLLHFAHSLREMPIAIKTEDAKSQHYELPTSFFKLVLGKHLKYSCCLFSETAKTLEDAEIAMLDLYCERAELKDGQSVLDVGCGWGSLSLYIAQKYSNCKVTGICNSATQKAHIEELCREHQLQNLEIIVADISTFDMEASYDRIFSIEMFEHMKNYKDLLKKISMWMKPDSLLFIHHFCHKAFAYHYEDVNEDDWITRYFFSGGTMPSANLLLYFQDDVSVVDHWLVNGNHYAQTSEEWLKRMDENTSSVKPIMESTYGKDSAVKWTVYWRTFFIAVAELFGYNNGEEWMVVHFLFKKK

SEQ ID NO: 6728 - protein, 350 aa, Vaccinium corymbosum
QVPYDATVRLMLSSLERNLLPDAVIRRLTRLLLSARLRSGYKSSSDLQLSHLLSFVHSLTESAIAVKTEKPKTQHYELPTSFFKLVLGKHLKYSCCYFTDTSSTLEDAEKAMLELYCERAKLKDGHSVLDIGCGWGSLCLYIAQKYSNCKVTGICNSTTQKSYIEEQSRDLQLQNLDVIVADISTFDMEATYDRIFSIEMFEHMKNYKDLLKKISKWMEPDSLLFVHHFCHKVFAYHFEDVNEDDWITRYFFTGGTMPSANLLLYFQDDVSVVNHWLVNGKHYAKTSEEWLKRMDKNLSSVKPIMEATYGKDSAVKWTVYWRTFFIAVAELFGYNDGEEWMVALFLFKKK

SEQ ID NO: 6729 - protein, 355 aa, Cucurbita pepo
MAELIQVPYDVTVRLLMASLERNFLPDAVVRRFTRLLLASRIRSQFKPSSQLQLSDFLHFVHALREMPIAIKTDKPKAQHYELPTSFFKLVLGKNLKYSSCYFKDKSSTLEDAEEAMLQMYCERSQLKDGHSVLDVGCGWGSLSLYIAQNYKNCQVTGICNSTTQKDYIEEQCRDLQLNNVNIIVADISTFEMEAEYDRIISIEMFEHMKNYKDLLKKISGWMKQDSLLFVHHFCHKVFAYHFEDKNEDDWITRYFFEGGTMPSANLLLYFQDDVSIVDHWLVNGKHYSQTSEEWLKRMDKNIASIKPIMATTYGKDSAVKWTVYWRTFFIAVAELFGYNNGEEWMVCHLLFKKK

SEQ ID NO: 6730 - protein, 355 aa, Lupinus angustifolius
MEGIMQVPYHTTTKLMLASLERNLLPDPIIRRLTRLLLASRLRSCSKPSSQLQLDDLIHFVHSLQEMPIAIDTDKAKSQHYELPTSFFKLVLGENLKYSSCYFSSTTKTLEEAEEAMLELYCERSKLKDGHTVLDVGCGWGSLPLYIAKKYSNSKVTGICNSTTQKAYIEERIRDLQLQNLDIIVADIRTFEMESSYDRIISIEMFEHMKNYGELLKKISKWMKEDSLLFVQHFCHKVFAYHFEDKDDDDWITRYFFTGGTMPSANLLLYFQGDVTVVNHWLLNGKHYAQTSEEWLKRMDKNITSIKPIMESTYGKDSATKWTVYWRTFFIAVAELFGYNDGEEWMVAHFLFKKK

SEQ ID NO: 6731 - protein, 363 aa, Mimulus guttatus
MAAVNGGIVDSIVQVPYEATVRLMLGSLERNLLPDAVVRRLTRLLLASRLRSGYRSSADIQLSDLLNFVHSLKEMPIAIQTETPKSQHYEVPTSFFKLALGKHLKYSCCYFSDKSSTLDDAEKAMLELYCERSQIKDGHSVLDVGCGWGSLSLYIAQKYPNCLIKGICNSITQKEHIEEQCRDLQVKNVEIVVGDISTFDMEASYDRIFSIEMFEHMKNYRDLLKKISKWMKSDGLLFIHYFCHKTFAYHFEDVNEDDWITRYFFTGGTMPSADLLLYFQDDVSIVDHWLVNGKHYAQTSEEWLKRMDQNLSSIKPLMESTYGKDSAVKWTVYWRTFFIAVAELFGYNNGEEWMVAHFLFKKK

SEQ ID NO: 6732 - protein, 276 aa, Lippia dulcis
MDSVVQVPYGATVRLMLASLERNLLPDAVVRRLTRLLLAGRLRSGYRSSADIQLSELLQFAQSLREMPIAIKTEKAKSQHYELPTPFFKLVLGKHLKYSSCYFPDKSSSLEDAEKAMLELYCERSQIKDGHSVLDVGCGWGSLVLYTAQKYPNCQITGICNSTTQKAHIEEQCRDLQLQNVEIIVADISTFDMEASYDRIFSIEMFEHMKNYHDLLKKISKWMKPDGLLFVHHFCHKTFAYHFEDLNDDDWITRYFLKEGQCPQQTCSFIFRTTCL

SEQ ID NO: 6733 - protein, 289 aa, Solanum phureja
MPIAVMTEKPKSQHYELPTSFFKIVLGKHLKYSCCYFKHKLSTLEDAEKAMMELYCERSQLKDGHTVLDVGCGWGSLSLYIAQKYSACKVTGICNSVTQKAHIEEQCRELQLRNLEIIVADISIFEMEGSYDRILSIEMFEHMKNYGDLLKKMSRWMKADSLLFVHYFCHKAFAYHFEDVNDDDWITRYFFSGGTMPSANLLLYFQDDVSVVNHWLVNGKHYAQTSEEWLKRMDENKSSIKPIMESTYGKDSAVKWTVYWRTFFLSVAELFGYNNGEEWMVAHFLFKKK

SEQ ID NO: 6734 - protein, 364 aa, Triphysaria pusilla
MEEVNGGGVVGSIVQVPYNATVRLTLVSLERNLLPDAVVRRLTRLLLAGRLRSGYRSSTDVQLSDLLEFANSLKEMPIAIKTERPKSQHYEVPTSFFKLVLGKHLKYSCCYFSDKTSTLEDAEKAMLDLYCERSQIKDGHSVLDVGCGWGSLSLHIAQKYPNCKVTGICNSATQKAHIDDQCRAHGMQNVEIIVADISTFEMEASYDRIFSIEMFEHMKNYQDLLKKISHWMKPDGLLFVHYFCHKTFAYHFEDVNDDDWITRYFFTGGTMPSANLLLYFQGDVSIVNHWLVNGKHYAQTSEEWLKRMDHNLSSIKPIMESTYGKDSAVKWIAYWRTFFISVAELFGYNDGEEWMVAHFLFKKK

SEQ ID NO: 6735 - protein, 355 aa, Phaseolus vulgaris
MEGMMQLAYGATVKLMLSALERNLLPDAVTRRLTRVLLATRLRSSSNTSSDLQLSHLLHFAHSLQEMPIAINTEKAKSQHYELPTAFFKLVLGSNLKYSCCYFSSASMTLEDAEEAMLKLYCERSNLKDGHTVLDVGCGWGSLALYIAKNYTNCRVTGICNSTTQKAYIEEKCRDLQLQNMNIIVADISTFEMEASYDRIFSIEMFEHMKNYKELLKKISKWMKEDSLLFVHYFCHKAFAYHFEDKNEDDWITRYFFSGGTMPSANLLLYFQDDVTVINHWLVNGKHYSQTSEEWLKRMDQRMTYIKPIMQSTYGNDSATKWTAYWRTFFISVAELFGYNNGEEWMVAHFLFKKK

SEQ ID NO: 6736 - protein, 355 aa, Cannabis sativa
MAALVQLPYDATVKLALASLERNLLPDAVIRRLTRLLLATRLRSGYKPSAHLQLSDLLRFIQSLKEMPIAIKTDEPKAQHYELPTSFFNLVLGQNFKYSCCYFEKSSSTLEEAEKAMLEMYCEKSKLEDGQTVLDVGCGWGSLSLYIAQKYKNCKVTGICNSSTQKDHIDQRCRELEVENVEIIVADISTFEMERSFDRIYSIEMFEHMKNYKELLKKISGWMKEDALLFVHHFCHKTFAYHFEDVNEDDWITRYFFTGGTMPSANLLLYFQDDVSVIDHWLVNGKHYAQTSEEWLKRMDKNVRLIKPIMESTYGKENAVKWTVYWRTFFIAVAELFGYNNGEEWMVALFLFKKK

SEQ ID NO: 6737 - protein, 355 aa, Chenopodium quinoa
MEEMKQMAYKATAKLMLGAHERNLLPDALIRRLTRLLLASRLRSSYKSSSQLQLSDLLHFVHSLREMPIAIQTDKAKSQHYELPTSFFKLVLGKHLKYSCCYFSDKQTNLDDAEKAMLELYCERSGIQDGHTVLDVGCGWGSLALYIAQKYSNCGVTGICNSVTQKAHIEDRCRDLQLKNVEIIVADISTFDMEGSYDRILSIEMFEHMKNYRDLLKKISNWMKPDGLLFVHYFCHKAFAYHFEDINDDDWITRYFFTGGTMPAANLLLYFQDDVSIVNHWLENGKHYAQTSEEWLKRMDRNLAYIRPIMESTYGKDSALKWIVYWRTFFIAVAELFGYNNGEEWMVAHFLFKKK

SEQ ID NO: 6738 - protein, 355 aa, Aquilegia formosa
MEGLIQVPYNVTVKMMLSSLERNILPDLLVRKLTKLLLSSRLRNGYKPTSEEQLSDLLHFALSLQEMPIAIKTDIPKSQHYELPTSFFNLVLGKHMKYSCCYFMDSSTTLEDAEKAMLDLYCERAQIKDGHTVLDVGCGWGSLCLFIAQKYSNCKITGICNSTTQKTYIDEQCRERQLQNVEIIVADISTYEMDASFDRVFSIEMFEHMKNYKKLLKKVSKWMNEESLLFVHHFCHKAFAYNFEDTNEDDWITRYFFTGGTMPSANLLLYFQEDVSVVNHWLVNGKHYAQTSEEWLKRMDQNLATIKPIMETTYGKDSAVKWTAYWRTFFISVAELFGYNNGEEWMVVHFLFKKK

SEQ ID NO: 6739 - protein, 355 aa, Cajanus cajan
MEGLKQAAYETTVKLMLAALERKLLPDIVTRTLTRFLLATRLRSAHKSFSELHLSDLLQFAHSLQDMPIAINTEKPKSQHYELPTAFFRMVLGNNLKYSCCYFSSASMTLDDAEEAMLKLYCERSNLKDGHTVLDVGCGWGSLALYIAKKYTNCRVTGICNSTTQKAYIEEKCRDLQLQNLGIIVADISTFEMEASYDRIFSIEMFEHMKNYKELLKKISKWMKEDSLLFVHHFCHKAFAYHFEDINDDDWITRYFFTGGTMPSANLLLYFQDDVTVINHWLVNGKHYSKTSEEWLKRMDHRMTLIKPIMESTYGKNSAIKWIAYWRTFFIAVAELFGYNNGEEWMVAHFLFRKK

SEQ ID NO: 6740 - protein, 355 aa, Cirsium arvense
MSNLVQVPYDATVKLMLVSLQRNLLPDPVIRRLTRLLLAGRLRSCFKPTTQQQLQDLLDFVQSLKEMPIAVKTEDAKAQHYELPTSFFNLVLGKNFKYSCCYFRDKLSSLEDAEEAMLQLYCEKSQLQDGHTVLDVGCGWGSLSIYIAKKYSNCKVTGICNSVTQKAHIEDQCRKLNLQNVEVIVADISTFEMEGSYDRIFSIEMFEHMKNYKDLLKKISNWMKTDGFLFVHYFCHKTYAYHFEDVSEEDWITRYFFSGGTMPSANLLLYFQDDVSVVNHWLVNGKHYAQTSEEWLKRMDKNIASIKPIMESTYGKDSAVKWTVYWRTFFISVAELFGYNNGEEWMVAHYLFKKK

SEQ ID NO: 6741 - protein, 357 aa, Daucus carota
MALKKMMEVPYAATVRVMLASLERNLLPDAVIRQLTRLLLSSRLRLGYAPSAHLQLAQLLHFAHSLRDLPIAIKTEDPKVQHYELPTSFFKLVLGENLKYSCCYFNDTSSTLDDAEKAMLETYCERSGLEDGHTVLDVGCGWGSLSIFIAKKYSNCKITGICNSKTQKAFIEERCRDLDLHNVEIIVADISTFDMEASYDRIFSIEMFEHMKNYKELLKKISRWMKPDSLLFVHHFCHKTFAYHFEDINEDDWITRYFFSGGTMPSANLLLYFQDDVSVVNHWLVNGKHYAQTSEEWLKRMDKNMSSVRPIMESTYGKDSAVKWTVYWRTFFIAVAELFGYSNGEEWMVAHFLFKRK

SEQ ID NO: 6742 - protein, 357 aa, Petroselinum crispum
MALKKMMEVPYTATVRMMLASLERNLLPDAVIRRLTRLLLSTRLRLGYAPSAHLQLAQLLHFAHSLRDMPIAIKTEDAKVQHYELPTSFFKLVLGENLKYSCCYFSDTSSTLDDAEKAMLETYCERSGLEDGHSVLDVGCGWGSLSIYIAKKYSKCKITGICNSTTQKAFIEERCRDLDLHNVEIVVADISTFDMEASYDRIFSIEMFEHMKNYKELLQKISWWMKPDSLLFVHHFCHKTFAYHFEDINEDDWITRYFFSGGTMPSANLLLYFQDDVSVVDHWLVNGKHYAQTSEEWLKRMDKNMSAVRPIMESTYGKDSAVKWTVYWRTFFIAVAELFGYANGEEWMVAHFLFKKK

SEQ ID NO: 6743 - protein, 356 aa, Aristolochia fimbriata
MAEGLLSVPYNATVRTMLTLLEKNLLPDMVIRKLTRLLLAERLRSGYLRSSELQLAALMEFVNSLLNMPIAVETDKAKAQHYELPTPFFKLVLGRNLKYSSCYFQDGSTTLDDAEEAMLELYCERAQIKDGHTILDVGCGWGSLSLYIAAKYQNCRVTGICNSTTQKTFIEEQCRDRQLLNVEIIIADISKFGMEANFDRILSIEMFEHMKNYKDLLKKISSWMKPDSLLFIHHFCHKMFAYHYEDKNEDDWITRYFFSGGTMPSANLLLYFQEDVTAVNHWLVNGKHYAQTSEEWLKRMDKNLDSIKPIMESTYGKDSATKWTVYWRTFFIAVAELFGYNNGEEWMVNHLLFKKK

SEQ ID NO: 6744 - protein, 355 aa, Centaurea maculosa
MSNLVQVPYDATVKLMLVSLQRNLLPDAVIRRLTRLLLAGRLRSCLKPTAQQQLQDLLDFVHSLREMPIAVKTEDAKAQHYELPTSFFKLVLGKNFKYSCCYFRDKISSLEDAEEAMLQLYCEKSQLQDGHTVLDVGCGWGSLSIYIAQKYSNCKVTGICNSVTQKAHIEDQCGKLNLQNVEVIVADISTFEMEGSYDRIFSIEMFEHMKNYKDLLKKISNWMKPDGFLFVHYFCHKTYAYHFEDVSEEDWITRYFFSGGTMPSANLLLYFQDDVSVVNHWLLNGKHYAQTSEEWLKRMDANIASVKPIMESTYGKDAAVKWTVYWRTFFISVAELFGYNNGEEWMVAHYLFKKK

SEQ ID NO: 6745 - protein, 108 aa, Gossypium hirsutum
MASSFRAFLNSPVGPKTTHFWGPVANWGFVLAGLVDMNKPPEMISGNMTSAMCVYSALFMRFAWMVQPRNYLLLACHASNETVQLYQLSRWARAQGYLSEKKDKATSQ

SEQ ID NO: 6746 - protein, 108 aa, Gossypium raimondii
MASSFRAFLNSSVGPKTTHFWGPVANWGFVLAGLVDMNKPPEMISGNMTSAMCVYSALFMRFAWMVQPRNYLLLACHASNETVQLYQLSRWARAQGYLSDKKDKATLQ

SEQ ID NO: 6747 - protein, 108 aa, Gossypium hirsutum
  Sequence also found in Organisms: Gossypium raimondii
MASSFRAFLNSPVGPKTTHFWGPVANWGFVLAGLVDMNKPPEMISGNMTSAMCVYSALFMRFAWMVQPRNYLLLACHASNETVQLYQLSRWARAQGYLSEKKEEASSQ

SEQ ID NO: 6748 - protein, 108 aa, Gossypium hirsutum
MASSFRAFLNSPVGPKTTHFGGRVANWGFVLAGLADMNKPPEMISGNMTSAMCVYSALFMRFAWMVQPRNYLLLACHASNETVQLYQLSRWARAQGYLSDKKDKATLQ

SEQ ID NO: 6749 - protein, 108 aa, Theobroma cacao
MASSFRAFLNSPVGPKTTHFWGPVANWGFVLAGLADMKKPPEMISGNMTTAMCVYSALFMRFAWMVQPRNYLLLVCHASNETVQLYQLSRWARAQGYLSEKKEEASSQ

SEQ ID NO: 6750 - protein, 107 aa, Cucumis sativus
MASFRAFLNSPVGPKTTHFWGPVANWGFVAAGLADMNKPPEMISGNMTAAMCVYSALFMRFAWMVQPRNYLLLACHASNETVQLYQFSRWAKAQGYLSEKKDEAGSQ

SEQ ID NO: 6751 - protein, 107 aa, Citrullus lanatus
MASFRAFLNSPVGPKTTHFWGPVANWGFVAAGLADMNKPPEMISGNMTAAMCVYSALFMRFAWMVQPRNYLLLACHASNETVQLYQFSRWAKAQGYLSEKKDEAASQ

SEQ ID NO: 6752 - protein, 108 aa, Eucalyptus grandis
MASFRAFLNSPVGPKTTHFWGPVANWGFVVAGLVDMQKPPEMISGNMTAAMCVYSALFMRFAWMVQPRNYLLLACHASNETVQLYQLSRWAKGQGYLSEKKKDEASSQ

SEQ ID NO: 6753 - protein, 107 aa, Eucalyptus grandis
MASFRAFLNSPVGPKTTHFWGPVANWGFVVAGLVDMQKPPEMISGNMTAAMCIYSALFMRFAWMVQPRNYLLLACHASNESVQLYQLSRWATAQGYLSQKKDKASSQ

SEQ ID NO: 6754 - protein, 107 aa, Euonymus alatus
MASFRAFLNSPVGPKTTHFWGPVANWGFVIAGLVDMQKPPEMISGNMTAAMCVYSGLFMRFAWMVQPRNYLLLACHASNETVQLYQLSRFARAQGYLSEKKEEASPQ

SEQ ID NO: 6755 - protein, 107 aa, Euonymus alatus
MASFRAFLNSPVGPKTTHFWGPVANWGFVIAGLVDMQKPPEMISGNMTAAMCVYSGLFMRFAWMVQPRNYLLLACHASNETVQLYQLSRFARAQGYLSQKKEEASLQ

SEQ ID NO: 6756 - protein, 107 aa, Cucurbita pepo
MASFRAFLNSPVGPKTTHFWGPVANWGFVAAGLADMNKPPEMISGNMTAAMCVYSALFMRFAWMVQPRNYLLLACHASNETVQMYQFSRWAKSQGYLSEKKDEAASQ

SEQ ID NO: 6757 - protein, 107 aa, Euonymus alatus
MASFRAFLNSPVGPKTTHFWGPVANWGFVIAGLVDMQKPPEMISGNMTAAMCVYSGLFMRFAWMVQPRNYLLLACHASNETVQLYQLSRFARAQGYLSQKKEEASPQ

SEQ ID NO: 6758 - protein, 108 aa, Arachis hypogaea
MASSFKAFLNSPVGPKTTHFWGPVANWGFVAAGLADMNKPPEMISGNMTAAMCVYSALFMRFAWMVQPRNYLLLACHASNETVQLYQLSRWAKGQGYLSDKKEEASPQ

SEQ ID NO: 6759 - protein, 110 aa, Manihot esculenta
MASFRAFLNSPVGPKTTHFWGPIANWGFVAAGLVDMNKPPEMISGNMTGAMCIYSALFMRFAWMVQPRNYLLLACHASNETVQLYQLSRWARAQGYLSTETEKKEKASSE

SEQ ID NO: 6760 - protein, 110 aa, Carica papaya
MASSFRAFLNSPVGPKTTHFWGPVANWGFVVAGLVDMQKPPEMISGNMTAAMCVYSGLFMRFAWMVQPRNYLLLACHASNETVQLYQLSRWAKGQGYLSSSEKKEEASSQ

SEQ ID NO: 6761 - protein, 108 aa, Ricinus communis
MASFRAFLNSPVGPKTTHFWGPVANWGFVAAGLVDMKKPPEMISGNMTGAMCIYSALFMRFAWMVQPRNYLLLACHASNETVQLYQFSRWARAQGYLSSEKKEKESSE

SEQ ID NO: 6762 - protein, 107 aa, Malus domestica
MASFRAFLNSPVGPKTTHFWGPVANWGFVAAGLADMNKPPEMISGNMTAAMCVYSALFMRFAWMVQPRNYLLLACHVSNETVQLYQLSRWARGQGYLAPKKDEAATE

SEQ ID NO: 6763 - protein, 107 aa, Malus domestica
MASFRAFLNSPVGPKTTHFWGPVANWGFVAAGLADMNKPPEMISGNMTAAMCVYSALFMRFAWMVQPRNYLLLACHVSNETVQLYQLSRWARGQGYLAPKKDEAASE

SEQ ID NO: 6764 - protein, 107 aa, Echinacea purpurea
MASFKAFLNSPVGPKTTHFWGPVANWGFVIAGLVDMKKPPEMISGNMTGAMCVYSALFMRFAWMVQPRNYLLLACHASNETVQLYQLSRWAKGQGYLGEKKAEASPQ

SEQ ID NO: 6765 - protein, 107 aa, Euonymus alatus
MASFRAFLNSPVGPKTTHFWGPVANWGFVIAGLVDMQKPPEMISGNMTGAMCIYSGLFMRFAWMVQPRNYLLLACHASNETVQLYQLSRWARGQGYLSQKKEEASTQ

SEQ ID NO: 6766 - protein, 107 aa, Vitis vinifera
MASFRAFLNSPVGPKTTHFWGPIANWGFVAAGLADMNKPPEMISGNMTAAMCVYSALFMRFAWMVQPRNYLLLACHASNETVQLYQLSRWAKGQGYLQEKKDEAASN

SEQ ID NO: 6767 - protein, 107 aa, Cucumis melo
MVSFRAFLNSPVGPKTTHFWGPVANWGFVAAGLADMNKPPEMISGNMTAAMCVYSGLFMRFAWMVQPRNYLLLACHASNETVQLYQFSRWAKAQGYLSEKKDEAASQ

SEQ ID NO: 6768 - protein, 107 aa, Scabiosa columbaria
MASFRAFLNSPVGPKTTHFWGPVANWGFVVAGLVDMQKPPELISGNMTGAMCIYSALFMRFAWMVQPRNYLLLACHASNETVQLYQLSRWARAQGYLGKKEDKAVSE

SEQ ID NO: 6769 - protein, 107 aa, Panicum virgatum
MSTALKAFLNSPVGPKTTHFWGPVANWGFVLAGLVDMNKPPEMISGNMTAAMCVYSALFMRFAWMVQPRNYLLLACHASNESVQLYQLSRWARAQGYLEKKEPETQQ

SEQ ID NO: 6770 - protein, 107 aa, Tripterygium wilfordii
MASFRAFLNSPVGPKTTHFWGPVANWGFVIAGLVDMQKPPEMISGNMTAAMCIYSGLFMRFAWMVQPRNYLLLACHASNETVQLYQLSRWAKGQGYLSEKKEEASPQ

SEQ ID NO: 6771 - protein, 110 aa, Silene vulgaris
MASTFRAFLNSPVGPKTTHFWGPVANWGFVVAGLVDMNKPPEMISGNMTAAMCVYSALFMRFAWMVQPRNYLLLTCHASNETVQMYQLSRWARANGYLSEKKEEAKSPEL

SEQ ID NO: 6772 - protein, 109 aa, Chenopodium quinoa
MASTFRAFLNSPVGPKTTHFWGPVANWGFVVAGLVDMNKPPEMISGNMSAAMCVYSGLFMRFAWMVQPRNYLLLACHASNETVQLYQFSRWARANGYLSQKKDEDTPSK

SEQ ID NO: 6773 - protein, 108 aa, Amaranthus tuberculatus
MASKLQAFLNSPVGPKTTHFWGPVANWGFVIAGLVDMNKPPEMISGNMTAAMCVYSGLFMRFAWMVQPRNYLLLACHASNETVQLYQLSRWARANGYLSQKKEDGVSQ

SEQ ID NO: 6774 - protein, 107 aa, Ambrosia trifida
MASFRAFLNSPVGPKTTHFWGPVANWGFVVAGLVDMQKPPEMISGNMTAAMCVYSGLFMRFAWMVQPRNYLLLACHASNETVQMYQLSRWARHQGYLQPKEDKSTST

SEQ ID NO: 6775 - protein, 108 aa, Fagopyrum esculentum
MASTFKAFLNSPVGPKTTHFWGPIANWGFVAAGLVDMNKPPEMISGNMTTAMCVYSALFMRFAWMVQPRNYLLLACHASNETVQLYQLSRWARAHGYLEEKKEEKKSE

SEQ ID NO: 6776 - protein, 107 aa, Flaveria ramosissima
MASFRAFLNSPVGPKTTHFWGPVANWGFVVAGLVDMQKPPEMISGNMTAAMCVYSGLFMRFAWMVQPRNYLLLACHASNETVQMYQLSRWAKHQGYLQPKEDKATST

SEQ ID NO: 6777 - protein, 107 aa, Mimulus guttatus
MASFRTFLNSPVGPKTTHFWGPVANWGFVIAGLVDMQKPPELISGNMTAAMCVYSALFMRFAWMVQPRNYLLLACHASNETVQLYQFSRWAKGQGYLTEKKDEASSQ

SEQ ID NO: 6778 - protein, 107 aa, Orobanche aegyptiaca
MASFKAFLNSPVGPKTTHFWGPVANWGFVIAGLVDMKKPPEMISGNMTAAMCVYSGLFMRFAWMVQPRNYLLLACHASNETVQLYQLSRWAKGQGYLGEQKDEALSQ

SEQ ID NO: 6779 - protein, 107 aa, Lippia dulcis
MASFKTFLNSPVGPKTTHFWGPVANWGFVIAGLVDMKKPPEMISGNMTGAMCVYSALFMRFAWMVQPRNYLLLACHASNETVQLYQLSRWAKGQGYLGEKKAEASPQ

SEQ ID NO: 6780 - protein, 107 aa, Primula obconica
MASFRAFLNSPVGPKTTHFWGPVANWGFVLAGLVDMKKPPEMISGNMSAAMCVYSALFMRFAWMVQPRNYLLLVCHASNETVQLYQFSRWARANGYLGQKKDEAVTE

SEQ ID NO: 6781 - protein, 107 aa, Senecio madagascariensis
MASFRAFLNSPVGPKTTHFWGPVANWGFVAAGLVDMQKPPEMISGNMTAAMCVYSALFMRFAWMVQPRNYLLLACHASNETVQMYQLSRWAKSQGYLEKKEDKAPST

SEQ ID NO: 6782 - protein, 148 aa, Fagus grandifolia
MASFRAFLNSPVGPKTTHFWGPVANWGFVAAGLADINKPPEMISGNMTAAMCVYSALFMRFAWMVQPRNYLLLACHVSNETVQLYQLSRWAKGQGYLSEKKANLHLSNLMLPFFFLPVLLSFVVVSAEIIRMSCWTHLKQFAFALMPV

SEQ ID NO: 6783 - protein, 115 aa, Chenopodium quinoa
MASTFRAFLNSPVGPKTTHFWGPVANWGFVVAGLVDMNKPPEMISGNMSAAMCVYSGLFMRFAWMVQPRNYLLLACHASNETVQLYQFSRWARAKWVLVNKRRRRYAIKVIYRIC

SEQ ID NO: 6784 - protein, 109 aa, Cleome gynandra
MASRFQAFLNSPVGPKTTHFWGPVANWGFVAAGLVDMNKPPEMISGNMTSAMCIYSALFMRFAWMVQPRNYLLLGCHASNEAVQLYQLSRWARVQGYLSSEKEEEKPSQ

SEQ ID NO: 6785 - protein, 108 aa, Euphorbia peplus
MASFRAFLNSPMGPKTTHFWGPVANWGFVAAGLVDMKKPPEMISGNMTGAMCIYSLLFMRFAWMVQPRNYLLLACHASNESVQLYQLSRWARAQGYLSSDKKEKASSE

SEQ ID NO: 6786 - protein, 105 aa, Heritiera littoralis
MASTFRAFLNSPVGPKTTHFWGPVANWGFVIAGLVDMKKPPEMISGNMTTAMCIYSALFMRFAWMVQPRNYLLLACRASNESVQLYQLSVGLEHRGICLERKRKP

SEQ ID NO: 6787 - protein, 61 aa, Carpinus betulus
MTAAMCVYSALFMRFAWMVQPRNYLLLACHVSNETVQLYQLSRWAKGQGYLSEKKKESEPQ

SEQ ID NO: 6788 - protein, 216 aa, Prunus persica
MGLFGGLELDSSPHRAFSLQSSLHHITPIKLGSSPITSGELELFPANLTHLWLKPCHLRSPISFLDFFVISDSSVVGVSFVPCASPSSSSPIKILRFVSIAIDSKRQLSNMAFRAFLNSPVGPKTTHFWGPVANWGFVAAGLADMNKPPEMISGNMTAAMCVYSALFMRFAWMVQPRNYLLLACHVSNETVQLYQLSRWARGQGYFTQKKDEPESQ

SEQ ID NO: 6789 - protein, 107 aa, Castanea mollissima
MASFRAFLNSPVGPKTTHFWGPVANWGFVAAGLADMNKPPELISGNMTGAMCIYSALFMRFAWMVQPRNYLLLACHVSNETVQLYQLSRWAKGQGYLSQKKEESTSQ

SEQ ID NO: 6790 - protein, 107 aa, Chrysanthemum coronarium
MATFRAFLNSPVGPKTTHFWGPIANWGFVAAGLVDMQKPPEMISGNMTGAMCVYSALFMRFAWMVQPRNYLLLACHASNETVQLYQLSRWAKSQGYLQQKEDKAPSA

SEQ ID NO: 6791 - protein, 107 aa, Cichorium intybus
MAAFRAFLNSPVGPKTTHFWGPVANWGFVAAGLVDMQKPPEMISGNMTAAMCVYSALFMRFSWMVQPRNYLLLACHASNETVQLYQLSRWAKSQGYLQQKEDKASST

SEQ ID NO: 6792 - protein, 107 aa, Vaccinium corymbosum
MASFRAFLNSPVGPKTTHFWGPVANWGFVLAGLVDMKKPPEMISGNMTGAMCIYSALFMRFAWMVQPRNYLLLACHASNETVQLYQFSRWAKANGYLGAKKEEAASE

SEQ ID NO: 6793 - protein, 107 aa, Flaveria ramosissima
MASFRAFLNSPVGPKTTHFWGPVANWGFVVAGLVDMQKPPEMISGNMTAAMCVYSGLFMRFAWMVQPRNYLLLACHASNETVQMYQLSRWAKHQGYLQPKEDKAAST

SEQ ID NO: 6794 - protein, 107 aa, Flaveria ramosissima
MASFRAFLNSPVGPKTTHFWGPVANWGFVVAGLVDMQKPPEMISGNMTAAMCVYSGLFMRFAWMVQPRNYLLLACHASNETVQMYQLSRWAKHQGYLQPKEDKAASN

SEQ ID NO: 6795 - protein, 107 aa, Gerbera hybrid cultivar
MASFRAFLNSPVGPKTSHFWGPVANWGFVIAGLVDMQKPPEMISGNMTGAMCVYSALFMRFAWMVQPRNYLLLACHASNETVQLYQFSRWAKSQGYLQQKEDKAPST

SEQ ID NO: 6796 - protein, 108 aa, Glycyrrhiza uralensis
MASSFRAFWNSPVGPKTSHFWGPVANWGFVAAGLADMNKPPEMISGNMTGAMCVYSALFMRFAWMVQPRNYLLLACHASNETVQLYQFSRWAKAEGFLSGKKEEASAQ

SEQ ID NO: 6797 - protein, 106 aa, Lupinus angustifolius
MASFRAFLNSPVGPKTTHFWGPVANWGFVAAGLADMQKPPEMISGNMTGAMCVYSALFMRFAWMVKPRNYLLLACHVSNEGVQLYQLSRWAKAQGYLSEKKEEASS

SEQ ID NO: 6798 - protein, 107 aa, Zea mays
MATALKSFLNSPVGPKTTHFWGPVANWGFVVAGLVDMNKPPEMISGNMTAAMCVYSGLFMRFAWMVQPRNYLLLACHASNESVQLYQLSRWARAQGYLEKKEPETQQ

SEQ ID NO: 6799 - protein, 107 aa, Quercus alba
MASFRAFLNSPVGPKTTHFWGPVANWGFVAAGLADINKPPEMISGNMTGAMCIYSALFMRFAWMVQPRNYLLLACHVSNETVQLYQLSRWAKGQGYLSQKKEESTSQ

SEQ ID NO: 6800 - protein, 107 aa, Parthenium argentatum
MASFRAFLNSPVGPKTTHFWGPVANWGFVVAGLVDMQKPPEMISGNMTAAMCVYSGLFMRFAWMVQPRNYLLLACHASNETVQMYQLSRWAKYQGYLQPKEDKTTST

SEQ ID NO: 6801 - protein, 107 aa, Prunus mume
MASFRAFLNSPVGPKTTHFWGPVANWGFVAAGLADMNKPPEMISGNMTAAMCVYSALFMRFAWMVQPRNYLLLACHVSNETVQLYQLSRWARGQGYFTQKKDEPASE

SEQ ID NO: 6802 - protein, 106 aa, Carthamus tinctorius
MASFRAFLNSPVGPKTSHFWGPVANWGFVVAGLVDMQKPPEMISGNMTGAMCVYSALFMRFAWMVQPRNYLLLACHASNETVQLYQFSRWAKSQGYLQKGDKAPST

SEQ ID NO: 6803 - protein, 107 aa, Saccharum officinarum
MATALKSFLNSPVGPKTTHFWGPVANWGFVIAGLVDMNKPPEMISGNMTAAMCVYSALFMRFAWMVQPRNYLLLACHASNESVQLYQLSRWARAQGYLEKKEAEAQQ

SEQ ID NO: 6804 - protein, 108 aa, Triphysaria pusilla
MASSFKAFLNSPVGPKTTHFWGPVANWGFVIAGLVDMQKPPEMISGNMTAAMCVYSALFMRFAWMVQPRNYLLLACHASNESVQLYQFSRWAKGQGYLGDKKEESTSQ

SEQ ID NO: 6805 - protein, 108 aa, Triphysaria pusilla
MASPFKAFLNSPVGPKTTHFWGPVANWGFVIAGLVDMQKPPEMISGNMTAAMCVYSALFMRFAWMVQPRNYLLLACHASNESVQLYQFSRWARGQGYLGDKKEEPTSQ

SEQ ID NO: 6806 - protein, 108 aa, Triphysaria pusilla
MASSFKAFLNSPVGPKTTHFWGPVANWGFVIAGLVDMQKPPEMISGNMTAAMCVYSALFMRFAWMVQPRNYLLLACHASNESVQLYQFSRWAKGQGYLGNKKEESTSQ

SEQ ID NO: 6807 - protein, 107 aa, Valeriana officinalis
MASFRAFLNSPVGPKTTHFWGPVANWGFVAAGLVDMQKPPELISGNMTGAMCVYSALFMRFAWMVQPRNYLLLACHASNETVQLYQLSRWARAHGFLEKKEEKAESK

SEQ ID NO: 6808 - protein, 107 aa, Vinca minor
MASFRAFLNSPVGPKTTHFWGPVANWGFVVAGLVDMQKPPEMISGNMTAAMCVYSGLFMRFAWMVQPRNYLLLACHASNETVQLYQLSRWAKSQGYLQQKEEKSTSE

SEQ ID NO: 6809 - protein, 113 aa, Humulus lupulus
MASFRAFLNSPVGPKTTHFWGPIANWGFVAAGLVDMQKPPEMISGNMTAAMCVYSALFMRFAWMVQPRNYLLLACHASNETVQLYQLSRWAKGQGYLSEKKEEKEEKDKAVSQ

SEQ ID NO: 6810 - protein, 110 aa, Arabidopsis lyrata
MATSRFQAFLNSPVGPKTTHFWGPIANWGFVAAGLVDMQKPPEMISGNMSSAMCVYSALFMRFAWMVQPRNYLLLACHASNETVQLYQLSRWARAQGYLSSKKEEEKPSQ

SEQ ID NO: 6811 - protein, 110 aa, Cleome spinosa
MASRFQAFLNSPVGPKTTHFWGPVANWGFVAAGLVDMNKPPEMISGNMTSAMCIYSALFMRFAWMVQPRNYLLLACHASNETVQLYQLSRWARSQGYLSSEKQQEEKPSE

SEQ ID NO: 6812 - protein, 108 aa, Citrus clementina
  Sequence also found in Organisms: Citrus sinensis
MASVRAFWNSPVGPKTTHFWGPVANWGFVVAGLVDLKKPPEMISGNMTTAMCIYSGLFMRFAWMVQPRNYLLLACHASNETVQLYHLSRWARSQGYLSEKKKDEASSQ

SEQ ID NO: 6813 - protein, 109 aa, Tropaeolum majus
MASSFKAFLNSPVGPKTTHFWGPIANWGFVAAGLADMNKPPEMISGKMTGVMCVYSALFMRFSWMVQPRNYLLLVCHASNETVQLYQLSRWARGQGYLSSEKKDEASPI

SEQ ID NO: 6814 - protein, 108 aa, Olea europaea
MASFKAFLNSPVGPKTTHFWGPVANWGFVIAGLVDMQKPPEMISGNMTAAMCIYSGLFMRFAWMVQPRNYLLLACHASNESVQLYQLSRWAKGQGYLGGEKKDEASSQ
